United States Patent 11,410,750 (METHYLATION MARKERS AND TARGETED METHYLATION PROBE PANEL) - sequence listing, part 5

SEQ ID NO: 63287 - DNA, 42 bp, Homo sapiens; identical to SEQ ID NO: 42820
  chr10:135012659-135012701
  hypo

SEQ ID NO: 63288 - DNA, 175 bp, Homo sapiens
  chr10:135014788-135014963
  hypo
cctctctctgtcacccggccccgtgcggcagttcagggtcccagcatctcccctgcactgggaggcggcagccgtgcccggggggcgcccgtggtgggcgggtgcaagagagaagggcgtcgggtgtgcaagcaccaccggcctcccattaacagcctgcccgggctccgcccac

SEQ ID NO: 63289 - DNA, 257 bp, Homo sapiens
  chr10:135015132-135015389
  hypo
gtaaaagccgagagagcgcagcagcctgaggctggcgaggacagacggccagctggcggggcctcagacgtggaggcagtgacccgactggccaggtccaaaggggtcggcccagccttgtcccccggcccagccggattccagagctgcagccccggctggtgcagcgccttctacgaggccgactgcttcggggccgacgtccacaactacgtgaaggacctggggcggcagcaggcggacggggccctgcccga

SEQ ID NO: 63290 - DNA, 297 bp, Homo sapiens
  chr10:135017129-135017426
  hypo
tgtggagctggcatccgcgtctcctgctgttaaaacaagcgtggctcccagagtcagcgtggacagcactggtgtgggttcctcccccgtctgtctgcaccggtgaagcctggcctcgtgtttccctcctcactgccccacatgtggtgtggattttagttaccgtggatttattaaaatcagtcaagaccgtcctcctcatggagtccgcctgtggttcccgcgtgaggagcgcccccgacggacatcgagtctgactgtgaacggaggccgtggaggtgccggccagagaggagt

SEQ ID NO: 63291 - DNA, 42 bp, Homo sapiens; identical to SEQ ID NO: 42823
  chr10:135018357-135018399
  hypo

SEQ ID NO: 63292 - DNA, 30 bp, Homo sapiens; identical to SEQ ID NO: 42824
  chr10:135018962-135018992
  hypo

SEQ ID NO: 63293 - DNA, 97 bp, Homo sapiens
  chr10:135020704-135020801
  hypo
ccgcaccctgcgacacgctggacttcagccccctggacgagtcctcctcgctcatcttctacaacgtcaacaagcacccgggcggccggcagaaggc

SEQ ID NO: 63294 - DNA, 30 bp, Homo sapiens; identical to SEQ ID NO: 15452
  chr10:135023111-135023141
  hypo

SEQ ID NO: 63295 - DNA, 36 bp, Homo sapiens; identical to SEQ ID NO: 24752
  chr10:135023434-135023470
  hypo

SEQ ID NO: 63296 - DNA, 98 bp, Homo sapiens
  chr10:135023500-135023598
  hypo
ccggtcccgaggcaccagctccctcagcttcccgagctaacgggtcctgcgagtggagacgtcacaaagccctgcatagggctgcgttcagaaaggcc

SEQ ID NO: 63297 - DNA, 26 bp, Homo sapiens
  chr10:135025729-135025755
  hypo
acgtgtgcaccctcacgcaatccaca

SEQ ID NO: 63298 - DNA, 30 bp, Homo sapiens; identical to SEQ ID NO: 15454
  chr10:135035009-135035039
  hypo

SEQ ID NO: 63299 - DNA, 30 bp, Homo sapiens; identical to SEQ ID NO: 42830
  chr10:135035302-135035332
  hypo

SEQ ID NO: 63300 - DNA, 42 bp, Homo sapiens; identical to SEQ ID NO: 42831
  chr10:135037546-135037588
  hypo

SEQ ID NO: 63301 - DNA, 100 bp, Homo sapiens; identical to SEQ ID NO: 42832
  chr10:135069848-135069948
  hypo

SEQ ID NO: 63302 - DNA, 144 bp, Homo sapiens; identical to SEQ ID NO: 42833
  chr10:135087501-135087645
  hypo

SEQ ID NO: 63303 - DNA, 34 bp, Homo sapiens; identical to SEQ ID NO: 42834
  chr10:135124157-135124191
  hypo

SEQ ID NO: 63304 - DNA, 27 bp, Homo sapiens
  chr10:135159617-135159644
  hypo
agggtgtgccagggacggctaaagaag

SEQ ID NO: 63305 - DNA, 30 bp, Homo sapiens; identical to SEQ ID NO: 42836
  chr10:135162912-135162942
  hypo

SEQ ID NO: 63306 - DNA, 18 bp, Homo sapiens
  chr10:135208606-135208624
  hypo
acccgtggaagggcccgg

SEQ ID NO: 63307 - DNA, 30 bp, Homo sapiens; identical to SEQ ID NO: 42838
  chr11:197439-197469
  hypo

SEQ ID NO: 63308 - DNA, 30 bp, Homo sapiens; identical to SEQ ID NO: 42839
  chr11:299379-299409
  hypo

SEQ ID NO: 63309 - DNA, 14 bp, Homo sapiens
  chr11:394801-394815
  hypo
ttggcacatggcag

SEQ ID NO: 63310 - DNA, 173 bp, Homo sapiens; identical to SEQ ID NO: 42841
  chr11:429466-429639
  hypo

SEQ ID NO: 63311 - DNA, 278 bp, Homo sapiens; identical to SEQ ID NO: 42842
  chr11:445925-446203
  hypo

SEQ ID NO: 63312 - DNA, 39 bp, Homo sapiens; identical to SEQ ID NO: 42843
  chr11:449334-449373
  hypo

SEQ ID NO: 63313 - DNA, 103 bp, Homo sapiens; identical to SEQ ID NO: 42844
  chr11:449589-449692
  hypo

SEQ ID NO: 63314 - DNA, 59 bp, Homo sapiens; identical to SEQ ID NO: 42845
  chr11:486036-486095
  hypo

SEQ ID NO: 63315 - DNA, 245 bp, Homo sapiens; identical to SEQ ID NO: 42846
  chr11:487303-487548
  hypo

SEQ ID NO: 63316 - DNA, 54 bp, Homo sapiens; identical to SEQ ID NO: 42847
  chr11:493145-493199
  hypo

SEQ ID NO: 63317 - DNA, 600 bp, Homo sapiens; identical to SEQ ID NO: 42848
  chr11:562246-562846
  hypo

SEQ ID NO: 63318 - DNA, 30 bp, Homo sapiens; identical to SEQ ID NO: 42849
  chr11:571791-571821
  hypo

SEQ ID NO: 63319 - DNA, 42 bp, Homo sapiens; identical to SEQ ID NO: 42850
  chr11:707906-707948
  hypo

SEQ ID NO: 63320 - DNA, 30 bp, Homo sapiens; identical to SEQ ID NO: 15461
  chr11:762939-762969
  hypo

SEQ ID NO: 63321 - DNA, 21 bp, Homo sapiens
  chr11:763302-763323
  hypo
cgccctcacctgccccgccct

SEQ ID NO: 63322 - DNA, 281 bp, Homo sapiens; identical to SEQ ID NO: 42854
  chr11:782269-782550
  hypo

SEQ ID NO: 63323 - DNA, 104 bp, Homo sapiens; identical to SEQ ID NO: 42855
  chr11:823903-824007
  hypo

SEQ ID NO: 63324 - DNA, 132 bp, Homo sapiens; identical to SEQ ID NO: 42856
  chr11:824852-824984
  hypo

SEQ ID NO: 63325 - DNA, 9 bp, Homo sapiens
  chr11:850546-850555
  hypo
gaaggtttg

SEQ ID NO: 63326 - DNA, 30 bp, Homo sapiens; identical to SEQ ID NO: 42858
  chr11:851077-851107
  hypo

SEQ ID NO: 63327 - DNA, 58 bp, Homo sapiens; identical to SEQ ID NO: 42859
  chr11:858498-858556
  hypo

SEQ ID NO: 63328 - DNA, 383 bp, Homo sapiens; identical to SEQ ID NO: 42860
  chr11:859019-859402
  hypo

SEQ ID NO: 63329 - DNA, 33 bp, Homo sapiens; identical to SEQ ID NO: 42861
  chr11:860888-860921
  hypo

SEQ ID NO: 63330 - DNA, 446 bp, Homo sapiens
  chr11:862616-863062
  hypo
tgtcctcttccttcccgtccctgtcggctgccaacttgctcatcatcaccggcgcctttgtcatggccatcggcttcgtgggctgcctgggtgccatcaaggagaacaagtgcctcctgctcactgtgagtgccggggcccaagcgatgctccgggtgggaccacgcagggtggggctccggtggcccccaggccttggctgccgcagtgaccccccagacgtgggcaccacctctggggccggacctccaggctggcagtgtggcccggggccctggccactgttgggtcttccaggccacactggggctggggggtgatttgcagagcggtgtgggggtcactcaagagaacgtgctgtaccttgtcaggggcctcccctgacgggacactggccctggtgagtgcaggcacagccccgcacacacgtacacacgcatgcgcag

SEQ ID NO: 63331 - DNA, 68 bp, Homo sapiens; identical to SEQ ID NO: 15467
  chr11:864749-864817
  hypo

SEQ ID NO: 63332 - DNA, 470 bp, Homo sapiens; identical to SEQ ID NO: 42864
  chr11:865657-866127
  hypo

SEQ ID NO: 63333 - DNA, 30 bp, Homo sapiens; identical to SEQ ID NO: 15469
  chr11:866956-866986
  hypo

SEQ ID NO: 63334 - DNA, 30 bp, Homo sapiens; identical to SEQ ID NO: 15470
  chr11:875487-875517
  hypo

SEQ ID NO: 63335 - DNA, 152 bp, Homo sapiens; identical to SEQ ID NO: 42867
  chr11:985308-985460
  hypo

SEQ ID NO: 63336 - DNA, 107 bp, Homo sapiens; identical to SEQ ID NO: 42868
  chr11:986906-987013
  hypo

SEQ ID NO: 63337 - DNA, 30 bp, Homo sapiens; identical to SEQ ID NO: 42869
  chr11:1008527-1008557
  hypo

SEQ ID NO: 63338 - DNA, 344 bp, Homo sapiens; identical to SEQ ID NO: 42870
  chr11:1024866-1025210
  hypo

SEQ ID NO: 63339 - DNA, 293 bp, Homo sapiens; identical to SEQ ID NO: 42871
  chr11:1025896-1026189
  hypo

SEQ ID NO: 63340 - DNA, 125 bp, Homo sapiens
  chr11:1027415-1027540
  hypo
cgctgtggtggcactcggtggcacggtccgacagcgacaggcaggtgcgctcacaggcttggctgttgtagctgaaggtggtgttacccgtgcaggggatggctgtgggggacccgggcatcaga

SEQ ID NO: 63341 - DNA, 61 bp, Homo sapiens; identical to SEQ ID NO: 42873
  chr11:1028309-1028370
  hypo

SEQ ID NO: 63342 - DNA, 60 bp, Homo sapiens
  chr11:1029178-1029238
  hypo
tggggtcaccgggagcgcccctccccacgggccacagggctcgtcctacctggaggagga

SEQ ID NO: 63343 - DNA, 18 bp, Homo sapiens
  chr11:1029403-1029421
  hypo
ggccgctggagccagaca

SEQ ID NO: 63344 - DNA, 50 bp, Homo sapiens
  chr11:1030165-1030215
  hypo
tctctctaggggtcccggggagagagagtgcctgcgactgccctcacctt

SEQ ID NO: 63345 - DNA, 12 bp, Homo sapiens
  chr11:1030296-1030308
  hypo
actcctggtaca

SEQ ID NO: 63346 - DNA, 33 bp, Homo sapiens; identical to SEQ ID NO: 42876
  chr11:1043870-1043903
  hypo

SEQ ID NO: 63347 - DNA, 151 bp, Homo sapiens; identical to SEQ ID NO: 42877
  chr11:1075796-1075947
  hypo

SEQ ID NO: 63348 - DNA, 155 bp, Homo sapiens; identical to SEQ ID NO: 42878
  chr11:1077593-1077748
  hypo

SEQ ID NO: 63349 - DNA, 16 bp, Homo sapiens
  chr11:1079536-1079552
  hypo
ccgggcaccgggagct

SEQ ID NO: 63350 - DNA, 30 bp, Homo sapiens; identical to SEQ ID NO: 42880
  chr11:1080245-1080275
  hypo

SEQ ID NO: 63351 - DNA, 41 bp, Homo sapiens; identical to SEQ ID NO: 42881
  chr11:1083467-1083508
  hypo

SEQ ID NO: 63352 - DNA, 30 bp, Homo sapiens; identical to SEQ ID NO: 42882
  chr11:1085664-1085694
  hypo

SEQ ID NO: 63353 - DNA, 198 bp, Homo sapiens; identical to SEQ ID NO: 42883
  chr11:1094942-1095140
  hypo

SEQ ID NO: 63354 - DNA, 30 bp, Homo sapiens; identical to SEQ ID NO: 42884
  chr11:1095639-1095669
  hypo

SEQ ID NO: 63355 - DNA, 199 bp, Homo sapiens; identical to SEQ ID NO: 42885
  chr11:1103985-1104184
  hypo

SEQ ID NO: 63356 - DNA, 62 bp, Homo sapiens; identical to SEQ ID NO: 42886
  chr11:1115115-1115177
  hypo

SEQ ID NO: 63357 - DNA, 73 bp, Homo sapiens; identical to SEQ ID NO: 42887
  chr11:1140450-1140523
  hypo

SEQ ID NO: 63358 - DNA, 30 bp, Homo sapiens; identical to SEQ ID NO: 15479
  chr11:1142462-1142492
  hypo

SEQ ID NO: 63359 - DNA, 30 bp, Homo sapiens; identical to SEQ ID NO: 42889
  chr11:1148164-1148194
  hypo

SEQ ID NO: 63360 - DNA, 54 bp, Homo sapiens; identical to SEQ ID NO: 42890
  chr11:1151771-1151825
  hypo

SEQ ID NO: 63361 - DNA, 30 bp, Homo sapiens; identical to SEQ ID NO: 42891
  chr11:1152610-1152640
  hypo

SEQ ID NO: 63362 - DNA, 30 bp, Homo sapiens; identical to SEQ ID NO: 42892
  chr11:1155200-1155230
  hypo

SEQ ID NO: 63363 - DNA, 123 bp, Homo sapiens; identical to SEQ ID NO: 42893
  chr11:1155629-1155752
  hypo

SEQ ID NO: 63364 - DNA, 50 bp, Homo sapiens
  chr11:1214917-1214967
  hypo
ccggggcagccactccccacccaggtggaaatgggcggggcagaggaggg

SEQ ID NO: 63365 - DNA, 30 bp, Homo sapiens; identical to SEQ ID NO: 42895
  chr11:1215395-1215425
  hypo

SEQ ID NO: 63366 - DNA, 83 bp, Homo sapiens
  chr11:1215816-1215899
  hypo
ccaggtcatgttctccggcctcatcttctccgtggaggtgcccttcagcaagtttgccaacaacaccgagggccagtgcggtg

SEQ ID NO: 63367 - DNA, 30 bp, Homo sapiens; identical to SEQ ID NO: 42898
  chr11:1241768-1241798
  hypo

SEQ ID NO: 63368 - DNA, 33 bp, Homo sapiens
  chr11:1244348-1244381
  hypo
ccaggatgggtgccccgagcgcgtgccggacgc

SEQ ID NO: 63369 - DNA, 66 bp, Homo sapiens; identical to SEQ ID NO: 24782
  chr11:1244465-1244531
  hypo

SEQ ID NO: 63370 - DNA, 67 bp, Homo sapiens; identical to SEQ ID NO: 15484
  chr11:1247815-1247882
  hypo

SEQ ID NO: 63371 - DNA, 24 bp, Homo sapiens
  chr11:1250865-1250889
  hypo
gaccttggtgtcccccgtgcatgg

SEQ ID NO: 63372 - DNA, 259 bp, Homo sapiens
  chr11:1250924-1251183
  hypo
gtgctggatgacatcacgcactctggctgcctgcccctcgggcagtgcccctgcacccacggcggccgcacctacagcccgggcacctccttcaacaccacctgcagctcctggtacttatgagcccaccagcctccgcctggggtggggtgtggagctcctggtatttatgaacccgccagcctctgcctggggtgggggtgtggagctcctggtgtgcacccaccagcctccgcctgcggtgggggtgtggagggtg

SEQ ID NO: 63373 - DNA, 178 bp, Homo sapiens; identical to SEQ ID NO: 42902
  chr11:1252902-1253080
  hypo

SEQ ID NO: 63374 - DNA, 30 bp, Homo sapiens; identical to SEQ ID NO: 42903
  chr11:1254339-1254369
  hypo

SEQ ID NO: 63375 - DNA, 321 bp, Homo sapiens; identical to SEQ ID NO: 42904
  chr11:1254973-1255294
  hypo

SEQ ID NO: 63376 - DNA, 48 bp, Homo sapiens; identical to SEQ ID NO: 42905
  chr11:1256469-1256517
  hypo

SEQ ID NO: 63377 - DNA, 141 bp, Homo sapiens; identical to SEQ ID NO: 42906
  chr11:1257678-1257819
  hypo

SEQ ID NO: 63378 - DNA, 178 bp, Homo sapiens; identical to SEQ ID NO: 42907
  chr11:1263199-1263377
  hypo

SEQ ID NO: 63379 - DNA, 57 bp, Homo sapiens
  chr11:1263644-1263701
  hypo
ggtgctgacctgcagcctggagacggggctgacctgcaagaacgaagaccagacagg

SEQ ID NO: 63380 - DNA, 30 bp, Homo sapiens; identical to SEQ ID NO: 42909
  chr11:1274002-1274032
  hypo

SEQ ID NO: 63381 - DNA, 35 bp, Homo sapiens; identical to SEQ ID NO: 42910
  chr11:1275653-1275688
  hypo

SEQ ID NO: 63382 - DNA, 445 bp, Homo sapiens; identical to SEQ ID NO: 42911
  chr11:1276293-1276738
  hypo

SEQ ID NO: 63383 - DNA, 20 bp, Homo sapiens
  chr11:1359706-1359726
  hypo
aatctcgggaccaggtggag

SEQ ID NO: 63384 - DNA, 40 bp, Homo sapiens; identical to SEQ ID NO: 42913
  chr11:1368324-1368364
  hypo

SEQ ID NO: 63385 - DNA, 183 bp, Homo sapiens; identical to SEQ ID NO: 42915
  chr11:1382225-1382408
  hypo

SEQ ID NO: 63386 - DNA, 120 bp, Homo sapiens; identical to SEQ ID NO: 42916
  chr11:1393300-1393420
  hypo

SEQ ID NO: 63387 - DNA, 30 bp, Homo sapiens; identical to SEQ ID NO: 42917
  chr11:1420766-1420796
  hypo

SEQ ID NO: 63388 - DNA, 30 bp, Homo sapiens; identical to SEQ ID NO: 42918
  chr11:1422084-1422114
  hypo

SEQ ID NO: 63389 - DNA, 328 bp, Homo sapiens
  chr11:1430794-1431122
  hypo
gtgcggtgtggttctgtttatgggtgttgtagagaaggcgccgtccagagacagagccactgctgaggtgggtggggggtgtatgaagggcacaaggacgctttgggggtgtcaggtatgatggccctcaggtcatggtttcacacgcgtgtgctttaaatgcgtgctggctgtcacgtgtcagtcgtgcctccacagagcttcaggaaccaccgagatggggagcctgccggagacacaggttttctgagcgcaccagcggctccaaaagcagagggaagagccctgcgtgcaggtggggcgctcatggcgtcggcctcgcagagcg

SEQ ID NO: 63390 - DNA, 42 bp, Homo sapiens; identical to SEQ ID NO: 42920
  chr11:1433065-1433107
  hypo

SEQ ID NO: 63391 - DNA, 30 bp, Homo sapiens; identical to SEQ ID NO: 42921
  chr11:1434266-1434296
  hypo

SEQ ID NO: 63392 - DNA, 128 bp, Homo sapiens; identical to SEQ ID NO: 42922
  chr11:1442699-1442827
  hypo

SEQ ID NO: 63393 - DNA, 373 bp, Homo sapiens; identical to SEQ ID NO: 42923
  chr11:1444579-1444952
  hypo

SEQ ID NO: 63394 - DNA, 61 bp, Homo sapiens; identical to SEQ ID NO: 42924
  chr11:1446330-1446391
  hypo

SEQ ID NO: 63395 - DNA, 30 bp, Homo sapiens; identical to SEQ ID NO: 42925
  chr11:1447472-1447502
  hypo

SEQ ID NO: 63396 - DNA, 35 bp, Homo sapiens; identical to SEQ ID NO: 42926
  chr11:1450725-1450760
  hypo

SEQ ID NO: 63397 - DNA, 66 bp, Homo sapiens; identical to SEQ ID NO: 42927
  chr11:1455198-1455264
  hypo

SEQ ID NO: 63398 - DNA, 30 bp, Homo sapiens; identical to SEQ ID NO: 42928
  chr11:1455520-1455550
  hypo

SEQ ID NO: 63399 - DNA, 65 bp, Homo sapiens; identical to SEQ ID NO: 42929
  chr11:1461955-1462020
  hypo

SEQ ID NO: 63400 - DNA, 30 bp, Homo sapiens; identical to SEQ ID NO: 42930
  chr11:1463761-1463791
  hypo

SEQ ID NO: 63401 - DNA, 76 bp, Homo sapiens; identical to SEQ ID NO: 24795
  chr11:1464204-1464280
  hypo

SEQ ID NO: 63402 - DNA, 543 bp, Homo sapiens
  chr11:1464428-1464971
  hypo
ggtgggaccccagcctgccgcacccccaggtgctgctaggctgcctgtccccgggccgactccctctgagcccaggccctccaaggcccccgccctgccctgcgccccccaacagcccgggcactgctgtccacagggggagaagtatgacggccggaaggcggacgtgtggagctgcggcgtcatcctgttcgccttgctggtggtgagaccctggccccctcaaccctgccctggcctctccccaaacctgcccccccacgctgacccccacacccggccgcccgcagggggctctgcccttcgacgatgacaacttgcgacagctgctggagaaggtgaagcggggcgtgttccacatgccgcactttatcccgcccgactgccagagtctgctacggggcatgatcgaggtggacgccgcacgccgcctcacggtgcgtgccctcggagcggggcggccccagagcgtggcgggggggcgcgggggcgggcgtgtgcctgtgtgtgcacaggtgtgtgcccagacgtgtgggcacccag

SEQ ID NO: 63403 - DNA, 292 bp, Homo sapiens; identical to SEQ ID NO: 42932
  chr11:1466910-1467202
  hypo

SEQ ID NO: 63404 - DNA, 105 bp, Homo sapiens
  chr11:1469123-1469228
  hypo
tcccagccccagacacgctgtcctgcctcaggccgggcaggcacatgggcgggtctggtggcgggctgggctgcagggctcctgctgcggtgaagccagccagca

SEQ ID NO: 63405 - DNA, 254 bp, Homo sapiens
  chr11:1469379-1469633
  hypo
gccagcccctgtgctgtgtccggtgggcctcggtggccctgctgcccctggggccggccagagttgaagccgagcagccgtcctgtgcccacctgcaggagctgaggagggcaggaggcgccgccgtcaagaggggcctctacctggggccagttttgcgagcctgggcgggtggcgccgcccccaaggctgcagtgtgctggctgccggtcggggtccttctctttgagccctggccccgtgcctacctggga

SEQ ID NO: 63406 - DNA, 47 bp, Homo sapiens; identical to SEQ ID NO: 42934
  chr11:1471413-1471460
  hypo

SEQ ID NO: 63407 - DNA, 55 bp, Homo sapiens
  chr11:1471865-1471920
  hypo
ggacacctgtccacacgccaaaggagagcccggctggcacgcccaaccccacgcc

SEQ ID NO: 63408 - DNA, 127 bp, Homo sapiens; identical to SEQ ID NO: 42936
  chr11:1473513-1473640
  hypo

SEQ ID NO: 63409 - DNA, 140 bp, Homo sapiens; identical to SEQ ID NO: 42937
  chr11:1477763-1477903
  hypo

SEQ ID NO: 63410 - DNA, 168 bp, Homo sapiens; identical to SEQ ID NO: 42938
  chr11:1478164-1478332
  hypo

SEQ ID NO: 63411 - DNA, 399 bp, Homo sapiens; identical to SEQ ID NO: 42939
  chr11:1483506-1483905
  hypo

SEQ ID NO: 63412 - DNA, 30 bp, Homo sapiens; identical to SEQ ID NO: 42940
  chr11:1517598-1517628
  hypo

SEQ ID NO: 63413 - DNA, 47 bp, Homo sapiens; identical to SEQ ID NO: 42941
  chr11:1553685-1553732
  hypo

SEQ ID NO: 63414 - DNA, 35 bp, Homo sapiens; identical to SEQ ID NO: 42942
  chr11:1560806-1560841
  hypo

SEQ ID NO: 63415 - DNA, 176 bp, Homo sapiens; identical to SEQ ID NO: 42943
  chr11:1669565-1669741
  hypo

SEQ ID NO: 63416 - DNA, 84 bp, Homo sapiens; identical to SEQ ID NO: 42944
  chr11:1760346-1760430
  hypo

SEQ ID NO: 63417 - DNA, 30 bp, Homo sapiens; identical to SEQ ID NO: 42945
  chr11:1790238-1790268
  hypo

SEQ ID NO: 63418 - DNA, 91 bp, Homo sapiens; identical to SEQ ID NO: 42946
  chr11:1795195-1795286
  hypo

SEQ ID NO: 63419 - DNA, 30 bp, Homo sapiens; identical to SEQ ID NO: 42947
  chr11:1801108-1801138
  hypo

SEQ ID NO: 63420 - DNA, 45 bp, Homo sapiens; identical to SEQ ID NO: 42948
  chr11:1825207-1825252
  hypo

SEQ ID NO: 63421 - DNA, 57 bp, Homo sapiens; identical to SEQ ID NO: 42949
  chr11:1856532-1856589
  hypo

SEQ ID NO: 63422 - DNA, 102 bp, Homo sapiens; identical to SEQ ID NO: 42950
  chr11:1857426-1857528
  hypo

SEQ ID NO: 63423 - DNA, 30 bp, Homo sapiens; identical to SEQ ID NO: 42951
  chr11:1857873-1857903
  hypo

SEQ ID NO: 63424 - DNA, 30 bp, Homo sapiens; identical to SEQ ID NO: 42952
  chr11:1863098-1863128
  hypo

SEQ ID NO: 63425 - DNA, 30 bp, Homo sapiens; identical to SEQ ID NO: 42953
  chr11:1867693-1867723
  hypo

SEQ ID NO: 63426 - DNA, 28 bp, Homo sapiens
  chr11:1868053-1868081
  hypo
catttgttcactgtccgtctcttcctct

SEQ ID NO: 63427 - DNA, 73 bp, Homo sapiens
  chr11:1868237-1868310
  hypo
gtacactggagtcctctggcagccagtgttccccgttgtgcggggctggccgtgaccacgctggaaacccccc

SEQ ID NO: 63428 - DNA, 58 bp, Homo sapiens; identical to SEQ ID NO: 42955
  chr11:1935022-1935080
  hypo

SEQ ID NO: 63429 - DNA, 30 bp, Homo sapiens; identical to SEQ ID NO: 42956
  chr11:1949952-1949982
  hypo

SEQ ID NO: 63430 - DNA, 83 bp, Homo sapiens; identical to SEQ ID NO: 42957
  chr11:1955308-1955391
  hypo

SEQ ID NO: 63431 - DNA, 19 bp, Homo sapiens
  chr11:1957372-1957391
  hypo
aagctagcccacagccggg

SEQ ID NO: 63432 - DNA, 482 bp, Homo sapiens; identical to SEQ ID NO: 42959
  chr11:1957864-1958346
  hypo

SEQ ID NO: 63433 - DNA, 192 bp, Homo sapiens
  chr11:1958885-1959077
  hypo
ggctacttggagtttcgatgttttctgggattcttctccctcctcctgtcgccttggcttccctgcggcgcccagggcgggctcctccgtggtgcacgtgacctcacggcctccctgttgtgccgtcaggggtcattgcagacccctctgagggtgggcagtcggcgtggtgtgcatgtgcctgcgtgtgtg

SEQ ID NO: 63434 - DNA, 52 bp, Homo sapiens
  chr11:1959187-1959239
  hypo
aagcactcctgtcctccacccgccttcacccctcacccgcacccagctcctc

SEQ ID NO: 63435 - DNA, 88 bp, Homo sapiens; identical to SEQ ID NO: 42961
  chr11:1959951-1960039
  hypo

SEQ ID NO: 63436 - DNA, 30 bp, Homo sapiens; identical to SEQ ID NO: 42962
  chr11:1976039-1976069
  hypo

SEQ ID NO: 63437 - DNA, 335 bp, Homo sapiens; identical to SEQ ID NO: 42963
  chr11:1981002-1981337
  hypo

SEQ ID NO: 63438 - DNA, 133 bp, Homo sapiens; identical to SEQ ID NO: 42964
  chr11:2036968-2037101
  hypo

SEQ ID NO: 63439 - DNA, 78 bp, Homo sapiens
  chr11:2040029-2040107
  hypo
cctccagaggggccccgccacagtccatccccttcgcccaggtcccctcggatcagggcctgccagggtggtgtggca

SEQ ID NO: 63440 - DNA, 41 bp, Homo sapiens
  chr11:2040148-2040189
  hypo
ggtgcagccaggctctggcccccacacgcttgggctttgct

SEQ ID NO: 63441 - DNA, 220 bp, Homo sapiens; identical to SEQ ID NO: 42966
  chr11:2042281-2042501
  hypo

SEQ ID NO: 63442 - DNA, 71 bp, Homo sapiens; identical to SEQ ID NO: 42967
  chr11:2048987-2049058
  hypo

SEQ ID NO: 63443 - DNA, 30 bp, Homo sapiens; identical to SEQ ID NO: 42968
  chr11:2108079-2108109
  hypo

SEQ ID NO: 63444 - DNA, 30 bp, Homo sapiens; identical to SEQ ID NO: 42969
  chr11:2110642-2110672
  hypo

SEQ ID NO: 63445 - DNA, 30 bp, Homo sapiens; identical to SEQ ID NO: 42970
  chr11:2133297-2133327
  hypo

SEQ ID NO: 63446 - DNA, 94 bp, Homo sapiens; identical to SEQ ID NO: 42971
  chr11:2151140-2151234
  hypo

SEQ ID NO: 63447 - DNA, 30 bp, Homo sapiens; identical to SEQ ID NO: 42972
  chr11:2152412-2152442
  hypo

SEQ ID NO: 63448 - DNA, 39 bp, Homo sapiens; identical to SEQ ID NO: 42973
  chr11:2156080-2156119
  hypo

SEQ ID NO: 63449 - DNA, 31 bp, Homo sapiens
  chr11:2209876-2209907
  hypo
tcggggagtagtacccggaacccacagagaa

SEQ ID NO: 63450 - DNA, 42 bp, Homo sapiens
  chr11:2210278-2210320
  hypo
gaaatgaaacctatgtccacccaggaacgtgtgtgtgactgc

SEQ ID NO: 63451 - DNA, 128 bp, Homo sapiens; identical to SEQ ID NO: 42975
  chr11:2224689-2224817
  hypo

SEQ ID NO: 63452 - DNA, 339 bp, Homo sapiens
  chr11:2278369-2278708
  hypo
ggaatccagccccagcgggcgggcggcagcagcagtgccggccctgcccagaacaggttcgacctgagccggcactgcccggctgccctggggctagggaggctgagacagagaagggaagccagagggtgggggtgggggcccggcactggcagagctgcctgccctcaacgaccgcccctgccggagacccccgccccacccgctgtggttctgctggcccaggtttcgctgggcccactcccagggtttggcatcactggagcccagggtcccccccgcaccctccccacagccttggccctgctgctgcctgcctcctccagggtaccccgaggc

SEQ ID NO: 63453 - DNA, 76 bp, Homo sapiens; identical to SEQ ID NO: 42978
  chr11:2289224-2289300
  hypo

SEQ ID NO: 63454 - DNA, 35 bp, Homo sapiens; identical to SEQ ID NO: 42979
  chr11:2428079-2428114
  hypo

SEQ ID NO: 63455 - DNA, 30 bp, Homo sapiens; identical to SEQ ID NO: 42980
  chr11:2435384-2435414
  hypo

SEQ ID NO: 63456 - DNA, 42 bp, Homo sapiens; identical to SEQ ID NO: 42981
  chr11:2436543-2436585
  hypo

SEQ ID NO: 63457 - DNA, 54 bp, Homo sapiens
  chr11:2438144-2438198
  hypo
atgaagcatggaatggcatacgcttcaacacggaggaaccgtcaaaccctcccg

SEQ ID NO: 63458 - DNA, 44 bp, Homo sapiens; identical to SEQ ID NO: 42983
  chr11:2491365-2491409
  hypo

SEQ ID NO: 63459 - DNA, 135 bp, Homo sapiens; identical to SEQ ID NO: 42984
  chr11:2541224-2541359
  hypo

SEQ ID NO: 63460 - DNA, 167 bp, Homo sapiens; identical to SEQ ID NO: 42985
  chr11:2543288-2543455
  hypo

SEQ ID NO: 63461 - DNA, 207 bp, Homo sapiens; identical to SEQ ID NO: 42986
  chr11:2596517-2596724
  hypo

SEQ ID NO: 63462 - DNA, 213 bp, Homo sapiens; identical to SEQ ID NO: 42987
  chr11:2753802-2754015
  hypo

SEQ ID NO: 63463 - DNA, 30 bp, Homo sapiens; identical to SEQ ID NO: 42988
  chr11:2770653-2770683
  hypo

SEQ ID NO: 63464 - DNA, 178 bp, Homo sapiens; identical to SEQ ID NO: 42989
  chr11:2818207-2818385
  hypo

SEQ ID NO: 63465 - DNA, 30 bp, Homo sapiens; identical to SEQ ID NO: 15520
  chr11:2829204-2829234
  hypo

SEQ ID NO: 63466 - DNA, 30 bp, Homo sapiens; identical to SEQ ID NO: 42991
  chr11:2933495-2933525
  hypo

SEQ ID NO: 63467 - DNA, 30 bp, Homo sapiens; identical to SEQ ID NO: 42992
  chr11:3150813-3150843
  hypo

SEQ ID NO: 63468 - DNA, 381 bp, Homo sapiens; identical to SEQ ID NO: 42993
  chr11:3164562-3164943
  hypo

SEQ ID NO: 63469 - DNA, 52 bp, Homo sapiens
  chr11:3169835-3169887
  hypo
tgtacatctttgacattttctatcatacgaagccaaacgggagaggacacag

SEQ ID NO: 63470 - DNA, 48 bp, Homo sapiens; identical to SEQ ID NO: 42995
  chr11:3187905-3187953
  hypo

SEQ ID NO: 63471 - DNA, 162 bp, Homo sapiens; identical to SEQ ID NO: 42996
  chr11:3249641-3249803
  hypo

SEQ ID NO: 63472 - DNA, 30 bp, Homo sapiens; identical to SEQ ID NO: 42997
  chr11:3398724-3398754
  hypo

SEQ ID NO: 63473 - DNA, 93 bp, Homo sapiens; identical to SEQ ID NO: 42998
  chr11:3697398-3697491
  hypo

SEQ ID NO: 63474 - DNA, 30 bp, Homo sapiens; identical to SEQ ID NO: 42999
  chr11:3766731-3766761
  hypo

SEQ ID NO: 63475 - DNA, 159 bp, Homo sapiens; identical to SEQ ID NO: 43000
  chr11:3828803-3828962
  hypo

SEQ ID NO: 63476 - DNA, 21 bp, Homo sapiens
  chr11:4785810-4785831
  hypo
gaatactgggcagggcgcagt

SEQ ID NO: 63477 - DNA, 26 bp, Homo sapiens
  chr11:5169023-5169049
  hypo
tttttttttttttttcggagacagag

SEQ ID NO: 63478 - DNA, 27 bp, Homo sapiens
  chr11:5177841-5177868
  hypo
agccactgcacccggcctactgaatat

SEQ ID NO: 63479 - DNA, 159 bp, Homo sapiens; identical to SEQ ID NO: 15524
  chr11:5192016-5192175
  hypo

SEQ ID NO: 63480 - DNA, 30 bp, Homo sapiens; identical to SEQ ID NO: 43005
  chr11:5192457-5192487
  hypo

SEQ ID NO: 63481 - DNA, 83 bp, Homo sapiens; identical to SEQ ID NO: 43006
  chr11:5330681-5330764
  hypo

SEQ ID NO: 63482 - DNA, 104 bp, Homo sapiens; identical to SEQ ID NO: 43007
  chr11:6257172-6257276
  hypo

SEQ ID NO: 63483 - DNA, 82 bp, Homo sapiens; identical to SEQ ID NO: 43008
  chr11:6497227-6497309
  hypo

SEQ ID NO: 63484 - DNA, 30 bp, Homo sapiens; identical to SEQ ID NO: 15526
  chr11:6731043-6731073
  hypo

SEQ ID NO: 63485 - DNA, 30 bp, Homo sapiens; identical to SEQ ID NO: 43010
  chr11:7439190-7439220
  hypo

SEQ ID NO: 63486 - DNA, 37 bp, Homo sapiens; identical to SEQ ID NO: 43012
  chr11:9405789-9405826
  hypo

SEQ ID NO: 63487 - DNA, 30 bp, Homo sapiens; identical to SEQ ID NO: 43013
  chr11:9830639-9830669
  hypo

SEQ ID NO: 63488 - DNA, 30 bp, Homo sapiens; identical to SEQ ID NO: 43014
  chr11:10509593-10509623
  hypo

SEQ ID NO: 63489 - DNA, 100 bp, Homo sapiens; identical to SEQ ID NO: 43016
  chr11:10865202-10865302
  hypo

SEQ ID NO: 63490 - DNA, 30 bp, Homo sapiens; identical to SEQ ID NO: 43017
  chr11:12288561-12288591
  hypo

SEQ ID NO: 63491 - DNA, 18 bp, Homo sapiens
  chr11:13691880-13691898
  hypo
gctggagtgcagtgacgc

SEQ ID NO: 63492 - DNA, 23 bp, Homo sapiens
  chr11:14558164-14558187
  hypo
tttttatttttgagacggagtct

SEQ ID NO: 63493 - DNA, 42 bp, Homo sapiens; identical to SEQ ID NO: 43020
  chr11:14564357-14564399
  hypo

SEQ ID NO: 63494 - DNA, 84 bp, Homo sapiens; identical to SEQ ID NO: 43021
  chr11:15084438-15084522
  hypo

SEQ ID NO: 63495 - DNA, 23 bp, Homo sapiens
  chr11:16255262-16255285
  hypo
aacataaaacaggcccggtgcgg

SEQ ID NO: 63496 - DNA, 108 bp, Homo sapiens; identical to SEQ ID NO: 43023
  chr11:16988399-16988507
  hypo

SEQ ID NO: 63497 - DNA, 16 bp, Homo sapiens
  chr11:17037317-17037333
  hypo
ccgagatcgcgccgct

SEQ ID NO: 63498 - DNA, 154 bp, Homo sapiens; identical to SEQ ID NO: 43025
  chr11:17100671-17100825
  hypo

SEQ ID NO: 63499 - DNA, 33 bp, Homo sapiens; identical to SEQ ID NO: 43026
  chr11:17566248-17566281
  hypo

SEQ ID NO: 63500 - DNA, 97 bp, Homo sapiens; identical to SEQ ID NO: 43027
  chr11:17633812-17633909
  hypo

SEQ ID NO: 63501 - DNA, 44 bp, Homo sapiens; identical to SEQ ID NO: 43028
  chr11:17784927-17784971
  hypo

SEQ ID NO: 63502 - DNA, 43 bp, Homo sapiens; identical to SEQ ID NO: 43029
  chr11:18656839-18656882
  hypo

SEQ ID NO: 63503 - DNA, 30 bp, Homo sapiens; identical to SEQ ID NO: 43030
  chr11:18950570-18950600
  hypo

SEQ ID NO: 63504 - DNA, 179 bp, Homo sapiens; identical to SEQ ID NO: 43031
  chr11:19567961-19568140
  hypo

SEQ ID NO: 63505 - DNA, 30 bp, Homo sapiens; identical to SEQ ID NO: 43032
  chr11:23326534-23326564
  hypo

SEQ ID NO: 63506 - DNA, 138 bp, Homo sapiens; identical to SEQ ID NO: 43033
  chr11:27495243-27495381
  hypo

SEQ ID NO: 63507 - DNA, 210 bp, Homo sapiens; identical to SEQ ID NO: 43034
  chr11:32728943-32729153
  hypo

SEQ ID NO: 63508 - DNA, 17 bp, Homo sapiens
  chr11:32859995-32860012
  hypo
tccggaaaaaaaaaaaa

SEQ ID NO: 63509 - DNA, 37 bp, Homo sapiens; identical to SEQ ID NO: 43036
  chr11:32935022-32935059
  hypo

SEQ ID NO: 63510 - DNA, 104 bp, Homo sapiens; identical to SEQ ID NO: 43037
  chr11:33181185-33181289
  hypo

SEQ ID NO: 63511 - DNA, 29 bp, Homo sapiens
  chr11:33202774-33202803
  hypo
acacctgtaattagccgggtgtggtggtg

SEQ ID NO: 63512 - DNA, 15 bp, Homo sapiens
  chr11:33262877-33262892
  hypo
cgcaaagaaattaat

SEQ ID NO: 63513 - DNA, 224 bp, Homo sapiens; identical to SEQ ID NO: 43040
  chr11:33269863-33270087
  hypo

SEQ ID NO: 63514 - DNA, 37 bp, Homo sapiens; identical to SEQ ID NO: 43041
  chr11:33277673-33277710
  hypo

SEQ ID NO: 63515 - DNA, 32 bp, Homo sapiens; identical to SEQ ID NO: 43042
  chr11:33874352-33874384
  hypo

SEQ ID NO: 63516 - DNA, 33 bp, Homo sapiens; identical to SEQ ID NO: 43043
  chr11:33880993-33881026
  hypo

SEQ ID NO: 63517 - DNA, 23 bp, Homo sapiens
  chr11:33951225-33951248
  hypo
gggcacggtggctcacgcctgta

SEQ ID NO: 63518 - DNA, 30 bp, Homo sapiens; identical to SEQ ID NO: 43045
  chr11:33976661-33976691
  hypo

SEQ ID NO: 63519 - DNA, 30 bp, Homo sapiens; identical to SEQ ID NO: 43046
  chr11:33993944-33993974
  hypo

SEQ ID NO: 63520 - DNA, 30 bp, Homo sapiens; identical to SEQ ID NO: 43047
  chr11:34517691-34517721
  hypo

SEQ ID NO: 63521 - DNA, 30 bp, Homo sapiens; identical to SEQ ID NO: 15538
  chr11:34534277-34534307
  hypo

SEQ ID NO: 63522 - DNA, 40 bp, Homo sapiens
  chr11:34535053-34535093
  hypo
gcaagccgtcacatccgtgtcaaacagctcccggaggccc

SEQ ID NO: 63523 - DNA, 125 bp, Homo sapiens
  chr11:34535123-34535248
  hypo
tggagctggagatggacgagcagacccaggccccaggccgagcctctgagccctgacaccccttacgattcatccaaaaaagcaaagaaaaggcgcttacgtgagggcagcggtggctaggtcca

SEQ ID NO: 63524 - DNA, 30 bp, Homo sapiens; identical to SEQ ID NO: 43050
  chr11:34536053-34536083
  hypo

SEQ ID NO: 63525 - DNA, 20 bp, Homo sapiens
  chr11:34577250-34577270
  hypo
aactcaaatctgaagcgtcc

SEQ ID NO: 63526 - DNA, 166 bp, Homo sapiens; identical to SEQ ID NO: 43052
  chr11:35134173-35134339
  hypo

SEQ ID NO: 63527 - DNA, 36 bp, Homo sapiens
  chr11:35684922-35684958
  hypo
gagggagatagaaagcgaggcaggggaagagagtga

SEQ ID NO: 63528 - DNA, 81 bp, Homo sapiens
  chr11:35685131-35685212
  hypo
aggcagaaagtgaatttgacccagaaatagaaatggaagcagagagagtggccaagaggaagtgtccggaccatgggcttg

SEQ ID NO: 63529 - DNA, 98 bp, Homo sapiens; identical to SEQ ID NO: 43054
  chr11:36687119-36687217
  hypo

SEQ ID NO: 63530 - DNA, 36 bp, Homo sapiens; identical to SEQ ID NO: 43055
  chr11:43544024-43544060
  hypo

SEQ ID NO: 63531 - DNA, 83 bp, Homo sapiens; identical to SEQ ID NO: 15542
  chr11:44922891-44922974
  hypo

SEQ ID NO: 63532 - DNA, 33 bp, Homo sapiens; identical to SEQ ID NO: 43057
  chr11:46298483-46298516
  hypo

SEQ ID NO: 63533 - DNA, 30 bp, Homo sapiens; identical to SEQ ID NO: 43058
  chr11:46405775-46405805
  hypo

SEQ ID NO: 63534 - DNA, 17 bp, Homo sapiens
  chr11:46614283-46614300
  hypo
ggcgacagagctagcct

SEQ ID NO: 63535 - DNA, 30 bp, Homo sapiens; identical to SEQ ID NO: 43060
  chr11:46774904-46774934
  hypo

SEQ ID NO: 63536 - DNA, 19 bp, Homo sapiens
  chr11:46777041-46777060
  hypo
ccaccgcacctggccccat

SEQ ID NO: 63537 - DNA, 30 bp, Homo sapiens; identical to SEQ ID NO: 43062
  chr11:46916192-46916222
  hypo

SEQ ID NO: 63538 - DNA, 65 bp, Homo sapiens; identical to SEQ ID NO: 43064
  chr11:47367760-47367825
  hypo

SEQ ID NO: 63539 - DNA, 56 bp, Homo sapiens; identical to SEQ ID NO: 43065
  chr11:47599259-47599315
  hypo

SEQ ID NO: 63540 - DNA, 35 bp, Homo sapiens; identical to SEQ ID NO: 43066
  chr11:49212608-49212643
  hypo

SEQ ID NO: 63541 - DNA, 30 bp, Homo sapiens; identical to SEQ ID NO: 43067
  chr11:50205839-50205869
  hypo

SEQ ID NO: 63542 - DNA, 156 bp, Homo sapiens; identical to SEQ ID NO: 43068
  chr11:50256725-50256881
  hypo

SEQ ID NO: 63543 - DNA, 35 bp, Homo sapiens; identical to SEQ ID NO: 43069
  chr11:55743005-55743040
  hypo

SEQ ID NO: 63544 - DNA, 30 bp, Homo sapiens; identical to SEQ ID NO: 15545
  chr11:57150498-57150528
  hypo

SEQ ID NO: 63545 - DNA, 151 bp, Homo sapiens
  chr11:57235255-57235406
  hypo
acaacctcatccgcacgctgcggccaggcacctttgggtccaacctgctcaccctgtggctcttctccaacaacctctccaccatctacccgggcactttccgccacttgcaagccctggaggagctggacctcggtgacaaccggcacct

SEQ ID NO: 63546 - DNA, 22 bp, Homo sapiens
  chr11:57235436-57235458
  hypo
cctggagcggctgcagtcgctg

SEQ ID NO: 63547 - DNA, 30 bp, Homo sapiens; identical to SEQ ID NO: 43072
  chr11:57311435-57311465
  hypo

SEQ ID NO: 63548 - DNA, 37 bp, Homo sapiens; identical to SEQ ID NO: 43073
  chr11:57423900-57423937
  hypo

SEQ ID NO: 63549 - DNA, 41 bp, Homo sapiens; identical to SEQ ID NO: 43076
  chr11:57548681-57548722
  hypo

SEQ ID NO: 63550 - DNA, 16 bp, Homo sapiens
  chr11:58821650-58821666
  hypo
gcgtggcctcctattc

SEQ ID NO: 63551 - DNA, 139 bp, Homo sapiens; identical to SEQ ID NO: 43078
  chr11:58835182-58835321
  hypo

SEQ ID NO: 63552 - DNA, 30 bp, Homo sapiens; identical to SEQ ID NO: 15547
  chr11:59312651-59312681
  hypo

SEQ ID NO: 63553 - DNA, 19 bp, Homo sapiens
  chr11:59328895-59328914
  hypo
accttaaaggctgggcgcg

SEQ ID NO: 63554 - DNA, 112 bp, Homo sapiens
  chr11:59329240-59329352
  hypo
agcaaattgtgggaaagcaaatatatgggaaattaatgttagataaaggcaggttcctaaagcttgttaaatgtacttctgtggtcccctctgttcacgtctccaagctgtt

SEQ ID NO: 63555 - DNA, 30 bp, Homo sapiens; identical to SEQ ID NO: 15548
  chr11:59609810-59609840
  hypo

SEQ ID NO: 63556 - DNA, 170 bp, Homo sapiens; identical to SEQ ID NO: 43083
  chr11:59807961-59808131
  hypo

SEQ ID NO: 63557 - DNA, 7 bp, Homo sapiens
  chr11:59841396-59841403
  hypo
ggaaaga

SEQ ID NO: 63558 - DNA, 30 bp, Homo sapiens; identical to SEQ ID NO: 43085
  chr11:60282848-60282878
  hypo

SEQ ID NO: 63559 - DNA, 33 bp, Homo sapiens; identical to SEQ ID NO: 43086
  chr11:60409097-60409130
  hypo

SEQ ID NO: 63560 - DNA, 30 bp, Homo sapiens; identical to SEQ ID NO: 43087
  chr11:60892552-60892582
  hypo

SEQ ID NO: 63561 - DNA, 47 bp, Homo sapiens; identical to SEQ ID NO: 43088
  chr11:60897862-60897909
  hypo

SEQ ID NO: 63562 - DNA, 171 bp, Homo sapiens; identical to SEQ ID NO: 5117
  chr11:60941596-60941767
  hypo

SEQ ID NO: 63563 - DNA, 335 bp, Homo sapiens; identical to SEQ ID NO: 43090
  chr11:61038940-61039275
  hypo

SEQ ID NO: 63564 - DNA, 124 bp, Homo sapiens; identical to SEQ ID NO: 43091
  chr11:61049497-61049621
  hypo

SEQ ID NO: 63565 - DNA, 71 bp, Homo sapiens
  chr11:61058212-61058283
  hypo
aggagatataattcccgctgtccccctccccctcccccaccactcccaggcgtctcacctgtacacctgat

SEQ ID NO: 63566 - DNA, 89 bp, Homo sapiens; identical to SEQ ID NO: 43093
  chr11:61058795-61058884
  hypo

SEQ ID NO: 63567 - DNA, 30 bp, Homo sapiens; identical to SEQ ID NO: 43094
  chr11:61633635-61633665
  hypo

SEQ ID NO: 63568 - DNA, 81 bp, Homo sapiens; identical to SEQ ID NO: 43095
  chr11:61641410-61641491
  hypo

SEQ ID NO: 63569 - DNA, 143 bp, Homo sapiens
  chr11:61664512-61664655
  hypo
gcaggccaccagccacggggagagggaggcctggctcatcccccagtaacccacagccctctgaatactaagggaggactcaaatagtcctccccacagcaagtaagtggtgatggcggaggtggggtggcttcaggatttgg

SEQ ID NO: 63570 - DNA, 196 bp, Homo sapiens
  chr11:61664770-61664966
  hypo
tgtaccaacaaagcctgcctttattaaatagagatcgcgttacattccatccaaagaaggaaatccggacgtggtgagggatgcgtccaggtgggagctccgaacgctggtcctgagtgggctctgatgggtgggagggcccaggtcctgcctgcccacccaggccccacatgccagggcgcgtgtctgcatggcc

SEQ ID NO: 63571 - DNA, 59 bp, Homo sapiens; identical to SEQ ID NO: 43097
  chr11:61665728-61665787
  hypo

SEQ ID NO: 63572 - DNA, 18 bp, Homo sapiens
  chr11:61666088-61666106
  hypo
agacaagcaggtacacgc

SEQ ID NO: 63573 - DNA, 134 bp, Homo sapiens; identical to SEQ ID NO: 43099
  chr11:61669877-61670011
  hypo

SEQ ID NO: 63574 - DNA, 87 bp, Homo sapiens; identical to SEQ ID NO: 43100
  chr11:61675013-61675100
  hypo

SEQ ID NO: 63575 - DNA, 23 bp, Homo sapiens
  chr11:61736670-61736693
  hypo
ttgcctggggctgggcgcggtgg

SEQ ID NO: 63576 - DNA, 82 bp, Homo sapiens; identical to SEQ ID NO: 43102
  chr11:61736993-61737075
  hypo

SEQ ID NO: 63577 - DNA, 30 bp, Homo sapiens; identical to SEQ ID NO: 43103
  chr11:61784772-61784802
  hypo

SEQ ID NO: 63578 - DNA, 198 bp, Homo sapiens
  chr11:62370522-62370720
  hypo
tggactctcacccaacgacacacgcccagcgttccaagcccaaactgggctccaccttgtcccccacccttccagcaggtttccacgcccctgctcaccgtagacgtgaaagcccagcacacaggtgtaggtagcccattcccggtctcggctctcatagcgattcttcagctgcttgcagcctccagccacgtcccc

SEQ ID NO: 63579 - DNA, 95 bp, Homo sapiens; identical to SEQ ID NO: 43105
  chr11:62421710-62421805
  hypo

SEQ ID NO: 63580 - DNA, 30 bp, Homo sapiens; identical to SEQ ID NO: 43106
  chr11:62440622-62440652
  hypo

SEQ ID NO: 63581 - DNA, 60 bp, Homo sapiens; identical to SEQ ID NO: 43107
  chr11:62445431-62445491
  hypo

SEQ ID NO: 63582 - DNA, 46 bp, Homo sapiens; identical to SEQ ID NO: 43108
  chr11:63572099-63572145
  hypo

SEQ ID NO: 63583 - DNA, 102 bp, Homo sapiens; identical to SEQ ID NO: 43110
  chr11:63779116-63779218
  hypo

SEQ ID NO: 63584 - DNA, 30 bp, Homo sapiens; identical to SEQ ID NO: 43111
  chr11:63780950-63780980
  hypo

SEQ ID NO: 63585 - DNA, 82 bp, Homo sapiens; identical to SEQ ID NO: 43112
  chr11:63783734-63783816
  hypo

SEQ ID NO: 63586 - DNA, 7 bp, Homo sapiens
  chr11:63849387-63849394
  hypo
tggactc

SEQ ID NO: 63587 - DNA, 194 bp, Homo sapiens
  chr11:63849426-63849620
  hypo
gttctaaatggacatgccatccccacagctgtgtcaataaagcagccatttacagagcgggcgccggatcccgtgacaggttgaaaagtgtgtgagctgcagcgtcctgggctggggcagaggggccgtggcgagaacagatggggctgtgcccatctccccaggccctcctgtggctgcgcctggagcctccc

SEQ ID NO: 63588 - DNA, 79 bp, Homo sapiens; identical to SEQ ID NO: 43114
  chr11:63955145-63955224
  hypo

SEQ ID NO: 63589 - DNA, 47 bp, Homo sapiens; identical to SEQ ID NO: 43115
  chr11:63978814-63978861
  hypo

SEQ ID NO: 63590 - DNA, 30 bp, Homo sapiens; identical to SEQ ID NO: 43116
  chr11:64042980-64043010
  hypo

SEQ ID NO: 63591 - DNA, 30 bp, Homo sapiens; identical to SEQ ID NO: 43117
  chr11:64054355-64054385
  hypo

SEQ ID NO: 63592 - DNA, 38 bp, Homo sapiens; identical to SEQ ID NO: 43119
  chr11:64120222-64120260
  hypo

SEQ ID NO: 63593 - DNA, 54 bp, Homo sapiens; identical to SEQ ID NO: 43121
  chr11:64124704-64124758
  hypo

SEQ ID NO: 63594 - DNA, 30 bp, Homo sapiens; identical to SEQ ID NO: 43122
  chr11:64292470-64292500
  hypo

SEQ ID NO: 63595 - DNA, 82 bp, Homo sapiens; identical to SEQ ID NO: 43123
  chr11:64488590-64488672
  hypo

SEQ ID NO: 63596 - DNA, 30 bp, Homo sapiens; identical to SEQ ID NO: 43124
  chr11:64507459-64507489
  hypo

SEQ ID NO: 63597 - DNA, 30 bp, Homo sapiens; identical to SEQ ID NO: 43125
  chr11:64572043-64572073
  hypo

SEQ ID NO: 63598 - DNA, 30 bp, Homo sapiens; identical to SEQ ID NO: 43127
  chr11:64610130-64610160
  hypo

SEQ ID NO: 63599 - DNA, 87 bp, Homo sapiens; identical to SEQ ID NO: 43128
  chr11:64667987-64668074
  hypo

SEQ ID NO: 63600 - DNA, 96 bp, Homo sapiens; identical to SEQ ID NO: 43129
  chr11:64669480-64669576
  hypo

SEQ ID NO: 63601 - DNA, 30 bp, Homo sapiens; identical to SEQ ID NO: 43132
  chr11:64878823-64878853
  hypo

SEQ ID NO: 63602 - DNA, 142 bp, Homo sapiens; identical to SEQ ID NO: 43133
  chr11:64883942-64884084
  hypo

SEQ ID NO: 63603 - DNA, 44 bp, Homo sapiens; identical to SEQ ID NO: 43134
  chr11:64903259-64903303
  hypo

SEQ ID NO: 63604 - DNA, 44 bp, Homo sapiens; identical to SEQ ID NO: 43135
  chr11:64903423-64903467
  hypo

SEQ ID NO: 63605 - DNA, 102 bp, Homo sapiens; identical to SEQ ID NO: 43137
  chr11:64951749-64951851
  hypo

SEQ ID NO: 63606 - DNA, 40 bp, Homo sapiens; identical to SEQ ID NO: 43138
  chr11:64975460-64975500
  hypo

SEQ ID NO: 63607 - DNA, 52 bp, Homo sapiens; identical to SEQ ID NO: 43139
  chr11:64977482-64977534
  hypo

SEQ ID NO: 63608 - DNA, 81 bp, Homo sapiens; identical to SEQ ID NO: 43140
  chr11:65028546-65028627
  hypo

SEQ ID NO: 63609 - DNA, 71 bp, Homo sapiens
  chr11:65091369-65091440
  hypo
ggaacacaggctggcggcagcagggaagagtttcgctggccaggctgacgctgaggcgatggggtgctgct

SEQ ID NO: 63610 - DNA, 169 bp, Homo sapiens; identical to SEQ ID NO: 43142
  chr11:65127486-65127655
  hypo

SEQ ID NO: 63611 - DNA, 30 bp, Homo sapiens; identical to SEQ ID NO: 43143
  chr11:65306390-65306420
  hypo

SEQ ID NO: 63612 - DNA, 30 bp, Homo sapiens; identical to SEQ ID NO: 43144
  chr11:65309028-65309058
  hypo

SEQ ID NO: 63613 - DNA, 232 bp, Homo sapiens; identical to SEQ ID NO: 43145
  chr11:65413881-65414113
  hypo

SEQ ID NO: 63614 - DNA, 30 bp, Homo sapiens; identical to SEQ ID NO: 43146
  chr11:65463016-65463046
  hypo

SEQ ID NO: 63615 - DNA, 8 bp, Homo sapiens
  chr11:65511172-65511180
  hypo
gatttcaa

SEQ ID NO: 63616 - DNA, 154 bp, Homo sapiens; identical to SEQ ID NO: 43150
  chr11:65551581-65551735
  hypo

SEQ ID NO: 63617 - DNA, 69 bp, Homo sapiens; identical to SEQ ID NO: 43151
  chr11:65629450-65629519
  hypo

SEQ ID NO: 63618 - DNA, 87 bp, Homo sapiens; identical to SEQ ID NO: 43152
  chr11:65685085-65685172
  hypo

SEQ ID NO: 63619 - DNA, 41 bp, Homo sapiens; identical to SEQ ID NO: 43153
  chr11:65722778-65722819
  hypo

SEQ ID NO: 63620 - DNA, 30 bp, Homo sapiens; identical to SEQ ID NO: 43154
  chr11:65741409-65741439
  hypo

SEQ ID NO: 63621 - DNA, 101 bp, Homo sapiens; identical to SEQ ID NO: 43155
  chr11:66048072-66048173
  hypo

SEQ ID NO: 63622 - DNA, 33 bp, Homo sapiens; identical to SEQ ID NO: 43156
  chr11:66324511-66324544
  hypo

SEQ ID NO: 63623 - DNA, 124 bp, Homo sapiens; identical to SEQ ID NO: 43157
  chr11:66325272-66325396
  hypo

SEQ ID NO: 63624 - DNA, 189 bp, Homo sapiens; identical to SEQ ID NO: 43158
  chr11:66411368-66411557
  hypo

SEQ ID NO: 63625 - DNA, 29 bp, Homo sapiens
  chr11:66511194-66511223
  hypo
ttcagtgcagtcaaacgtggaaaggggcc

SEQ ID NO: 63626 - DNA, 58 bp, Homo sapiens
  chr11:66513159-66513217
  hypo
cattttacaaataaccgaacctaggctagaacccagggcgctgactcataggccagtg

SEQ ID NO: 63627 - DNA, 16 bp, Homo sapiens
  chr11:66515380-66515396
  hypo
gcgcagggcagcatta

SEQ ID NO: 63628 - DNA, 82 bp, Homo sapiens; identical to SEQ ID NO: 43163
  chr11:66557367-66557449
  hypo

SEQ ID NO: 63629 - DNA, 59 bp, Homo sapiens; identical to SEQ ID NO: 24864
  chr11:66625148-66625207
  hypo

SEQ ID NO: 63630 - DNA, 772 bp, Homo sapiens
  chr11:66625240-66626012
  hypo
tgctggccagtggagcggccgcctgcccgctgccctgcgtctgccagaacctgtccgagtcgctcagcaccctctgtgcccaccgaggcctgctgtttgtgccgcccaacgtggaccggcgcacagtggagctgcggctggctgacaacttcatccaggccctggggccccctgacttccgcaacatgacgggactggtggacctgacactgtctcgcaatgccatcacccgcattggggcccgcgcctttggggacctcgagagcctgcgttccctccaccttgacggcaacaggctggtggagctgggcaccgggagcctccggggccccgtcaatctgcagcacctcatcctcagcggcaaccagctgggccgcatcgcgccgggagccttcgacgacttcctagagagcctggaggacctggacctgtcctacaacaacctccggcaggtgccctgggccggcatcggcgccatgcctgccctgcacaccctcaacctggaccataaccttattgacgcactgcccccaggcgccttcgcccagctcggtcagctctcccgcctggacctcacctccaaccgcctggccacgctggctccggacccgcttttctctcgtgggcgtgatgcagaggcctctcccgcccccctggtgctgagctttagcgggaaccccctgcactgcaactgtgagctgctgtggctgcggcggctggcgcggccggacgacctggaaacgtgcgcctccccgcccggcctggccggccg

SEQ ID NO: 63631 - DNA, 96 bp, Homo sapiens; identical to SEQ ID NO: 43165
  chr11:66626839-66626935
  hypo

SEQ ID NO: 63632 - DNA, 250 bp, Homo sapiens; identical to SEQ ID NO: 43166
  chr11:66631300-66631550
  hypo

SEQ ID NO: 63633 - DNA, 67 bp, Homo sapiens; identical to SEQ ID NO: 43167
  chr11:66648961-66649028
  hypo

SEQ ID NO: 63634 - DNA, 149 bp, Homo sapiens; identical to SEQ ID NO: 43168
  chr11:66897593-66897742
  hypo

SEQ ID NO: 63635 - DNA, 138 bp, Homo sapiens
  chr11:67072101-67072239
  hypo
ccactctagacctatcgaccgcgtgggggcccatgaatccgtgtagacaagggctgcaggtgaatgtgatgcatgctagactttgagagcccctaccctaaggggaatgaggagccatgacagttgcccactgccctg

SEQ ID NO: 63636 - DNA, 30 bp, Homo sapiens; identical to SEQ ID NO: 43171
  chr11:67442110-67442140
  hypo

SEQ ID NO: 63637 - DNA, 15 bp, Homo sapiens
  chr11:67462628-67462643
  hypo
agatccgccttaagc

SEQ ID NO: 63638 - DNA, 92 bp, Homo sapiens
  chr11:67764095-67764187
  hypo
agagcacctcgaagccgctgtagataaagaaaggcacgaggtggcgcaggcggtagtcacgcacgtgcttgaagggcagctggaagatgttg

SEQ ID NO: 63639 - DNA, 45 bp, Homo sapiens; identical to SEQ ID NO: 24869
  chr11:67781564-67781609
  hypo

SEQ ID NO: 63640 - DNA, 65 bp, Homo sapiens
  chr11:67797137-67797202
  hypo
tgtcctccctctgcacgggcatgggacatgccctctgcctccttcctgtcctggcctgcccaact

SEQ ID NO: 63641 - DNA, 119 bp, Homo sapiens; identical to SEQ ID NO: 43176
  chr11:67811705-67811824
  hypo

SEQ ID NO: 63642 - DNA, 30 bp, Homo sapiens; identical to SEQ ID NO: 43177
  chr11:67915948-67915978
  hypo

SEQ ID NO: 63643 - DNA, 154 bp, Homo sapiens; identical to SEQ ID NO: 15587
  chr11:68111091-68111245
  hypo

SEQ ID NO: 63644 - DNA, 227 bp, Homo sapiens; identical to SEQ ID NO: 43179
  chr11:68132977-68133204
  hypo

SEQ ID NO: 63645 - DNA, 30 bp, Homo sapiens; identical to SEQ ID NO: 43180
  chr11:68210102-68210132
  hypo

SEQ ID NO: 63646 - DNA, 30 bp, Homo sapiens; identical to SEQ ID NO: 43181
  chr11:68225302-68225332
  hypo

SEQ ID NO: 63647 - DNA, 37 bp, Homo sapiens; identical to SEQ ID NO: 43182
  chr11:68226712-68226749
  hypo

SEQ ID NO: 63648 - DNA, 82 bp, Homo sapiens; identical to SEQ ID NO: 43183
  chr11:68385159-68385241
  hypo

SEQ ID NO: 63649 - DNA, 143 bp, Homo sapiens; identical to SEQ ID NO: 43184
  chr11:68385590-68385733
  hypo

SEQ ID NO: 63650 - DNA, 30 bp, Homo sapiens; identical to SEQ ID NO: 43185
  chr11:68412854-68412884
  hypo

SEQ ID NO: 63651 - DNA, 161 bp, Homo sapiens; identical to SEQ ID NO: 43186
  chr11:68417837-68417998
  hypo

SEQ ID NO: 63652 - DNA, 242 bp, Homo sapiens; identical to SEQ ID NO: 43187
  chr11:68432989-68433231
  hypo

SEQ ID NO: 63653 - DNA, 30 bp, Homo sapiens; identical to SEQ ID NO: 43188
  chr11:68564345-68564375
  hypo

SEQ ID NO: 63654 - DNA, 30 bp, Homo sapiens; identical to SEQ ID NO: 43189
  chr11:68672906-68672936
  hypo

SEQ ID NO: 63655 - DNA, 30 bp, Homo sapiens; identical to SEQ ID NO: 43190
  chr11:68692056-68692086
  hypo

SEQ ID NO: 63656 - DNA, 38 bp, Homo sapiens; identical to SEQ ID NO: 43191
  chr11:68771669-68771707
  hypo

SEQ ID NO: 63657 - DNA, 28 bp, Homo sapiens
  chr11:68804776-68804804
  hypo
ctgcggggacgctcgggtccttcttggg

SEQ ID NO: 63658 - DNA, 161 bp, Homo sapiens; identical to SEQ ID NO: 43193
  chr11:68965052-68965213
  hypo

SEQ ID NO: 63659 - DNA, 80 bp, Homo sapiens
  chr11:69192486-69192566
  hypo
tggcagaggctgttccgaggctgctccgatgtgtgggaactgagggggttcccaggatgtgagactttcagtgctgaaac

SEQ ID NO: 63660 - DNA, 36 bp, Homo sapiens
  chr11:69192784-69192820
  hypo
taacacagagcacccaacgggcgcagccgcccccat

SEQ ID NO: 63661 - DNA, 30 bp, Homo sapiens; identical to SEQ ID NO: 43195
  chr11:69206384-69206414
  hypo

SEQ ID NO: 63662 - DNA, 32 bp, Homo sapiens
  chr11:69280529-69280561
  hypo
tctccaggtgattctcgtgtgcagccaagtta

SEQ ID NO: 63663 - DNA, 67 bp, Homo sapiens; identical to SEQ ID NO: 43197
  chr11:69339948-69340015
  hypo

SEQ ID NO: 63664 - DNA, 167 bp, Homo sapiens; identical to SEQ ID NO: 43198
  chr11:69360946-69361113
  hypo

SEQ ID NO: 63665 - DNA, 30 bp, Homo sapiens; identical to SEQ ID NO: 43199
  chr11:69458784-69458814
  hypo

SEQ ID NO: 63666 - DNA, 30 bp, Homo sapiens; identical to SEQ ID NO: 43200
  chr11:69466053-69466083
  hypo

SEQ ID NO: 63667 - DNA, 147 bp, Homo sapiens; identical to SEQ ID NO: 43201
  chr11:69498970-69499117
  hypo

SEQ ID NO: 63668 - DNA, 75 bp, Homo sapiens; identical to SEQ ID NO: 43202
  chr11:69970448-69970523
  hypo

SEQ ID NO: 63669 - DNA, 30 bp, Homo sapiens; identical to SEQ ID NO: 43203
  chr11:70005678-70005708
  hypo

SEQ ID NO: 63670 - DNA, 30 bp, Homo sapiens; identical to SEQ ID NO: 43204
  chr11:70022959-70022989
  hypo

SEQ ID NO: 63671 - DNA, 258 bp, Homo sapiens; identical to SEQ ID NO: 43205
  chr11:70050908-70051166
  hypo

SEQ ID NO: 63672 - DNA, 30 bp, Homo sapiens; identical to SEQ ID NO: 43206
  chr11:71098989-71099019
  hypo

SEQ ID NO: 63673 - DNA, 57 bp, Homo sapiens; identical to SEQ ID NO: 43207
  chr11:71117658-71117715
  hypo

SEQ ID NO: 63674 - DNA, 24 bp, Homo sapiens
  chr11:71192722-71192746
  hypo
tgcgtatctgcagttcgtcggtgg

SEQ ID NO: 63675 - DNA, 30 bp, Homo sapiens; identical to SEQ ID NO: 43209
  chr11:71507973-71508003
  hypo

SEQ ID NO: 63676 - DNA, 29 bp, Homo sapiens
  chr11:71781578-71781607
  hypo
cccagtggctcacagcggtaatcccagca

SEQ ID NO: 63677 - DNA, 30 bp, Homo sapiens; identical to SEQ ID NO: 43211
  chr11:72109516-72109546
  hypo

SEQ ID NO: 63678 - DNA, 12 bp, Homo sapiens
  chr11:72475711-72475723
  hypo
cccaaaggtgta

SEQ ID NO: 63679 - DNA, 48 bp, Homo sapiens
  chr11:72532300-72532348
  hypo
ctgggaacatcatggcgcccgagggccggatgggcatttggcagcctc

SEQ ID NO: 63680 - DNA, 30 bp, Homo sapiens; identical to SEQ ID NO: 43214
  chr11:72532613-72532643
  hypo

SEQ ID NO: 63681 - DNA, 30 bp, Homo sapiens; identical to SEQ ID NO: 15597
  chr11:72905832-72905862
  hypo

SEQ ID NO: 63682 - DNA, 155 bp, Homo sapiens; identical to SEQ ID NO: 43216
  chr11:73073174-73073329
  hypo

SEQ ID NO: 63683 - DNA, 25 bp, Homo sapiens
  chr11:73310342-73310367
  hypo
gggtgtcagattgcacgtaggtttt

SEQ ID NO: 63684 - DNA, 30 bp, Homo sapiens; identical to SEQ ID NO: 43218
  chr11:73805524-73805554
  hypo

SEQ ID NO: 63685 - DNA, 40 bp, Homo sapiens; identical to SEQ ID NO: 43219
  chr11:74246636-74246676
  hypo

SEQ ID NO: 63686 - DNA, 48 bp, Homo sapiens; identical to SEQ ID NO: 43220
  chr11:74302595-74302643
  hypo

SEQ ID NO: 63687 - DNA, 35 bp, Homo sapiens; identical to SEQ ID NO: 43221
  chr11:75100584-75100619
  hypo

SEQ ID NO: 63688 - DNA, 56 bp, Homo sapiens; identical to SEQ ID NO: 43222
  chr11:75152480-75152536
  hypo

SEQ ID NO: 63689 - DNA, 13 bp, Homo sapiens
  chr11:75459473-75459486
  hypo
cagataaacaaaa

SEQ ID NO: 63690 - DNA, 30 bp, Homo sapiens; identical to SEQ ID NO: 43224
  chr11:75879446-75879476
  hypo

SEQ ID NO: 63691 - DNA, 111 bp, Homo sapiens
  chr11:76371627-76371738
  hypo
gctcaagaaagctgtcggggatgagctcaatctcattgtagctcaaatccagattcaagagctgggaaagggggcggccgctggcattcccgctgggggctgagaggggca

SEQ ID NO: 63692 - DNA, 159 bp, Homo sapiens
  chr11:76372077-76372236
  hypo
ccatcagcacgttgctatgcaggtcaagctgctccagcgcaggcatgtcccggaaggtgtggcgggtgaggcgagtcagactgttctccgccagtgagagggtatgcaggctgggtgcctcccccagcagccgctccagcaggccgctgtacaggctgt

SEQ ID NO: 63693 - DNA, 169 bp, Homo sapiens; identical to SEQ ID NO: 43226
  chr11:76902500-76902669
  hypo

SEQ ID NO: 63694 - DNA, 18 bp, Homo sapiens
  chr11:77025115-77025133
  hypo
aaaaatatttaaggccgg

SEQ ID NO: 63695 - DNA, 85 bp, Homo sapiens; identical to SEQ ID NO: 43228
  chr11:82214234-82214319
  hypo

SEQ ID NO: 63696 - DNA, 30 bp, Homo sapiens; identical to SEQ ID NO: 43229
  chr11:83561479-83561509
  hypo

SEQ ID NO: 63697 - DNA, 30 bp, Homo sapiens; identical to SEQ ID NO: 43230
  chr11:85359853-85359883
  hypo

SEQ ID NO: 63698 - DNA, 24 bp, Homo sapiens
  chr11:85379748-85379772
  hypo
agattaagaaacatgcggccgggc

SEQ ID NO: 63699 - DNA, 150 bp, Homo sapiens; identical to SEQ ID NO: 43232
  chr11:85564833-85564983
  hypo

SEQ ID NO: 63700 - DNA, 30 bp, Homo sapiens; identical to SEQ ID NO: 43233
  chr11:85906245-85906275
  hypo

SEQ ID NO: 63701 - DNA, 21 bp, Homo sapiens
  chr11:92929514-92929535
  hypo
aattgctgggtcaaacgataa

SEQ ID NO: 63702 - DNA, 20 bp, Homo sapiens
  chr11:94064787-94064807
  hypo
gccaccgcgcctggcccaag

SEQ ID NO: 63703 - DNA, 26 bp, Homo sapiens
  chr11:94892054-94892080
  hypo
tcctccctgggcgacaaagcaagact

SEQ ID NO: 63704 - DNA, 30 bp, Homo sapiens; identical to SEQ ID NO: 43237
  chr11:94924721-94924751
  hypo

SEQ ID NO: 63705 - DNA, 41 bp, Homo sapiens; identical to SEQ ID NO: 43238
  chr11:95020639-95020680
  hypo

SEQ ID NO: 63706 - DNA, 30 bp, Homo sapiens; identical to SEQ ID NO: 15603
  chr11:95488699-95488729
  hypo

SEQ ID NO: 63707 - DNA, 30 bp, Homo sapiens; identical to SEQ ID NO: 15604
  chr11:95658721-95658751
  hypo

SEQ ID NO: 63708 - DNA, 17 bp, Homo sapiens
  chr11:102158484-102158501
  hypo
cccggcccctgtttact

SEQ ID NO: 63709 - DNA, 30 bp, Homo sapiens; identical to SEQ ID NO: 43243
  chr11:109880267-109880297
  hypo

SEQ ID NO: 63710 - DNA, 40 bp, Homo sapiens; identical to SEQ ID NO: 43244
  chr11:111154502-111154542
  hypo

SEQ ID NO: 63711 - DNA, 100 bp, Homo sapiens; identical to SEQ ID NO: 43245
  chr11:111156679-111156779
  hypo

SEQ ID NO: 63712 - DNA, 23 bp, Homo sapiens
  chr11:113373844-113373867
  hypo
cgagactccgtctcaaaaaaaaa

SEQ ID NO: 63713 - DNA, 185 bp, Homo sapiens; identical to SEQ ID NO: 15606
  chr11:113552799-113552984
  hypo

SEQ ID NO: 63714 - DNA, 151 bp, Homo sapiens; identical to SEQ ID NO: 43248
  chr11:113560972-113561123
  hypo

SEQ ID NO: 63715 - DNA, 67 bp, Homo sapiens; identical to SEQ ID NO: 43249
  chr11:113800743-113800810
  hypo

SEQ ID NO: 63716 - DNA, 171 bp, Homo sapiens; identical to SEQ ID NO: 43250
  chr11:114115465-114115636
  hypo

SEQ ID NO: 63717 - DNA, 30 bp, Homo sapiens; identical to SEQ ID NO: 43251
  chr11:114121201-114121231
  hypo

SEQ ID NO: 63718 - DNA, 30 bp, Homo sapiens; identical to SEQ ID NO: 43252
  chr11:115763341-115763371
  hypo

SEQ ID NO: 63719 - DNA, 32 bp, Homo sapiens; identical to SEQ ID NO: 15607
  chr11:116890012-116890044
  hypo

SEQ ID NO: 63720 - DNA, 75 bp, Homo sapiens; identical to SEQ ID NO: 43254
  chr11:116952331-116952406
  hypo

SEQ ID NO: 63721 - DNA, 30 bp, Homo sapiens; identical to SEQ ID NO: 43255
  chr11:117010343-117010373
  hypo

SEQ ID NO: 63722 - DNA, 30 bp, Homo sapiens; identical to SEQ ID NO: 43256
  chr11:117054963-117054993
  hypo

SEQ ID NO: 63723 - DNA, 52 bp, Homo sapiens; identical to SEQ ID NO: 43257
  chr11:118768516-118768568
  hypo

SEQ ID NO: 63724 - DNA, 32 bp, Homo sapiens; identical to SEQ ID NO: 43258
  chr11:118781045-118781077
  hypo

SEQ ID NO: 63725 - DNA, 46 bp, Homo sapiens; identical to SEQ ID NO: 43259
  chr11:119524180-119524226
  hypo

SEQ ID NO: 63726 - DNA, 34 bp, Homo sapiens
  chr11:120008071-120008105
  hypo
cgggcctcaaagtcccggatgggctcgagcagct

SEQ ID NO: 63727 - DNA, 63 bp, Homo sapiens; identical to SEQ ID NO: 43261
  chr11:120008655-120008718
  hypo

SEQ ID NO: 63728 - DNA, 30 bp, Homo sapiens; identical to SEQ ID NO: 15610
  chr11:120367603-120367633
  hypo

SEQ ID NO: 63729 - DNA, 30 bp, Homo sapiens; identical to SEQ ID NO: 43263
  chr11:120384093-120384123
  hypo

SEQ ID NO: 63730 - DNA, 30 bp, Homo sapiens; identical to SEQ ID NO: 43264
  chr11:120410117-120410147
  hypo

SEQ ID NO: 63731 - DNA, 109 bp, Homo sapiens; identical to SEQ ID NO: 43265
  chr11:120748772-120748881
  hypo

SEQ ID NO: 63732 - DNA, 32 bp, Homo sapiens; identical to SEQ ID NO: 43266
  chr11:120772673-120772705
  hypo

SEQ ID NO: 63733 - DNA, 30 bp, Homo sapiens; identical to SEQ ID NO: 43267
  chr11:120837904-120837934
  hypo

SEQ ID NO: 63734 - DNA, 8 bp, Homo sapiens
  chr11:120998825-120998833
  hypo
ctgctcag

SEQ ID NO: 63735 - DNA, 30 bp, Homo sapiens; identical to SEQ ID NO: 43269
  chr11:121000904-121000934
  hypo

SEQ ID NO: 63736 - DNA, 162 bp, Homo sapiens; identical to SEQ ID NO: 43270
  chr11:121023638-121023800
  hypo

SEQ ID NO: 63737 - DNA, 82 bp, Homo sapiens
  chr11:121152203-121152285
  hypo
gccactttatgtactcttaacttgtcttgtctcattcctttgactatgccagactttgtagcccccacggcctggtgttggg

SEQ ID NO: 63738 - DNA, 30 bp, Homo sapiens; identical to SEQ ID NO: 43272
  chr11:121910451-121910481
  hypo

SEQ ID NO: 63739 - DNA, 21 bp, Homo sapiens
  chr11:122402739-122402760
  hypo
aagacatattgttgccgggca

SEQ ID NO: 63740 - DNA, 95 bp, Homo sapiens; identical to SEQ ID NO: 43274
  chr11:123169348-123169443
  hypo

SEQ ID NO: 63741 - DNA, 30 bp, Homo sapiens; identical to SEQ ID NO: 43275
  chr11:123457234-123457264
  hypo

SEQ ID NO: 63742 - DNA, 30 bp, Homo sapiens; identical to SEQ ID NO: 43276
  chr11:124526915-124526945
  hypo

SEQ ID NO: 63743 - DNA, 30 bp, Homo sapiens; identical to SEQ ID NO: 43277
  chr11:124743216-124743246
  hypo

SEQ ID NO: 63744 - DNA, 39 bp, Homo sapiens
  chr11:125220643-125220682
  hypo
ggacgggtgagccctggggaggggcgagcttggtgcttg

SEQ ID NO: 63745 - DNA, 43 bp, Homo sapiens; identical to SEQ ID NO: 24891
  chr11:125755569-125755612
  hypo

SEQ ID NO: 63746 - DNA, 81 bp, Homo sapiens; identical to SEQ ID NO: 43280
  chr11:126083885-126083966
  hypo

SEQ ID NO: 63747 - DNA, 20 bp, Homo sapiens
  chr11:126154214-126154234
  hypo
cactgcgcccagcccttcat

SEQ ID NO: 63748 - DNA, 231 bp, Homo sapiens; identical to SEQ ID NO: 43282
  chr11:126273042-126273273
  hypo

SEQ ID NO: 63749 - DNA, 66 bp, Homo sapiens; identical to SEQ ID NO: 43284
  chr11:129866993-129867059
  hypo

SEQ ID NO: 63750 - DNA, 35 bp, Homo sapiens; identical to SEQ ID NO: 43285
  chr11:130058066-130058101
  hypo

SEQ ID NO: 63751 - DNA, 102 bp, Homo sapiens; identical to SEQ ID NO: 43286
  chr11:130060305-130060407
  hypo

SEQ ID NO: 63752 - DNA, 30 bp, Homo sapiens; identical to SEQ ID NO: 43287
  chr11:130090184-130090214
  hypo

SEQ ID NO: 63753 - DNA, 190 bp, Homo sapiens; identical to SEQ ID NO: 43288
  chr11:130515653-130515843
  hypo

SEQ ID NO: 63754 - DNA, 30 bp, Homo sapiens; identical to SEQ ID NO: 15616
  chr11:130717573-130717603
  hypo

SEQ ID NO: 63755 - DNA, 29 bp, Homo sapiens
  chr11:130785458-130785487
  hypo
ctggctcctggctcacggaacggtaccaa

SEQ ID NO: 63756 - DNA, 62 bp, Homo sapiens
  chr11:130785622-130785684
  hypo
ccagcgaggctggagcccagccatcctcccagcaccactagcaatgccgacagaaggcacag

SEQ ID NO: 63757 - DNA, 9 bp, Homo sapiens
  chr11:131522754-131522763
  hypo
ggtggccat

SEQ ID NO: 63758 - DNA, 169 bp, Homo sapiens; identical to SEQ ID NO: 43292
  chr11:131631013-131631182
  hypo

SEQ ID NO: 63759 - DNA, 18 bp, Homo sapiens
  chr11:131766960-131766978
  hypo
atgcgttgctgcgtctct

SEQ ID NO: 63760 - DNA, 38 bp, Homo sapiens; identical to SEQ ID NO: 43294
  chr11:131799626-131799664
  hypo

SEQ ID NO: 63761 - DNA, 18 bp, Homo sapiens
  chr11:132484404-132484422
  hypo
taccgcttgtgtgtctgt

SEQ ID NO: 63762 - DNA, 30 bp, Homo sapiens; identical to SEQ ID NO: 43296
  chr11:132792371-132792401
  hypo

SEQ ID NO: 63763 - DNA, 11 bp, Homo sapiens
  chr11:133231728-133231739
  hypo
aatgagctcag

SEQ ID NO: 63764 - DNA, 192 bp, Homo sapiens; identical to SEQ ID NO: 43298
  chr11:133386010-133386202
  hypo

SEQ ID NO: 63765 - DNA, 30 bp, Homo sapiens; identical to SEQ ID NO: 43299
  chr11:133805206-133805236
  hypo

SEQ ID NO: 63766 - DNA, 219 bp, Homo sapiens; identical to SEQ ID NO: 43300
  chr11:134011075-134011294
  hypo

SEQ ID NO: 63767 - DNA, 34 bp, Homo sapiens; identical to SEQ ID NO: 43301
  chr11:134274891-134274925
  hypo

SEQ ID NO: 63768 - DNA, 30 bp, Homo sapiens; identical to SEQ ID NO: 43302
  chr11:134458505-134458535
  hypo

SEQ ID NO: 63769 - DNA, 30 bp, Homo sapiens; identical to SEQ ID NO: 43303
  chr11:134526234-134526264
  hypo

SEQ ID NO: 63770 - DNA, 30 bp, Homo sapiens; identical to SEQ ID NO: 43304
  chr11:134607499-134607529
  hypo

SEQ ID NO: 63771 - DNA, 94 bp, Homo sapiens; identical to SEQ ID NO: 43305
  chr11:134608582-134608676
  hypo

SEQ ID NO: 63772 - DNA, 30 bp, Homo sapiens; identical to SEQ ID NO: 43306
  chr12:299633-299663
  hypo

SEQ ID NO: 63773 - DNA, 35 bp, Homo sapiens; identical to SEQ ID NO: 43307
  chr12:709027-709062
  hypo

SEQ ID NO: 63774 - DNA, 34 bp, Homo sapiens; identical to SEQ ID NO: 43308
  chr12:1650728-1650762
  hypo

SEQ ID NO: 63775 - DNA, 76 bp, Homo sapiens; identical to SEQ ID NO: 43309
  chr12:1651130-1651206
  hypo

SEQ ID NO: 63776 - DNA, 34 bp, Homo sapiens; identical to SEQ ID NO: 43310
  chr12:1716758-1716792
  hypo

SEQ ID NO: 63777 - DNA, 42 bp, Homo sapiens; identical to SEQ ID NO: 43311
  chr12:1948142-1948184
  hypo

SEQ ID NO: 63778 - DNA, 173 bp, Homo sapiens; identical to SEQ ID NO: 43312
  chr12:1948419-1948592
  hypo

SEQ ID NO: 63779 - DNA, 45 bp, Homo sapiens; identical to SEQ ID NO: 43313
  chr12:2017790-2017835
  hypo

SEQ ID NO: 63780 - DNA, 32 bp, Homo sapiens; identical to SEQ ID NO: 43314
  chr12:2018113-2018145
  hypo

SEQ ID NO: 63781 - DNA, 134 bp, Homo sapiens; identical to SEQ ID NO: 43315
  chr12:2040511-2040645
  hypo

SEQ ID NO: 63782 - DNA, 30 bp, Homo sapiens; identical to SEQ ID NO: 43316
  chr12:2046347-2046377
  hypo

SEQ ID NO: 63783 - DNA, 53 bp, Homo sapiens; identical to SEQ ID NO: 43317
  chr12:2088785-2088838
  hypo

SEQ ID NO: 63784 - DNA, 40 bp, Homo sapiens; identical to SEQ ID NO: 43318
  chr12:2245461-2245501
  hypo

SEQ ID NO: 63785 - DNA, 30 bp, Homo sapiens; identical to SEQ ID NO: 15624
  chr12:2590465-2590495
  hypo

SEQ ID NO: 63786 - DNA, 37 bp, Homo sapiens; identical to SEQ ID NO: 43321
  chr12:2921106-2921143
  hypo

SEQ ID NO: 63787 - DNA, 235 bp, Homo sapiens
  chr12:2964577-2964812
  hypo
tgggagggtgggagggactcgctggcctggaccatctagggagagacaaaagggagcctggggaaggttgtgcagacaggggtgcagaaaggtgggtgaggcactccgctctccttcccaggcacgacctctgccagcccaggattctcatgaggacgcagaagtcctggcagggccgcatctccatccctctccttcccggcggaagttatggctgctgcgtatcatcttcaca

SEQ ID NO: 63788 - DNA, 30 bp, Homo sapiens; identical to SEQ ID NO: 43323
  chr12:3640833-3640863
  hypo

SEQ ID NO: 63789 - DNA, 30 bp, Homo sapiens; identical to SEQ ID NO: 43324
  chr12:4019070-4019100
  hypo

SEQ ID NO: 63790 - DNA, 196 bp, Homo sapiens; identical to SEQ ID NO: 43325
  chr12:4194712-4194908
  hypo

SEQ ID NO: 63791 - DNA, 30 bp, Homo sapiens; identical to SEQ ID NO: 43326
  chr12:4217500-4217530
  hypo

SEQ ID NO: 63792 - DNA, 84 bp, Homo sapiens; identical to SEQ ID NO: 43327
  chr12:4268526-4268610
  hypo

SEQ ID NO: 63793 - DNA, 17 bp, Homo sapiens
  chr12:4272614-4272631
  hypo
agcgagactctgtctca

SEQ ID NO: 63794 - DNA, 30 bp, Homo sapiens; identical to SEQ ID NO: 43329
  chr12:4280922-4280952
  hypo

SEQ ID NO: 63795 - DNA, 30 bp, Homo sapiens; identical to SEQ ID NO: 43330
  chr12:4356247-4356277
  hypo

SEQ ID NO: 63796 - DNA, 75 bp, Homo sapiens; identical to SEQ ID NO: 43331
  chr12:4405652-4405727
  hypo

SEQ ID NO: 63797 - DNA, 30 bp, Homo sapiens; identical to SEQ ID NO: 43332
  chr12:4411192-4411222
  hypo

SEQ ID NO: 63798 - DNA, 102 bp, Homo sapiens
  chr12:4554831-4554933
  hypo
tttggaaggcagatgaaggctgctgacatgaaaccaaagcctccatcgggcactcgggttgagagcagagggacccaggctgagccgcggccggtagagacc

SEQ ID NO: 63799 - DNA, 30 bp, Homo sapiens; identical to SEQ ID NO: 43334
  chr12:4734872-4734902
  hypo

SEQ ID NO: 63800 - DNA, 146 bp, Homo sapiens; identical to SEQ ID NO: 43335
  chr12:4829055-4829201
  hypo

SEQ ID NO: 63801 - DNA, 30 bp, Homo sapiens; identical to SEQ ID NO: 43336
  chr12:4959461-4959491
  hypo

SEQ ID NO: 63802 - DNA, 141 bp, Homo sapiens; identical to SEQ ID NO: 43337
  chr12:5315393-5315534
  hypo

SEQ ID NO: 63803 - DNA, 106 bp, Homo sapiens; identical to SEQ ID NO: 43338
  chr12:5323880-5323986
  hypo

SEQ ID NO: 63804 - DNA, 141 bp, Homo sapiens; identical to SEQ ID NO: 43339
  chr12:5335908-5336049
  hypo

SEQ ID NO: 63805 - DNA, 30 bp, Homo sapiens; identical to SEQ ID NO: 43340
  chr12:5384595-5384625
  hypo

SEQ ID NO: 63806 - DNA, 20 bp, Homo sapiens
  chr12:5561269-5561289
  hypo
ttttttttttgttgacggag

SEQ ID NO: 63807 - DNA, 54 bp, Homo sapiens; identical to SEQ ID NO: 43342
  chr12:5713384-5713438
  hypo

SEQ ID NO: 63808 - DNA, 21 bp, Homo sapiens
  chr12:5720406-5720427
  hypo
ttacagcggtgagccaccaca

SEQ ID NO: 63809 - DNA, 30 bp, Homo sapiens; identical to SEQ ID NO: 43344
  chr12:6180349-6180379
  hypo

SEQ ID NO: 63810 - DNA, 30 bp, Homo sapiens; identical to SEQ ID NO: 43345
  chr12:6316943-6316973
  hypo

SEQ ID NO: 63811 - DNA, 47 bp, Homo sapiens; identical to SEQ ID NO: 24904
  chr12:6483568-6483615
  hypo

SEQ ID NO: 63812 - DNA, 30 bp, Homo sapiens
  chr12:6483756-6483786
  hypo
tgttgcagaagaactcgaagagctctcggt

SEQ ID NO: 63813 - DNA, 30 bp, Homo sapiens; identical to SEQ ID NO: 43347
  chr12:6484000-6484030
  hypo

SEQ ID NO: 63814 - DNA, 30 bp, Homo sapiens; identical to SEQ ID NO: 43348
  chr12:6495108-6495138
  hypo

SEQ ID NO: 63815 - DNA, 69 bp, Homo sapiens; identical to SEQ ID NO: 43349
  chr12:6623485-6623554
  hypo

SEQ ID NO: 63816 - DNA, 30 bp, Homo sapiens; identical to SEQ ID NO: 43350
  chr12:6804680-6804710
  hypo

SEQ ID NO: 63817 - DNA, 16 bp, Homo sapiens
  chr12:7462672-7462688
  hypo
gcgcctggcaggagac

SEQ ID NO: 63818 - DNA, 81 bp, Homo sapiens; identical to SEQ ID NO: 43352
  chr12:7767211-7767292
  hypo

SEQ ID NO: 63819 - DNA, 33 bp, Homo sapiens; identical to SEQ ID NO: 43353
  chr12:7864862-7864895
  hypo

SEQ ID NO: 63820 - DNA, 84 bp, Homo sapiens; identical to SEQ ID NO: 43354
  chr12:7921500-7921584
  hypo

SEQ ID NO: 63821 - DNA, 43 bp, Homo sapiens; identical to SEQ ID NO: 43355
  chr12:7960433-7960476
  hypo

SEQ ID NO: 63822 - DNA, 41 bp, Homo sapiens; identical to SEQ ID NO: 43356
  chr12:7963835-7963876
  hypo

SEQ ID NO: 63823 - DNA, 18 bp, Homo sapiens
  chr12:7973388-7973406
  hypo
aattaaacaacagtccgg

SEQ ID NO: 63824 - DNA, 30 bp, Homo sapiens; identical to SEQ ID NO: 43358
  chr12:7980007-7980037
  hypo

SEQ ID NO: 63825 - DNA, 30 bp, Homo sapiens; identical to SEQ ID NO: 43359
  chr12:7986413-7986443
  hypo

SEQ ID NO: 63826 - DNA, 30 bp, Homo sapiens; identical to SEQ ID NO: 43360
  chr12:8023514-8023544
  hypo

SEQ ID NO: 63827 - DNA, 96 bp, Homo sapiens; identical to SEQ ID NO: 43361
  chr12:8117682-8117778
  hypo

SEQ ID NO: 63828 - DNA, 18 bp, Homo sapiens
  chr12:8122686-8122704
  hypo
gcccgaactacaattctt

SEQ ID NO: 63829 - DNA, 38 bp, Homo sapiens; identical to SEQ ID NO: 43364
  chr12:8168255-8168293
  hypo

SEQ ID NO: 63830 - DNA, 32 bp, Homo sapiens; identical to SEQ ID NO: 43365
  chr12:8170444-8170476
  hypo

SEQ ID NO: 63831 - DNA, 89 bp, Homo sapiens; identical to SEQ ID NO: 43366
  chr12:8322396-8322485
  hypo

SEQ ID NO: 63832 - DNA, 21 bp, Homo sapiens
  chr12:8748055-8748076
  hypo
ccaaagcgctgggattacagg

SEQ ID NO: 63833 - DNA, 30 bp, Homo sapiens; identical to SEQ ID NO: 43368
  chr12:8748716-8748746
  hypo

SEQ ID NO: 63834 - DNA, 28 bp, Homo sapiens
  chr12:8751148-8751176
  hypo
aggtttacttgacttcgaagtcatactg

SEQ ID NO: 63835 - DNA, 198 bp, Homo sapiens; identical to SEQ ID NO: 43370
  chr12:8790007-8790205
  hypo

SEQ ID NO: 63836 - DNA, 61 bp, Homo sapiens; identical to SEQ ID NO: 43371
  chr12:8799944-8800005
  hypo

SEQ ID NO: 63837 - DNA, 40 bp, Homo sapiens; identical to SEQ ID NO: 24909
  chr12:8808559-8808599
  hypo

SEQ ID NO: 63838 - DNA, 25 bp, Homo sapiens
  chr12:8869424-8869449
  hypo
caggctcaagcgatcttcccacctc

SEQ ID NO: 63839 - DNA, 80 bp, Homo sapiens; identical to SEQ ID NO: 43374
  chr12:8908240-8908320
  hypo

SEQ ID NO: 63840 - DNA, 147 bp, Homo sapiens; identical to SEQ ID NO: 43376
  chr12:8982341-8982488
  hypo

SEQ ID NO: 63841 - DNA, 103 bp, Homo sapiens; identical to SEQ ID NO: 43377
  chr12:8983831-8983934
  hypo

SEQ ID NO: 63842 - DNA, 30 bp, Homo sapiens; identical to SEQ ID NO: 43378
  chr12:9006991-9007021
  hypo

SEQ ID NO: 63843 - DNA, 135 bp, Homo sapiens; identical to SEQ ID NO: 43379
  chr12:9016413-9016548
  hypo

SEQ ID NO: 63844 - DNA, 21 bp, Homo sapiens
  chr12:9018124-9018145
  hypo
aaactccgtctcaacaacaac

SEQ ID NO: 63845 - DNA, 30 bp, Homo sapiens; identical to SEQ ID NO: 43381
  chr12:9026553-9026583
  hypo

SEQ ID NO: 63846 - DNA, 105 bp, Homo sapiens; identical to SEQ ID NO: 43382
  chr12:9203172-9203277
  hypo

SEQ ID NO: 63847 - DNA, 28 bp, Homo sapiens
  chr12:10086245-10086273
  hypo
gcttttggtgcttcggtgcagagacaga

SEQ ID NO: 63848 - DNA, 30 bp, Homo sapiens; identical to SEQ ID NO: 43386
  chr12:10364485-10364515
  hypo

SEQ ID NO: 63849 - DNA, 32 bp, Homo sapiens; identical to SEQ ID NO: 43387
  chr12:10823904-10823936
  hypo

SEQ ID NO: 63850 - DNA, 93 bp, Homo sapiens; identical to SEQ ID NO: 43389
  chr12:13025675-13025768
  hypo

SEQ ID NO: 63851 - DNA, 187 bp, Homo sapiens; identical to SEQ ID NO: 43390
  chr12:13030748-13030935
  hypo

SEQ ID NO: 63852 - DNA, 16 bp, Homo sapiens
  chr12:13035999-13036015
  hypo
gtgtttaaggccgggc

SEQ ID NO: 63853 - DNA, 385 bp, Homo sapiens; identical to SEQ ID NO: 43392
  chr12:13079626-13080011
  hypo

SEQ ID NO: 63854 - DNA, 94 bp, Homo sapiens; identical to SEQ ID NO: 15639
  chr12:13215216-13215310
  hypo

SEQ ID NO: 63855 - DNA, 30 bp, Homo sapiens; identical to SEQ ID NO: 43394
  chr12:13229039-13229069
  hypo

SEQ ID NO: 63856 - DNA, 30 bp, Homo sapiens; identical to SEQ ID NO: 43395
  chr12:13716358-13716388
  hypo

SEQ ID NO: 63857 - DNA, 36 bp, Homo sapiens; identical to SEQ ID NO: 43396
  chr12:14817857-14817893
  hypo

SEQ ID NO: 63858 - DNA, 18 bp, Homo sapiens
  chr12:14905519-14905537
  hypo
aaaaaaaaagctggccgg

SEQ ID NO: 63859 - DNA, 30 bp, Homo sapiens; identical to SEQ ID NO: 43398
  chr12:14926203-14926233
  hypo

SEQ ID NO: 63860 - DNA, 52 bp, Homo sapiens; identical to SEQ ID NO: 43399
  chr12:14929885-14929937
  hypo

SEQ ID NO: 63861 - DNA, 82 bp, Homo sapiens; identical to SEQ ID NO: 43400
  chr12:17629461-17629543
  hypo

SEQ ID NO: 63862 - DNA, 35 bp, Homo sapiens; identical to SEQ ID NO: 43401
  chr12:19636251-19636286
  hypo

SEQ ID NO: 63863 - DNA, 81 bp, Homo sapiens; identical to SEQ ID NO: 43403
  chr12:22698115-22698196
  hypo

SEQ ID NO: 63864 - DNA, 187 bp, Homo sapiens; identical to SEQ ID NO: 43404
  chr12:25059405-25059592
  hypo

SEQ ID NO: 63865 - DNA, 77 bp, Homo sapiens; identical to SEQ ID NO: 15643
  chr12:25081492-25081569
  hypo

SEQ ID NO: 63866 - DNA, 25 bp, Homo sapiens
  chr12:25191255-25191280
  hypo
caaaattgcaaatgacgaactataa

SEQ ID NO: 63867 - DNA, 30 bp, Homo sapiens; identical to SEQ ID NO: 43407
  chr12:25195744-25195774
  hypo

SEQ ID NO: 63868 - DNA, 30 bp, Homo sapiens; identical to SEQ ID NO: 43408
  chr12:25262919-25262949
  hypo

SEQ ID NO: 63869 - DNA, 30 bp, Homo sapiens; identical to SEQ ID NO: 43409
  chr12:25537400-25537430
  hypo

SEQ ID NO: 63870 - DNA, 30 bp, Homo sapiens; identical to SEQ ID NO: 43410
  chr12:26555243-26555273
  hypo

SEQ ID NO: 63871 - DNA, 37 bp, Homo sapiens; identical to SEQ ID NO: 43411
  chr12:26555819-26555856
  hypo

SEQ ID NO: 63872 - DNA, 153 bp, Homo sapiens; identical to SEQ ID NO: 43412
  chr12:27489449-27489602
  hypo

SEQ ID NO: 63873 - DNA, 30 bp, Homo sapiens; identical to SEQ ID NO: 43413
  chr12:29374034-29374064
  hypo

SEQ ID NO: 63874 - DNA, 20 bp, Homo sapiens
  chr12:30859424-30859444
  hypo
acaagcgtaagccactgtac

SEQ ID NO: 63875 - DNA, 41 bp, Homo sapiens; identical to SEQ ID NO: 43415
  chr12:30947564-30947605
  hypo

SEQ ID NO: 63876 - DNA, 30 bp, Homo sapiens; identical to SEQ ID NO: 43416
  chr12:31255181-31255211
  hypo

SEQ ID NO: 63877 - DNA, 16 bp, Homo sapiens
  chr12:32087179-32087195
  hypo
gtgccacagctactcc

SEQ ID NO: 63878 - DNA, 151 bp, Homo sapiens; identical to SEQ ID NO: 15647
  chr12:32597645-32597796
  hypo

SEQ ID NO: 63879 - DNA, 40 bp, Homo sapiens; identical to SEQ ID NO: 43420
  chr12:32831140-32831180
  hypo

SEQ ID NO: 63880 - DNA, 240 bp, Homo sapiens; identical to SEQ ID NO: 43421
  chr12:32831300-32831540
  hypo

SEQ ID NO: 63881 - DNA, 157 bp, Homo sapiens; identical to SEQ ID NO: 43422
  chr12:33205564-33205721
  hypo

SEQ ID NO: 63882 - DNA, 43 bp, Homo sapiens; identical to SEQ ID NO: 43423
  chr12:34362659-34362702
  hypo

SEQ ID NO: 63883 - DNA, 30 bp, Homo sapiens; identical to SEQ ID NO: 43424
  chr12:34364426-34364456
  hypo

SEQ ID NO: 63884 - DNA, 25 bp, Homo sapiens
  chr12:34463931-34463956
  hypo
tgcgtgtcgtgctcacggggacacc

SEQ ID NO: 63885 - DNA, 85 bp, Homo sapiens; identical to SEQ ID NO: 43426
  chr12:34464016-34464101
  hypo

SEQ ID NO: 63886 - DNA, 51 bp, Homo sapiens
  chr12:34494918-34494969
  hypo
gtcccgggtttgcactccccgagcggctggacactgcggggggctgcccaa

SEQ ID NO: 63887 - DNA, 114 bp, Homo sapiens
  chr12:34502619-34502733
  hypo
atttggcctaacccacgcggggtccagcctctccgggggtgtgaaccccggacctcagggtcctcaggacccagtgcatgcgcagcaggtgggacttggggttggccgggggcc

SEQ ID NO: 63888 - DNA, 84 bp, Homo sapiens
  chr12:34502803-34502887
  hypo
gcggctgtgggcggctaccccaggggaccagctgctccgagggcgcgagcctaggaccctgcttatgcacggcaggggtggtgt

SEQ ID NO: 63889 - DNA, 93 bp, Homo sapiens; identical to SEQ ID NO: 43429
  chr12:34519278-34519371
  hypo

SEQ ID NO: 63890 - DNA, 113 bp, Homo sapiens; identical to SEQ ID NO: 43430
  chr12:34520137-34520250
  hypo

SEQ ID NO: 63891 - DNA, 30 bp, Homo sapiens; identical to SEQ ID NO: 43431
  chr12:34522309-34522339
  hypo

SEQ ID NO: 63892 - DNA, 30 bp, Homo sapiens; identical to SEQ ID NO: 43432
  chr12:38543382-38543412
  hypo

SEQ ID NO: 63893 - DNA, 30 bp, Homo sapiens; identical to SEQ ID NO: 43433
  chr12:38549417-38549447
  hypo

SEQ ID NO: 63894 - DNA, 177 bp, Homo sapiens; identical to SEQ ID NO: 43434
  chr12:38550692-38550869
  hypo

SEQ ID NO: 63895 - DNA, 207 bp, Homo sapiens; identical to SEQ ID NO: 43435
  chr12:38551229-38551436
  hypo

SEQ ID NO: 63896 - DNA, 43 bp, Homo sapiens; identical to SEQ ID NO: 43436
  chr12:38551858-38551901
  hypo

SEQ ID NO: 63897 - DNA, 36 bp, Homo sapiens; identical to SEQ ID NO: 43437
  chr12:38553830-38553866
  hypo

SEQ ID NO: 63898 - DNA, 96 bp, Homo sapiens; identical to SEQ ID NO: 43438
  chr12:38595440-38595536
  hypo

SEQ ID NO: 63899 - DNA, 30 bp, Homo sapiens; identical to SEQ ID NO: 43439
  chr12:40501737-40501767
  hypo

SEQ ID NO: 63900 - DNA, 30 bp, Homo sapiens; identical to SEQ ID NO: 43440
  chr12:41925162-41925192
  hypo

SEQ ID NO: 63901 - DNA, 24 bp, Homo sapiens
  chr12:42654216-42654240
  hypo
gataatagtacttgccgggaggcg

SEQ ID NO: 63902 - DNA, 83 bp, Homo sapiens; identical to SEQ ID NO: 43442
  chr12:42654300-42654383
  hypo

SEQ ID NO: 63903 - DNA, 21 bp, Homo sapiens
  chr12:43957389-43957410
  hypo
ccaccgcgcccggccctcaga

SEQ ID NO: 63904 - DNA, 86 bp, Homo sapiens; identical to SEQ ID NO: 43444
  chr12:47628723-47628809
  hypo

SEQ ID NO: 63905 - DNA, 140 bp, Homo sapiens; identical to SEQ ID NO: 43445
  chr12:47629068-47629208
  hypo

SEQ ID NO: 63906 - DNA, 30 bp, Homo sapiens; identical to SEQ ID NO: 43446
  chr12:48590883-48590913
  hypo

SEQ ID NO: 63907 - DNA, 18 bp, Homo sapiens
  chr12:49108598-49108616
  hypo
tataaggcggccaggcgc

SEQ ID NO: 63908 - DNA, 25 bp, Homo sapiens
  chr12:49174695-49174720
  hypo
cattctggccaggtgcggtggctca

SEQ ID NO: 63909 - DNA, 17 bp, Homo sapiens
  chr12:49455664-49455681
  hypo
agagtctcgcactgtcg

SEQ ID NO: 63910 - DNA, 35 bp, Homo sapiens; identical to SEQ ID NO: 43450
  chr12:49596187-49596222
  hypo

SEQ ID NO: 63911 - DNA, 98 bp, Homo sapiens; identical to SEQ ID NO: 24924
  chr12:49657607-49657705
  hypo

SEQ ID NO: 63912 - DNA, 30 bp, Homo sapiens; identical to SEQ ID NO: 43452
  chr12:50790622-50790652
  hypo

SEQ ID NO: 63913 - DNA, 21 bp, Homo sapiens
  chr12:50897742-50897763
  hypo
tttcttttctttagacggagt

SEQ ID NO: 63914 - DNA, 285 bp, Homo sapiens
  chr12:51421271-51421556
  hypo
cccaagcctccgtagtgaattgttttcctcctcgcccagctgactcgattctccccagacttcatcctacctacccaaaagcaatcccactctatcgccagtttcagcctcacaccgtatcttttgctctgaagatgagactgccaaactggtgaagagggaataaatggcctaacaaattaccgtaattttctgcaatgtcgtttacagccaccaaaaacattagatcctcccgccaccctcactccccgacccctcgcactgcttacagcattaaaggtaatt

SEQ ID NO: 63915 - DNA, 148 bp, Homo sapiens; identical to SEQ ID NO: 43457
  chr12:52387912-52388060
  hypo

SEQ ID NO: 63916 - DNA, 94 bp, Homo sapiens; identical to SEQ ID NO: 43458
  chr12:52388344-52388438
  hypo

SEQ ID NO: 63917 - DNA, 30 bp, Homo sapiens; identical to SEQ ID NO: 43459
  chr12:52467638-52467668
  hypo

SEQ ID NO: 63918 - DNA, 30 bp, Homo sapiens; identical to SEQ ID NO: 43460
  chr12:52913808-52913838
  hypo

SEQ ID NO: 63919 - DNA, 30 bp, Homo sapiens; identical to SEQ ID NO: 43461
  chr12:52914057-52914087
  hypo

SEQ ID NO: 63920 - DNA, 102 bp, Homo sapiens; identical to SEQ ID NO: 43462
  chr12:53069161-53069263
  hypo

SEQ ID NO: 63921 - DNA, 210 bp, Homo sapiens; identical to SEQ ID NO: 43463
  chr12:53189513-53189723
  hypo

SEQ ID NO: 63922 - DNA, 30 bp, Homo sapiens; identical to SEQ ID NO: 43464
  chr12:53455806-53455836
  hypo

SEQ ID NO: 63923 - DNA, 30 bp, Homo sapiens; identical to SEQ ID NO: 43465
  chr12:53456042-53456072
  hypo

SEQ ID NO: 63924 - DNA, 240 bp, Homo sapiens; identical to SEQ ID NO: 43466
  chr12:53662984-53663224
  hypo

SEQ ID NO: 63925 - DNA, 30 bp, Homo sapiens; identical to SEQ ID NO: 43467
  chr12:53813830-53813860
  hypo

SEQ ID NO: 63926 - DNA, 71 bp, Homo sapiens; identical to SEQ ID NO: 24928
  chr12:54720232-54720303
  hypo

SEQ ID NO: 63927 - DNA, 111 bp, Homo sapiens; identical to SEQ ID NO: 43470
  chr12:55356770-55356881
  hypo

SEQ ID NO: 63928 - DNA, 30 bp, Homo sapiens; identical to SEQ ID NO: 43471
  chr12:55786344-55786374
  hypo

SEQ ID NO: 63929 - DNA, 30 bp, Homo sapiens; identical to SEQ ID NO: 43472
  chr12:56094359-56094389
  hypo

SEQ ID NO: 63930 - DNA, 43 bp, Homo sapiens; identical to SEQ ID NO: 15661
  chr12:56441277-56441320
  hypo

SEQ ID NO: 63931 - DNA, 30 bp, Homo sapiens; identical to SEQ ID NO: 43474
  chr12:57493886-57493916
  hypo

SEQ ID NO: 63932 - DNA, 56 bp, Homo sapiens; identical to SEQ ID NO: 43475
  chr12:57559766-57559822
  hypo

SEQ ID NO: 63933 - DNA, 15 bp, Homo sapiens
  chr12:57881112-57881127
  hypo
ctttgtcactaattc

SEQ ID NO: 63934 - DNA, 90 bp, Homo sapiens; identical to SEQ ID NO: 43477
  chr12:58241509-58241599
  hypo

SEQ ID NO: 63935 - DNA, 39 bp, Homo sapiens; identical to SEQ ID NO: 43478
  chr12:62429791-62429830
  hypo

SEQ ID NO: 63936 - DNA, 31 bp, Homo sapiens; identical to SEQ ID NO: 43479
  chr12:62539074-62539105
  hypo

SEQ ID NO: 63937 - DNA, 31 bp, Homo sapiens; identical to SEQ ID NO: 43480
  chr12:62539225-62539256
  hypo

SEQ ID NO: 63938 - DNA, 42 bp, Homo sapiens; identical to SEQ ID NO: 43481
  chr12:62563338-62563380
  hypo

SEQ ID NO: 63939 - DNA, 168 bp, Homo sapiens; identical to SEQ ID NO: 43482
  chr12:62580835-62581003
  hypo

SEQ ID NO: 63940 - DNA, 22 bp, Homo sapiens
  chr12:62603703-62603725
  hypo
aggcgcaggggctcacgcctgt

SEQ ID NO: 63941 - DNA, 40 bp, Homo sapiens; identical to SEQ ID NO: 43484
  chr12:62630994-62631034
  hypo

SEQ ID NO: 63942 - DNA, 30 bp, Homo sapiens; identical to SEQ ID NO: 43485
  chr12:63788043-63788073
  hypo

SEQ ID NO: 63943 - DNA, 40 bp, Homo sapiens
  chr12:64783308-64783348
  hypo
tctgtagctcaggctggagtgcaggtggggcgatctcggc

SEQ ID NO: 63944 - DNA, 42 bp, Homo sapiens; identical to SEQ ID NO: 43487
  chr12:64797450-64797492
  hypo

SEQ ID NO: 63945 - DNA, 20 bp, Homo sapiens
  chr12:64799707-64799727
  hypo
ttgatcgtccaaatgccttc

SEQ ID NO: 63946 - DNA, 75 bp, Homo sapiens; identical to SEQ ID NO: 24937
  chr12:65516455-65516530
  hypo

SEQ ID NO: 63947 - DNA, 29 bp, Homo sapiens
  chr12:65530856-65530885
  hypo
ctagaaaaggccaggcgtggtggcctttt

SEQ ID NO: 63948 - DNA, 30 bp, Homo sapiens; identical to SEQ ID NO: 43493
  chr12:65787081-65787111
  hypo

SEQ ID NO: 63949 - DNA, 44 bp, Homo sapiens; identical to SEQ ID NO: 43494
  chr12:66208320-66208364
  hypo

SEQ ID NO: 63950 - DNA, 30 bp, Homo sapiens; identical to SEQ ID NO: 43495
  chr12:66211140-66211170
  hypo

SEQ ID NO: 63951 - DNA, 22 bp, Homo sapiens
  chr12:66242342-66242364
  hypo
ttaaaagtttaaggccgggtgc

SEQ ID NO: 63952 - DNA, 81 bp, Homo sapiens; identical to SEQ ID NO: 43497
  chr12:68978219-68978300
  hypo

SEQ ID NO: 63953 - DNA, 21 bp, Homo sapiens
  chr12:68978600-68978621
  hypo
tttttccgttttcactagaaa

SEQ ID NO: 63954 - DNA, 19 bp, Homo sapiens
  chr12:69751028-69751047
  hypo
tttttgtttttgagacgga

SEQ ID NO: 63955 - DNA, 16 bp, Homo sapiens
  chr12:69754426-69754442
  hypo
acacagcccctggcac

SEQ ID NO: 63956 - DNA, 26 bp, Homo sapiens
  chr12:69964264-69964290
  hypo
ttgaaagtggtcgaaggtgtcaaact

SEQ ID NO: 63957 - DNA, 23 bp, Homo sapiens
  chr12:69999350-69999373
  hypo
atcacaattactggccgggcgcg

SEQ ID NO: 63958 - DNA, 30 bp, Homo sapiens; identical to SEQ ID NO: 43504
  chr12:70024017-70024047
  hypo

SEQ ID NO: 63959 - DNA, 179 bp, Homo sapiens
  chr12:70087568-70087747
  hypo
gcgcccgtgctcgtcgcttccgtgaacactgctagagatgaggaacattagcctgtctggccagggcaaattcacaaactggttccaccatcggttcactaccagagtaacataaaaccctgtagaataacaggaaattataaagcagtttcttacagcagacacgttggtgacactga

SEQ ID NO: 63960 - DNA, 30 bp, Homo sapiens; identical to SEQ ID NO: 43506
  chr12:70173245-70173275
  hypo

SEQ ID NO: 63961 - DNA, 137 bp, Homo sapiens; identical to SEQ ID NO: 43507
  chr12:71626492-71626629
  hypo

SEQ ID NO: 63962 - DNA, 37 bp, Homo sapiens; identical to SEQ ID NO: 43508
  chr12:72054795-72054832
  hypo

SEQ ID NO: 63963 - DNA, 30 bp, Homo sapiens; identical to SEQ ID NO: 43509
  chr12:72077720-72077750
  hypo

SEQ ID NO: 63964 - DNA, 16 bp, Homo sapiens
  chr12:72634641-72634657
  hypo
gcgcctggcctctcca

SEQ ID NO: 63965 - DNA, 20 bp, Homo sapiens
  chr12:73732468-73732488
  hypo
gcgcccggccatttactggt

SEQ ID NO: 63966 - DNA, 30 bp, Homo sapiens; identical to SEQ ID NO: 43512
  chr12:74092079-74092109
  hypo

SEQ ID NO: 63967 - DNA, 25 bp, Homo sapiens
  chr12:74930406-74930431
  hypo
catgtaaggcactgtcgcaagattt

SEQ ID NO: 63968 - DNA, 43 bp, Homo sapiens; identical to SEQ ID NO: 43514
  chr12:77085862-77085905
  hypo

SEQ ID NO: 63969 - DNA, 30 bp, Homo sapiens; identical to SEQ ID NO: 15677
  chr12:77150018-77150048
  hypo

SEQ ID NO: 63970 - DNA, 30 bp, Homo sapiens; identical to SEQ ID NO: 43516
  chr12:79842607-79842637
  hypo

SEQ ID NO: 63971 - DNA, 96 bp, Homo sapiens; identical to SEQ ID NO: 43517
  chr12:80488160-80488256
  hypo

SEQ ID NO: 63972 - DNA, 30 bp, Homo sapiens; identical to SEQ ID NO: 43518
  chr12:89794228-89794258
  hypo

SEQ ID NO: 63973 - DNA, 156 bp, Homo sapiens; identical to SEQ ID NO: 43519
  chr12:90313545-90313701
  hypo

SEQ ID NO: 63974 - DNA, 33 bp, Homo sapiens; identical to SEQ ID NO: 43520
  chr12:93711081-93711114
  hypo

SEQ ID NO: 63975 - DNA, 30 bp, Homo sapiens; identical to SEQ ID NO: 43521
  chr12:93797551-93797581
  hypo

SEQ ID NO: 63976 - DNA, 30 bp, Homo sapiens; identical to SEQ ID NO: 15678
  chr12:94641622-94641652
  hypo

SEQ ID NO: 63977 - DNA, 81 bp, Homo sapiens; identical to SEQ ID NO: 15679
  chr12:95465839-95465920
  hypo

SEQ ID NO: 63978 - DNA, 9 bp, Homo sapiens
  chr12:96881029-96881038
  hypo
ccagccaat

SEQ ID NO: 63979 - DNA, 30 bp, Homo sapiens; identical to SEQ ID NO: 43525
  chr12:97073402-97073432
  hypo

SEQ ID NO: 63980 - DNA, 133 bp, Homo sapiens; identical to SEQ ID NO: 43526
  chr12:98763899-98764032
  hypo

SEQ ID NO: 63981 - DNA, 38 bp, Homo sapiens; identical to SEQ ID NO: 43527
  chr12:98947863-98947901
  hypo

SEQ ID NO: 63982 - DNA, 42 bp, Homo sapiens; identical to SEQ ID NO: 15681
  chr12:98948376-98948418
  hypo

SEQ ID NO: 63983 - DNA, 24 bp, Homo sapiens
  chr12:98986204-98986228
  hypo
ttaagaatttcaagccgggcatgg

SEQ ID NO: 63984 - DNA, 35 bp, Homo sapiens; identical to SEQ ID NO: 43530
  chr12:100595448-100595483
  hypo

SEQ ID NO: 63985 - DNA, 30 bp, Homo sapiens; identical to SEQ ID NO: 43531
  chr12:101025517-101025547
  hypo

SEQ ID NO: 63986 - DNA, 30 bp, Homo sapiens; identical to SEQ ID NO: 43532
  chr12:102158693-102158723
  hypo

SEQ ID NO: 63987 - DNA, 30 bp, Homo sapiens; identical to SEQ ID NO: 15682
  chr12:104690709-104690739
  hypo

SEQ ID NO: 63988 - DNA, 85 bp, Homo sapiens; identical to SEQ ID NO: 43534
  chr12:104695389-104695474
  hypo

SEQ ID NO: 63989 - DNA, 102 bp, Homo sapiens; identical to SEQ ID NO: 43535
  chr12:104696536-104696638
  hypo

SEQ ID NO: 63990 - DNA, 30 bp, Homo sapiens; identical to SEQ ID NO: 43536
  chr12:104698273-104698303
  hypo

SEQ ID NO: 63991 - DNA, 30 bp, Homo sapiens; identical to SEQ ID NO: 43537
  chr12:104975785-104975815
  hypo

SEQ ID NO: 63992 - DNA, 78 bp, Homo sapiens; identical to SEQ ID NO: 43538
  chr12:105018625-105018703
  hypo

SEQ ID NO: 63993 - DNA, 30 bp, Homo sapiens; identical to SEQ ID NO: 43539
  chr12:105056939-105056969
  hypo

SEQ ID NO: 63994 - DNA, 141 bp, Homo sapiens; identical to SEQ ID NO: 43540
  chr12:105069324-105069465
  hypo

SEQ ID NO: 63995 - DNA, 30 bp, Homo sapiens; identical to SEQ ID NO: 43541
  chr12:105104162-105104192
  hypo

SEQ ID NO: 63996 - DNA, 200 bp, Homo sapiens; identical to SEQ ID NO: 43542
  chr12:107138858-107139058
  hypo

SEQ ID NO: 63997 - DNA, 158 bp, Homo sapiens; identical to SEQ ID NO: 43543
  chr12:108898965-108899123
  hypo

SEQ ID NO: 63998 - DNA, 58 bp, Homo sapiens; identical to SEQ ID NO: 43544
  chr12:109208616-109208674
  hypo

SEQ ID NO: 63999 - DNA, 30 bp, Homo sapiens; identical to SEQ ID NO: 43545
  chr12:109343659-109343689
  hypo

SEQ ID NO: 64000 - DNA, 30 bp, Homo sapiens; identical to SEQ ID NO: 43546
  chr12:109719635-109719665
  hypo

SEQ ID NO: 64001 - DNA, 37 bp, Homo sapiens; identical to SEQ ID NO: 43547
  chr12:110506967-110507004
  hypo

SEQ ID NO: 64002 - DNA, 38 bp, Homo sapiens; identical to SEQ ID NO: 43548
  chr12:110563206-110563244
  hypo

SEQ ID NO: 64003 - DNA, 89 bp, Homo sapiens
  chr12:110717710-110717799
  hypo
taattttttgtttgtttgtttcgtgtagggttttgttggttcttttccaagtatcaatcaaaactacatgccaacgtccactccttgga

SEQ ID NO: 64004 - DNA, 30 bp, Homo sapiens; identical to SEQ ID NO: 15684
  chr12:110782730-110782760
  hypo

SEQ ID NO: 64005 - DNA, 23 bp, Homo sapiens
  chr12:110840421-110840444
  hypo
agccactacgcccggccaataaa

SEQ ID NO: 64006 - DNA, 39 bp, Homo sapiens; identical to SEQ ID NO: 43552
  chr12:110908132-110908171
  hypo

SEQ ID NO: 64007 - DNA, 35 bp, Homo sapiens; identical to SEQ ID NO: 43553
  chr12:110915431-110915466
  hypo

SEQ ID NO: 64008 - DNA, 30 bp, Homo sapiens; identical to SEQ ID NO: 15686
  chr12:111296630-111296660
  hypo

SEQ ID NO: 64009 - DNA, 30 bp, Homo sapiens; identical to SEQ ID NO: 43555
  chr12:111355976-111356006
  hypo

SEQ ID NO: 64010 - DNA, 224 bp, Homo sapiens; identical to SEQ ID NO: 43556
  chr12:111369069-111369293
  hypo

SEQ ID NO: 64011 - DNA, 30 bp, Homo sapiens; identical to SEQ ID NO: 43557
  chr12:111535459-111535489
  hypo

SEQ ID NO: 64012 - DNA, 23 bp, Homo sapiens
  chr12:112281623-112281646
  hypo
tgtttgtttttgagacggagtct

SEQ ID NO: 64013 - DNA, 68 bp, Homo sapiens; identical to SEQ ID NO: 43560
  chr12:112605535-112605603
  hypo

SEQ ID NO: 64014 - DNA, 91 bp, Homo sapiens; identical to SEQ ID NO: 43561
  chr12:112610355-112610446
  hypo

SEQ ID NO: 64015 - DNA, 30 bp, Homo sapiens; identical to SEQ ID NO: 15688
  chr12:112628549-112628579
  hypo

SEQ ID NO: 64016 - DNA, 30 bp, Homo sapiens; identical to SEQ ID NO: 43563
  chr12:112630855-112630885
  hypo

SEQ ID NO: 64017 - DNA, 30 bp, Homo sapiens; identical to SEQ ID NO: 43564
  chr12:112820695-112820725
  hypo

SEQ ID NO: 64018 - DNA, 152 bp, Homo sapiens; identical to SEQ ID NO: 43565
  chr12:112825982-112826134
  hypo

SEQ ID NO: 64019 - DNA, 30 bp, Homo sapiens; identical to SEQ ID NO: 15690
  chr12:112919571-112919601
  hypo

SEQ ID NO: 64020 - DNA, 36 bp, Homo sapiens; identical to SEQ ID NO: 43567
  chr12:113677751-113677787
  hypo

SEQ ID NO: 64021 - DNA, 98 bp, Homo sapiens; identical to SEQ ID NO: 43568
  chr12:113725864-113725962
  hypo

SEQ ID NO: 64022 - DNA, 36 bp, Homo sapiens; identical to SEQ ID NO: 43569
  chr12:113795723-113795759
  hypo

SEQ ID NO: 64023 - DNA, 143 bp, Homo sapiens; identical to SEQ ID NO: 43570
  chr12:114130077-114130220
  hypo

SEQ ID NO: 64024 - DNA, 49 bp, Homo sapiens; identical to SEQ ID NO: 43571
  chr12:114236483-114236532
  hypo

SEQ ID NO: 64025 - DNA, 180 bp, Homo sapiens; identical to SEQ ID NO: 43572
  chr12:114240258-114240438
  hypo

SEQ ID NO: 64026 - DNA, 30 bp, Homo sapiens; identical to SEQ ID NO: 43573
  chr12:114295503-114295533
  hypo

SEQ ID NO: 64027 - DNA, 152 bp, Homo sapiens; identical to SEQ ID NO: 43574
  chr12:114329563-114329715
  hypo

SEQ ID NO: 64028 - DNA, 49 bp, Homo sapiens; identical to SEQ ID NO: 43575
  chr12:114337939-114337988
  hypo

SEQ ID NO: 64029 - DNA, 74 bp, Homo sapiens; identical to SEQ ID NO: 43576
  chr12:116756120-116756194
  hypo

SEQ ID NO: 64030 - DNA, 59 bp, Homo sapiens; identical to SEQ ID NO: 43577
  chr12:116842266-116842325
  hypo

SEQ ID NO: 64031 - DNA, 172 bp, Homo sapiens; identical to SEQ ID NO: 43578
  chr12:116941191-116941363
  hypo

SEQ ID NO: 64032 - DNA, 30 bp, Homo sapiens; identical to SEQ ID NO: 43579
  chr12:117472788-117472818
  hypo

SEQ ID NO: 64033 - DNA, 30 bp, Homo sapiens; identical to SEQ ID NO: 43580
  chr12:117473067-117473097
  hypo

SEQ ID NO: 64034 - DNA, 78 bp, Homo sapiens
  chr12:117473987-117474065
  hypo
gcctggggtggcacacgctgctgtctggtgtctactaggctctgccaggtgcttacaatgacaatgacagcacagagt

SEQ ID NO: 64035 - DNA, 198 bp, Homo sapiens; identical to SEQ ID NO: 43582
  chr12:117474577-117474775
  hypo

SEQ ID NO: 64036 - DNA, 30 bp, Homo sapiens; identical to SEQ ID NO: 43583
  chr12:117484341-117484371
  hypo

SEQ ID NO: 64037 - DNA, 347 bp, Homo sapiens; identical to SEQ ID NO: 43584
  chr12:117529912-117530259
  hypo

SEQ ID NO: 64038 - DNA, 87 bp, Homo sapiens; identical to SEQ ID NO: 43585
  chr12:117530986-117531073
  hypo

SEQ ID NO: 64039 - DNA, 151 bp, Homo sapiens; identical to SEQ ID NO: 43586
  chr12:117532401-117532552
  hypo

SEQ ID NO: 64040 - DNA, 20 bp, Homo sapiens
  chr12:117533167-117533187
  hypo
acgcccggcctagaccttac

SEQ ID NO: 64041 - DNA, 67 bp, Homo sapiens; identical to SEQ ID NO: 43588
  chr12:117544227-117544294
  hypo

SEQ ID NO: 64042 - DNA, 60 bp, Homo sapiens; identical to SEQ ID NO: 43589
  chr12:117563240-117563300
  hypo

SEQ ID NO: 64043 - DNA, 38 bp, Homo sapiens; identical to SEQ ID NO: 43590
  chr12:118177130-118177168
  hypo

SEQ ID NO: 64044 - DNA, 37 bp, Homo sapiens; identical to SEQ ID NO: 43591
  chr12:118198752-118198789
  hypo

SEQ ID NO: 64045 - DNA, 87 bp, Homo sapiens; identical to SEQ ID NO: 43593
  chr12:120148309-120148396
  hypo

SEQ ID NO: 64046 - DNA, 30 bp, Homo sapiens; identical to SEQ ID NO: 43594
  chr12:120152067-120152097
  hypo

SEQ ID NO: 64047 - DNA, 30 bp, Homo sapiens; identical to SEQ ID NO: 15699
  chr12:120574326-120574356
  hypo

SEQ ID NO: 64048 - DNA, 63 bp, Homo sapiens; identical to SEQ ID NO: 43596
  chr12:120580446-120580509
  hypo

SEQ ID NO: 64049 - DNA, 30 bp, Homo sapiens; identical to SEQ ID NO: 43597
  chr12:120740933-120740963
  hypo

SEQ ID NO: 64050 - DNA, 42 bp, Homo sapiens; identical to SEQ ID NO: 43598
  chr12:120932999-120933041
  hypo

SEQ ID NO: 64051 - DNA, 155 bp, Homo sapiens; identical to SEQ ID NO: 43599
  chr12:121366974-121367129
  hypo

SEQ ID NO: 64052 - DNA, 30 bp, Homo sapiens; identical to SEQ ID NO: 43600
  chr12:121641645-121641675
  hypo

SEQ ID NO: 64053 - DNA, 30 bp, Homo sapiens; identical to SEQ ID NO: 43601
  chr12:121688301-121688331
  hypo

SEQ ID NO: 64054 - DNA, 82 bp, Homo sapiens; identical to SEQ ID NO: 43602
  chr12:122107201-122107283
  hypo

SEQ ID NO: 64055 - DNA, 46 bp, Homo sapiens; identical to SEQ ID NO: 15700
  chr12:122141060-122141106
  hypo

SEQ ID NO: 64056 - DNA, 104 bp, Homo sapiens; identical to SEQ ID NO: 43604
  chr12:122204974-122205078
  hypo

SEQ ID NO: 64057 - DNA, 85 bp, Homo sapiens; identical to SEQ ID NO: 43605
  chr12:122213608-122213693
  hypo

SEQ ID NO: 64058 - DNA, 166 bp, Homo sapiens; identical to SEQ ID NO: 43606
  chr12:122281163-122281329
  hypo

SEQ ID NO: 64059 - DNA, 40 bp, Homo sapiens; identical to SEQ ID NO: 24966
  chr12:122285027-122285067
  hypo

SEQ ID NO: 64060 - DNA, 30 bp, Homo sapiens; identical to SEQ ID NO: 15703
  chr12:122292767-122292797
  hypo

SEQ ID NO: 64061 - DNA, 112 bp, Homo sapiens; identical to SEQ ID NO: 43609
  chr12:122439399-122439511
  hypo

SEQ ID NO: 64062 - DNA, 53 bp, Homo sapiens; identical to SEQ ID NO: 43610
  chr12:122458643-122458696
  hypo

SEQ ID NO: 64063 - DNA, 30 bp, Homo sapiens; identical to SEQ ID NO: 43611
  chr12:122591572-122591602
  hypo

SEQ ID NO: 64064 - DNA, 50 bp, Homo sapiens; identical to SEQ ID NO: 43612
  chr12:122602863-122602913
  hypo

SEQ ID NO: 64065 - DNA, 30 bp, Homo sapiens; identical to SEQ ID NO: 15707
  chr12:122622042-122622072
  hypo

SEQ ID NO: 64066 - DNA, 41 bp, Homo sapiens; identical to SEQ ID NO: 43614
  chr12:122622344-122622385
  hypo

SEQ ID NO: 64067 - DNA, 89 bp, Homo sapiens; identical to SEQ ID NO: 43615
  chr12:122623990-122624079
  hypo

SEQ ID NO: 64068 - DNA, 30 bp, Homo sapiens; identical to SEQ ID NO: 43616
  chr12:122691182-122691212
  hypo

SEQ ID NO: 64069 - DNA, 201 bp, Homo sapiens
  chr12:123128928-123129129
  hypo
ggagccagaaaggagatggttttcttcgggagtcgggcggcttcttcgcagcccgggctctcctccgactgcccaggccaaactccgcctcattcccccagtcaatggcctgatggcctgtaggcatgccagtgtctgactatgtgctcttccgccagcgtgctaccctcgatgtcctctcgatgtccagccacctgtgtc

SEQ ID NO: 64070 - DNA, 41 bp, Homo sapiens; identical to SEQ ID NO: 43618
  chr12:123333308-123333349
  hypo

SEQ ID NO: 64071 - DNA, 38 bp, Homo sapiens; identical to SEQ ID NO: 43619
  chr12:123881693-123881731
  hypo

SEQ ID NO: 64072 - DNA, 30 bp, Homo sapiens; identical to SEQ ID NO: 43621
  chr12:124284067-124284097
  hypo

SEQ ID NO: 64073 - DNA, 92 bp, Homo sapiens; identical to SEQ ID NO: 43624
  chr12:124404180-124404272
  hypo

SEQ ID NO: 64074 - DNA, 47 bp, Homo sapiens; identical to SEQ ID NO: 43625
  chr12:124651773-124651820
  hypo

SEQ ID NO: 64075 - DNA, 207 bp, Homo sapiens; identical to SEQ ID NO: 43626
  chr12:124716795-124717002
  hypo

SEQ ID NO: 64076 - DNA, 173 bp, Homo sapiens; identical to SEQ ID NO: 15711
  chr12:124778198-124778371
  hypo

SEQ ID NO: 64077 - DNA, 30 bp, Homo sapiens; identical to SEQ ID NO: 43628
  chr12:124782655-124782685
  hypo

SEQ ID NO: 64078 - DNA, 223 bp, Homo sapiens; identical to SEQ ID NO: 43629
  chr12:124788775-124788998
  hypo

SEQ ID NO: 64079 - DNA, 33 bp, Homo sapiens; identical to SEQ ID NO: 43630
  chr12:124843830-124843863
  hypo

SEQ ID NO: 64080 - DNA, 129 bp, Homo sapiens; identical to SEQ ID NO: 43631
  chr12:124869876-124870005
  hypo

SEQ ID NO: 64081 - DNA, 60 bp, Homo sapiens; identical to SEQ ID NO: 43632
  chr12:124893479-124893539
  hypo

SEQ ID NO: 64082 - DNA, 45 bp, Homo sapiens; identical to SEQ ID NO: 43633
  chr12:124989304-124989349
  hypo

SEQ ID NO: 64083 - DNA, 54 bp, Homo sapiens; identical to SEQ ID NO: 15714
  chr12:125009346-125009400
  hypo

SEQ ID NO: 64084 - DNA, 70 bp, Homo sapiens; identical to SEQ ID NO: 43635
  chr12:125092426-125092496
  hypo

SEQ ID NO: 64085 - DNA, 33 bp, Homo sapiens; identical to SEQ ID NO: 15716
  chr12:125102143-125102176
  hypo

SEQ ID NO: 64086 - DNA, 40 bp, Homo sapiens; identical to SEQ ID NO: 43637
  chr12:125102525-125102565
  hypo

SEQ ID NO: 64087 - DNA, 65 bp, Homo sapiens; identical to SEQ ID NO: 43638
  chr12:125102819-125102884
  hypo

SEQ ID NO: 64088 - DNA, 58 bp, Homo sapiens; identical to SEQ ID NO: 43639
  chr12:125119323-125119381
  hypo

SEQ ID NO: 64089 - DNA, 146 bp, Homo sapiens; identical to SEQ ID NO: 43640
  chr12:125152108-125152254
  hypo

SEQ ID NO: 64090 - DNA, 30 bp, Homo sapiens; identical to SEQ ID NO: 15719
  chr12:125167715-125167745
  hypo

SEQ ID NO: 64091 - DNA, 30 bp, Homo sapiens; identical to SEQ ID NO: 43642
  chr12:125200849-125200879
  hypo

SEQ ID NO: 64092 - DNA, 188 bp, Homo sapiens; identical to SEQ ID NO: 43643
  chr12:125565948-125566136
  hypo

SEQ ID NO: 64093 - DNA, 30 bp, Homo sapiens; identical to SEQ ID NO: 43644
  chr12:125578422-125578452
  hypo

SEQ ID NO: 64094 - DNA, 186 bp, Homo sapiens; identical to SEQ ID NO: 43645
  chr12:125813536-125813722
  hypo

SEQ ID NO: 64095 - DNA, 34 bp, Homo sapiens; identical to SEQ ID NO: 43646
  chr12:125977301-125977335
  hypo

SEQ ID NO: 64096 - DNA, 29 bp, Homo sapiens
  chr12:126243099-126243128
  hypo
tgagccaccgcgcccggctgatgattgtg

SEQ ID NO: 64097 - DNA, 43 bp, Homo sapiens; identical to SEQ ID NO: 43648
  chr12:127051899-127051942
  hypo

SEQ ID NO: 64098 - DNA, 40 bp, Homo sapiens; identical to SEQ ID NO: 43649
  chr12:128310415-128310455
  hypo

SEQ ID NO: 64099 - DNA, 35 bp, Homo sapiens; identical to SEQ ID NO: 15721
  chr12:128311016-128311051
  hypo

SEQ ID NO: 64100 - DNA, 166 bp, Homo sapiens; identical to SEQ ID NO: 43651
  chr12:128899701-128899867
  hypo

SEQ ID NO: 64101 - DNA, 193 bp, Homo sapiens; identical to SEQ ID NO: 43652
  chr12:128964823-128965016
  hypo

SEQ ID NO: 64102 - DNA, 30 bp, Homo sapiens; identical to SEQ ID NO: 43653
  chr12:129028675-129028705
  hypo

SEQ ID NO: 64103 - DNA, 30 bp, Homo sapiens; identical to SEQ ID NO: 43654
  chr12:129441934-129441964
  hypo

SEQ ID NO: 64104 - DNA, 120 bp, Homo sapiens; identical to SEQ ID NO: 43655
  chr12:129520220-129520340
  hypo

SEQ ID NO: 64105 - DNA, 48 bp, Homo sapiens
  chr12:130037778-130037826
  hypo
cactctgccacagtggcccgtggtccctggctgcgtgagtccatcctg

SEQ ID NO: 64106 - DNA, 30 bp, Homo sapiens; identical to SEQ ID NO: 43657
  chr12:130216152-130216182
  hypo

SEQ ID NO: 64107 - DNA, 30 bp, Homo sapiens; identical to SEQ ID NO: 43658
  chr12:130308451-130308481
  hypo

SEQ ID NO: 64108 - DNA, 65 bp, Homo sapiens; identical to SEQ ID NO: 43659
  chr12:130325114-130325179
  hypo

SEQ ID NO: 64109 - DNA, 51 bp, Homo sapiens; identical to SEQ ID NO: 24986
  chr12:130821621-130821672
  hypo

SEQ ID NO: 64110 - DNA, 106 bp, Homo sapiens; identical to SEQ ID NO: 43661
  chr12:130918507-130918613
  hypo

SEQ ID NO: 64111 - DNA, 86 bp, Homo sapiens; identical to SEQ ID NO: 43662
  chr12:130920592-130920678
  hypo

SEQ ID NO: 64112 - DNA, 30 bp, Homo sapiens; identical to SEQ ID NO: 43663
  chr12:130947254-130947284
  hypo

SEQ ID NO: 64113 - DNA, 39 bp, Homo sapiens; identical to SEQ ID NO: 43664
  chr12:131077323-131077362
  hypo

SEQ ID NO: 64114 - DNA, 30 bp, Homo sapiens; identical to SEQ ID NO: 43665
  chr12:131159790-131159820
  hypo

SEQ ID NO: 64115 - DNA, 30 bp, Homo sapiens; identical to SEQ ID NO: 43666
  chr12:131229952-131229982
  hypo

SEQ ID NO: 64116 - DNA, 123 bp, Homo sapiens; identical to SEQ ID NO: 43667
  chr12:131268359-131268482
  hypo

SEQ ID NO: 64117 - DNA, 56 bp, Homo sapiens; identical to SEQ ID NO: 43668
  chr12:131271976-131272032
  hypo

SEQ ID NO: 64118 - DNA, 30 bp, Homo sapiens; identical to SEQ ID NO: 43669
  chr12:131335293-131335323
  hypo

SEQ ID NO: 64119 - DNA, 166 bp, Homo sapiens; identical to SEQ ID NO: 43670
  chr12:131383570-131383736
  hypo

SEQ ID NO: 64120 - DNA, 30 bp, Homo sapiens; identical to SEQ ID NO: 43671
  chr12:131387248-131387278
  hypo

SEQ ID NO: 64121 - DNA, 34 bp, Homo sapiens; identical to SEQ ID NO: 43672
  chr12:131389290-131389324
  hypo

SEQ ID NO: 64122 - DNA, 30 bp, Homo sapiens; identical to SEQ ID NO: 43673
  chr12:131402594-131402624
  hypo

SEQ ID NO: 64123 - DNA, 263 bp, Homo sapiens; identical to SEQ ID NO: 43674
  chr12:131433182-131433445
  hypo

SEQ ID NO: 64124 - DNA, 53 bp, Homo sapiens; identical to SEQ ID NO: 43675
  chr12:131500873-131500926
  hypo

SEQ ID NO: 64125 - DNA, 30 bp, Homo sapiens; identical to SEQ ID NO: 43676
  chr12:131513475-131513505
  hypo

SEQ ID NO: 64126 - DNA, 53 bp, Homo sapiens; identical to SEQ ID NO: 43677
  chr12:131535504-131535557
  hypo

SEQ ID NO: 64127 - DNA, 27 bp, Homo sapiens
  chr12:131547329-131547356
  hypo
atacaagggtcacgtggtaaatatatt

SEQ ID NO: 64128 - DNA, 30 bp, Homo sapiens; identical to SEQ ID NO: 43679
  chr12:131569185-131569215
  hypo

SEQ ID NO: 64129 - DNA, 75 bp, Homo sapiens; identical to SEQ ID NO: 43680
  chr12:131615224-131615299
  hypo

SEQ ID NO: 64130 - DNA, 190 bp, Homo sapiens; identical to SEQ ID NO: 43681
  chr12:131619032-131619222
  hypo

SEQ ID NO: 64131 - DNA, 61 bp, Homo sapiens; identical to SEQ ID NO: 43682
  chr12:131623336-131623397
  hypo

SEQ ID NO: 64132 - DNA, 30 bp, Homo sapiens; identical to SEQ ID NO: 43683
  chr12:131624881-131624911
  hypo

SEQ ID NO: 64133 - DNA, 42 bp, Homo sapiens; identical to SEQ ID NO: 43684
  chr12:131687270-131687312
  hypo

SEQ ID NO: 64134 - DNA, 87 bp, Homo sapiens; identical to SEQ ID NO: 43685
  chr12:131725445-131725532
  hypo

SEQ ID NO: 64135 - DNA, 33 bp, Homo sapiens; identical to SEQ ID NO: 43686
  chr12:131767017-131767050
  hypo

SEQ ID NO: 64136 - DNA, 39 bp, Homo sapiens; identical to SEQ ID NO: 43687
  chr12:131768368-131768407
  hypo

SEQ ID NO: 64137 - DNA, 30 bp, Homo sapiens; identical to SEQ ID NO: 43688
  chr12:131769387-131769417
  hypo

SEQ ID NO: 64138 - DNA, 37 bp, Homo sapiens; identical to SEQ ID NO: 43689
  chr12:131772177-131772214
  hypo

SEQ ID NO: 64139 - DNA, 30 bp, Homo sapiens; identical to SEQ ID NO: 43690
  chr12:131834216-131834246
  hypo

SEQ ID NO: 64140 - DNA, 30 bp, Homo sapiens; identical to SEQ ID NO: 43691
  chr12:131850690-131850720
  hypo

SEQ ID NO: 64141 - DNA, 30 bp, Homo sapiens; identical to SEQ ID NO: 43692
  chr12:131852434-131852464
  hypo

SEQ ID NO: 64142 - DNA, 62 bp, Homo sapiens; identical to SEQ ID NO: 43693
  chr12:131928846-131928908
  hypo

SEQ ID NO: 64143 - DNA, 122 bp, Homo sapiens; identical to SEQ ID NO: 43694
  chr12:131979037-131979159
  hypo

SEQ ID NO: 64144 - DNA, 197 bp, Homo sapiens; identical to SEQ ID NO: 43695
  chr12:132044061-132044258
  hypo

SEQ ID NO: 64145 - DNA, 30 bp, Homo sapiens; identical to SEQ ID NO: 43696
  chr12:132068982-132069012
  hypo

SEQ ID NO: 64146 - DNA, 300 bp, Homo sapiens; identical to SEQ ID NO: 43697
  chr12:132076528-132076828
  hypo

SEQ ID NO: 64147 - DNA, 157 bp, Homo sapiens; identical to SEQ ID NO: 43698
  chr12:132106066-132106223
  hypo

SEQ ID NO: 64148 - DNA, 80 bp, Homo sapiens; identical to SEQ ID NO: 43699
  chr12:132168266-132168346
  hypo

SEQ ID NO: 64149 - DNA, 34 bp, Homo sapiens; identical to SEQ ID NO: 43700
  chr12:132171651-132171685
  hypo

SEQ ID NO: 64150 - DNA, 87 bp, Homo sapiens; identical to SEQ ID NO: 24993
  chr12:132221602-132221689
  hypo

SEQ ID NO: 64151 - DNA, 48 bp, Homo sapiens; identical to SEQ ID NO: 24994
  chr12:132222076-132222124
  hypo

SEQ ID NO: 64152 - DNA, 62 bp, Homo sapiens; identical to SEQ ID NO: 43702
  chr12:132240207-132240269
  hypo

SEQ ID NO: 64153 - DNA, 21 bp, Homo sapiens
  chr12:132244054-132244075
  hypo
aaatagtaggccgggcgcggt

SEQ ID NO: 64154 - DNA, 30 bp, Homo sapiens; identical to SEQ ID NO: 43704
  chr12:132279981-132280011
  hypo

SEQ ID NO: 64155 - DNA, 133 bp, Homo sapiens; identical to SEQ ID NO: 15732
  chr12:132280877-132281010
  hypo

SEQ ID NO: 64156 - DNA, 82 bp, Homo sapiens; identical to SEQ ID NO: 43706
  chr12:132284411-132284493
  hypo

SEQ ID NO: 64157 - DNA, 104 bp, Homo sapiens; identical to SEQ ID NO: 43707
  chr12:132325069-132325173
  hypo

SEQ ID NO: 64158 - DNA, 84 bp, Homo sapiens; identical to SEQ ID NO: 43708
  chr12:132329560-132329644
  hypo

SEQ ID NO: 64159 - DNA, 166 bp, Homo sapiens; identical to SEQ ID NO: 43709
  chr12:132329877-132330043
  hypo

SEQ ID NO: 64160 - DNA, 36 bp, Homo sapiens
  chr12:132333398-132333434
  hypo
ggacgctgctatgagcgtgagtgtgcaaacgtctct

SEQ ID NO: 64161 - DNA, 70 bp, Homo sapiens
  chr12:132333597-132333667
  hypo
catatcctcccgacacaggtgactttccacgttcttgacagtgggggcgagggggcgtctcattgtggtt

SEQ ID NO: 64162 - DNA, 80 bp, Homo sapiens; identical to SEQ ID NO: 43712
  chr12:132335471-132335551
  hypo

SEQ ID NO: 64163 - DNA, 62 bp, Homo sapiens
  chr12:132348589-132348651
  hypo
accctggctgtctgtcgggcagccccggcgaggagttgagtccccttaccgctgcgaatgag

SEQ ID NO: 64164 - DNA, 42 bp, Homo sapiens; identical to SEQ ID NO: 43714
  chr12:132349937-132349979
  hypo

SEQ ID NO: 64165 - DNA, 109 bp, Homo sapiens; identical to SEQ ID NO: 43715
  chr12:132377954-132378063
  hypo

SEQ ID NO: 64166 - DNA, 37 bp, Homo sapiens; identical to SEQ ID NO: 43716
  chr12:132415173-132415210
  hypo

SEQ ID NO: 64167 - DNA, 37 bp, Homo sapiens; identical to SEQ ID NO: 43717
  chr12:132415270-132415307
  hypo

SEQ ID NO: 64168 - DNA, 238 bp, Homo sapiens; identical to SEQ ID NO: 43719
  chr12:132617211-132617449
  hypo

SEQ ID NO: 64169 - DNA, 30 bp, Homo sapiens; identical to SEQ ID NO: 43720
  chr12:132617675-132617705
  hypo

SEQ ID NO: 64170 - DNA, 134 bp, Homo sapiens; identical to SEQ ID NO: 43721
  chr12:132643874-132644008
  hypo

SEQ ID NO: 64171 - DNA, 30 bp, Homo sapiens; identical to SEQ ID NO: 43722
  chr12:132648490-132648520
  hypo

SEQ ID NO: 64172 - DNA, 161 bp, Homo sapiens; identical to SEQ ID NO: 43723
  chr12:132653008-132653169
  hypo

SEQ ID NO: 64173 - DNA, 44 bp, Homo sapiens; identical to SEQ ID NO: 43724
  chr12:132666377-132666421
  hypo

SEQ ID NO: 64174 - DNA, 84 bp, Homo sapiens; identical to SEQ ID NO: 43725
  chr12:132682582-132682666
  hypo

SEQ ID NO: 64175 - DNA, 288 bp, Homo sapiens; identical to SEQ ID NO: 43726
  chr12:132687989-132688277
  hypo

SEQ ID NO: 64176 - DNA, 23 bp, Homo sapiens
  chr12:132691177-132691200
  hypo
cgagactccgtctcaaaaaaaaa

SEQ ID NO: 64177 - DNA, 41 bp, Homo sapiens; identical to SEQ ID NO: 43728
  chr12:132694981-132695022
  hypo

SEQ ID NO: 64178 - DNA, 115 bp, Homo sapiens; identical to SEQ ID NO: 43729
  chr12:132983629-132983744
  hypo

SEQ ID NO: 64179 - DNA, 48 bp, Homo sapiens; identical to SEQ ID NO: 43730
  chr12:132985665-132985713
  hypo

SEQ ID NO: 64180 - DNA, 44 bp, Homo sapiens
  chr12:132986451-132986495
  hypo
acccagagctgccaccgtcctgtgggtgacggcagaacatctgg

SEQ ID NO: 64181 - DNA, 75 bp, Homo sapiens
  chr12:132986581-132986656
  hypo
agggagcggagccgggaaggccacggacatctgtgtggtgtcacgaacaaggtccggccacgtgtgtgggagacg

SEQ ID NO: 64182 - DNA, 45 bp, Homo sapiens; identical to SEQ ID NO: 43732
  chr12:132987467-132987512
  hypo

SEQ ID NO: 64183 - DNA, 60 bp, Homo sapiens; identical to SEQ ID NO: 43734
  chr12:133003308-133003368
  hypo

SEQ ID NO: 64184 - DNA, 17 bp, Homo sapiens
  chr12:133019687-133019704
  hypo
cccgaaaaaaaaaaaac

SEQ ID NO: 64185 - DNA, 190 bp, Homo sapiens; identical to SEQ ID NO: 43736
  chr12:133035657-133035847
  hypo

SEQ ID NO: 64186 - DNA, 58 bp, Homo sapiens; identical to SEQ ID NO: 43737
  chr12:133060930-133060988
  hypo

SEQ ID NO: 64187 - DNA, 46 bp, Homo sapiens; identical to SEQ ID NO: 43738
  chr12:133100409-133100455
  hypo

SEQ ID NO: 64188 - DNA, 30 bp, Homo sapiens; identical to SEQ ID NO: 15744
  chr12:133100990-133101020
  hypo

SEQ ID NO: 64189 - DNA, 30 bp, Homo sapiens; identical to SEQ ID NO: 15745
  chr12:133122176-133122206
  hypo

SEQ ID NO: 64190 - DNA, 30 bp, Homo sapiens; identical to SEQ ID NO: 43741
  chr12:133167902-133167932
  hypo

SEQ ID NO: 64191 - DNA, 256 bp, Homo sapiens; identical to SEQ ID NO: 43742
  chr12:133169847-133170103
  hypo

SEQ ID NO: 64192 - DNA, 102 bp, Homo sapiens; identical to SEQ ID NO: 15747
  chr12:133188357-133188459
  hypo

SEQ ID NO: 64193 - DNA, 30 bp, Homo sapiens; identical to SEQ ID NO: 43744
  chr12:133199671-133199701
  hypo

SEQ ID NO: 64194 - DNA, 43 bp, Homo sapiens; identical to SEQ ID NO: 43745
  chr12:133200007-133200050
  hypo

SEQ ID NO: 64195 - DNA, 79 bp, Homo sapiens; identical to SEQ ID NO: 43747
  chr12:133705743-133705822
  hypo

SEQ ID NO: 64196 - DNA, 162 bp, Homo sapiens; identical to SEQ ID NO: 43748
  chr13:19517741-19517903
  hypo

SEQ ID NO: 64197 - DNA, 101 bp, Homo sapiens; identical to SEQ ID NO: 43749
  chr13:20078200-20078301
  hypo

SEQ ID NO: 64198 - DNA, 87 bp, Homo sapiens; identical to SEQ ID NO: 43750
  chr13:20392358-20392445
  hypo

SEQ ID NO: 64199 - DNA, 27 bp, Homo sapiens
  chr13:20692250-20692277
  hypo
cgtgagccactgcgcctggccacattt

SEQ ID NO: 64200 - DNA, 165 bp, Homo sapiens; identical to SEQ ID NO: 43752
  chr13:21057336-21057501
  hypo

SEQ ID NO: 64201 - DNA, 30 bp, Homo sapiens; identical to SEQ ID NO: 43753
  chr13:21711382-21711412
  hypo

SEQ ID NO: 64202 - DNA, 23 bp, Homo sapiens
  chr13:22049000-22049023
  hypo
tttttttttttgagacggagtct

SEQ ID NO: 64203 - DNA, 30 bp, Homo sapiens; identical to SEQ ID NO: 43755
  chr13:22336937-22336967
  hypo

SEQ ID NO: 64204 - DNA, 30 bp, Homo sapiens; identical to SEQ ID NO: 43756
  chr13:22391874-22391904
  hypo

SEQ ID NO: 64205 - DNA, 30 bp, Homo sapiens; identical to SEQ ID NO: 43757
  chr13:23717527-23717557
  hypo

SEQ ID NO: 64206 - DNA, 92 bp, Homo sapiens; identical to SEQ ID NO: 43758
  chr13:23896875-23896967
  hypo

SEQ ID NO: 64207 - DNA, 62 bp, Homo sapiens; identical to SEQ ID NO: 43759
  chr13:24289608-24289670
  hypo

SEQ ID NO: 64208 - DNA, 30 bp, Homo sapiens; identical to SEQ ID NO: 43760
  chr13:25561078-25561108
  hypo

SEQ ID NO: 64209 - DNA, 27 bp, Homo sapiens
  chr13:25668696-25668723
  hypo
ctactctaggctaggcgcggcggctca

SEQ ID NO: 64210 - DNA, 71 bp, Homo sapiens; identical to SEQ ID NO: 15753
  chr13:25670585-25670656
  hypo

SEQ ID NO: 64211 - DNA, 30 bp, Homo sapiens; identical to SEQ ID NO: 43763
  chr13:27278150-27278180
  hypo

SEQ ID NO: 64212 - DNA, 84 bp, Homo sapiens; identical to SEQ ID NO: 43765
  chr13:29914132-29914216
  hypo

SEQ ID NO: 64213 - DNA, 30 bp, Homo sapiens; identical to SEQ ID NO: 43766
  chr13:29933609-29933639
  hypo

SEQ ID NO: 64214 - DNA, 19 bp, Homo sapiens
  chr13:30031261-30031280
  hypo
acagcgagactccattcaa

SEQ ID NO: 64215 - DNA, 57 bp, Homo sapiens; identical to SEQ ID NO: 43768
  chr13:30107065-30107122
  hypo

SEQ ID NO: 64216 - DNA, 41 bp, Homo sapiens; identical to SEQ ID NO: 43769
  chr13:30123237-30123278
  hypo

SEQ ID NO: 64217 - DNA, 36 bp, Homo sapiens; identical to SEQ ID NO: 43770
  chr13:30149052-30149088
  hypo

SEQ ID NO: 64218 - DNA, 64 bp, Homo sapiens; identical to SEQ ID NO: 43771
  chr13:30574503-30574567
  hypo

SEQ ID NO: 64219 - DNA, 26 bp, Homo sapiens
  chr13:30707178-30707204
  hypo
aggtccaggccatagcgacggggacc

SEQ ID NO: 64220 - DNA, 117 bp, Homo sapiens; identical to SEQ ID NO: 43773
  chr13:30707244-30707361
  hypo

SEQ ID NO: 64221 - DNA, 186 bp, Homo sapiens; identical to SEQ ID NO: 43775
  chr13:30761001-30761187
  hypo

SEQ ID NO: 64222 - DNA, 36 bp, Homo sapiens
  chr13:31742917-31742953
  hypo
cccaggcagataacccgccggctggtgcctcccaac

SEQ ID NO: 64223 - DNA, 89 bp, Homo sapiens; identical to SEQ ID NO: 43777
  chr13:31821217-31821306
  hypo

SEQ ID NO: 64224 - DNA, 21 bp, Homo sapiens
  chr13:32244681-32244702
  hypo
acaggctaggctgggcgcggt

SEQ ID NO: 64225 - DNA, 30 bp, Homo sapiens; identical to SEQ ID NO: 43779
  chr13:32670558-32670588
  hypo

SEQ ID NO: 64226 - DNA, 30 bp, Homo sapiens; identical to SEQ ID NO: 43780
  chr13:33113918-33113948
  hypo

SEQ ID NO: 64227 - DNA, 29 bp, Homo sapiens
  chr13:36883103-36883132
  hypo
aggtgtggtggctcacgcctgtaatccca

SEQ ID NO: 64228 - DNA, 270 bp, Homo sapiens
  chr13:37643672-37643942
  hypo
gtcccctgtgccccacgtcccggaagcaacctcctgtgctgcccccaaactcatgcagccaggtgggacccgaccctaggcccggagctttcatcactcgggactctggccccacactgctgctctcacccacgcactgctgctgtggggagggcgtggggaggaggcggagctgggcccggggctgtgccacgcttcacgcttcacggaaccagcgggagccaaggacaagcaggagccgccccgcagccccttgggggccgccgctat

SEQ ID NO: 64229 - DNA, 30 bp, Homo sapiens; identical to SEQ ID NO: 43783
  chr13:40020880-40020910
  hypo

SEQ ID NO: 64230 - DNA, 32 bp, Homo sapiens; identical to SEQ ID NO: 43784
  chr13:41103319-41103351
  hypo

SEQ ID NO: 64231 - DNA, 53 bp, Homo sapiens; identical to SEQ ID NO: 15760
  chr13:41681520-41681573
  hypo

SEQ ID NO: 64232 - DNA, 30 bp, Homo sapiens; identical to SEQ ID NO: 43786
  chr13:41705935-41705965
  hypo

SEQ ID NO: 64233 - DNA, 181 bp, Homo sapiens; identical to SEQ ID NO: 43787
  chr13:42540722-42540903
  hypo

SEQ ID NO: 64234 - DNA, 30 bp, Homo sapiens; identical to SEQ ID NO: 43788
  chr13:43543197-43543227
  hypo

SEQ ID NO: 64235 - DNA, 108 bp, Homo sapiens; identical to SEQ ID NO: 43789
  chr13:43986042-43986150
  hypo

SEQ ID NO: 64236 - DNA, 30 bp, Homo sapiens; identical to SEQ ID NO: 43790
  chr13:45165574-45165604
  hypo

SEQ ID NO: 64237 - DNA, 17 bp, Homo sapiens
  chr13:45562261-45562278
  hypo
ctgcactacctggcccg

SEQ ID NO: 64238 - DNA, 229 bp, Homo sapiens; identical to SEQ ID NO: 43792
  chr13:45564574-45564803
  hypo

SEQ ID NO: 64239 - DNA, 30 bp, Homo sapiens; identical to SEQ ID NO: 43794
  chr13:45939250-45939280
  hypo

SEQ ID NO: 64240 - DNA, 34 bp, Homo sapiens; identical to SEQ ID NO: 43795
  chr13:45950905-45950939
  hypo

SEQ ID NO: 64241 - DNA, 85 bp, Homo sapiens; identical to SEQ ID NO: 43796
  chr13:46659255-46659340
  hypo

SEQ ID NO: 64242 - DNA, 120 bp, Homo sapiens; identical to SEQ ID NO: 43797
  chr13:46660682-46660802
  hypo

SEQ ID NO: 64243 - DNA, 75 bp, Homo sapiens; identical to SEQ ID NO: 43798
  chr13:46661292-46661367
  hypo

SEQ ID NO: 64244 - DNA, 172 bp, Homo sapiens; identical to SEQ ID NO: 15765
  chr13:46920144-46920316
  hypo

SEQ ID NO: 64245 - DNA, 142 bp, Homo sapiens; identical to SEQ ID NO: 43800
  chr13:47528522-47528664
  hypo

SEQ ID NO: 64246 - DNA, 63 bp, Homo sapiens; identical to SEQ ID NO: 43802
  chr13:49922188-49922251
  hypo

SEQ ID NO: 64247 - DNA, 49 bp, Homo sapiens; identical to SEQ ID NO: 43803
  chr13:49923030-49923079
  hypo

SEQ ID NO: 64248 - DNA, 19 bp, Homo sapiens
  chr13:50367846-50367865
  hypo
agagctgctttcggccggg

SEQ ID NO: 64249 - DNA, 75 bp, Homo sapiens; identical to SEQ ID NO: 43805
  chr13:52532595-52532670
  hypo

SEQ ID NO: 64250 - DNA, 36 bp, Homo sapiens; identical to SEQ ID NO: 43806
  chr13:53025686-53025722
  hypo

SEQ ID NO: 64251 - DNA, 17 bp, Homo sapiens
  chr13:53580919-53580936
  hypo
ggcgtgagccaccgcgc

SEQ ID NO: 64252 - DNA, 30 bp, Homo sapiens; identical to SEQ ID NO: 43808
  chr13:56180149-56180179
  hypo

SEQ ID NO: 64253 - DNA, 30 bp, Homo sapiens; identical to SEQ ID NO: 43809
  chr13:60614880-60614910
  hypo

SEQ ID NO: 64254 - DNA, 31 bp, Homo sapiens; identical to SEQ ID NO: 43810
  chr13:64311606-64311637
  hypo

SEQ ID NO: 64255 - DNA, 30 bp, Homo sapiens; identical to SEQ ID NO: 43811
  chr13:65904937-65904967
  hypo

SEQ ID NO: 64256 - DNA, 51 bp, Homo sapiens; identical to SEQ ID NO: 43812
  chr13:68343951-68344002
  hypo

SEQ ID NO: 64257 - DNA, 30 bp, Homo sapiens; identical to SEQ ID NO: 43813
  chr13:74987640-74987670
  hypo

SEQ ID NO: 64258 - DNA, 28 bp, Homo sapiens
  chr13:77553713-77553741
  hypo
gggcgcggtgactcacgactgtaagtcg

SEQ ID NO: 64259 - DNA, 44 bp, Homo sapiens; identical to SEQ ID NO: 43815
  chr13:78081890-78081934
  hypo

SEQ ID NO: 64260 - DNA, 16 bp, Homo sapiens
  chr13:78567988-78568004
  hypo
gcgcctggcatgtagt

SEQ ID NO: 64261 - DNA, 30 bp, Homo sapiens; identical to SEQ ID NO: 43818
  chr13:95711256-95711286
  hypo

SEQ ID NO: 64262 - DNA, 50 bp, Homo sapiens; identical to SEQ ID NO: 43819
  chr13:95718425-95718475
  hypo

SEQ ID NO: 64263 - DNA, 37 bp, Homo sapiens; identical to SEQ ID NO: 43820
  chr13:95858839-95858876
  hypo

SEQ ID NO: 64264 - DNA, 30 bp, Homo sapiens; identical to SEQ ID NO: 43821
  chr13:95888816-95888846
  hypo

SEQ ID NO: 64265 - DNA, 66 bp, Homo sapiens; identical to SEQ ID NO: 43823
  chr13:96409578-96409644
  hypo

SEQ ID NO: 64266 - DNA, 18 bp, Homo sapiens
  chr13:97599727-97599745
  hypo
tctcgcctcactgcaacc

SEQ ID NO: 64267 - DNA, 16 bp, Homo sapiens
  chr13:98426774-98426790
  hypo
tgcctgatctcagctc

SEQ ID NO: 64268 - DNA, 30 bp, Homo sapiens; identical to SEQ ID NO: 43826
  chr13:98866341-98866371
  hypo

SEQ ID NO: 64269 - DNA, 30 bp, Homo sapiens; identical to SEQ ID NO: 43827
  chr13:99083172-99083202
  hypo

SEQ ID NO: 64270 - DNA, 42 bp, Homo sapiens; identical to SEQ ID NO: 43828
  chr13:99083425-99083467
  hypo

SEQ ID NO: 64271 - DNA, 30 bp, Homo sapiens; identical to SEQ ID NO: 43829
  chr13:99189615-99189645
  hypo

SEQ ID NO: 64272 - DNA, 30 bp, Homo sapiens; identical to SEQ ID NO: 43830
  chr13:99428706-99428736
  hypo

SEQ ID NO: 64273 - DNA, 30 bp, Homo sapiens; identical to SEQ ID NO: 43831
  chr13:100095884-100095914
  hypo

SEQ ID NO: 64274 - DNA, 37 bp, Homo sapiens; identical to SEQ ID NO: 43832
  chr13:100146505-100146542
  hypo

SEQ ID NO: 64275 - DNA, 81 bp, Homo sapiens; identical to SEQ ID NO: 15770
  chr13:100356871-100356952
  hypo

SEQ ID NO: 64276 - DNA, 276 bp, Homo sapiens; identical to SEQ ID NO: 43834
  chr13:100575337-100575613
  hypo

SEQ ID NO: 64277 - DNA, 30 bp, Homo sapiens; identical to SEQ ID NO: 43835
  chr13:100583792-100583822
  hypo

SEQ ID NO: 64278 - DNA, 30 bp, Homo sapiens; identical to SEQ ID NO: 43836
  chr13:102206088-102206118
  hypo

SEQ ID NO: 64279 - DNA, 30 bp, Homo sapiens; identical to SEQ ID NO: 43837
  chr13:102385630-102385660
  hypo

SEQ ID NO: 64280 - DNA, 27 bp, Homo sapiens
  chr13:103569166-103569193
  hypo
ccggccgtcccccgttaatcttactcc

SEQ ID NO: 64281 - DNA, 143 bp, Homo sapiens; identical to SEQ ID NO: 43839
  chr13:108218849-108218992
  hypo

SEQ ID NO: 64282 - DNA, 24 bp, Homo sapiens
  chr13:110053866-110053890
  hypo
tacctgagattcaatcgctgaggc

SEQ ID NO: 64283 - DNA, 72 bp, Homo sapiens
  chr13:110434379-110434451
  hypo
cctcctcacctttcacgatggtggcctccttcaagtggtgggacaagaagtcaatgctggcgtaggtgttgg

SEQ ID NO: 64284 - DNA, 1851 bp, Homo sapiens
  chr13:110434593-110436444
  hypo
ctgcggctggggtggcagcccgggctcctccctcacgtcgatggcgatgtagttgagaccattctggaagccggcagaggtctctctgcgcatgggcgatccaccgctcccaggacaaccgaccaagcccccgggctgacccggggtccacggccggccctgcggtgccaaagggggcgccggctgcaactgtcgtggggaggtgggcggctcgtcgccccctccagggccgacacccacgccgccctcgctgcttttcctgagagagacattttccacggaggccgagttgtggcgcttggggttgtgggcgaaggacggggacacgggggtgaccgtcgtggtggaggagaaggtctcggaactgtggcggcggcggcccccctgcgggtctgcgcggatgaccttggcgccgcggtgggggtccgggggctggctggcctgcaggaaggcctcgactcccgacacctgctccatgaggctcagcctcttcacgcccgacgtcgggctggccacgcgggcagcttctggcttcgggggggccgcgataggttgcggcggggtggcggccacaccaaaagccatctcggtgtagtcaccattgtccccggtgtccgaggacaacgatgaggcggcgcccgggccctgggcggtggcaacggccgaggcggggggcaggcggtacagctcccccggggccggcggcggtggcggcggctgcagagacgacgacggggacgcggacggacgcgggggcaacggcggatacggggaggaggcctcgggggacaggaggccgtccaaggagcccacggggtggccgctcggggcgcccggcttaggagacttgggggagctgaagtcgaggttcatgtagtcggagagcggagaccgctgccggctgtcgctgctggtgcccggggtgcctgagcccagcgacgaggccgggctgctggcggacaagagcgaggaggacgaggccgccgacgccagcaggggaggcgcgggcggcgacaggcgggccccgggctcgccaaagtcgatgttgatgtactcgccggggctcttgggctccggtggcagtgggtactcgtgcatgctgggcaggctgggcagcccctccagggacaggcgcgtgggcctcaccgcccggccgcgctggcccaagaagccctccgggcggccgccgctaggccgcacgggcgaaggcactacagggtgagggggctgcgtggggccggccccgaaggcgctggccgcctggctgggccctggcgtggcctgaggctccagacgctcctcctccaggatgcgccccacgggggagctcatgagcacgtactggtcgctgtccccgccacaggtgtagggggccttgtaggagcggggcaaggagctgtagcagcagccgggaacgcccctgagcggctccccgccggggtgcagggctgcggagaagaagtcgggcggggtgcccgtggtgaccgcgtcgctgggggacacgttgaggtagtccccgttgggcagcagcttgccatctgcatgctccatggacagcttggaaccgcaccacatgcgcatgtacccactgtcctcgggggagctctcggcgggcgagctggccttgtagccgcccccgctcgccgggaatgtcctgcccgccgcagaggtgggtgctggccccgcaggccccgcagaaggcacggcggcggcggcggcggcggcggccctgggctgcaagatctgcttgggggcggacacgctggcggggctcatgggcatgtagtcgtcgctcctgcagctgccgctcccactgcccgcgagggccgcgccgggcgtcatgggcatgta

SEQ ID NO: 64285 - DNA, 30 bp, Homo sapiens; identical to SEQ ID NO: 43842
  chr13:110659714-110659744
  hypo

SEQ ID NO: 64286 - DNA, 77 bp, Homo sapiens; identical to SEQ ID NO: 43843
  chr13:110998830-110998907
  hypo

SEQ ID NO: 64287 - DNA, 149 bp, Homo sapiens; identical to SEQ ID NO: 43844
  chr13:111144888-111145037
  hypo

SEQ ID NO: 64288 - DNA, 496 bp, Homo sapiens; identical to SEQ ID NO: 43845
  chr13:111277129-111277625
  hypo

SEQ ID NO: 64289 - DNA, 56 bp, Homo sapiens; identical to SEQ ID NO: 15777
  chr13:111289222-111289278
  hypo

SEQ ID NO: 64290 - DNA, 31 bp, Homo sapiens; identical to SEQ ID NO: 43849
  chr13:111704359-111704390
  hypo

SEQ ID NO: 64291 - DNA, 30 bp, Homo sapiens; identical to SEQ ID NO: 43850
  chr13:111764740-111764770
  hypo

SEQ ID NO: 64292 - DNA, 234 bp, Homo sapiens; identical to SEQ ID NO: 43851
  chr13:111978711-111978945
  hypo

SEQ ID NO: 64293 - DNA, 30 bp, Homo sapiens; identical to SEQ ID NO: 43852
  chr13:112062748-112062778
  hypo

SEQ ID NO: 64294 - DNA, 56 bp, Homo sapiens; identical to SEQ ID NO: 43853
  chr13:112078451-112078507
  hypo

SEQ ID NO: 64295 - DNA, 30 bp, Homo sapiens; identical to SEQ ID NO: 43854
  chr13:112090544-112090574
  hypo

SEQ ID NO: 64296 - DNA, 30 bp, Homo sapiens; identical to SEQ ID NO: 43855
  chr13:112243149-112243179
  hypo

SEQ ID NO: 64297 - DNA, 68 bp, Homo sapiens; identical to SEQ ID NO: 43857
  chr13:112274715-112274783
  hypo

SEQ ID NO: 64298 - DNA, 30 bp, Homo sapiens; identical to SEQ ID NO: 43858
  chr13:112320732-112320762
  hypo

SEQ ID NO: 64299 - DNA, 41 bp, Homo sapiens; identical to SEQ ID NO: 43859
  chr13:112559680-112559721
  hypo

SEQ ID NO: 64300 - DNA, 30 bp, Homo sapiens; identical to SEQ ID NO: 43860
  chr13:112573448-112573478
  hypo

SEQ ID NO: 64301 - DNA, 35 bp, Homo sapiens; identical to SEQ ID NO: 43861
  chr13:112573696-112573731
  hypo

SEQ ID NO: 64302 - DNA, 30 bp, Homo sapiens; identical to SEQ ID NO: 43862
  chr13:112618950-112618980
  hypo

SEQ ID NO: 64303 - DNA, 38 bp, Homo sapiens; identical to SEQ ID NO: 43863
  chr13:112682862-112682900
  hypo

SEQ ID NO: 64304 - DNA, 50 bp, Homo sapiens; identical to SEQ ID NO: 43864
  chr13:112690800-112690850
  hypo

SEQ ID NO: 64305 - DNA, 30 bp, Homo sapiens; identical to SEQ ID NO: 43865
  chr13:112800543-112800573
  hypo

SEQ ID NO: 64306 - DNA, 41 bp, Homo sapiens; identical to SEQ ID NO: 43866
  chr13:112830483-112830524
  hypo

SEQ ID NO: 64307 - DNA, 32 bp, Homo sapiens; identical to SEQ ID NO: 43867
  chr13:112882268-112882300
  hypo

SEQ ID NO: 64308 - DNA, 32 bp, Homo sapiens; identical to SEQ ID NO: 43868
  chr13:112882360-112882392
  hypo

SEQ ID NO: 64309 - DNA, 42 bp, Homo sapiens; identical to SEQ ID NO: 43869
  chr13:113099281-113099323
  hypo

SEQ ID NO: 64310 - DNA, 73 bp, Homo sapiens; identical to SEQ ID NO: 43870
  chr13:113107030-113107103
  hypo

SEQ ID NO: 64311 - DNA, 30 bp, Homo sapiens; identical to SEQ ID NO: 43871
  chr13:113319347-113319377
  hypo

SEQ ID NO: 64312 - DNA, 210 bp, Homo sapiens; identical to SEQ ID NO: 43872
  chr13:113400400-113400610
  hypo

SEQ ID NO: 64313 - DNA, 39 bp, Homo sapiens; identical to SEQ ID NO: 43873
  chr13:113401430-113401469
  hypo

SEQ ID NO: 64314 - DNA, 30 bp, Homo sapiens; identical to SEQ ID NO: 43874
  chr13:113424905-113424935
  hypo

SEQ ID NO: 64315 - DNA, 55 bp, Homo sapiens; identical to SEQ ID NO: 25040
  chr13:113598563-113598618
  hypo

SEQ ID NO: 64316 - DNA, 30 bp, Homo sapiens; identical to SEQ ID NO: 43876
  chr13:113608292-113608322
  hypo

SEQ ID NO: 64317 - DNA, 79 bp, Homo sapiens; identical to SEQ ID NO: 43877
  chr13:113648553-113648632
  hypo

SEQ ID NO: 64318 - DNA, 44 bp, Homo sapiens; identical to SEQ ID NO: 43878
  chr13:113763552-113763596
  hypo

SEQ ID NO: 64319 - DNA, 42 bp, Homo sapiens; identical to SEQ ID NO: 43879
  chr13:113776004-113776046
  hypo

SEQ ID NO: 64320 - DNA, 25 bp, Homo sapiens
  chr13:114055958-114055983
  hypo
gggagctgtggggaccggcccccca

SEQ ID NO: 64321 - DNA, 3 bp, Homo sapiens
  chr13:114056137-114056140
  hypo
gct

SEQ ID NO: 64322 - DNA, 30 bp, Homo sapiens; identical to SEQ ID NO: 43882
  chr13:114059583-114059613
  hypo

SEQ ID NO: 64323 - DNA, 78 bp, Homo sapiens
  chr13:114059986-114060064
  hypo
cctctgggtgctggacgagggccacgcctctcaggaggctcctccctgctgctccactcttgggctccaaggatcccc

SEQ ID NO: 64324 - DNA, 132 bp, Homo sapiens
  chr13:114060333-114060465
  hypo
gtgatttcctcggcagccttcaggggctgagaagactctattagcagcggccttctgcattcctccagcgcaccgggcactgtcatgcccatcggggtgacaccctcaggccccgtacgccccttggatgat

SEQ ID NO: 64325 - DNA, 106 bp, Homo sapiens; identical to SEQ ID NO: 43884
  chr13:114060775-114060881
  hypo

SEQ ID NO: 64326 - DNA, 33 bp, Homo sapiens; identical to SEQ ID NO: 43885
  chr13:114064741-114064774
  hypo

SEQ ID NO: 64327 - DNA, 194 bp, Homo sapiens; identical to SEQ ID NO: 25043
  chr13:114074574-114074768
  hypo

SEQ ID NO: 64328 - DNA, 436 bp, Homo sapiens
  chr13:114074853-114075289
  hypo
gggtttcttttcctgaaaggtaattctcagttaatttccccacacccacgggtgctgggaccacactccatggacgtgtgtgacgtgaggcccttcgcccccgtgtgcctgtctctctggttcttctgacttaaagcaccagtagcagcacagttagtccagttattcggaagctcagcacggagccacattgctgcagcatagaaggccacggattcctccatcagcatggactacacttcccacaaaacgaacggggcatctctatggaaaaagcaaagcgtgtccctatccctgggacacctctacccctgggacacacctagccccaggacccgcccacccccgggacccgctcaccccgggacaccactacccctgggacatgcccacccctgggacaaccctaccccccccgacacgccctgggacacgc

SEQ ID NO: 64329 - DNA, 30 bp, Homo sapiens; identical to SEQ ID NO: 43887
  chr13:114108109-114108139
  hypo

SEQ ID NO: 64330 - DNA, 43 bp, Homo sapiens; identical to SEQ ID NO: 15787
  chr13:114122929-114122972
  hypo

SEQ ID NO: 64331 - DNA, 86 bp, Homo sapiens; identical to SEQ ID NO: 15788
  chr13:114188403-114188489
  hypo

SEQ ID NO: 64332 - DNA, 30 bp, Homo sapiens; identical to SEQ ID NO: 43890
  chr13:114189602-114189632
  hypo

SEQ ID NO: 64333 - DNA, 57 bp, Homo sapiens; identical to SEQ ID NO: 43891
  chr13:114220577-114220634
  hypo

SEQ ID NO: 64334 - DNA, 12 bp, Homo sapiens
  chr13:114221652-114221664
  hypo
aacatgttctct

SEQ ID NO: 64335 - DNA, 62 bp, Homo sapiens; identical to SEQ ID NO: 43893
  chr13:114271940-114272002
  hypo

SEQ ID NO: 64336 - DNA, 30 bp, Homo sapiens; identical to SEQ ID NO: 43894
  chr13:114285192-114285222
  hypo

SEQ ID NO: 64337 - DNA, 30 bp, Homo sapiens; identical to SEQ ID NO: 43895
  chr13:114285597-114285627
  hypo

SEQ ID NO: 64338 - DNA, 53 bp, Homo sapiens; identical to SEQ ID NO: 43897
  chr13:114312349-114312402
  hypo

SEQ ID NO: 64339 - DNA, 30 bp, Homo sapiens; identical to SEQ ID NO: 43898
  chr13:114318203-114318233
  hypo

SEQ ID NO: 64340 - DNA, 30 bp, Homo sapiens; identical to SEQ ID NO: 43899
  chr13:114426896-114426926
  hypo

SEQ ID NO: 64341 - DNA, 46 bp, Homo sapiens; identical to SEQ ID NO: 43900
  chr13:114450608-114450654
  hypo

SEQ ID NO: 64342 - DNA, 22 bp, Homo sapiens
  chr13:114454880-114454902
  hypo
cagttgtgccagctccgtggct

SEQ ID NO: 64343 - DNA, 21 bp, Homo sapiens
  chr13:114479383-114479404
  hypo
cgcacctctcttctgcgggcg

SEQ ID NO: 64344 - DNA, 8 bp, Homo sapiens
  chr13:114479434-114479442
  hypo
tacgtcca

SEQ ID NO: 64345 - DNA, 30 bp, Homo sapiens; identical to SEQ ID NO: 43903
  chr13:114497409-114497439
  hypo

SEQ ID NO: 64346 - DNA, 173 bp, Homo sapiens
  chr13:114497844-114498017
  hypo
gttgcttctcagaggcgcgtgccgagggcccggggatggcaacgcccttccgtgcagaaggcgcctgggtgggtcttgcggaatagacgcgtgaggacgacccgcagggtggagtccggcctggccagggctggaagtcataggacgaaaggtagaggtgagaagaggcagtt

SEQ ID NO: 64347 - DNA, 18 bp, Homo sapiens
  chr13:114498260-114498278
  hypo
cgacgtgaaaaaagtaca

SEQ ID NO: 64348 - DNA, 175 bp, Homo sapiens; identical to SEQ ID NO: 43905
  chr13:114502787-114502962
  hypo

SEQ ID NO: 64349 - DNA, 45 bp, Homo sapiens; identical to SEQ ID NO: 43906
  chr13:114506372-114506417
  hypo

SEQ ID NO: 64350 - DNA, 123 bp, Homo sapiens; identical to SEQ ID NO: 43907
  chr13:114526487-114526610
  hypo

SEQ ID NO: 64351 - DNA, 154 bp, Homo sapiens; identical to SEQ ID NO: 43908
  chr13:114742788-114742942
  hypo

SEQ ID NO: 64352 - DNA, 77 bp, Homo sapiens; identical to SEQ ID NO: 43909
  chr13:114746775-114746852
  hypo

SEQ ID NO: 64353 - DNA, 498 bp, Homo sapiens
  chr13:114748638-114749136
  hypo
ggccgggacggcgtgcatctcactttgccggctctgcgctcttccttctcttctccctcccaaaggctgcggctttgcatgggcagcttgctggcgccactgggcgcgtcccgcagactttaaatggaatgagtggaggtctcggactgctgccggatgtagttctggaagctcttgtctccgatggggtgctccctgaaaagggggatgggagagggaatgaggcacagaccccgttgcctggtgctcacccgtggctgcgggagcttttcctgttcctaaatgtgacacactcacactgcaatccacacaaaaaatagaggagccaaaggaaccacagtgcccccggaagcacccacggtgactctgatgtgtgtgcacaggtgggtcaggcgtgcaagtacatgtgcacgtgtgctctccctgtggcacgtgtgtagcgcatatacatgtgcagatgtggaatatgtagagtgtatggcacgtgtgcagaatgtg

SEQ ID NO: 64354 - DNA, 32 bp, Homo sapiens; identical to SEQ ID NO: 43911
  chr13:114749950-114749982
  hypo

SEQ ID NO: 64355 - DNA, 30 bp, Homo sapiens; identical to SEQ ID NO: 43912
  chr13:114751360-114751390
  hypo

SEQ ID NO: 64356 - DNA, 64 bp, Homo sapiens; identical to SEQ ID NO: 43913
  chr13:114760951-114761015
  hypo

SEQ ID NO: 64357 - DNA, 56 bp, Homo sapiens; identical to SEQ ID NO: 43914
  chr13:114765157-114765213
  hypo

SEQ ID NO: 64358 - DNA, 137 bp, Homo sapiens; identical to SEQ ID NO: 43915
  chr13:114767508-114767645
  hypo

SEQ ID NO: 64359 - DNA, 81 bp, Homo sapiens; identical to SEQ ID NO: 43916
  chr13:114767926-114768007
  hypo

SEQ ID NO: 64360 - DNA, 206 bp, Homo sapiens; identical to SEQ ID NO: 43917
  chr13:114769986-114770192
  hypo

SEQ ID NO: 64361 - DNA, 124 bp, Homo sapiens; identical to SEQ ID NO: 43918
  chr13:114770941-114771065
  hypo

SEQ ID NO: 64362 - DNA, 179 bp, Homo sapiens; identical to SEQ ID NO: 43919
  chr13:114774968-114775147
  hypo

SEQ ID NO: 64363 - DNA, 64 bp, Homo sapiens; identical to SEQ ID NO: 43920
  chr13:114776318-114776382
  hypo

SEQ ID NO: 64364 - DNA, 40 bp, Homo sapiens; identical to SEQ ID NO: 43921
  chr13:114777010-114777050
  hypo

SEQ ID NO: 64365 - DNA, 34 bp, Homo sapiens; identical to SEQ ID NO: 43922
  chr13:114778697-114778731
  hypo

SEQ ID NO: 64366 - DNA, 78 bp, Homo sapiens; identical to SEQ ID NO: 43923
  chr13:114779945-114780023
  hypo

SEQ ID NO: 64367 - DNA, 6 bp, Homo sapiens
  chr13:114780555-114780561
  hypo
cggaac

SEQ ID NO: 64368 - DNA, 22 bp, Homo sapiens
  chr13:114781061-114781083
  hypo
gaatggacgttcactagaatgt

SEQ ID NO: 64369 - DNA, 30 bp, Homo sapiens; identical to SEQ ID NO: 43925
  chr13:114784556-114784586
  hypo

SEQ ID NO: 64370 - DNA, 66 bp, Homo sapiens; identical to SEQ ID NO: 43926
  chr13:114785766-114785832
  hypo

SEQ ID NO: 64371 - DNA, 35 bp, Homo sapiens; identical to SEQ ID NO: 43927
  chr13:114786866-114786901
  hypo

SEQ ID NO: 64372 - DNA, 30 bp, Homo sapiens; identical to SEQ ID NO: 43928
  chr13:114789401-114789431
  hypo

SEQ ID NO: 64373 - DNA, 36 bp, Homo sapiens; identical to SEQ ID NO: 43929
  chr13:114802282-114802318
  hypo

SEQ ID NO: 64374 - DNA, 30 bp, Homo sapiens; identical to SEQ ID NO: 43930
  chr13:114802665-114802695
  hypo

SEQ ID NO: 64375 - DNA, 32 bp, Homo sapiens; identical to SEQ ID NO: 25060
  chr13:114807815-114807847
  hypo

SEQ ID NO: 64376 - DNA, 18 bp, Homo sapiens
  chr13:114812180-114812198
  hypo
gtccgagccctgccttca

SEQ ID NO: 64377 - DNA, 53 bp, Homo sapiens; identical to SEQ ID NO: 43933
  chr13:114843043-114843096
  hypo

SEQ ID NO: 64378 - DNA, 161 bp, Homo sapiens
  chr13:114855474-114855635
  hypo
tgatatttcatgtcacggatggaacgcattctgtgtatttgttaatcactgatggatgtttgggctgttcccagctttcagttgttgtgaatggtgccgctgtgaagtgtgcacaagttcccatgtgaacacggacagctttgggattctcttgattattt

SEQ ID NO: 64379 - DNA, 38 bp, Homo sapiens; identical to SEQ ID NO: 43935
  chr13:114917035-114917073
  hypo

SEQ ID NO: 64380 - DNA, 79 bp, Homo sapiens
  chr13:114961744-114961823
  hypo
ttcagaacttcaggccgtgtgctgacatggaatccctggtgccacgaaagaccccagagcagcacaatctgagctcact

SEQ ID NO: 64381 - DNA, 50 bp, Homo sapiens; identical to SEQ ID NO: 43937
  chr13:114989948-114989998
  hypo

SEQ ID NO: 64382 - DNA, 30 bp, Homo sapiens; identical to SEQ ID NO: 43938
  chr14:19828313-19828343
  hypo

SEQ ID NO: 64383 - DNA, 30 bp, Homo sapiens; identical to SEQ ID NO: 43939
  chr14:20928272-20928302
  hypo

SEQ ID NO: 64384 - DNA, 107 bp, Homo sapiens; identical to SEQ ID NO: 43940
  chr14:21190405-21190512
  hypo

SEQ ID NO: 64385 - DNA, 24 bp, Homo sapiens
  chr14:21265229-21265253
  hypo
gcacctggccgtagcttctaattc

SEQ ID NO: 64386 - DNA, 23 bp, Homo sapiens
  chr14:21282035-21282058
  hypo
atgtttctggctgggcgcagtgg

SEQ ID NO: 64387 - DNA, 32 bp, Homo sapiens; identical to SEQ ID NO: 43943
  chr14:21657875-21657907
  hypo

SEQ ID NO: 64388 - DNA, 30 bp, Homo sapiens; identical to SEQ ID NO: 43944
  chr14:21721854-21721884
  hypo

SEQ ID NO: 64389 - DNA, 42 bp, Homo sapiens; identical to SEQ ID NO: 43945
  chr14:21980230-21980272
  hypo

SEQ ID NO: 64390 - DNA, 38 bp, Homo sapiens; identical to SEQ ID NO: 43946
  chr14:22551269-22551307
  hypo

SEQ ID NO: 64391 - DNA, 30 bp, Homo sapiens; identical to SEQ ID NO: 43947
  chr14:23183874-23183904
  hypo

SEQ ID NO: 64392 - DNA, 46 bp, Homo sapiens; identical to SEQ ID NO: 43948
  chr14:23355390-23355436
  hypo

SEQ ID NO: 64393 - DNA, 41 bp, Homo sapiens; identical to SEQ ID NO: 43949
  chr14:23426904-23426945
  hypo

SEQ ID NO: 64394 - DNA, 141 bp, Homo sapiens; identical to SEQ ID NO: 43951
  chr14:23707497-23707638
  hypo

SEQ ID NO: 64395 - DNA, 285 bp, Homo sapiens; identical to SEQ ID NO: 43952
  chr14:23776954-23777239
  hypo

SEQ ID NO: 64396 - DNA, 94 bp, Homo sapiens; identical to SEQ ID NO: 43953
  chr14:23884288-23884382
  hypo

SEQ ID NO: 64397 - DNA, 93 bp, Homo sapiens; identical to SEQ ID NO: 43954
  chr14:24021398-24021491
  hypo

SEQ ID NO: 64398 - DNA, 153 bp, Homo sapiens; identical to SEQ ID NO: 15809
  chr14:24862082-24862235
  hypo

SEQ ID NO: 64399 - DNA, 30 bp, Homo sapiens; identical to SEQ ID NO: 43956
  chr14:24901976-24902006
  hypo

SEQ ID NO: 64400 - DNA, 100 bp, Homo sapiens; identical to SEQ ID NO: 43957
  chr14:31027393-31027493
  hypo

SEQ ID NO: 64401 - DNA, 119 bp, Homo sapiens; identical to SEQ ID NO: 43958
  chr14:31534496-31534615
  hypo

SEQ ID NO: 64402 - DNA, 97 bp, Homo sapiens; identical to SEQ ID NO: 43960
  chr14:32597741-32597838
  hypo

SEQ ID NO: 64403 - DNA, 23 bp, Homo sapiens
  chr14:34920639-34920662
  hypo
caattctaggctgggcgcggtag

SEQ ID NO: 64404 - DNA, 16 bp, Homo sapiens
  chr14:34921211-34921227
  hypo
tagcgtggtggctcac

SEQ ID NO: 64405 - DNA, 30 bp, Homo sapiens; identical to SEQ ID NO: 43963
  chr14:35017114-35017144
  hypo

SEQ ID NO: 64406 - DNA, 289 bp, Homo sapiens
  chr14:35023322-35023611
  hypo
cgggggtgggagagagaaaatctacaccgggctgcataggtaaattcgtaggttaggtgctaagtgctttgaaaaagcaaacaaacacagggaaagtgagataaggagttgcggcaaggggcaggtggctgtgttaaatcgagtggttggaagaagctgctatgagaaggtaccgtatgagcaaaggacttgaagcaggtgaagggagttggtcacggggcatccccagcacaaacatcagctacagcaaaggcccaggtaggactgggtttggcgaacagcaaggagg

SEQ ID NO: 64407 - DNA, 17 bp, Homo sapiens
  chr14:35507705-35507722
  hypo
ttacgaatagagcgccg

SEQ ID NO: 64408 - DNA, 30 bp, Homo sapiens; identical to SEQ ID NO: 15815
  chr14:35866882-35866912
  hypo

SEQ ID NO: 64409 - DNA, 30 bp, Homo sapiens; identical to SEQ ID NO: 43968
  chr14:36458365-36458395
  hypo

SEQ ID NO: 64410 - DNA, 20 bp, Homo sapiens
  chr14:40125126-40125146
  hypo
tcccagtatgagcaacgcag

SEQ ID NO: 64411 - DNA, 23 bp, Homo sapiens
  chr14:40221669-40221692
  hypo
cgagagtccgtctcaaaaaaaaa

SEQ ID NO: 64412 - DNA, 25 bp, Homo sapiens
  chr14:45382862-45382887
  hypo
ggtctcgaaacgctagcctccagtt

SEQ ID NO: 64413 - DNA, 27 bp, Homo sapiens
  chr14:48095553-48095580
  hypo
attcttcttcctgtccgctacactgtg

SEQ ID NO: 64414 - DNA, 30 bp, Homo sapiens; identical to SEQ ID NO: 43973
  chr14:48135049-48135079
  hypo

SEQ ID NO: 64415 - DNA, 40 bp, Homo sapiens; identical to SEQ ID NO: 43974
  chr14:50098049-50098089
  hypo

SEQ ID NO: 64416 - DNA, 180 bp, Homo sapiens; identical to SEQ ID NO: 43975
  chr14:50233117-50233297
  hypo

SEQ ID NO: 64417 - DNA, 144 bp, Homo sapiens; identical to SEQ ID NO: 43976
  chr14:50233597-50233741
  hypo

SEQ ID NO: 64418 - DNA, 30 bp, Homo sapiens; identical to SEQ ID NO: 43977
  chr14:50287126-50287156
  hypo

SEQ ID NO: 64419 - DNA, 89 bp, Homo sapiens
  chr14:50333994-50334083
  hypo
ttgcttttttaacagtgcaaaaaacaaggccgtgtctggctatatggggctttgcttgttcaaaatgtaacctctatacggccgcgcgc

SEQ ID NO: 64420 - DNA, 29 bp, Homo sapiens
  chr14:50434015-50434044
  hypo
catttatgcataaacgatcacatgacatg

SEQ ID NO: 64421 - DNA, 54 bp, Homo sapiens; identical to SEQ ID NO: 43981
  chr14:50777944-50777998
  hypo

SEQ ID NO: 64422 - DNA, 43 bp, Homo sapiens; identical to SEQ ID NO: 43982
  chr14:52226966-52227009
  hypo

SEQ ID NO: 64423 - DNA, 30 bp, Homo sapiens; identical to SEQ ID NO: 43983
  chr14:52321518-52321548
  hypo

SEQ ID NO: 64424 - DNA, 15 bp, Homo sapiens
  chr14:54956536-54956551
  hypo
cgctgggatcacagg

SEQ ID NO: 64425 - DNA, 39 bp, Homo sapiens; identical to SEQ ID NO: 43985
  chr14:55517158-55517197
  hypo

SEQ ID NO: 64426 - DNA, 30 bp, Homo sapiens; identical to SEQ ID NO: 15822
  chr14:55664068-55664098
  hypo

SEQ ID NO: 64427 - DNA, 30 bp, Homo sapiens; identical to SEQ ID NO: 43988
  chr14:56077686-56077716
  hypo

SEQ ID NO: 64428 - DNA, 48 bp, Homo sapiens
  chr14:57045739-57045787
  hypo
gtccttattaacggctccgattctttttttttgcgttacagctcattg

SEQ ID NO: 64429 - DNA, 30 bp, Homo sapiens; identical to SEQ ID NO: 43990
  chr14:58410326-58410356
  hypo

SEQ ID NO: 64430 - DNA, 23 bp, Homo sapiens
  chr14:58599589-58599612
  hypo
actgcgcccggccaacccttgtc

SEQ ID NO: 64431 - DNA, 40 bp, Homo sapiens; identical to SEQ ID NO: 43992
  chr14:58893188-58893228
  hypo

SEQ ID NO: 64432 - DNA, 88 bp, Homo sapiens; identical to SEQ ID NO: 43993
  chr14:64022981-64023069
  hypo

SEQ ID NO: 64433 - DNA, 30 bp, Homo sapiens; identical to SEQ ID NO: 43994
  chr14:65086478-65086508
  hypo

SEQ ID NO: 64434 - DNA, 21 bp, Homo sapiens
  chr14:65233318-65233339
  hypo
ggggaggatggagggcggggc

SEQ ID NO: 64435 - DNA, 15 bp, Homo sapiens
  chr14:65233464-65233479
  hypo
cgcatggtgggaaac

SEQ ID NO: 64436 - DNA, 399 bp, Homo sapiens; identical to SEQ ID NO: 43996
  chr14:65239395-65239794
  hypo

SEQ ID NO: 64437 - DNA, 63 bp, Homo sapiens; identical to SEQ ID NO: 43997
  chr14:65273132-65273195
  hypo

SEQ ID NO: 64438 - DNA, 107 bp, Homo sapiens; identical to SEQ ID NO: 43998
  chr14:65406280-65406387
  hypo

SEQ ID NO: 64439 - DNA, 17 bp, Homo sapiens
  chr14:66499286-66499303
  hypo
accggagctgttcctgt

SEQ ID NO: 64440 - DNA, 41 bp, Homo sapiens; identical to SEQ ID NO: 44000
  chr14:66560653-66560694
  hypo

SEQ ID NO: 64441 - DNA, 189 bp, Homo sapiens; identical to SEQ ID NO: 44001
  chr14:66792112-66792301
  hypo

SEQ ID NO: 64442 - DNA, 181 bp, Homo sapiens; identical to SEQ ID NO: 44002
  chr14:67688245-67688426
  hypo

SEQ ID NO: 64443 - DNA, 30 bp, Homo sapiens; identical to SEQ ID NO: 44003
  chr14:67879219-67879249
  hypo

SEQ ID NO: 64444 - DNA, 39 bp, Homo sapiens; identical to SEQ ID NO: 25084
  chr14:67886606-67886645
  hypo

SEQ ID NO: 64445 - DNA, 139 bp, Homo sapiens; identical to SEQ ID NO: 44005
  chr14:68067690-68067829
  hypo

SEQ ID NO: 64446 - DNA, 30 bp, Homo sapiens; identical to SEQ ID NO: 44006
  chr14:68231335-68231365
  hypo

SEQ ID NO: 64447 - DNA, 36 bp, Homo sapiens; identical to SEQ ID NO: 44007
  chr14:68284131-68284167
  hypo

SEQ ID NO: 64448 - DNA, 30 bp, Homo sapiens; identical to SEQ ID NO: 44009
  chr14:69245934-69245964
  hypo

SEQ ID NO: 64449 - DNA, 132 bp, Homo sapiens; identical to SEQ ID NO: 44011
  chr14:70701228-70701360
  hypo

SEQ ID NO: 64450 - DNA, 30 bp, Homo sapiens; identical to SEQ ID NO: 15833
  chr14:72892242-72892272
  hypo

SEQ ID NO: 64451 - DNA, 30 bp, Homo sapiens; identical to SEQ ID NO: 44013
  chr14:72976891-72976921
  hypo

SEQ ID NO: 64452 - DNA, 73 bp, Homo sapiens; identical to SEQ ID NO: 44014
  chr14:73029715-73029788
  hypo

SEQ ID NO: 64453 - DNA, 250 bp, Homo sapiens; identical to SEQ ID NO: 44015
  chr14:73140612-73140862
  hypo

SEQ ID NO: 64454 - DNA, 30 bp, Homo sapiens; identical to SEQ ID NO: 44016
  chr14:73146807-73146837
  hypo

SEQ ID NO: 64455 - DNA, 221 bp, Homo sapiens; identical to SEQ ID NO: 44017
  chr14:73147279-73147500
  hypo

SEQ ID NO: 64456 - DNA, 30 bp, Homo sapiens; identical to SEQ ID NO: 44018
  chr14:73150302-73150332
  hypo

SEQ ID NO: 64457 - DNA, 37 bp, Homo sapiens; identical to SEQ ID NO: 44019
  chr14:73157349-73157386
  hypo

SEQ ID NO: 64458 - DNA, 151 bp, Homo sapiens; identical to SEQ ID NO: 44021
  chr14:73172944-73173095
  hypo

SEQ ID NO: 64459 - DNA, 62 bp, Homo sapiens
  chr14:73175148-73175210
  hypo
ccaaggacctgcaagacaactgagtgatgagcccagcttcccttccgcgacaaaggcagtga

SEQ ID NO: 64460 - DNA, 30 bp, Homo sapiens; identical to SEQ ID NO: 44023
  chr14:73176464-73176494
  hypo

SEQ ID NO: 64461 - DNA, 30 bp, Homo sapiens; identical to SEQ ID NO: 44024
  chr14:73178102-73178132
  hypo

SEQ ID NO: 64462 - DNA, 87 bp, Homo sapiens
  chr14:73178865-73178952
  hypo
aaagcctgccgtcaggcctcccaggcactacagggcacacagaaggtgggagagagcctgcggggagggcatcgagagaagcaaacg

SEQ ID NO: 64463 - DNA, 95 bp, Homo sapiens
  chr14:73180113-73180208
  hypo
gccccacccctaccccgccttgccagctctctccctgccttcagggagactgcagaccctggcgagatgggtgggacacccagagggagacccgt

SEQ ID NO: 64464 - DNA, 37 bp, Homo sapiens; identical to SEQ ID NO: 44027
  chr14:73185482-73185519
  hypo

SEQ ID NO: 64465 - DNA, 146 bp, Homo sapiens; identical to SEQ ID NO: 44028
  chr14:73194579-73194725
  hypo

SEQ ID NO: 64466 - DNA, 166 bp, Homo sapiens; identical to SEQ ID NO: 15840
  chr14:73195193-73195359
  hypo

SEQ ID NO: 64467 - DNA, 79 bp, Homo sapiens; identical to SEQ ID NO: 44030
  chr14:73195581-73195660
  hypo

SEQ ID NO: 64468 - DNA, 30 bp, Homo sapiens; identical to SEQ ID NO: 44031
  chr14:73196936-73196966
  hypo

SEQ ID NO: 64469 - DNA, 30 bp, Homo sapiens; identical to SEQ ID NO: 44032
  chr14:73197190-73197220
  hypo

SEQ ID NO: 64470 - DNA, 35 bp, Homo sapiens; identical to SEQ ID NO: 44033
  chr14:73198555-73198590
  hypo

SEQ ID NO: 64471 - DNA, 152 bp, Homo sapiens; identical to SEQ ID NO: 44034
  chr14:73202868-73203020
  hypo

SEQ ID NO: 64472 - DNA, 445 bp, Homo sapiens; identical to SEQ ID NO: 44035
  chr14:73209603-73210048
  hypo

SEQ ID NO: 64473 - DNA, 96 bp, Homo sapiens; identical to SEQ ID NO: 44036
  chr14:73226814-73226910
  hypo

SEQ ID NO: 64474 - DNA, 114 bp, Homo sapiens; identical to SEQ ID NO: 44037
  chr14:73273305-73273419
  hypo

SEQ ID NO: 64475 - DNA, 30 bp, Homo sapiens; identical to SEQ ID NO: 15844
  chr14:73275087-73275117
  hypo

SEQ ID NO: 64476 - DNA, 30 bp, Homo sapiens; identical to SEQ ID NO: 44039
  chr14:73300028-73300058
  hypo

SEQ ID NO: 64477 - DNA, 32 bp, Homo sapiens; identical to SEQ ID NO: 15845
  chr14:73313912-73313944
  hypo

SEQ ID NO: 64478 - DNA, 86 bp, Homo sapiens
  chr14:73318385-73318471
  hypo
cacaaactaacttcccgagggatgagtattttgatgcagatacttcttcaagtgaaaaatgtacaatgtacaaaatgtccactcga

SEQ ID NO: 64479 - DNA, 30 bp, Homo sapiens; identical to SEQ ID NO: 44042
  chr14:73318945-73318975
  hypo

SEQ ID NO: 64480 - DNA, 30 bp, Homo sapiens; identical to SEQ ID NO: 44043
  chr14:73331141-73331171
  hypo

SEQ ID NO: 64481 - DNA, 93 bp, Homo sapiens
  chr14:73333156-73333249
  hypo
gaacccaagcttattcgaatgcacaggctcaggtacccgcctctgctccatcgataccagccatggagtcttgggcaaatcttgggcaactcc

SEQ ID NO: 64482 - DNA, 77 bp, Homo sapiens
  chr14:73602389-73602466
  hypo
ttttaaagaaactttagaagaatgtaacttgcccagataccatgtaccgttaatttcattttcggttttttgaatac

SEQ ID NO: 64483 - DNA, 30 bp, Homo sapiens; identical to SEQ ID NO: 44046
  chr14:73691528-73691558
  hypo

SEQ ID NO: 64484 - DNA, 30 bp, Homo sapiens; identical to SEQ ID NO: 15848
  chr14:73958845-73958875
  hypo

SEQ ID NO: 64485 - DNA, 109 bp, Homo sapiens; identical to SEQ ID NO: 44048
  chr14:73959120-73959229
  hypo

SEQ ID NO: 64486 - DNA, 60 bp, Homo sapiens; identical to SEQ ID NO: 44049
  chr14:74717689-74717749
  hypo

SEQ ID NO: 64487 - DNA, 38 bp, Homo sapiens; identical to SEQ ID NO: 44050
  chr14:75389373-75389411
  hypo

SEQ ID NO: 64488 - DNA, 18 bp, Homo sapiens
  chr14:75390699-75390717
  hypo
gatcgtgtcactgcactc

SEQ ID NO: 64489 - DNA, 30 bp, Homo sapiens; identical to SEQ ID NO: 44052
  chr14:75446328-75446358
  hypo

SEQ ID NO: 64490 - DNA, 18 bp, Homo sapiens
  chr14:75517394-75517412
  hypo
gcccggccagaaggtcat

SEQ ID NO: 64491 - DNA, 153 bp, Homo sapiens; identical to SEQ ID NO: 44054
  chr14:75760140-75760293
  hypo

SEQ ID NO: 64492 - DNA, 30 bp, Homo sapiens; identical to SEQ ID NO: 44055
  chr14:76101271-76101301
  hypo

SEQ ID NO: 64493 - DNA, 172 bp, Homo sapiens; identical to SEQ ID NO: 44056
  chr14:76998049-76998221
  hypo

SEQ ID NO: 64494 - DNA, 30 bp, Homo sapiens; identical to SEQ ID NO: 44057
  chr14:77242483-77242513
  hypo

SEQ ID NO: 64495 - DNA, 30 bp, Homo sapiens; identical to SEQ ID NO: 44058
  chr14:78141401-78141431
  hypo

SEQ ID NO: 64496 - DNA, 34 bp, Homo sapiens; identical to SEQ ID NO: 44059
  chr14:78247790-78247824
  hypo

SEQ ID NO: 64497 - DNA, 30 bp, Homo sapiens; identical to SEQ ID NO: 44060
  chr14:79111630-79111660
  hypo

SEQ ID NO: 64498 - DNA, 30 bp, Homo sapiens; identical to SEQ ID NO: 44061
  chr14:81489175-81489205
  hypo

SEQ ID NO: 64499 - DNA, 30 bp, Homo sapiens; identical to SEQ ID NO: 44062
  chr14:88673478-88673508
  hypo

SEQ ID NO: 64500 - DNA, 33 bp, Homo sapiens; identical to SEQ ID NO: 44063
  chr14:89606032-89606065
  hypo

SEQ ID NO: 64501 - DNA, 98 bp, Homo sapiens; identical to SEQ ID NO: 44064
  chr14:89657653-89657751
  hypo

SEQ ID NO: 64502 - DNA, 30 bp, Homo sapiens; identical to SEQ ID NO: 44065
  chr14:89895234-89895264
  hypo

SEQ ID NO: 64503 - DNA, 30 bp, Homo sapiens; identical to SEQ ID NO: 44066
  chr14:89918720-89918750
  hypo

SEQ ID NO: 64504 - DNA, 20 bp, Homo sapiens
  chr14:89962546-89962566
  hypo
aactccgtctcaaaaaaaga

SEQ ID NO: 64505 - DNA, 30 bp, Homo sapiens; identical to SEQ ID NO: 44068
  chr14:90043896-90043926
  hypo

SEQ ID NO: 64506 - DNA, 30 bp, Homo sapiens; identical to SEQ ID NO: 44069
  chr14:90650692-90650722
  hypo

SEQ ID NO: 64507 - DNA, 32 bp, Homo sapiens; identical to SEQ ID NO: 44070
  chr14:90724207-90724239
  hypo

SEQ ID NO: 64508 - DNA, 30 bp, Homo sapiens; identical to SEQ ID NO: 15852
  chr14:90983280-90983310
  hypo

SEQ ID NO: 64509 - DNA, 30 bp, Homo sapiens; identical to SEQ ID NO: 44072
  chr14:91059804-91059834
  hypo

SEQ ID NO: 64510 - DNA, 114 bp, Homo sapiens; identical to SEQ ID NO: 44074
  chr14:91747935-91748049
  hypo

SEQ ID NO: 64511 - DNA, 30 bp, Homo sapiens; identical to SEQ ID NO: 44075
  chr14:91754764-91754794
  hypo

SEQ ID NO: 64512 - DNA, 66 bp, Homo sapiens
  chr14:91766450-91766516
  hypo
ggccttcttttccgacaggtaactcacatcccagaggatctgcgtgcctcccgtgagaaaatggga

SEQ ID NO: 64513 - DNA, 90 bp, Homo sapiens; identical to SEQ ID NO: 44077
  chr14:91849645-91849735
  hypo

SEQ ID NO: 64514 - DNA, 30 bp, Homo sapiens; identical to SEQ ID NO: 44078
  chr14:91850063-91850093
  hypo

SEQ ID NO: 64515 - DNA, 30 bp, Homo sapiens; identical to SEQ ID NO: 44079
  chr14:92801258-92801288
  hypo

SEQ ID NO: 64516 - DNA, 191 bp, Homo sapiens; identical to SEQ ID NO: 44080
  chr14:92829024-92829215
  hypo

SEQ ID NO: 64517 - DNA, 30 bp, Homo sapiens; identical to SEQ ID NO: 44081
  chr14:93065511-93065541
  hypo

SEQ ID NO: 64518 - DNA, 79 bp, Homo sapiens; identical to SEQ ID NO: 44082
  chr14:93151456-93151535
  hypo

SEQ ID NO: 64519 - DNA, 124 bp, Homo sapiens; identical to SEQ ID NO: 25105
  chr14:93154937-93155061
  hypo

SEQ ID NO: 64520 - DNA, 30 bp, Homo sapiens; identical to SEQ ID NO: 44084
  chr14:93454054-93454084
  hypo

SEQ ID NO: 64521 - DNA, 37 bp, Homo sapiens; identical to SEQ ID NO: 15855
  chr14:93697020-93697057
  hypo

SEQ ID NO: 64522 - DNA, 30 bp, Homo sapiens; identical to SEQ ID NO: 44086
  chr14:93706848-93706878
  hypo

SEQ ID NO: 64523 - DNA, 30 bp, Homo sapiens; identical to SEQ ID NO: 44087
  chr14:95200361-95200391
  hypo

SEQ ID NO: 64524 - DNA, 55 bp, Homo sapiens; identical to SEQ ID NO: 44088
  chr14:95522889-95522944
  hypo

SEQ ID NO: 64525 - DNA, 30 bp, Homo sapiens; identical to SEQ ID NO: 44089
  chr14:95906326-95906356
  hypo

SEQ ID NO: 64526 - DNA, 130 bp, Homo sapiens; identical to SEQ ID NO: 44090
  chr14:95927934-95928064
  hypo

SEQ ID NO: 64527 - DNA, 39 bp, Homo sapiens; identical to SEQ ID NO: 44091
  chr14:96967321-96967360
  hypo

SEQ ID NO: 64528 - DNA, 109 bp, Homo sapiens; identical to SEQ ID NO: 44093
  chr14:97188235-97188344
  hypo

SEQ ID NO: 64529 - DNA, 205 bp, Homo sapiens; identical to SEQ ID NO: 44094
  chr14:97262648-97262853
  hypo

SEQ ID NO: 64530 - DNA, 32 bp, Homo sapiens; identical to SEQ ID NO: 44095
  chr14:99532995-99533027
  hypo

SEQ ID NO: 64531 - DNA, 30 bp, Homo sapiens; identical to SEQ ID NO: 44096
  chr14:99615561-99615591
  hypo

SEQ ID NO: 64532 - DNA, 30 bp, Homo sapiens; identical to SEQ ID NO: 44097
  chr14:99626459-99626489
  hypo

SEQ ID NO: 64533 - DNA, 30 bp, Homo sapiens; identical to SEQ ID NO: 44098
  chr14:99804005-99804035
  hypo

SEQ ID NO: 64534 - DNA, 30 bp, Homo sapiens; identical to SEQ ID NO: 44099
  chr14:99848008-99848038
  hypo

SEQ ID NO: 64535 - DNA, 154 bp, Homo sapiens; identical to SEQ ID NO: 44100
  chr14:99849909-99850063
  hypo

SEQ ID NO: 64536 - DNA, 36 bp, Homo sapiens; identical to SEQ ID NO: 44101
  chr14:100209839-100209875
  hypo

SEQ ID NO: 64537 - DNA, 38 bp, Homo sapiens; identical to SEQ ID NO: 44102
  chr14:100591043-100591081
  hypo

SEQ ID NO: 64538 - DNA, 30 bp, Homo sapiens; identical to SEQ ID NO: 15860
  chr14:100611919-100611949
  hypo

SEQ ID NO: 64539 - DNA, 82 bp, Homo sapiens; identical to SEQ ID NO: 44104
  chr14:100637036-100637118
  hypo

SEQ ID NO: 64540 - DNA, 65 bp, Homo sapiens
  chr14:100643285-100643350
  hypo
ggcaccgagtccctacggtgggaccatgcccgcagcggcagtgtggaagatgggacagacacagc

SEQ ID NO: 64541 - DNA, 79 bp, Homo sapiens; identical to SEQ ID NO: 15862
  chr14:100644399-100644478
  hypo

SEQ ID NO: 64542 - DNA, 27 bp, Homo sapiens
  chr14:100747273-100747300
  hypo
gaagcctgataatttcgggaggctgag

SEQ ID NO: 64543 - DNA, 35 bp, Homo sapiens; identical to SEQ ID NO: 44108
  chr14:100780162-100780197
  hypo

SEQ ID NO: 64544 - DNA, 19 bp, Homo sapiens
  chr14:100843965-100843984
  hypo
tttgcgtgtggaagttgtt

SEQ ID NO: 64545 - DNA, 32 bp, Homo sapiens; identical to SEQ ID NO: 44110
  chr14:101198835-101198867
  hypo

SEQ ID NO: 64546 - DNA, 116 bp, Homo sapiens; identical to SEQ ID NO: 44111
  chr14:101200602-101200718
  hypo

SEQ ID NO: 64547 - DNA, 44 bp, Homo sapiens; identical to SEQ ID NO: 44112
  chr14:101201633-101201677
  hypo

SEQ ID NO: 64548 - DNA, 27 bp, Homo sapiens
  chr14:101250082-101250109
  hypo
ggggagctggggtggcgacccatgaat

SEQ ID NO: 64549 - DNA, 22 bp, Homo sapiens
  chr14:101250272-101250294
  hypo
ggtgcaccggggctttgttcag

SEQ ID NO: 64550 - DNA, 30 bp, Homo sapiens; identical to SEQ ID NO: 44114
  chr14:101532280-101532310
  hypo

SEQ ID NO: 64551 - DNA, 30 bp, Homo sapiens; identical to SEQ ID NO: 44115
  chr14:101532816-101532846
  hypo

SEQ ID NO: 64552 - DNA, 30 bp, Homo sapiens; identical to SEQ ID NO: 44116
  chr14:101591942-101591972
  hypo

SEQ ID NO: 64553 - DNA, 30 bp, Homo sapiens; identical to SEQ ID NO: 44117
  chr14:101694589-101694619
  hypo

SEQ ID NO: 64554 - DNA, 152 bp, Homo sapiens; identical to SEQ ID NO: 44118
  chr14:101713576-101713728
  hypo

SEQ ID NO: 64555 - DNA, 32 bp, Homo sapiens; identical to SEQ ID NO: 44119
  chr14:102094096-102094128
  hypo

SEQ ID NO: 64556 - DNA, 30 bp, Homo sapiens; identical to SEQ ID NO: 44120
  chr14:102325042-102325072
  hypo

SEQ ID NO: 64557 - DNA, 51 bp, Homo sapiens; identical to SEQ ID NO: 15865
  chr14:102335848-102335899
  hypo

SEQ ID NO: 64558 - DNA, 81 bp, Homo sapiens
  chr14:102418526-102418607
  hypo
ggcccaggagttgctcgcatgagccaccacgcccagtgtattcagattttcttcgtgtttcttttctcttccgggatccca

SEQ ID NO: 64559 - DNA, 30 bp, Homo sapiens; identical to SEQ ID NO: 44123
  chr14:102474565-102474595
  hypo

SEQ ID NO: 64560 - DNA, 38 bp, Homo sapiens; identical to SEQ ID NO: 44124
  chr14:102493613-102493651
  hypo

SEQ ID NO: 64561 - DNA, 28 bp, Homo sapiens
  chr14:102529474-102529502
  hypo
aatagaatggaaacgttagggagtagca

SEQ ID NO: 64562 - DNA, 21 bp, Homo sapiens
  chr14:102530479-102530500
  hypo
gctccttctccccagcgtggt

SEQ ID NO: 64563 - DNA, 61 bp, Homo sapiens; identical to SEQ ID NO: 44129
  chr14:102673269-102673330
  hypo

SEQ ID NO: 64564 - DNA, 96 bp, Homo sapiens
  chr14:102682149-102682245
  hypo
gagaagaactcatgatttacattgtcttactatgaaataccatccctcactcttgacagacgacgtagctgatctgagcagcgccctggcacccgc

SEQ ID NO: 64565 - DNA, 30 bp, Homo sapiens; identical to SEQ ID NO: 44131
  chr14:102909162-102909192
  hypo

SEQ ID NO: 64566 - DNA, 152 bp, Homo sapiens; identical to SEQ ID NO: 44132
  chr14:103007088-103007240
  hypo

SEQ ID NO: 64567 - DNA, 37 bp, Homo sapiens; identical to SEQ ID NO: 44133
  chr14:103018826-103018863
  hypo

SEQ ID NO: 64568 - DNA, 30 bp, Homo sapiens; identical to SEQ ID NO: 44134
  chr14:103144541-103144571
  hypo

SEQ ID NO: 64569 - DNA, 66 bp, Homo sapiens; identical to SEQ ID NO: 44135
  chr14:103216392-103216458
  hypo

SEQ ID NO: 64570 - DNA, 177 bp, Homo sapiens; identical to SEQ ID NO: 44136
  chr14:103277520-103277697
  hypo

SEQ ID NO: 64571 - DNA, 30 bp, Homo sapiens; identical to SEQ ID NO: 44137
  chr14:103456678-103456708
  hypo

SEQ ID NO: 64572 - DNA, 17 bp, Homo sapiens
  chr14:103477626-103477643
  hypo
ctaggcaaagccaaccg

SEQ ID NO: 64573 - DNA, 44 bp, Homo sapiens; identical to SEQ ID NO: 44139
  chr14:103699549-103699593
  hypo

SEQ ID NO: 64574 - DNA, 89 bp, Homo sapiens; identical to SEQ ID NO: 15869
  chr14:103820833-103820922
  hypo

SEQ ID NO: 64575 - DNA, 30 bp, Homo sapiens; identical to SEQ ID NO: 15870
  chr14:103996414-103996444
  hypo

SEQ ID NO: 64576 - DNA, 49 bp, Homo sapiens; identical to SEQ ID NO: 44142
  chr14:104048933-104048982
  hypo

SEQ ID NO: 64577 - DNA, 30 bp, Homo sapiens; identical to SEQ ID NO: 15871
  chr14:104061854-104061884
  hypo

SEQ ID NO: 64578 - DNA, 30 bp, Homo sapiens; identical to SEQ ID NO: 44144
  chr14:104121128-104121158
  hypo

SEQ ID NO: 64579 - DNA, 55 bp, Homo sapiens; identical to SEQ ID NO: 44145
  chr14:104194695-104194750
  hypo

SEQ ID NO: 64580 - DNA, 30 bp, Homo sapiens; identical to SEQ ID NO: 44146
  chr14:104195285-104195315
  hypo

SEQ ID NO: 64581 - DNA, 82 bp, Homo sapiens
  chr14:104202759-104202841
  hypo
cctgcaggacagacaggacaaacgagctcctgagccccagggcaagagtgtgctgttcttaaggtgacgcttagcaatcaca

SEQ ID NO: 64582 - DNA, 40 bp, Homo sapiens; identical to SEQ ID NO: 44148
  chr14:104355130-104355170
  hypo

SEQ ID NO: 64583 - DNA, 35 bp, Homo sapiens; identical to SEQ ID NO: 44149
  chr14:104387085-104387120
  hypo

SEQ ID NO: 64584 - DNA, 30 bp, Homo sapiens; identical to SEQ ID NO: 44151
  chr14:104600477-104600507
  hypo

SEQ ID NO: 64585 - DNA, 30 bp, Homo sapiens; identical to SEQ ID NO: 44152
  chr14:104609469-104609499
  hypo

SEQ ID NO: 64586 - DNA, 611 bp, Homo sapiens; identical to SEQ ID NO: 44153
  chr14:104617674-104618285
  hypo

SEQ ID NO: 64587 - DNA, 139 bp, Homo sapiens; identical to SEQ ID NO: 44154
  chr14:104618691-104618830
  hypo

SEQ ID NO: 64588 - DNA, 242 bp, Homo sapiens; identical to SEQ ID NO: 44155
  chr14:104619085-104619327
  hypo

SEQ ID NO: 64589 - DNA, 50 bp, Homo sapiens
  chr14:104620554-104620604
  hypo
caaggcaaacactgatctggggccagcgggtgggacgggggtgctgcagc

SEQ ID NO: 64590 - DNA, 314 bp, Homo sapiens; identical to SEQ ID NO: 44157
  chr14:104622939-104623253
  hypo

SEQ ID NO: 64591 - DNA, 264 bp, Homo sapiens; identical to SEQ ID NO: 44158
  chr14:104623478-104623742
  hypo

SEQ ID NO: 64592 - DNA, 216 bp, Homo sapiens; identical to SEQ ID NO: 44159
  chr14:104626773-104626989
  hypo

SEQ ID NO: 64593 - DNA, 76 bp, Homo sapiens
  chr14:104627759-104627835
  hypo
ggtaattaagggcctcaccatcaaggccaactgcctgtgaaattaccctcttgtttggaagcggtgatttttctct

SEQ ID NO: 64594 - DNA, 78 bp, Homo sapiens; identical to SEQ ID NO: 44161
  chr14:104628609-104628687
  hypo

SEQ ID NO: 64595 - DNA, 140 bp, Homo sapiens; identical to SEQ ID NO: 44162
  chr14:104630035-104630175
  hypo

SEQ ID NO: 64596 - DNA, 45 bp, Homo sapiens; identical to SEQ ID NO: 44163
  chr14:104630962-104631007
  hypo

SEQ ID NO: 64597 - DNA, 49 bp, Homo sapiens; identical to SEQ ID NO: 44164
  chr14:104637029-104637078
  hypo

SEQ ID NO: 64598 - DNA, 33 bp, Homo sapiens; identical to SEQ ID NO: 44165
  chr14:104638185-104638218
  hypo

SEQ ID NO: 64599 - DNA, 752 bp, Homo sapiens; identical to SEQ ID NO: 44166
  chr14:104639103-104639855
  hypo

SEQ ID NO: 64600 - DNA, 30 bp, Homo sapiens; identical to SEQ ID NO: 44167
  chr14:104640459-104640489
  hypo

SEQ ID NO: 64601 - DNA, 427 bp, Homo sapiens; identical to SEQ ID NO: 44168
  chr14:104641348-104641775
  hypo

SEQ ID NO: 64602 - DNA, 30 bp, Homo sapiens; identical to SEQ ID NO: 44169
  chr14:104642691-104642721
  hypo

SEQ ID NO: 64603 - DNA, 390 bp, Homo sapiens; identical to SEQ ID NO: 44170
  chr14:104643013-104643403
  hypo

SEQ ID NO: 64604 - DNA, 489 bp, Homo sapiens; identical to SEQ ID NO: 44171
  chr14:104643693-104644182
  hypo

SEQ ID NO: 64605 - DNA, 320 bp, Homo sapiens
  chr14:104645188-104645508
  hypo
ggtgtggctgggcagcccctgacctcactttctgtccacgttcctcccaggacgcaaaggtaggagcggccctgcccagcccaagcctgttgcagctccgacactccccttgggcagtgggtgggtggctggggggtcctgaggccactgctgctgtccgctggaattctcccctgtcgtggggagggtggtcctagagccgagccaggacccagacgggcatgggtgggctgccccaggtccgccccctgcccgcccttggagccccactgtgtgcctgccaaggcctggcaggtgaagggaggcgggggccacatcag

SEQ ID NO: 64606 - DNA, 400 bp, Homo sapiens; identical to SEQ ID NO: 44173
  chr14:104645716-104646116
  hypo

SEQ ID NO: 64607 - DNA, 195 bp, Homo sapiens
  chr14:104646491-104646686
  hypo
ccaccttgccttctttgcagccaagcagtttttgtggagtggagtgggacttacctgcacgccccaggggtctttcaggattcaggatgacttttcttttacaatggtttcctctcggcagagcccgggttgtgggggatctgtgtggggttctcaacgcagatccatcctggggtctcccgggcagggatggct

SEQ ID NO: 64608 - DNA, 49 bp, Homo sapiens; identical to SEQ ID NO: 15884
  chr14:104647208-104647257
  hypo

SEQ ID NO: 64609 - DNA, 128 bp, Homo sapiens
  chr14:104647287-104647415
  hypo
ccctctgagggtccctggggtgacgggcagtaagcgtgggaaggacacatccacggggacccagggcttcgggtgctgtgccagggcctgccttgcagcccctgtggggcccacggtgccatgagggc

SEQ ID NO: 64610 - DNA, 30 bp, Homo sapiens; identical to SEQ ID NO: 44176
  chr14:104647924-104647954
  hypo

SEQ ID NO: 64611 - DNA, 54 bp, Homo sapiens; identical to SEQ ID NO: 44177
  chr14:104648777-104648831
  hypo

SEQ ID NO: 64612 - DNA, 160 bp, Homo sapiens; identical to SEQ ID NO: 44179
  chr14:104705230-104705390
  hypo

SEQ ID NO: 64613 - DNA, 30 bp, Homo sapiens; identical to SEQ ID NO: 44180
  chr14:104768222-104768252
  hypo

SEQ ID NO: 64614 - DNA, 30 bp, Homo sapiens; identical to SEQ ID NO: 44181
  chr14:104798505-104798535
  hypo

SEQ ID NO: 64615 - DNA, 38 bp, Homo sapiens; identical to SEQ ID NO: 44182
  chr14:104800605-104800643
  hypo

SEQ ID NO: 64616 - DNA, 37 bp, Homo sapiens; identical to SEQ ID NO: 44183
  chr14:104801369-104801406
  hypo

SEQ ID NO: 64617 - DNA, 30 bp, Homo sapiens; identical to SEQ ID NO: 44184
  chr14:104820337-104820367
  hypo

SEQ ID NO: 64618 - DNA, 174 bp, Homo sapiens; identical to SEQ ID NO: 44185
  chr14:104842214-104842388
  hypo

SEQ ID NO: 64619 - DNA, 103 bp, Homo sapiens; identical to SEQ ID NO: 44186
  chr14:104897622-104897725
  hypo

SEQ ID NO: 64620 - DNA, 54 bp, Homo sapiens; identical to SEQ ID NO: 44187
  chr14:104899461-104899515
  hypo

SEQ ID NO: 64621 - DNA, 38 bp, Homo sapiens; identical to SEQ ID NO: 44188
  chr14:105026775-105026813
  hypo

SEQ ID NO: 64622 - DNA, 119 bp, Homo sapiens; identical to SEQ ID NO: 44189
  chr14:105174275-105174394
  hypo

SEQ ID NO: 64623 - DNA, 30 bp, Homo sapiens; identical to SEQ ID NO: 44190
  chr14:105194964-105194994
  hypo

SEQ ID NO: 64624 - DNA, 18 bp, Homo sapiens
  chr14:105195822-105195840
  hypo
ggagggaggaggtagcgt

SEQ ID NO: 64625 - DNA, 196 bp, Homo sapiens; identical to SEQ ID NO: 44192
  chr14:105196366-105196562
  hypo

SEQ ID NO: 64626 - DNA, 92 bp, Homo sapiens; identical to SEQ ID NO: 44193
  chr14:105241003-105241095
  hypo

SEQ ID NO: 64627 - DNA, 30 bp, Homo sapiens; identical to SEQ ID NO: 44194
  chr14:105254641-105254671
  hypo

SEQ ID NO: 64628 - DNA, 35 bp, Homo sapiens; identical to SEQ ID NO: 44195
  chr14:105268737-105268772
  hypo

SEQ ID NO: 64629 - DNA, 30 bp, Homo sapiens; identical to SEQ ID NO: 44196
  chr14:105538919-105538949
  hypo

SEQ ID NO: 64630 - DNA, 30 bp, Homo sapiens; identical to SEQ ID NO: 44197
  chr14:105590655-105590685
  hypo

SEQ ID NO: 64631 - DNA, 26 bp, Homo sapiens
  chr14:105714232-105714258
  hypo
ggattagccccaggccgggaggctag

SEQ ID NO: 64632 - DNA, 81 bp, Homo sapiens; identical to SEQ ID NO: 56211
  chr14:105714334-105714415
  hypo

SEQ ID NO: 64633 - DNA, 30 bp, Homo sapiens; identical to SEQ ID NO: 44200
  chr14:105739229-105739259
  hypo

SEQ ID NO: 64634 - DNA, 30 bp, Homo sapiens; identical to SEQ ID NO: 44201
  chr14:105739632-105739662
  hypo

SEQ ID NO: 64635 - DNA, 30 bp, Homo sapiens; identical to SEQ ID NO: 44202
  chr14:106334145-106334175
  hypo

SEQ ID NO: 64636 - DNA, 29 bp, Homo sapiens
  chr15:20499470-20499499
  hypo
ttaggagaaacaggccgagcgcgctgact

SEQ ID NO: 64637 - DNA, 35 bp, Homo sapiens; identical to SEQ ID NO: 44204
  chr15:22515501-22515536
  hypo

SEQ ID NO: 64638 - DNA, 30 bp, Homo sapiens; identical to SEQ ID NO: 44205
  chr15:22876959-22876989
  hypo

SEQ ID NO: 64639 - DNA, 128 bp, Homo sapiens; identical to SEQ ID NO: 44206
  chr15:22977063-22977191
  hypo

SEQ ID NO: 64640 - DNA, 19 bp, Homo sapiens
  chr15:23087577-23087596
  hypo
tttgagacagagtctcgct

SEQ ID NO: 64641 - DNA, 30 bp, Homo sapiens; identical to SEQ ID NO: 44208
  chr15:23182596-23182626
  hypo

SEQ ID NO: 64642 - DNA, 107 bp, Homo sapiens; identical to SEQ ID NO: 44209
  chr15:23662038-23662145
  hypo

SEQ ID NO: 64643 - DNA, 30 bp, Homo sapiens; identical to SEQ ID NO: 44210
  chr15:25449793-25449823
  hypo

SEQ ID NO: 64644 - DNA, 30 bp, Homo sapiens; identical to SEQ ID NO: 44211
  chr15:26869355-26869385
  hypo

SEQ ID NO: 64645 - DNA, 66 bp, Homo sapiens; identical to SEQ ID NO: 44212
  chr15:28389827-28389893
  hypo

SEQ ID NO: 64646 - DNA, 122 bp, Homo sapiens; identical to SEQ ID NO: 44213
  chr15:28517076-28517198
  hypo

SEQ ID NO: 64647 - DNA, 30 bp, Homo sapiens; identical to SEQ ID NO: 44214
  chr15:29087614-29087644
  hypo

SEQ ID NO: 64648 - DNA, 48 bp, Homo sapiens; identical to SEQ ID NO: 44215
  chr15:29112193-29112241
  hypo

SEQ ID NO: 64649 - DNA, 297 bp, Homo sapiens; identical to SEQ ID NO: 44216
  chr15:29133536-29133833
  hypo

SEQ ID NO: 64650 - DNA, 158 bp, Homo sapiens; identical to SEQ ID NO: 44217
  chr15:29145324-29145482
  hypo

SEQ ID NO: 64651 - DNA, 30 bp, Homo sapiens; identical to SEQ ID NO: 44218
  chr15:29221674-29221704
  hypo

SEQ ID NO: 64652 - DNA, 30 bp, Homo sapiens; identical to SEQ ID NO: 44219
  chr15:29397531-29397561
  hypo

SEQ ID NO: 64653 - DNA, 34 bp, Homo sapiens; identical to SEQ ID NO: 44220
  chr15:29409363-29409397
  hypo

SEQ ID NO: 64654 - DNA, 30 bp, Homo sapiens; identical to SEQ ID NO: 15892
  chr15:29449033-29449063
  hypo

SEQ ID NO: 64655 - DNA, 153 bp, Homo sapiens; identical to SEQ ID NO: 44222
  chr15:29721877-29722030
  hypo

SEQ ID NO: 64656 - DNA, 30 bp, Homo sapiens; identical to SEQ ID NO: 44223
  chr15:31083776-31083806
  hypo

SEQ ID NO: 64657 - DNA, 30 bp, Homo sapiens; identical to SEQ ID NO: 44224
  chr15:31121996-31122026
  hypo

SEQ ID NO: 64658 - DNA, 30 bp, Homo sapiens; identical to SEQ ID NO: 44225
  chr15:31221190-31221220
  hypo

SEQ ID NO: 64659 - DNA, 167 bp, Homo sapiens; identical to SEQ ID NO: 44226
  chr15:31377678-31377845
  hypo

SEQ ID NO: 64660 - DNA, 30 bp, Homo sapiens; identical to SEQ ID NO: 44227
  chr15:31509535-31509565
  hypo

SEQ ID NO: 64661 - DNA, 30 bp, Homo sapiens; identical to SEQ ID NO: 44228
  chr15:31539632-31539662
  hypo

SEQ ID NO: 64662 - DNA, 56 bp, Homo sapiens; identical to SEQ ID NO: 44229
  chr15:31603992-31604048
  hypo

SEQ ID NO: 64663 - DNA, 30 bp, Homo sapiens; identical to SEQ ID NO: 44230
  chr15:31813319-31813349
  hypo

SEQ ID NO: 64664 - DNA, 30 bp, Homo sapiens; identical to SEQ ID NO: 44231
  chr15:33438087-33438117
  hypo

SEQ ID NO: 64665 - DNA, 27 bp, Homo sapiens
  chr15:33541634-33541661
  hypo
gcctcagcctcccgtaaaggtttttaa

SEQ ID NO: 64666 - DNA, 43 bp, Homo sapiens; identical to SEQ ID NO: 15893
  chr15:33632093-33632136
  hypo

SEQ ID NO: 64667 - DNA, 17 bp, Homo sapiens
  chr15:33633532-33633549
  hypo
cccggtctgattcagtg

SEQ ID NO: 64668 - DNA, 30 bp, Homo sapiens; identical to SEQ ID NO: 44235
  chr15:33727786-33727816
  hypo

SEQ ID NO: 64669 - DNA, 30 bp, Homo sapiens; identical to SEQ ID NO: 44236
  chr15:33746640-33746670
  hypo

SEQ ID NO: 64670 - DNA, 155 bp, Homo sapiens; identical to SEQ ID NO: 44237
  chr15:33954397-33954552
  hypo

SEQ ID NO: 64671 - DNA, 36 bp, Homo sapiens; identical to SEQ ID NO: 44238
  chr15:34879893-34879929
  hypo

SEQ ID NO: 64672 - DNA, 163 bp, Homo sapiens; identical to SEQ ID NO: 44239
  chr15:38218484-38218647
  hypo

SEQ ID NO: 64673 - DNA, 30 bp, Homo sapiens; identical to SEQ ID NO: 15894
  chr15:40228636-40228666
  hypo

SEQ ID NO: 64674 - DNA, 39 bp, Homo sapiens; identical to SEQ ID NO: 44241
  chr15:40368182-40368221
  hypo

SEQ ID NO: 64675 - DNA, 92 bp, Homo sapiens; identical to SEQ ID NO: 44242
  chr15:40423336-40423428
  hypo

SEQ ID NO: 64676 - DNA, 75 bp, Homo sapiens; identical to SEQ ID NO: 44243
  chr15:40532146-40532221
  hypo

SEQ ID NO: 64677 - DNA, 30 bp, Homo sapiens; identical to SEQ ID NO: 44244
  chr15:40532791-40532821
  hypo

SEQ ID NO: 64678 - DNA, 56 bp, Homo sapiens; identical to SEQ ID NO: 44245
  chr15:40545776-40545832
  hypo

SEQ ID NO: 64679 - DNA, 30 bp, Homo sapiens; identical to SEQ ID NO: 44246
  chr15:40546043-40546073
  hypo

SEQ ID NO: 64680 - DNA, 30 bp, Homo sapiens; identical to SEQ ID NO: 44248
  chr15:41291830-41291860
  hypo

SEQ ID NO: 64681 - DNA, 99 bp, Homo sapiens
  chr15:41835720-41835819
  hypo
cttaagtcccatttccacaactgtaaaatgtgagtaacaggtcctatataataggaaatgtgtgaggatttaaatgactatacacgcaaaacgcctagc

SEQ ID NO: 64682 - DNA, 30 bp, Homo sapiens; identical to SEQ ID NO: 44250
  chr15:41878349-41878379
  hypo

SEQ ID NO: 64683 - DNA, 30 bp, Homo sapiens; identical to SEQ ID NO: 44251
  chr15:42448030-42448060
  hypo

SEQ ID NO: 64684 - DNA, 104 bp, Homo sapiens; identical to SEQ ID NO: 44252
  chr15:42562548-42562652
  hypo

SEQ ID NO: 64685 - DNA, 248 bp, Homo sapiens; identical to SEQ ID NO: 44253
  chr15:42684673-42684921
  hypo

SEQ ID NO: 64686 - DNA, 40 bp, Homo sapiens; identical to SEQ ID NO: 44254
  chr15:42784374-42784414
  hypo

SEQ ID NO: 64687 - DNA, 141 bp, Homo sapiens; identical to SEQ ID NO: 44255
  chr15:43020219-43020360
  hypo

SEQ ID NO: 64688 - DNA, 20 bp, Homo sapiens
  chr15:43511855-43511875
  hypo
aacgatttggccaggcgcag

SEQ ID NO: 64689 - DNA, 51 bp, Homo sapiens; identical to SEQ ID NO: 44257
  chr15:43661941-43661992
  hypo

SEQ ID NO: 64690 - DNA, 94 bp, Homo sapiens
  chr15:44037474-44037568
  hypo
atgtacccacatctacgaactaggagcagttgggcagaacaaacattctactaagactcagggttttttgaaacaaaaggggctaagagtggta

SEQ ID NO: 64691 - DNA, 221 bp, Homo sapiens; identical to SEQ ID NO: 44259
  chr15:44092138-44092359
  hypo

SEQ ID NO: 64692 - DNA, 17 bp, Homo sapiens
  chr15:44116023-44116040
  hypo
tgttgagactagatacg

SEQ ID NO: 64693 - DNA, 30 bp, Homo sapiens; identical to SEQ ID NO: 44261
  chr15:45471850-45471880
  hypo

SEQ ID NO: 64694 - DNA, 23 bp, Homo sapiens
  chr15:45544201-45544224
  hypo
cggcctcccgaagtgctgggatt

SEQ ID NO: 64695 - DNA, 20 bp, Homo sapiens
  chr15:48906097-48906117
  hypo
ctgggcgacagagtgagact

SEQ ID NO: 64696 - DNA, 204 bp, Homo sapiens; identical to SEQ ID NO: 44264
  chr15:49182759-49182963
  hypo

SEQ ID NO: 64697 - DNA, 22 bp, Homo sapiens
  chr15:51202484-51202506
  hypo
aggcgctcgatggttgcacgga

SEQ ID NO: 64698 - DNA, 29 bp, Homo sapiens
  chr15:52967811-52967840
  hypo
aacttagtgttaggccgggcgcggtggct

SEQ ID NO: 64699 - DNA, 145 bp, Homo sapiens; identical to SEQ ID NO: 15900
  chr15:53976280-53976425
  hypo

SEQ ID NO: 64700 - DNA, 43 bp, Homo sapiens; identical to SEQ ID NO: 44269
  chr15:55689108-55689151
  hypo

SEQ ID NO: 64701 - DNA, 9 bp, Homo sapiens
  chr15:55699080-55699089
  hypo
ttttgactg

SEQ ID NO: 64702 - DNA, 92 bp, Homo sapiens; identical to SEQ ID NO: 44271
  chr15:55806620-55806712
  hypo

SEQ ID NO: 64703 - DNA, 28 bp, Homo sapiens
  chr15:59158460-59158488
  hypo
gcccggccccaggtttggattctttcac

SEQ ID NO: 64704 - DNA, 30 bp, Homo sapiens; identical to SEQ ID NO: 44273
  chr15:59243729-59243759
  hypo

SEQ ID NO: 64705 - DNA, 30 bp, Homo sapiens; identical to SEQ ID NO: 44274
  chr15:59453484-59453514
  hypo

SEQ ID NO: 64706 - DNA, 30 bp, Homo sapiens; identical to SEQ ID NO: 44275
  chr15:60915264-60915294
  hypo

SEQ ID NO: 64707 - DNA, 30 bp, Homo sapiens; identical to SEQ ID NO: 44276
  chr15:61305596-61305626
  hypo

SEQ ID NO: 64708 - DNA, 30 bp, Homo sapiens; identical to SEQ ID NO: 44277
  chr15:62361320-62361350
  hypo

SEQ ID NO: 64709 - DNA, 44 bp, Homo sapiens; identical to SEQ ID NO: 44278
  chr15:62367703-62367747
  hypo

SEQ ID NO: 64710 - DNA, 223 bp, Homo sapiens; identical to SEQ ID NO: 44279
  chr15:63753342-63753565
  hypo

SEQ ID NO: 64711 - DNA, 30 bp, Homo sapiens; identical to SEQ ID NO: 44280
  chr15:64440388-64440418
  hypo

SEQ ID NO: 64712 - DNA, 30 bp, Homo sapiens; identical to SEQ ID NO: 44281
  chr15:64443222-64443252
  hypo

SEQ ID NO: 64713 - DNA, 152 bp, Homo sapiens; identical to SEQ ID NO: 44282
  chr15:65043526-65043678
  hypo

SEQ ID NO: 64714 - DNA, 45 bp, Homo sapiens; identical to SEQ ID NO: 44283
  chr15:65127716-65127761
  hypo

SEQ ID NO: 64715 - DNA, 44 bp, Homo sapiens; identical to SEQ ID NO: 44284
  chr15:65622974-65623018
  hypo

SEQ ID NO: 64716 - DNA, 73 bp, Homo sapiens
  chr15:65862121-65862194
  hypo
atttcttaacttgggttatataaactcaaatgtttatttggcagtattctttagactgcgtttgaacatgtgt

SEQ ID NO: 64717 - DNA, 33 bp, Homo sapiens; identical to SEQ ID NO: 44286
  chr15:66147762-66147795
  hypo

SEQ ID NO: 64718 - DNA, 192 bp, Homo sapiens; identical to SEQ ID NO: 44287
  chr15:66598802-66598994
  hypo

SEQ ID NO: 64719 - DNA, 30 bp, Homo sapiens; identical to SEQ ID NO: 44288
  chr15:66788210-66788240
  hypo

SEQ ID NO: 64720 - DNA, 34 bp, Homo sapiens; identical to SEQ ID NO: 44289
  chr15:66789324-66789358
  hypo

SEQ ID NO: 64721 - DNA, 131 bp, Homo sapiens; identical to SEQ ID NO: 44290
  chr15:66963229-66963360
  hypo

SEQ ID NO: 64722 - DNA, 35 bp, Homo sapiens; identical to SEQ ID NO: 44291
  chr15:66963682-66963717
  hypo

SEQ ID NO: 64723 - DNA, 72 bp, Homo sapiens; identical to SEQ ID NO: 44292
  chr15:66964011-66964083
  hypo

SEQ ID NO: 64724 - DNA, 39 bp, Homo sapiens; identical to SEQ ID NO: 44293
  chr15:67457364-67457403
  hypo

SEQ ID NO: 64725 - DNA, 81 bp, Homo sapiens; identical to SEQ ID NO: 15907
  chr15:67545405-67545486
  hypo

SEQ ID NO: 64726 - DNA, 23 bp, Homo sapiens
  chr15:69324757-69324780
  hypo
tttttttttctgagacggagtct

SEQ ID NO: 64727 - DNA, 30 bp, Homo sapiens; identical to SEQ ID NO: 44296
  chr15:69754387-69754417
  hypo

SEQ ID NO: 64728 - DNA, 30 bp, Homo sapiens; identical to SEQ ID NO: 15908
  chr15:70075720-70075750
  hypo

SEQ ID NO: 64729 - DNA, 18 bp, Homo sapiens
  chr15:71117912-71117930
  hypo
tttttttttttgagacgg

SEQ ID NO: 64730 - DNA, 176 bp, Homo sapiens; identical to SEQ ID NO: 15909
  chr15:72102772-72102948
  hypo

SEQ ID NO: 64731 - DNA, 17 bp, Homo sapiens
  chr15:72411795-72411812
  hypo
tggaggtcatttagccg

SEQ ID NO: 64732 - DNA, 133 bp, Homo sapiens; identical to SEQ ID NO: 25159
  chr15:72412176-72412309
  hypo

SEQ ID NO: 64733 - DNA, 30 bp, Homo sapiens; identical to SEQ ID NO: 44302
  chr15:72462639-72462669
  hypo

SEQ ID NO: 64734 - DNA, 319 bp, Homo sapiens; identical to SEQ ID NO: 44303
  chr15:72581481-72581800
  hypo

SEQ ID NO: 64735 - DNA, 30 bp, Homo sapiens; identical to SEQ ID NO: 44304
  chr15:72743660-72743690
  hypo

SEQ ID NO: 64736 - DNA, 36 bp, Homo sapiens; identical to SEQ ID NO: 44305
  chr15:72768976-72769012
  hypo

SEQ ID NO: 64737 - DNA, 30 bp, Homo sapiens; identical to SEQ ID NO: 44306
  chr15:73919229-73919259
  hypo

SEQ ID NO: 64738 - DNA, 96 bp, Homo sapiens; identical to SEQ ID NO: 44307
  chr15:74790274-74790370
  hypo

SEQ ID NO: 64739 - DNA, 30 bp, Homo sapiens; identical to SEQ ID NO: 44310
  chr15:74911603-74911633
  hypo

SEQ ID NO: 64740 - DNA, 101 bp, Homo sapiens; identical to SEQ ID NO: 44311
  chr15:75143124-75143225
  hypo

SEQ ID NO: 64741 - DNA, 76 bp, Homo sapiens; identical to SEQ ID NO: 44313
  chr15:76197445-76197521
  hypo

SEQ ID NO: 64742 - DNA, 30 bp, Homo sapiens; identical to SEQ ID NO: 15913
  chr15:76510088-76510118
  hypo

SEQ ID NO: 64743 - DNA, 81 bp, Homo sapiens; identical to SEQ ID NO: 44315
  chr15:77852830-77852911
  hypo

SEQ ID NO: 64744 - DNA, 51 bp, Homo sapiens; identical to SEQ ID NO: 44316
  chr15:77906947-77906998
  hypo

SEQ ID NO: 64745 - DNA, 30 bp, Homo sapiens; identical to SEQ ID NO: 44317
  chr15:78252931-78252961
  hypo

SEQ ID NO: 64746 - DNA, 30 bp, Homo sapiens; identical to SEQ ID NO: 44318
  chr15:78277490-78277520
  hypo

SEQ ID NO: 64747 - DNA, 15 bp, Homo sapiens
  chr15:78501791-78501806
  hypo
cgtgtgcttccgggg

SEQ ID NO: 64748 - DNA, 30 bp, Homo sapiens; identical to SEQ ID NO: 44320
  chr15:78503615-78503645
  hypo

SEQ ID NO: 64749 - DNA, 139 bp, Homo sapiens; identical to SEQ ID NO: 15917
  chr15:78609750-78609889
  hypo

SEQ ID NO: 64750 - DNA, 68 bp, Homo sapiens; identical to SEQ ID NO: 44323
  chr15:79055979-79056047
  hypo

SEQ ID NO: 64751 - DNA, 30 bp, Homo sapiens; identical to SEQ ID NO: 44324
  chr15:79057117-79057147
  hypo

SEQ ID NO: 64752 - DNA, 66 bp, Homo sapiens; identical to SEQ ID NO: 44325
  chr15:80624497-80624563
  hypo

SEQ ID NO: 64753 - DNA, 48 bp, Homo sapiens; identical to SEQ ID NO: 44326
  chr15:82042541-82042589
  hypo

SEQ ID NO: 64754 - DNA, 162 bp, Homo sapiens; identical to SEQ ID NO: 44327
  chr15:82205642-82205804
  hypo

SEQ ID NO: 64755 - DNA, 21 bp, Homo sapiens
  chr15:83572455-83572476
  hypo
ctgaacaagactgggcgcagt

SEQ ID NO: 64756 - DNA, 95 bp, Homo sapiens; identical to SEQ ID NO: 15918
  chr15:83655934-83656029
  hypo

SEQ ID NO: 64757 - DNA, 29 bp, Homo sapiens
  chr15:83665114-83665143
  hypo
tggcgcggtggctcacgcctgtaatccca

SEQ ID NO: 64758 - DNA, 37 bp, Homo sapiens; identical to SEQ ID NO: 44331
  chr15:84582058-84582095
  hypo

SEQ ID NO: 64759 - DNA, 30 bp, Homo sapiens; identical to SEQ ID NO: 44332
  chr15:84950141-84950171
  hypo

SEQ ID NO: 64760 - DNA, 159 bp, Homo sapiens; identical to SEQ ID NO: 44333
  chr15:85143074-85143233
  hypo

SEQ ID NO: 64761 - DNA, 47 bp, Homo sapiens; identical to SEQ ID NO: 44334
  chr15:85728800-85728847
  hypo

SEQ ID NO: 64762 - DNA, 27 bp, Homo sapiens
  chr15:85886665-85886692
  hypo
gattttaacttgcgttagtgaactaat

SEQ ID NO: 64763 - DNA, 38 bp, Homo sapiens; identical to SEQ ID NO: 44336
  chr15:89142361-89142399
  hypo

SEQ ID NO: 64764 - DNA, 30 bp, Homo sapiens; identical to SEQ ID NO: 44337
  chr15:89145873-89145903
  hypo

SEQ ID NO: 64765 - DNA, 20 bp, Homo sapiens
  chr15:89448511-89448531
  hypo
taataaatcattcatcgggg

SEQ ID NO: 64766 - DNA, 214 bp, Homo sapiens; identical to SEQ ID NO: 44339
  chr15:89876593-89876807
  hypo

SEQ ID NO: 64767 - DNA, 214 bp, Homo sapiens; identical to SEQ ID NO: 44340
  chr15:89876867-89877081
  hypo

SEQ ID NO: 64768 - DNA, 199 bp, Homo sapiens; identical to SEQ ID NO: 44341
  chr15:90109400-90109599
  hypo

SEQ ID NO: 64769 - DNA, 30 bp, Homo sapiens; identical to SEQ ID NO: 44342
  chr15:90501049-90501079
  hypo

SEQ ID NO: 64770 - DNA, 30 bp, Homo sapiens; identical to SEQ ID NO: 44343
  chr15:90501399-90501429
  hypo

SEQ ID NO: 64771 - DNA, 30 bp, Homo sapiens; identical to SEQ ID NO: 15919
  chr15:90630578-90630608
  hypo

SEQ ID NO: 64772 - DNA, 39 bp, Homo sapiens
  chr15:90667422-90667461
  hypo
cctttttttttgagacggagtttcactcttgttgcccag

SEQ ID NO: 64773 - DNA, 20 bp, Homo sapiens
  chr15:90703242-90703262
  hypo
ttgtttgtttttttgcgggg

SEQ ID NO: 64774 - DNA, 20 bp, Homo sapiens
  chr15:90741434-90741454
  hypo
caccgcgcctggctggtaaa

SEQ ID NO: 64775 - DNA, 30 bp, Homo sapiens; identical to SEQ ID NO: 44348
  chr15:90755834-90755864
  hypo

SEQ ID NO: 64776 - DNA, 55 bp, Homo sapiens; identical to SEQ ID NO: 44349
  chr15:90866273-90866328
  hypo

SEQ ID NO: 64777 - DNA, 35 bp, Homo sapiens; identical to SEQ ID NO: 44350
  chr15:90896205-90896240
  hypo

SEQ ID NO: 64778 - DNA, 116 bp, Homo sapiens; identical to SEQ ID NO: 15922
  chr15:91189343-91189459
  hypo

SEQ ID NO: 64779 - DNA, 22 bp, Homo sapiens
  chr15:91313693-91313715
  hypo
ccgtgcccggccaatccccaca

SEQ ID NO: 64780 - DNA, 30 bp, Homo sapiens; identical to SEQ ID NO: 15924
  chr15:91409404-91409434
  hypo

SEQ ID NO: 64781 - DNA, 30 bp, Homo sapiens; identical to SEQ ID NO: 44354
  chr15:91500770-91500800
  hypo

SEQ ID NO: 64782 - DNA, 46 bp, Homo sapiens; identical to SEQ ID NO: 44355
  chr15:92459343-92459389
  hypo

SEQ ID NO: 64783 - DNA, 98 bp, Homo sapiens; identical to SEQ ID NO: 44356
  chr15:92459593-92459691
  hypo

SEQ ID NO: 64784 - DNA, 30 bp, Homo sapiens; identical to SEQ ID NO: 44357
  chr15:92701704-92701734
  hypo

SEQ ID NO: 64785 - DNA, 18 bp, Homo sapiens
  chr15:93364650-93364668
  hypo
tctcgggggaaaaaaaaa

SEQ ID NO: 64786 - DNA, 121 bp, Homo sapiens; identical to SEQ ID NO: 44359
  chr15:93594841-93594962
  hypo

SEQ ID NO: 64787 - DNA, 45 bp, Homo sapiens; identical to SEQ ID NO: 44360
  chr15:93609520-93609565
  hypo

SEQ ID NO: 64788 - DNA, 63 bp, Homo sapiens; identical to SEQ ID NO: 44361
  chr15:93609815-93609878
  hypo

SEQ ID NO: 64789 - DNA, 33 bp, Homo sapiens; identical to SEQ ID NO: 44362
  chr15:93902389-93902422
  hypo

SEQ ID NO: 64790 - DNA, 40 bp, Homo sapiens; identical to SEQ ID NO: 44364
  chr15:94478454-94478494
  hypo

SEQ ID NO: 64791 - DNA, 30 bp, Homo sapiens; identical to SEQ ID NO: 44365
  chr15:94925846-94925876
  hypo

SEQ ID NO: 64792 - DNA, 19 bp, Homo sapiens
  chr15:97006353-97006372
  hypo
catgtctgtgacatccgtg

SEQ ID NO: 64793 - DNA, 30 bp, Homo sapiens; identical to SEQ ID NO: 44367
  chr15:98417575-98417605
  hypo

SEQ ID NO: 64794 - DNA, 31 bp, Homo sapiens; identical to SEQ ID NO: 15930
  chr15:98454964-98454995
  hypo

SEQ ID NO: 64795 - DNA, 38 bp, Homo sapiens; identical to SEQ ID NO: 44369
  chr15:98776801-98776839
  hypo

SEQ ID NO: 64796 - DNA, 26 bp, Homo sapiens
  chr15:99168900-99168926
  hypo
acctcagagtcctcacgtataaaatg

SEQ ID NO: 64797 - DNA, 90 bp, Homo sapiens; identical to SEQ ID NO: 44371
  chr15:99183400-99183490
  hypo

SEQ ID NO: 64798 - DNA, 42 bp, Homo sapiens; identical to SEQ ID NO: 44372
  chr15:99254581-99254623
  hypo

SEQ ID NO: 64799 - DNA, 41 bp, Homo sapiens; identical to SEQ ID NO: 44373
  chr15:99295597-99295638
  hypo

SEQ ID NO: 64800 - DNA, 30 bp, Homo sapiens; identical to SEQ ID NO: 44374
  chr15:99454637-99454667
  hypo

SEQ ID NO: 64801 - DNA, 33 bp, Homo sapiens; identical to SEQ ID NO: 44375
  chr15:99456398-99456431
  hypo

SEQ ID NO: 64802 - DNA, 48 bp, Homo sapiens; identical to SEQ ID NO: 44376
  chr15:99460220-99460268
  hypo

SEQ ID NO: 64803 - DNA, 38 bp, Homo sapiens; identical to SEQ ID NO: 44377
  chr15:99484067-99484105
  hypo

SEQ ID NO: 64804 - DNA, 132 bp, Homo sapiens; identical to SEQ ID NO: 15933
  chr15:99484456-99484588
  hypo

SEQ ID NO: 64805 - DNA, 30 bp, Homo sapiens; identical to SEQ ID NO: 44379
  chr15:99506147-99506177
  hypo

SEQ ID NO: 64806 - DNA, 30 bp, Homo sapiens; identical to SEQ ID NO: 44380
  chr15:99974913-99974943
  hypo

SEQ ID NO: 64807 - DNA, 30 bp, Homo sapiens; identical to SEQ ID NO: 44381
  chr15:99981097-99981127
  hypo

SEQ ID NO: 64808 - DNA, 30 bp, Homo sapiens; identical to SEQ ID NO: 44382
  chr15:100378951-100378981
  hypo

SEQ ID NO: 64809 - DNA, 30 bp, Homo sapiens; identical to SEQ ID NO: 44383
  chr15:100888957-100888987
  hypo

SEQ ID NO: 64810 - DNA, 326 bp, Homo sapiens; identical to SEQ ID NO: 44384
  chr15:102043003-102043329
  hypo

SEQ ID NO: 64811 - DNA, 22 bp, Homo sapiens
  chr15:102193729-102193751
  hypo
gagactccgtctcaaaaaataa

SEQ ID NO: 64812 - DNA, 30 bp, Homo sapiens; identical to SEQ ID NO: 44386
  chr15:102276370-102276400
  hypo

SEQ ID NO: 64813 - DNA, 23 bp, Homo sapiens
  chr16:142626-142649
  hypo
ttctgacaaggagaccggcaagg

SEQ ID NO: 64814 - DNA, 120 bp, Homo sapiens; identical to SEQ ID NO: 44388
  chr16:189557-189677
  hypo

SEQ ID NO: 64815 - DNA, 23 bp, Homo sapiens
  chr16:208745-208768
  hypo
ttttcttttttgagacggaatct

SEQ ID NO: 64816 - DNA, 30 bp, Homo sapiens; identical to SEQ ID NO: 44390
  chr16:318060-318090
  hypo

SEQ ID NO: 64817 - DNA, 38 bp, Homo sapiens; identical to SEQ ID NO: 44391
  chr16:319924-319962
  hypo

SEQ ID NO: 64818 - DNA, 158 bp, Homo sapiens; identical to SEQ ID NO: 44392
  chr16:323428-323586
  hypo

SEQ ID NO: 64819 - DNA, 92 bp, Homo sapiens; identical to SEQ ID NO: 44393
  chr16:332635-332727
  hypo

SEQ ID NO: 64820 - DNA, 39 bp, Homo sapiens
  chr16:337560-337599
  hypo
atgtacatatttacacgggccctcagaaaggaggaccca

SEQ ID NO: 64821 - DNA, 119 bp, Homo sapiens
  chr16:337659-337778
  hypo
caggcaagagacaagctgtgttgaaggcactcggtggcgcgtacaattgacagaggccctgcaggcctctgcatccgggcctgggccccacccagacctgggtacgtgggcaaatccca

SEQ ID NO: 64822 - DNA, 119 bp, Homo sapiens; identical to SEQ ID NO: 25185
  chr16:410258-410377
  hypo

SEQ ID NO: 64823 - DNA, 307 bp, Homo sapiens
  chr16:410407-410714
  hypo
ctaataacctaacaatcgtgtcaacgggagctttgaacccccagggcgcgcctgccaggccaactgagagctcaaggcctctgtgggcagcaggacgtggtcggggggaggagacgcagccacggctgtcctcacacccagctcggcccctgcgggctcctctgggcagaacctggggaaggcacggcctctagcaggaggtggaggcctttgaaagggtgcaggtgttgggaccaggtacccggcccaggcccccagccgcgtccacacacgtcgcacacggcagcaaggacgcaagcagtgtgga

SEQ ID NO: 64824 - DNA, 461 bp, Homo sapiens; identical to SEQ ID NO: 44396
  chr16:411043-411504
  hypo

SEQ ID NO: 64825 - DNA, 309 bp, Homo sapiens; identical to SEQ ID NO: 44397
  chr16:412764-413073
  hypo

SEQ ID NO: 64826 - DNA, 30 bp, Homo sapiens; identical to SEQ ID NO: 44398
  chr16:501353-501383
  hypo

SEQ ID NO: 64827 - DNA, 19 bp, Homo sapiens
  chr16:611950-611969
  hypo
gtgcagccagggccccgca

SEQ ID NO: 64828 - DNA, 60 bp, Homo sapiens
  chr16:612260-612320
  hypo
ggagctgggctgagcaggtggctgagccgtggggccatgctgggacgtccactccccaca

SEQ ID NO: 64829 - DNA, 72 bp, Homo sapiens; identical to SEQ ID NO: 44402
  chr16:613552-613624
  hypo

SEQ ID NO: 64830 - DNA, 134 bp, Homo sapiens; identical to SEQ ID NO: 44403
  chr16:613908-614042
  hypo

SEQ ID NO: 64831 - DNA, 30 bp, Homo sapiens; identical to SEQ ID NO: 44404
  chr16:614353-614383
  hypo

SEQ ID NO: 64832 - DNA, 480 bp, Homo sapiens; identical to SEQ ID NO: 44405
  chr16:614777-615257
  hypo

SEQ ID NO: 64833 - DNA, 30 bp, Homo sapiens; identical to SEQ ID NO: 44406
  chr16:623234-623264
  hypo

SEQ ID NO: 64834 - DNA, 84 bp, Homo sapiens; identical to SEQ ID NO: 44407
  chr16:643882-643966
  hypo

SEQ ID NO: 64835 - DNA, 117 bp, Homo sapiens; identical to SEQ ID NO: 44408
  chr16:666790-666907
  hypo

SEQ ID NO: 64836 - DNA, 63 bp, Homo sapiens; identical to SEQ ID NO: 25191
  chr16:667484-667547
  hypo

SEQ ID NO: 64837 - DNA, 61 bp, Homo sapiens; identical to SEQ ID NO: 44410
  chr16:677848-677909
  hypo

SEQ ID NO: 64838 - DNA, 175 bp, Homo sapiens
  chr16:700124-700299
  hypo
gcccagcaagcacttcgtcatccacctcgatgtgtcctccaaggtacggagcccgcggctgggggctgcgtgggagccccggcacccctgcggcccctgtctcctcacggccctgctccgtccccacaggacaaccaagtcatccgtgtgtctttctccaacctcttcaaggagt

SEQ ID NO: 64839 - DNA, 64 bp, Homo sapiens; identical to SEQ ID NO: 44412
  chr16:700572-700636
  hypo

SEQ ID NO: 64840 - DNA, 30 bp, Homo sapiens; identical to SEQ ID NO: 44413
  chr16:721696-721726
  hypo

SEQ ID NO: 64841 - DNA, 57 bp, Homo sapiens
  chr16:726990-727047
  hypo
cggggcccgcctcaacaagtgggtgctgcagacctaccaccccgagtacatgaagag

SEQ ID NO: 64842 - DNA, 135 bp, Homo sapiens
  chr16:731353-731488
  hypo
ggctgacaagctgcccggttgtggggcctctggggccaggcgggtggactggccagagagtgacgtgaagcccccgttccccagcttacagcctggccaaggagcagcggctgaacttcggggacgacatcccca

SEQ ID NO: 64843 - DNA, 464 bp, Homo sapiens
  chr16:734741-735205
  hypo
actcgcagaggtggccgcagcctgcgggacagtgggagctgccttccagccacttcatgatgtgctgcaggtggccgccgtggctgcagccctggcaccacacgaagagacccttgactacgtggtggcagacggcacacatgctggcgcagcggtggcacctgggggcgggcgggagggagggtgcctcagcgggggctgctgcgctgcctgcaggcccctgccccacctcccgaccccactgccccacctgtcgcagacccagccccggctgctcatgggccgcttgcagtggctgcagttgacgtgcagggtggtggaggcctggttgaggcagctgacggcgcggctggtgctcagcttgaccacctcgttggacacgttccagaggcggaagcgctgcagcaggtcgatgtaggaagtgtaccagtgctcctgggggagggagcgcccggcagtcagga

SEQ ID NO: 64844 - DNA, 357 bp, Homo sapiens
  chr16:735594-735951
  hypo
cggctggaaggcagggaccagcggaggctctgagtctgtcctccatccgcctctgaaccccaccctgcccggacccccactcacggtgcgcgtgttccggatccagcaggtacagctcgtcctcctcaccttccacgtcacccagcaggtagtcggcaggtacgtcgctgccctcggtttcctcgttatctgcccgacaatggggcgggcattcagggtcgtctgggacacccccacccctctcccatcagcacccctacccaccccagcctaccctcattggtgatgagtgtggccgaggagtcgagcagaactgtgtcgctccgtgcatctcctttgctgcggtccagccgcgtc

SEQ ID NO: 64845 - DNA, 30 bp, Homo sapiens; identical to SEQ ID NO: 44418
  chr16:760916-760946
  hypo

SEQ ID NO: 64846 - DNA, 244 bp, Homo sapiens; identical to SEQ ID NO: 44419
  chr16:775524-775768
  hypo

SEQ ID NO: 64847 - DNA, 126 bp, Homo sapiens; identical to SEQ ID NO: 44420
  chr16:798233-798359
  hypo

SEQ ID NO: 64848 - DNA, 30 bp, Homo sapiens; identical to SEQ ID NO: 15953
  chr16:809500-809530
  hypo

SEQ ID NO: 64849 - DNA, 267 bp, Homo sapiens; identical to SEQ ID NO: 44422
  chr16:809787-810054
  hypo

SEQ ID NO: 64850 - DNA, 193 bp, Homo sapiens; identical to SEQ ID NO: 44423
  chr16:816004-816197
  hypo

SEQ ID NO: 64851 - DNA, 19 bp, Homo sapiens
  chr16:822477-822496
  hypo
actccgtctcaaaaaatga

SEQ ID NO: 64852 - DNA, 30 bp, Homo sapiens; identical to SEQ ID NO: 44425
  chr16:822951-822981
  hypo

SEQ ID NO: 64853 - DNA, 289 bp, Homo sapiens; identical to SEQ ID NO: 44426
  chr16:824923-825212
  hypo

SEQ ID NO: 64854 - DNA, 53 bp, Homo sapiens; identical to SEQ ID NO: 25202
  chr16:837308-837361
  hypo

SEQ ID NO: 64855 - DNA, 98 bp, Homo sapiens
  chr16:837460-837558
  hypo
ccagctggtggcagaacctggagtgggacagagtccagagtctgagccactttcctccacagacgccaccgtggggctccggccgccccccctacctg

SEQ ID NO: 64856 - DNA, 507 bp, Homo sapiens
  chr16:845985-846492
  hypo
ctggccagcctggtgggcacgatgctcgcttacagcctgacctaccgccaggagcgcacgcccgatggccagtacatctacaggctggagccgtgagtcccccagtgcctggggtgtgctccagggtcatgctccccggctgtgctccatgttcagggcccgcatggggccaggagtctgaaagcacggtcatggcgtctgggggtggcgggccccagcttatcttttgctcagatgtaaccgtgaaggggggtcacttccagctacttgagattggctctgggacctgagttttgctgcagagctgctcccagccttagcacccccacatggaactggagccgggggccccgagagtgactgcactttccaacactccgtttcccgctgtgggatggccatgggggtggtgggggtgaggcatggggcagtggccccggggtcctgctgccccagcgacggcaccaacttgcaggacgctgagtcactctccgtggcagccatcgg

SEQ ID NO: 64857 - DNA, 66 bp, Homo sapiens; identical to SEQ ID NO: 44429
  chr16:847020-847086
  hypo

SEQ ID NO: 64858 - DNA, 53 bp, Homo sapiens; identical to SEQ ID NO: 15959
  chr16:858748-858801
  hypo

SEQ ID NO: 64859 - DNA, 185 bp, Homo sapiens; identical to SEQ ID NO: 44431
  chr16:870944-871129
  hypo

SEQ ID NO: 64860 - DNA, 79 bp, Homo sapiens; identical to SEQ ID NO: 44432
  chr16:882403-882482
  hypo

SEQ ID NO: 64861 - DNA, 93 bp, Homo sapiens
  chr16:882588-882681
  hypo
ttagctgtgggatgtttgggctttgaaaggagctgatctgacggagccaggagggctggctgcaggacagagacaggacggctgtcacagcag

SEQ ID NO: 64862 - DNA, 30 bp, Homo sapiens; identical to SEQ ID NO: 44434
  chr16:883678-883708
  hypo

SEQ ID NO: 64863 - DNA, 131 bp, Homo sapiens; identical to SEQ ID NO: 44435
  chr16:888838-888969
  hypo

SEQ ID NO: 64864 - DNA, 30 bp, Homo sapiens; identical to SEQ ID NO: 44436
  chr16:891770-891800
  hypo

SEQ ID NO: 64865 - DNA, 203 bp, Homo sapiens
  chr16:894890-895093
  hypo
cagagcctgcctctccgggactgggcttcggccgagcagacaccgcctagctgctctttgaccagcgttctctgctctgcgtctggctggcatcggcggcttgctgagtccagcctggcatctcgctggcatcggcggctcgctgggtccagcctggcgctgacacgtttctgtgctcatttcattttacaaatcaactcccc

SEQ ID NO: 64866 - DNA, 285 bp, Homo sapiens; identical to SEQ ID NO: 44438
  chr16:924548-924833
  hypo

SEQ ID NO: 64867 - DNA, 22 bp, Homo sapiens
  chr16:943459-943481
  hypo
ggatgagcccaaagtcggaggg

SEQ ID NO: 64868 - DNA, 60 bp, Homo sapiens
  chr16:943553-943613
  hypo
tctcccacacactgcagctcgcctgctgtgaggactcctggggcacgggacaggcttcca

SEQ ID NO: 64869 - DNA, 132 bp, Homo sapiens; identical to SEQ ID NO: 44440
  chr16:963266-963398
  hypo

SEQ ID NO: 64870 - DNA, 76 bp, Homo sapiens; identical to SEQ ID NO: 44441
  chr16:965804-965880
  hypo

SEQ ID NO: 64871 - DNA, 30 bp, Homo sapiens; identical to SEQ ID NO: 44442
  chr16:968262-968292
  hypo

SEQ ID NO: 64872 - DNA, 45 bp, Homo sapiens; identical to SEQ ID NO: 44443
  chr16:968601-968646
  hypo

SEQ ID NO: 64873 - DNA, 77 bp, Homo sapiens; identical to SEQ ID NO: 44444
  chr16:981729-981806
  hypo

SEQ ID NO: 64874 - DNA, 30 bp, Homo sapiens; identical to SEQ ID NO: 44445
  chr16:1022784-1022814
  hypo

SEQ ID NO: 64875 - DNA, 131 bp, Homo sapiens; identical to SEQ ID NO: 44446
  chr16:1040337-1040468
  hypo

SEQ ID NO: 64876 - DNA, 115 bp, Homo sapiens
  chr16:1052472-1052587
  hypo
cacatgtgcacctgccgcagccccgatgtccctccccgggtgaaggaacccacggacgtggctcatccataccgcggaacgtgagccatgaaaaggggcagcctcggctcagcca

SEQ ID NO: 64877 - DNA, 30 bp, Homo sapiens; identical to SEQ ID NO: 44448
  chr16:1061426-1061456
  hypo

SEQ ID NO: 64878 - DNA, 32 bp, Homo sapiens; identical to SEQ ID NO: 44449
  chr16:1062412-1062444
  hypo

SEQ ID NO: 64879 - DNA, 30 bp, Homo sapiens; identical to SEQ ID NO: 44450
  chr16:1072992-1073022
  hypo

SEQ ID NO: 64880 - DNA, 42 bp, Homo sapiens; identical to SEQ ID NO: 44451
  chr16:1073516-1073558
  hypo

SEQ ID NO: 64881 - DNA, 51 bp, Homo sapiens; identical to SEQ ID NO: 44452
  chr16:1076434-1076485
  hypo

SEQ ID NO: 64882 - DNA, 78 bp, Homo sapiens; identical to SEQ ID NO: 44453
  chr16:1077581-1077659
  hypo

SEQ ID NO: 64883 - DNA, 217 bp, Homo sapiens; identical to SEQ ID NO: 15968
  chr16:1081773-1081990
  hypo

SEQ ID NO: 64884 - DNA, 30 bp, Homo sapiens; identical to SEQ ID NO: 44455
  chr16:1089739-1089769
  hypo

SEQ ID NO: 64885 - DNA, 30 bp, Homo sapiens; identical to SEQ ID NO: 44456
  chr16:1092742-1092772
  hypo

SEQ ID NO: 64886 - DNA, 69 bp, Homo sapiens; identical to SEQ ID NO: 44457
  chr16:1101038-1101107
  hypo

SEQ ID NO: 64887 - DNA, 30 bp, Homo sapiens; identical to SEQ ID NO: 44458
  chr16:1103161-1103191
  hypo

SEQ ID NO: 64888 - DNA, 44 bp, Homo sapiens
  chr16:1128967-1129011
  hypo
ccctcggcaggggcccgggcggtgctggtgcccgtgctgtacct

SEQ ID NO: 64889 - DNA, 51 bp, Homo sapiens
  chr16:1155111-1155162
  hypo
ggggccagcagcaggcgggtctcagcggcggtgctaccacctcccactcag

SEQ ID NO: 64890 - DNA, 206 bp, Homo sapiens; identical to SEQ ID NO: 44461
  chr16:1166561-1166767
  hypo

SEQ ID NO: 64891 - DNA, 67 bp, Homo sapiens; identical to SEQ ID NO: 44462
  chr16:1171222-1171289
  hypo

SEQ ID NO: 64892 - DNA, 143 bp, Homo sapiens; identical to SEQ ID NO: 44463
  chr16:1173250-1173393
  hypo

SEQ ID NO: 64893 - DNA, 33 bp, Homo sapiens; identical to SEQ ID NO: 44464
  chr16:1188925-1188958
  hypo

SEQ ID NO: 64894 - DNA, 152 bp, Homo sapiens; identical to SEQ ID NO: 44465
  chr16:1195670-1195822
  hypo

SEQ ID NO: 64895 - DNA, 112 bp, Homo sapiens
  chr16:1217195-1217307
  hypo
cccgtggggatgaaacgggctctttgcggggggcctgtggggtatgggcctcctgtcagcagcccgtcccggtgggtggggcttgccggccgcccgcgaatgtcaggaacct

SEQ ID NO: 64896 - DNA, 126 bp, Homo sapiens
  chr16:1217908-1218034
  hypo
ccagtgcgtggagcacgtggggcctcaggagccaggcctgttccccggggctgcctggaggcggccgcttgtccccaaggcctggtgaccgcacctctgtctgccctaggccttcgagttggggga

SEQ ID NO: 64897 - DNA, 30 bp, Homo sapiens; identical to SEQ ID NO: 44468
  chr16:1220508-1220538
  hypo

SEQ ID NO: 64898 - DNA, 30 bp, Homo sapiens; identical to SEQ ID NO: 44469
  chr16:1222610-1222640
  hypo

SEQ ID NO: 64899 - DNA, 24 bp, Homo sapiens
  chr16:1228780-1228804
  hypo
ccaagctccagaagtcggggttgg

SEQ ID NO: 64900 - DNA, 15 bp, Homo sapiens
  chr16:1228916-1228931
  hypo
cggaggaccagatgg

SEQ ID NO: 64901 - DNA, 154 bp, Homo sapiens
  chr16:1230142-1230296
  hypo
gtgccctggctgggtccctgtccctgcacaccgggtcagccggctcctgggtgcacaggcaggtggtgtgcgtccgcattgcagaacacggggcgttgcaggccggagctgggttttcacacagattgagaccaggcgtcgcccacagagcata

SEQ ID NO: 64902 - DNA, 205 bp, Homo sapiens; identical to SEQ ID NO: 44472
  chr16:1236691-1236896
  hypo

SEQ ID NO: 64903 - DNA, 30 bp, Homo sapiens; identical to SEQ ID NO: 44473
  chr16:1245806-1245836
  hypo

SEQ ID NO: 64904 - DNA, 138 bp, Homo sapiens
  chr16:1248466-1248604
  hypo
caccagggggtggcccgagtcagtgtgcagtgggcgtggacacccactgtgaacagtggacggggctcgggggtcccgggaggggctgcagccccgaggacactcctgcagggcttagcagtgccaatcctggccctg

SEQ ID NO: 64905 - DNA, 215 bp, Homo sapiens
  chr16:1248675-1248890
  hypo
gctgtgcttcttcgtcttcttcattttcggcatcgttggcgtccagctctgggctggcctcctgcggaaccgctgcttcctggacagtgcctttgtcaggtgcccaggccccacccccgtgaggcccctgcccagatggccctgcccaccatgcagataacgcaccatgtggctccaccgccccacgtggctctgcccaccgtgcagtcacccgc

SEQ ID NO: 64906 - DNA, 79 bp, Homo sapiens; identical to SEQ ID NO: 44475
  chr16:1250278-1250357
  hypo

SEQ ID NO: 64907 - DNA, 100 bp, Homo sapiens; identical to SEQ ID NO: 44476
  chr16:1251693-1251793
  hypo

SEQ ID NO: 64908 - DNA, 51 bp, Homo sapiens; identical to SEQ ID NO: 44477
  chr16:1253065-1253116
  hypo

SEQ ID NO: 64909 - DNA, 32 bp, Homo sapiens; identical to SEQ ID NO: 44478
  chr16:1259204-1259236
  hypo

SEQ ID NO: 64910 - DNA, 38 bp, Homo sapiens; identical to SEQ ID NO: 44479
  chr16:1261601-1261639
  hypo

SEQ ID NO: 64911 - DNA, 133 bp, Homo sapiens; identical to SEQ ID NO: 44480
  chr16:1262013-1262146
  hypo

SEQ ID NO: 64912 - DNA, 47 bp, Homo sapiens; identical to SEQ ID NO: 44481
  chr16:1262447-1262494
  hypo

SEQ ID NO: 64913 - DNA, 52 bp, Homo sapiens; identical to SEQ ID NO: 44482
  chr16:1265614-1265666
  hypo

SEQ ID NO: 64914 - DNA, 30 bp, Homo sapiens; identical to SEQ ID NO: 44483
  chr16:1267184-1267214
  hypo

SEQ ID NO: 64915 - DNA, 418 bp, Homo sapiens
  chr16:1268120-1268538
  hypo
cttgcagggcagggggaaggggacggcactgccagggtggcacccgcgggtgggtgtggaccccggcccacagctgtcccccaccgcaggacacgctgcgcgagtgctcccgtgaggacaagcactgcctgagctacctgccggccctgtcgcccgtctacttcgtgaccttcgtgctggtggcccagttcgtgctggtgaacgtggtggtggccgtgctcatgaagcacctggaggagagcaacaaggaggcacgggaggatgcggagctggacgccgagatcgagctggagatggcgcagggccccgggagtgcacgccgggtggacgcggacaggcctcccttgccccaggagagtccgggcgccagggacgccccaaacctggttgcacgcaaggtgtccgtgtccaggatgct

SEQ ID NO: 64916 - DNA, 150 bp, Homo sapiens; identical to SEQ ID NO: 44485
  chr16:1270207-1270357
  hypo

SEQ ID NO: 64917 - DNA, 30 bp, Homo sapiens; identical to SEQ ID NO: 44486
  chr16:1271505-1271535
  hypo

SEQ ID NO: 64918 - DNA, 38 bp, Homo sapiens; identical to SEQ ID NO: 44487
  chr16:1272194-1272232
  hypo

SEQ ID NO: 64919 - DNA, 30 bp, Homo sapiens; identical to SEQ ID NO: 44488
  chr16:1288468-1288498
  hypo

SEQ ID NO: 64920 - DNA, 39 bp, Homo sapiens; identical to SEQ ID NO: 44489
  chr16:1307000-1307039
  hypo

SEQ ID NO: 64921 - DNA, 83 bp, Homo sapiens
  chr16:1312443-1312526
  hypo
cccgaacatcctgatcgctccccagccagtcacccagcactggtccttcggggtgagctccagcgagaccggggagagcttga

SEQ ID NO: 64922 - DNA, 99 bp, Homo sapiens
  chr16:1312611-1312710
  hypo
ggggtggacgatgatccggctgacgttcagcagcccccggcccccgtagagatacacgtccccagcgtggatccggtagatggacgggtcggtgtcctt

SEQ ID NO: 64923 - DNA, 133 bp, Homo sapiens; identical to SEQ ID NO: 44491
  chr16:1315371-1315504
  hypo

SEQ ID NO: 64924 - DNA, 44 bp, Homo sapiens; identical to SEQ ID NO: 44492
  chr16:1323678-1323722
  hypo

SEQ ID NO: 64925 - DNA, 42 bp, Homo sapiens
  chr16:1324061-1324103
  hypo
cggcagcatatctgcagagacaagccacgggtggcgggagca

SEQ ID NO: 64926 - DNA, 30 bp, Homo sapiens; identical to SEQ ID NO: 44494
  chr16:1329677-1329707
  hypo

SEQ ID NO: 64927 - DNA, 191 bp, Homo sapiens; identical to SEQ ID NO: 44495
  chr16:1391751-1391942
  hypo

SEQ ID NO: 64928 - DNA, 30 bp, Homo sapiens; identical to SEQ ID NO: 44496
  chr16:1397121-1397151
  hypo

SEQ ID NO: 64929 - DNA, 311 bp, Homo sapiens; identical to SEQ ID NO: 44497
  chr16:1397548-1397859
  hypo

SEQ ID NO: 64930 - DNA, 72 bp, Homo sapiens
  chr16:1407846-1407918
  hypo
gagtttgaaacatcagtctggggcgtcctcctctaaccagtgcacttgctgctgcagcgcaggcccttcagg

SEQ ID NO: 64931 - DNA, 282 bp, Homo sapiens; identical to SEQ ID NO: 44500
  chr16:1417076-1417358
  hypo

SEQ ID NO: 64932 - DNA, 411 bp, Homo sapiens; identical to SEQ ID NO: 44501
  chr16:1417675-1418086
  hypo

SEQ ID NO: 64933 - DNA, 200 bp, Homo sapiens; identical to SEQ ID NO: 44502
  chr16:1425484-1425684
  hypo

SEQ ID NO: 64934 - DNA, 395 bp, Homo sapiens
  chr16:1428113-1428508
  hypo
ccccagaaagctgctcggcctccaagccctgcatggaatgccccccactacatccttgcaggtgtcagcctgaaccatgtcagggccctggacagactcactgaggacaggcaccgaccccccaacccgcaggcctgcccacagccccctcatgctcccatacgggggcttgatgacgggcagggccaagcggtttgcccatagtcaggtcagccaggctcgggaacctggacctgccctctgcacccaagtcccaggatcaggatatggcagccccttcagagctcaccgcccctcacacctggcagagatccagaaactcctcatgaaaatcaaagacgcaaagaagttgggggacaggaacggaggcgccttttctccccttggagtggggt

SEQ ID NO: 64935 - DNA, 34 bp, Homo sapiens
  chr16:1428873-1428907
  hypo
cctggcccactttctcacccgcagcttctccccc

SEQ ID NO: 64936 - DNA, 48 bp, Homo sapiens; identical to SEQ ID NO: 44504
  chr16:1430200-1430248
  hypo

SEQ ID NO: 64937 - DNA, 30 bp, Homo sapiens; identical to SEQ ID NO: 15991
  chr16:1486627-1486657
  hypo

SEQ ID NO: 64938 - DNA, 30 bp, Homo sapiens; identical to SEQ ID NO: 44506
  chr16:1488680-1488710
  hypo

SEQ ID NO: 64939 - DNA, 82 bp, Homo sapiens; identical to SEQ ID NO: 44507
  chr16:1491115-1491197
  hypo

SEQ ID NO: 64940 - DNA, 30 bp, Homo sapiens; identical to SEQ ID NO: 44508
  chr16:1491482-1491512
  hypo

SEQ ID NO: 64941 - DNA, 101 bp, Homo sapiens; identical to SEQ ID NO: 44509
  chr16:1493574-1493675
  hypo

SEQ ID NO: 64942 - DNA, 120 bp, Homo sapiens; identical to SEQ ID NO: 44510
  chr16:1729690-1729810
  hypo

SEQ ID NO: 64943 - DNA, 164 bp, Homo sapiens
  chr16:1730597-1730761
  hypo
acatttagttttgctgtgaagcgagtcaggtggtggctgtaagattacctagccaggttttcctctcctgagacctcacatctctcctttccttgctgagggattgtcttgtgttaaaggggtttcgtaaaagcgttatgctttagccgcgattaacctgaggt

SEQ ID NO: 64944 - DNA, 30 bp, Homo sapiens; identical to SEQ ID NO: 44512
  chr16:1734955-1734985
  hypo

SEQ ID NO: 64945 - DNA, 127 bp, Homo sapiens
  chr16:1741726-1741853
  hypo
ctcagggctggcactcggggttcctatgagaggaggtctccaaagcactgcgggggtggggtggggtggggtccggtggacgtctggttgctcagtgttctgtgatcgtttctgcagggggtaaagg

SEQ ID NO: 64946 - DNA, 262 bp, Homo sapiens; identical to SEQ ID NO: 44514
  chr16:1813482-1813744
  hypo

SEQ ID NO: 64947 - DNA, 55 bp, Homo sapiens; identical to SEQ ID NO: 44515
  chr16:1813946-1814001
  hypo

SEQ ID NO: 64948 - DNA, 48 bp, Homo sapiens; identical to SEQ ID NO: 44516
  chr16:1814297-1814345
  hypo

SEQ ID NO: 64949 - DNA, 30 bp, Homo sapiens; identical to SEQ ID NO: 44517
  chr16:1831357-1831387
  hypo

SEQ ID NO: 64950 - DNA, 39 bp, Homo sapiens; identical to SEQ ID NO: 44518
  chr16:1833960-1833999
  hypo

SEQ ID NO: 64951 - DNA, 30 bp, Homo sapiens; identical to SEQ ID NO: 44519
  chr16:1946973-1947003
  hypo

SEQ ID NO: 64952 - DNA, 30 bp, Homo sapiens; identical to SEQ ID NO: 44520
  chr16:1962525-1962555
  hypo

SEQ ID NO: 64953 - DNA, 96 bp, Homo sapiens; identical to SEQ ID NO: 44521
  chr16:2028658-2028754
  hypo

SEQ ID NO: 64954 - DNA, 100 bp, Homo sapiens
  chr16:2028972-2029072
  hypo
ctggccagggagatccgccctccccgctcctccccagccctgggatggcgcggtccatcccctcatcgggatcctcgcgctcactgctccgtcgtggggt

SEQ ID NO: 64955 - DNA, 60 bp, Homo sapiens
  chr16:2029137-2029197
  hypo
cgtgtgacggtgcagcagcggctctggatggcgcccggcgaaggtcgggtgggcacggtg

SEQ ID NO: 64956 - DNA, 200 bp, Homo sapiens; identical to SEQ ID NO: 44523
  chr16:2105061-2105261
  hypo

SEQ ID NO: 64957 - DNA, 102 bp, Homo sapiens; identical to SEQ ID NO: 44525
  chr16:2145625-2145727
  hypo

SEQ ID NO: 64958 - DNA, 30 bp, Homo sapiens; identical to SEQ ID NO: 44526
  chr16:2146363-2146393
  hypo

SEQ ID NO: 64959 - DNA, 23 bp, Homo sapiens
  chr16:2151275-2151298
  hypo
cgcccggccgacagtttttaaaa

SEQ ID NO: 64960 - DNA, 112 bp, Homo sapiens; identical to SEQ ID NO: 44528
  chr16:2193270-2193382
  hypo

SEQ ID NO: 64961 - DNA, 142 bp, Homo sapiens; identical to SEQ ID NO: 44529
  chr16:2212716-2212858
  hypo

SEQ ID NO: 64962 - DNA, 52 bp, Homo sapiens; identical to SEQ ID NO: 44530
  chr16:2213671-2213723
  hypo

SEQ ID NO: 64963 - DNA, 30 bp, Homo sapiens; identical to SEQ ID NO: 44531
  chr16:2229690-2229720
  hypo

SEQ ID NO: 64964 - DNA, 231 bp, Homo sapiens; identical to SEQ ID NO: 44532
  chr16:2229967-2230198
  hypo

SEQ ID NO: 64965 - DNA, 605 bp, Homo sapiens; identical to SEQ ID NO: 44533
  chr16:2230512-2231117
  hypo

SEQ ID NO: 64966 - DNA, 141 bp, Homo sapiens; identical to SEQ ID NO: 44535
  chr16:2233066-2233207
  hypo

SEQ ID NO: 64967 - DNA, 412 bp, Homo sapiens
  chr16:2234314-2234726
  hypo
ggcctcgggctggaccggaaggtgggctctgtgcccacaggcaggggcaccttgcctcctccaccgtgcaggactcagccagcagcttacagctctccggcacacgagtgcactcacacaccatacgccgtgcccatgcacacgctgcaccatctcatacccatccccttccacctgtacacagacacgcgtgcccagctcgcagtcccaccatcacacacacacacgcacacacagaggcacaggttggcccacacgcacagcctgcacaatgacgacacccgtacacacaggcagacacacacacaacacacagactgacagacagaggagagggtctggcctggcaatgcccccgaccccgccgctgccaggccaggcaggccgtgtaagcacccatcagcccatcggc

SEQ ID NO: 64968 - DNA, 19 bp, Homo sapiens
  chr16:2235020-2235039
  hypo
gcaccgttgccaggagctg

SEQ ID NO: 64969 - DNA, 51 bp, Homo sapiens; identical to SEQ ID NO: 44537
  chr16:2237472-2237523
  hypo

SEQ ID NO: 64970 - DNA, 387 bp, Homo sapiens; identical to SEQ ID NO: 44538
  chr16:2278383-2278770
  hypo

SEQ ID NO: 64971 - DNA, 33 bp, Homo sapiens; identical to SEQ ID NO: 44540
  chr16:2294623-2294656
  hypo

SEQ ID NO: 64972 - DNA, 30 bp, Homo sapiens; identical to SEQ ID NO: 44541
  chr16:2324195-2324225
  hypo

SEQ ID NO: 64973 - DNA, 30 bp, Homo sapiens; identical to SEQ ID NO: 44542
  chr16:2436229-2436259
  hypo

SEQ ID NO: 64974 - DNA, 34 bp, Homo sapiens; identical to SEQ ID NO: 16004
  chr16:2466336-2466370
  hypo

SEQ ID NO: 64975 - DNA, 56 bp, Homo sapiens; identical to SEQ ID NO: 44544
  chr16:2474253-2474309
  hypo

SEQ ID NO: 64976 - DNA, 174 bp, Homo sapiens; identical to SEQ ID NO: 44545
  chr16:2497879-2498053
  hypo

SEQ ID NO: 64977 - DNA, 16 bp, Homo sapiens
  chr16:2508540-2508556
  hypo
gcgcctggcccccaaa

SEQ ID NO: 64978 - DNA, 59 bp, Homo sapiens; identical to SEQ ID NO: 44547
  chr16:2531804-2531863
  hypo

SEQ ID NO: 64979 - DNA, 37 bp, Homo sapiens; identical to SEQ ID NO: 16006
  chr16:2540828-2540865
  hypo

SEQ ID NO: 64980 - DNA, 48 bp, Homo sapiens; identical to SEQ ID NO: 44549
  chr16:2546458-2546506
  hypo

SEQ ID NO: 64981 - DNA, 76 bp, Homo sapiens; identical to SEQ ID NO: 44550
  chr16:2589044-2589120
  hypo

SEQ ID NO: 64982 - DNA, 120 bp, Homo sapiens; identical to SEQ ID NO: 44551
  chr16:2731629-2731749
  hypo

SEQ ID NO: 64983 - DNA, 82 bp, Homo sapiens; identical to SEQ ID NO: 44552
  chr16:2762758-2762840
  hypo

SEQ ID NO: 64984 - DNA, 266 bp, Homo sapiens
  chr16:2764111-2764377
  hypo
cgtctcaaagatcaccgaggggtcaggcaggcacacggggaggatgtaattggtgaagggcactggtgcctccagctccaccagggccacgtcagcgctggaggccgtgccctggtacagggggttgctctccacctgcctcacccgggcatacatagcgtgtggtcccggctgcactagctgccttgcccccagcaggacctggtacagggacgtctcagaggtgctggcgggagaaacagagaggcggcgtgaggcggcccctc

SEQ ID NO: 64985 - DNA, 239 bp, Homo sapiens
  chr16:2764470-2764709
  hypo
ggacagccaggtgcagcggtgatgcgtgttgacattgaagccagaccgcccgactcagatttccacctccacccctggccgctgtgtggccttgggcaagtcacttaacaagttctctgtgatgcagctttctcacctgtgctgtggggacagtcacagtgcctacctgaaaggctggctcggagagaaccaccctccaggtgcagcagggccagccccacctgcgggcctctggcagg

SEQ ID NO: 64986 - DNA, 133 bp, Homo sapiens; identical to SEQ ID NO: 44555
  chr16:2806261-2806394
  hypo

SEQ ID NO: 64987 - DNA, 30 bp, Homo sapiens; identical to SEQ ID NO: 44556
  chr16:2849391-2849421
  hypo

SEQ ID NO: 64988 - DNA, 30 bp, Homo sapiens; identical to SEQ ID NO: 16011
  chr16:2877506-2877536
  hypo

SEQ ID NO: 64989 - DNA, 138 bp, Homo sapiens; identical to SEQ ID NO: 44558
  chr16:2975835-2975973
  hypo

SEQ ID NO: 64990 - DNA, 34 bp, Homo sapiens; identical to SEQ ID NO: 44559
  chr16:3021547-3021581
  hypo

SEQ ID NO: 64991 - DNA, 30 bp, Homo sapiens; identical to SEQ ID NO: 44560
  chr16:3139240-3139270
  hypo

SEQ ID NO: 64992 - DNA, 30 bp, Homo sapiens; identical to SEQ ID NO: 44561
  chr16:3142599-3142629
  hypo

SEQ ID NO: 64993 - DNA, 30 bp, Homo sapiens; identical to SEQ ID NO: 44562
  chr16:3151067-3151097
  hypo

SEQ ID NO: 64994 - DNA, 35 bp, Homo sapiens
  chr16:3211673-3211708
  hypo
acctccctcagctcccgtggtgcgcccgggggaaa

SEQ ID NO: 64995 - DNA, 30 bp, Homo sapiens; identical to SEQ ID NO: 44565
  chr16:3286293-3286323
  hypo

SEQ ID NO: 64996 - DNA, 80 bp, Homo sapiens
  chr16:3492675-3492755
  hypo
aaaaaaaaaaaaaaagaacttttaaaagtagccagacactgtggtatgcgcgcctctcagatactcgagaggctgaggcg

SEQ ID NO: 64997 - DNA, 78 bp, Homo sapiens
  chr16:3696724-3696802
  hypo
gctgtggggacggctgggacatgtacctggaagcagggcagccaaagggagaggcagtgatgacgggtggtatggagg

SEQ ID NO: 64998 - DNA, 30 bp, Homo sapiens; identical to SEQ ID NO: 44569
  chr16:3925449-3925479
  hypo

SEQ ID NO: 64999 - DNA, 37 bp, Homo sapiens; identical to SEQ ID NO: 16016
  chr16:3957870-3957907
  hypo

SEQ ID NO: 65000 - DNA, 76 bp, Homo sapiens; identical to SEQ ID NO: 44571
  chr16:4203919-4203995
  hypo

SEQ ID NO: 65001 - DNA, 30 bp, Homo sapiens; identical to SEQ ID NO: 44573
  chr16:4308074-4308104
  hypo

SEQ ID NO: 65002 - DNA, 34 bp, Homo sapiens; identical to SEQ ID NO: 44574
  chr16:4385394-4385428
  hypo

SEQ ID NO: 65003 - DNA, 66 bp, Homo sapiens; identical to SEQ ID NO: 44575
  chr16:4410920-4410986
  hypo

SEQ ID NO: 65004 - DNA, 30 bp, Homo sapiens; identical to SEQ ID NO: 44576
  chr16:4474675-4474705
  hypo

SEQ ID NO: 65005 - DNA, 30 bp, Homo sapiens; identical to SEQ ID NO: 44577
  chr16:4655417-4655447
  hypo

SEQ ID NO: 65006 - DNA, 30 bp, Homo sapiens; identical to SEQ ID NO: 16018
  chr16:4840446-4840476
  hypo

SEQ ID NO: 65007 - DNA, 84 bp, Homo sapiens; identical to SEQ ID NO: 44579
  chr16:4841600-4841684
  hypo

SEQ ID NO: 65008 - DNA, 44 bp, Homo sapiens; identical to SEQ ID NO: 44581
  chr16:4846780-4846824
  hypo

SEQ ID NO: 65009 - DNA, 30 bp, Homo sapiens; identical to SEQ ID NO: 44582
  chr16:5090604-5090634
  hypo

SEQ ID NO: 65010 - DNA, 30 bp, Homo sapiens; identical to SEQ ID NO: 44583
  chr16:5115567-5115597
  hypo

SEQ ID NO: 65011 - DNA, 30 bp, Homo sapiens; identical to SEQ ID NO: 44584
  chr16:5130557-5130587
  hypo

SEQ ID NO: 65012 - DNA, 41 bp, Homo sapiens; identical to SEQ ID NO: 44585
  chr16:5412627-5412668
  hypo

SEQ ID NO: 65013 - DNA, 30 bp, Homo sapiens; identical to SEQ ID NO: 16020
  chr16:5439313-5439343
  hypo

SEQ ID NO: 65014 - DNA, 141 bp, Homo sapiens; identical to SEQ ID NO: 44587
  chr16:5541176-5541317
  hypo

SEQ ID NO: 65015 - DNA, 152 bp, Homo sapiens; identical to SEQ ID NO: 44588
  chr16:5559744-5559896
  hypo

SEQ ID NO: 65016 - DNA, 30 bp, Homo sapiens; identical to SEQ ID NO: 44589
  chr16:6186354-6186384
  hypo

SEQ ID NO: 65017 - DNA, 30 bp, Homo sapiens; identical to SEQ ID NO: 44590
  chr16:6314961-6314991
  hypo

SEQ ID NO: 65018 - DNA, 161 bp, Homo sapiens; identical to SEQ ID NO: 44591
  chr16:7489023-7489184
  hypo

SEQ ID NO: 65019 - DNA, 34 bp, Homo sapiens; identical to SEQ ID NO: 44592
  chr16:8222706-8222740
  hypo

SEQ ID NO: 65020 - DNA, 28 bp, Homo sapiens
  chr16:8781004-8781032
  hypo
ggacgcacatctggacggaaagtgtttg

SEQ ID NO: 65021 - DNA, 29 bp, Homo sapiens
  chr16:8963909-8963938
  hypo
gggtgcggtggctcacgcctgtaattcca

SEQ ID NO: 65022 - DNA, 76 bp, Homo sapiens; identical to SEQ ID NO: 16023
  chr16:9005728-9005804
  hypo

SEQ ID NO: 65023 - DNA, 30 bp, Homo sapiens; identical to SEQ ID NO: 16024
  chr16:9010029-9010059
  hypo

SEQ ID NO: 65024 - DNA, 208 bp, Homo sapiens; identical to SEQ ID NO: 44598
  chr16:9888740-9888948
  hypo

SEQ ID NO: 65025 - DNA, 47 bp, Homo sapiens; identical to SEQ ID NO: 44599
  chr16:10721519-10721566
  hypo

SEQ ID NO: 65026 - DNA, 30 bp, Homo sapiens; identical to SEQ ID NO: 16025
  chr16:10804588-10804618
  hypo

SEQ ID NO: 65027 - DNA, 30 bp, Homo sapiens; identical to SEQ ID NO: 44601
  chr16:11712101-11712131
  hypo

SEQ ID NO: 65028 - DNA, 20 bp, Homo sapiens
  chr16:11808484-11808504
  hypo
gactccgtctcaaaaaaaaa

SEQ ID NO: 65029 - DNA, 42 bp, Homo sapiens; identical to SEQ ID NO: 44603
  chr16:11853669-11853711
  hypo

SEQ ID NO: 65030 - DNA, 33 bp, Homo sapiens; identical to SEQ ID NO: 44604
  chr16:12012098-12012131
  hypo

SEQ ID NO: 65031 - DNA, 27 bp, Homo sapiens
  chr16:13064659-13064686
  hypo
tgtgagccaccgcgcctggccggggca

SEQ ID NO: 65032 - DNA, 147 bp, Homo sapiens; identical to SEQ ID NO: 44606
  chr16:13676585-13676732
  hypo

SEQ ID NO: 65033 - DNA, 32 bp, Homo sapiens; identical to SEQ ID NO: 44607
  chr16:14464204-14464236
  hypo

SEQ ID NO: 65034 - DNA, 21 bp, Homo sapiens
  chr16:14724506-14724527
  hypo
aatgggatccgggtgcggtgg

SEQ ID NO: 65035 - DNA, 71 bp, Homo sapiens; identical to SEQ ID NO: 25266
  chr16:14725771-14725842
  hypo

SEQ ID NO: 65036 - DNA, 30 bp, Homo sapiens; identical to SEQ ID NO: 44610
  chr16:14728494-14728524
  hypo

SEQ ID NO: 65037 - DNA, 48 bp, Homo sapiens; identical to SEQ ID NO: 44611
  chr16:14761842-14761890
  hypo

SEQ ID NO: 65038 - DNA, 30 bp, Homo sapiens; identical to SEQ ID NO: 44612
  chr16:15052961-15052991
  hypo

SEQ ID NO: 65039 - DNA, 106 bp, Homo sapiens; identical to SEQ ID NO: 44613
  chr16:15241283-15241389
  hypo

SEQ ID NO: 65040 - DNA, 30 bp, Homo sapiens; identical to SEQ ID NO: 44614
  chr16:15555102-15555132
  hypo

SEQ ID NO: 65041 - DNA, 80 bp, Homo sapiens; identical to SEQ ID NO: 44615
  chr16:15595921-15596001
  hypo

SEQ ID NO: 65042 - DNA, 42 bp, Homo sapiens; identical to SEQ ID NO: 44616
  chr16:15604294-15604336
  hypo

SEQ ID NO: 65043 - DNA, 47 bp, Homo sapiens; identical to SEQ ID NO: 44617
  chr16:15692124-15692171
  hypo

SEQ ID NO: 65044 - DNA, 22 bp, Homo sapiens
  chr16:15708051-15708073
  hypo
agtttcggccaggtgcggtggc

SEQ ID NO: 65045 - DNA, 42 bp, Homo sapiens; identical to SEQ ID NO: 44619
  chr16:15762689-15762731
  hypo

SEQ ID NO: 65046 - DNA, 52 bp, Homo sapiens
  chr16:15820865-15820917
  hypo
tctctttctccagcgtctgcttattcttgtctaggttcgccttggcctggcg

SEQ ID NO: 65047 - DNA, 16 bp, Homo sapiens
  chr16:17049595-17049611
  hypo
ccggccacaacagatt

SEQ ID NO: 65048 - DNA, 30 bp, Homo sapiens; identical to SEQ ID NO: 44622
  chr16:17341523-17341553
  hypo

SEQ ID NO: 65049 - DNA, 100 bp, Homo sapiens; identical to SEQ ID NO: 44623
  chr16:17866410-17866510
  hypo

SEQ ID NO: 65050 - DNA, 37 bp, Homo sapiens; identical to SEQ ID NO: 44625
  chr16:18804505-18804542
  hypo

SEQ ID NO: 65051 - DNA, 30 bp, Homo sapiens; identical to SEQ ID NO: 44626
  chr16:18950653-18950683
  hypo

SEQ ID NO: 65052 - DNA, 31 bp, Homo sapiens; identical to SEQ ID NO: 44628
  chr16:19534839-19534870
  hypo

SEQ ID NO: 65053 - DNA, 30 bp, Homo sapiens; identical to SEQ ID NO: 44629
  chr16:19708504-19708534
  hypo

SEQ ID NO: 65054 - DNA, 30 bp, Homo sapiens; identical to SEQ ID NO: 44630
  chr16:19929817-19929847
  hypo

SEQ ID NO: 65055 - DNA, 194 bp, Homo sapiens; identical to SEQ ID NO: 44631
  chr16:20327311-20327505
  hypo

SEQ ID NO: 65056 - DNA, 35 bp, Homo sapiens; identical to SEQ ID NO: 44632
  chr16:21539162-21539197
  hypo

SEQ ID NO: 65057 - DNA, 18 bp, Homo sapiens
  chr16:21541457-21541475
  hypo
agcttgatccagacccga

SEQ ID NO: 65058 - DNA, 38 bp, Homo sapiens; identical to SEQ ID NO: 44634
  chr16:21566671-21566709
  hypo

SEQ ID NO: 65059 - DNA, 33 bp, Homo sapiens; identical to SEQ ID NO: 44635
  chr16:21719131-21719164
  hypo

SEQ ID NO: 65060 - DNA, 30 bp, Homo sapiens; identical to SEQ ID NO: 44636
  chr16:23093885-23093915
  hypo

SEQ ID NO: 65061 - DNA, 30 bp, Homo sapiens; identical to SEQ ID NO: 16032
  chr16:23303315-23303345
  hypo

SEQ ID NO: 65062 - DNA, 30 bp, Homo sapiens; identical to SEQ ID NO: 44638
  chr16:23444796-23444826
  hypo

SEQ ID NO: 65063 - DNA, 29 bp, Homo sapiens
  chr16:23606614-23606643
  hypo
tcactgcctcccggcgtttcagcctcacg

SEQ ID NO: 65064 - DNA, 91 bp, Homo sapiens; identical to SEQ ID NO: 44640
  chr16:23716327-23716418
  hypo

SEQ ID NO: 65065 - DNA, 151 bp, Homo sapiens; identical to SEQ ID NO: 44641
  chr16:23990960-23991111
  hypo

SEQ ID NO: 65066 - DNA, 33 bp, Homo sapiens; identical to SEQ ID NO: 44642
  chr16:24013932-24013965
  hypo

SEQ ID NO: 65067 - DNA, 30 bp, Homo sapiens; identical to SEQ ID NO: 44643
  chr16:25077168-25077198
  hypo

SEQ ID NO: 65068 - DNA, 28 bp, Homo sapiens
  chr16:25692519-25692547
  hypo
ttaagatatgtaggccgggtgcggtggc

SEQ ID NO: 65069 - DNA, 16 bp, Homo sapiens
  chr16:26388437-26388453
  hypo
ccgtctcaaaaaaaaa

SEQ ID NO: 65070 - DNA, 6 bp, Homo sapiens
  chr16:26664733-26664739
  hypo
gggatt

SEQ ID NO: 65071 - DNA, 30 bp, Homo sapiens; identical to SEQ ID NO: 44647
  chr16:26732577-26732607
  hypo

SEQ ID NO: 65072 - DNA, 32 bp, Homo sapiens; identical to SEQ ID NO: 44648
  chr16:27038943-27038975
  hypo

SEQ ID NO: 65073 - DNA, 36 bp, Homo sapiens; identical to SEQ ID NO: 44649
  chr16:27279055-27279091
  hypo

SEQ ID NO: 65074 - DNA, 40 bp, Homo sapiens; identical to SEQ ID NO: 44650
  chr16:27853439-27853479
  hypo

SEQ ID NO: 65075 - DNA, 103 bp, Homo sapiens; identical to SEQ ID NO: 44651
  chr16:28560175-28560278
  hypo

SEQ ID NO: 65076 - DNA, 78 bp, Homo sapiens; identical to SEQ ID NO: 16035
  chr16:28878714-28878792
  hypo

SEQ ID NO: 65077 - DNA, 26 bp, Homo sapiens
  chr16:28947344-28947370
  hypo
cccgtccgcctcgcaatttgaactcc

SEQ ID NO: 65078 - DNA, 91 bp, Homo sapiens; identical to SEQ ID NO: 44654
  chr16:29009366-29009457
  hypo

SEQ ID NO: 65079 - DNA, 34 bp, Homo sapiens; identical to SEQ ID NO: 16036
  chr16:29139111-29139145
  hypo

SEQ ID NO: 65080 - DNA, 81 bp, Homo sapiens
  chr16:29153203-29153284
  hypo
catggcacaagggagcggtggaataatcctctgtggcacgcgggggggggtgtggaataatcctccgtggcacgagggggt

SEQ ID NO: 65081 - DNA, 162 bp, Homo sapiens; identical to SEQ ID NO: 44657
  chr16:29153365-29153527
  hypo

SEQ ID NO: 65082 - DNA, 96 bp, Homo sapiens; identical to SEQ ID NO: 44658
  chr16:29244717-29244813
  hypo

SEQ ID NO: 65083 - DNA, 30 bp, Homo sapiens; identical to SEQ ID NO: 44659
  chr16:29262965-29262995
  hypo

SEQ ID NO: 65084 - DNA, 30 bp, Homo sapiens; identical to SEQ ID NO: 44660
  chr16:29266418-29266448
  hypo

SEQ ID NO: 65085 - DNA, 34 bp, Homo sapiens; identical to SEQ ID NO: 44661
  chr16:29324812-29324846
  hypo

SEQ ID NO: 65086 - DNA, 73 bp, Homo sapiens; identical to SEQ ID NO: 44662
  chr16:29691644-29691717
  hypo

SEQ ID NO: 65087 - DNA, 45 bp, Homo sapiens; identical to SEQ ID NO: 25275
  chr16:29831078-29831123
  hypo

SEQ ID NO: 65088 - DNA, 102 bp, Homo sapiens
  chr16:30017228-30017330
  hypo
gcgggggcctggggccgggctctgagcactgcccgggtgtgcagatgatggggggtttgcatatttgcagggactagcgagtcaggcaggaggtttgcatat

SEQ ID NO: 65089 - DNA, 214 bp, Homo sapiens
  chr16:30017447-30017661
  hypo
tgcgaaggttgggtactggacccggctcgatgggcctgtgccgggacactgctgtccactcaggctgaggacagagccccggccgcagggggcagctcactggtcagggtgtgccagcgctccagggctgcgtccggctgctgcaggcagtcactccagtgcttccgagcctcgcctcgggcacctggccccagggacacgccacctggggagc

SEQ ID NO: 65090 - DNA, 37 bp, Homo sapiens
  chr16:30116248-30116285
  hypo
gataatccgttatgacgccagtggctcccacgctgaa

SEQ ID NO: 65091 - DNA, 176 bp, Homo sapiens
  chr16:30124515-30124691
  hypo
cagcatcttcttcctcgtccacaccctgccctgccacttcgctctccttctctcttggtccctgccccgtttctagcatgcccccttggacctacccctctgtgctgtccactttggcacctgttctcacccctacccggctcacctcctcggtgggcccccaggcggatgcggaa

SEQ ID NO: 65092 - DNA, 30 bp, Homo sapiens; identical to SEQ ID NO: 44667
  chr16:30354712-30354742
  hypo

SEQ ID NO: 65093 - DNA, 30 bp, Homo sapiens; identical to SEQ ID NO: 44668
  chr16:30430132-30430162
  hypo

SEQ ID NO: 65094 - DNA, 32 bp, Homo sapiens; identical to SEQ ID NO: 44669
  chr16:30567477-30567509
  hypo

SEQ ID NO: 65095 - DNA, 30 bp, Homo sapiens; identical to SEQ ID NO: 44670
  chr16:30803924-30803954
  hypo

SEQ ID NO: 65096 - DNA, 24 bp, Homo sapiens
  chr16:30906986-30907010
  hypo
tccagcaattgctcacggcaatac

SEQ ID NO: 65097 - DNA, 170 bp, Homo sapiens
  chr16:30907148-30907318
  hypo
acgcagacacacgcaagcgcacacacacacgggcctcctcgtcttcattcacaaaccccattagcttctgttgtctatgggcttcctcgacagaccgcgagcccctcgcgggggccagaaaccaagtatggatcatccctatgtgccttcctttccgtctacaccaggtt

SEQ ID NO: 65098 - DNA, 30 bp, Homo sapiens; identical to SEQ ID NO: 44674
  chr16:31018076-31018106
  hypo

SEQ ID NO: 65099 - DNA, 120 bp, Homo sapiens; identical to SEQ ID NO: 16045
  chr16:31138607-31138727
  hypo

SEQ ID NO: 65100 - DNA, 39 bp, Homo sapiens; identical to SEQ ID NO: 44676
  chr16:31149942-31149981
  hypo

SEQ ID NO: 65101 - DNA, 144 bp, Homo sapiens; identical to SEQ ID NO: 44677
  chr16:31373926-31374070
  hypo

SEQ ID NO: 65102 - DNA, 30 bp, Homo sapiens; identical to SEQ ID NO: 44678
  chr16:31384803-31384833
  hypo

SEQ ID NO: 65103 - DNA, 129 bp, Homo sapiens
  chr16:31447096-31447225
  hypo
cacccagggctgcagcacgctggttcttcagtgtcgggccaggttggacctccggctggaggccttccacaccggaaacactggtagggctcctctccagtgtgggttcgagggcggtggaggagctcg

SEQ ID NO: 65104 - DNA, 33 bp, Homo sapiens; identical to SEQ ID NO: 44681
  chr16:31526376-31526409
  hypo

SEQ ID NO: 65105 - DNA, 16 bp, Homo sapiens
  chr16:31658246-31658262
  hypo
aatggaaggactgggc

SEQ ID NO: 65106 - DNA, 30 bp, Homo sapiens; identical to SEQ ID NO: 44683
  chr16:32485550-32485580
  hypo

SEQ ID NO: 65107 - DNA, 18 bp, Homo sapiens
  chr16:33396766-33396784
  hypo
tatgagatggattttcgc

SEQ ID NO: 65108 - DNA, 120 bp, Homo sapiens; identical to SEQ ID NO: 44685
  chr16:33893446-33893566
  hypo

SEQ ID NO: 65109 - DNA, 92 bp, Homo sapiens; identical to SEQ ID NO: 44686
  chr16:33897833-33897925
  hypo

SEQ ID NO: 65110 - DNA, 30 bp, Homo sapiens; identical to SEQ ID NO: 44687
  chr16:34983961-34983991
  hypo

SEQ ID NO: 65111 - DNA, 19 bp, Homo sapiens
  chr16:46721707-46721726
  hypo
taagcgagctgcctaaatt

SEQ ID NO: 65112 - DNA, 37 bp, Homo sapiens; identical to SEQ ID NO: 44689
  chr16:46803066-46803103
  hypo

SEQ ID NO: 65113 - DNA, 120 bp, Homo sapiens; identical to SEQ ID NO: 44690
  chr16:48642029-48642149
  hypo

SEQ ID NO: 65114 - DNA, 30 bp, Homo sapiens; identical to SEQ ID NO: 44691
  chr16:49500178-49500208
  hypo

SEQ ID NO: 65115 - DNA, 30 bp, Homo sapiens; identical to SEQ ID NO: 44692
  chr16:49533007-49533037
  hypo

SEQ ID NO: 65116 - DNA, 161 bp, Homo sapiens; identical to SEQ ID NO: 44693
  chr16:49545215-49545376
  hypo

SEQ ID NO: 65117 - DNA, 90 bp, Homo sapiens; identical to SEQ ID NO: 44694
  chr16:49623675-49623765
  hypo

SEQ ID NO: 65118 - DNA, 30 bp, Homo sapiens; identical to SEQ ID NO: 44695
  chr16:49634741-49634771
  hypo

SEQ ID NO: 65119 - DNA, 19 bp, Homo sapiens
  chr16:50070334-50070353
  hypo
ccaccgtgcctggcctctt

SEQ ID NO: 65120 - DNA, 80 bp, Homo sapiens; identical to SEQ ID NO: 44698
  chr16:50218595-50218675
  hypo

SEQ ID NO: 65121 - DNA, 30 bp, Homo sapiens; identical to SEQ ID NO: 44700
  chr16:50336356-50336386
  hypo

SEQ ID NO: 65122 - DNA, 152 bp, Homo sapiens; identical to SEQ ID NO: 44701
  chr16:50336625-50336777
  hypo

SEQ ID NO: 65123 - DNA, 30 bp, Homo sapiens; identical to SEQ ID NO: 44702
  chr16:50958718-50958748
  hypo

SEQ ID NO: 65124 - DNA, 34 bp, Homo sapiens; identical to SEQ ID NO: 16051
  chr16:53448517-53448551
  hypo

SEQ ID NO: 65125 - DNA, 168 bp, Homo sapiens
  chr16:53563454-53563622
  hypo
ccttcatatagcaatcggctcctcttatcccccaggcaactggctgcctttcacctccgcggcacagcaattatgtggtgtaatggaggcagcgcaaataagcagaaagattttattaaaccaaatgagcaaatcatctgcgtattattgcgatttgattgacactga

SEQ ID NO: 65126 - DNA, 221 bp, Homo sapiens; identical to SEQ ID NO: 44705
  chr16:55203739-55203960
  hypo

SEQ ID NO: 65127 - DNA, 30 bp, Homo sapiens; identical to SEQ ID NO: 44706
  chr16:56460223-56460253
  hypo

SEQ ID NO: 65128 - DNA, 27 bp, Homo sapiens
  chr16:56774935-56774962
  hypo
ggagagggagagcgctaaatttctttt

SEQ ID NO: 65129 - DNA, 63 bp, Homo sapiens; identical to SEQ ID NO: 44708
  chr16:57222193-57222256
  hypo

SEQ ID NO: 65130 - DNA, 12 bp, Homo sapiens
  chr16:57222709-57222721
  hypo
gagccactgtgt

SEQ ID NO: 65131 - DNA, 30 bp, Homo sapiens; identical to SEQ ID NO: 44710
  chr16:57321322-57321352
  hypo

SEQ ID NO: 65132 - DNA, 30 bp, Homo sapiens; identical to SEQ ID NO: 16055
  chr16:57759922-57759952
  hypo

SEQ ID NO: 65133 - DNA, 122 bp, Homo sapiens; identical to SEQ ID NO: 44712
  chr16:58120963-58121085
  hypo

SEQ ID NO: 65134 - DNA, 21 bp, Homo sapiens
  chr16:58462002-58462023
  hypo
atacatcgtggacatccttcc

SEQ ID NO: 65135 - DNA, 39 bp, Homo sapiens; identical to SEQ ID NO: 44714
  chr16:58548346-58548385
  hypo

SEQ ID NO: 65136 - DNA, 30 bp, Homo sapiens; identical to SEQ ID NO: 44715
  chr16:58886327-58886357
  hypo

SEQ ID NO: 65137 - DNA, 33 bp, Homo sapiens; identical to SEQ ID NO: 44716
  chr16:58932088-58932121
  hypo

SEQ ID NO: 65138 - DNA, 30 bp, Homo sapiens; identical to SEQ ID NO: 44718
  chr16:59046529-59046559
  hypo

SEQ ID NO: 65139 - DNA, 174 bp, Homo sapiens; identical to SEQ ID NO: 44719
  chr16:67241603-67241777
  hypo

SEQ ID NO: 65140 - DNA, 63 bp, Homo sapiens; identical to SEQ ID NO: 25289
  chr16:67313895-67313958
  hypo

SEQ ID NO: 65141 - DNA, 48 bp, Homo sapiens; identical to SEQ ID NO: 44721
  chr16:67578633-67578681
  hypo

SEQ ID NO: 65142 - DNA, 27 bp, Homo sapiens
  chr16:68770701-68770728
  hypo
aaaaaattagcctggcgtggtggtgtg

SEQ ID NO: 65143 - DNA, 45 bp, Homo sapiens; identical to SEQ ID NO: 44724
  chr16:68787504-68787549
  hypo

SEQ ID NO: 65144 - DNA, 30 bp, Homo sapiens; identical to SEQ ID NO: 44726
  chr16:69133585-69133615
  hypo

SEQ ID NO: 65145 - DNA, 30 bp, Homo sapiens; identical to SEQ ID NO: 44727
  chr16:69352566-69352596
  hypo

SEQ ID NO: 65146 - DNA, 121 bp, Homo sapiens; identical to SEQ ID NO: 44728
  chr16:70380004-70380125
  hypo

SEQ ID NO: 65147 - DNA, 137 bp, Homo sapiens; identical to SEQ ID NO: 44729
  chr16:70416085-70416222
  hypo

SEQ ID NO: 65148 - DNA, 126 bp, Homo sapiens; identical to SEQ ID NO: 44730
  chr16:70427606-70427732
  hypo

SEQ ID NO: 65149 - DNA, 50 bp, Homo sapiens; identical to SEQ ID NO: 44732
  chr16:70680482-70680532
  hypo

SEQ ID NO: 65150 - DNA, 30 bp, Homo sapiens; identical to SEQ ID NO: 44733
  chr16:70795276-70795306
  hypo

SEQ ID NO: 65151 - DNA, 23 bp, Homo sapiens
  chr16:71266650-71266673
  hypo
gggtgcagtggctcacgcctgta

SEQ ID NO: 65152 - DNA, 29 bp, Homo sapiens
  chr16:71841040-71841069
  hypo
actttttgccaggcacggtggctcacgcc

SEQ ID NO: 65153 - DNA, 36 bp, Homo sapiens; identical to SEQ ID NO: 44736
  chr16:71919045-71919081
  hypo

SEQ ID NO: 65154 - DNA, 84 bp, Homo sapiens; identical to SEQ ID NO: 16064
  chr16:72461607-72461691
  hypo

SEQ ID NO: 65155 - DNA, 19 bp, Homo sapiens
  chr16:72957744-72957763
  hypo
tactttgaattgcctcgtc

SEQ ID NO: 65156 - DNA, 30 bp, Homo sapiens; identical to SEQ ID NO: 44739
  chr16:73033457-73033487
  hypo

SEQ ID NO: 65157 - DNA, 30 bp, Homo sapiens; identical to SEQ ID NO: 44740
  chr16:73062471-73062501
  hypo

SEQ ID NO: 65158 - DNA, 30 bp, Homo sapiens; identical to SEQ ID NO: 44741
  chr16:73397239-73397269
  hypo

SEQ ID NO: 65159 - DNA, 30 bp, Homo sapiens; identical to SEQ ID NO: 44742
  chr16:74331835-74331865
  hypo

SEQ ID NO: 65160 - DNA, 18 bp, Homo sapiens
  chr16:74901527-74901545
  hypo
ctggtccaccctatccgt

SEQ ID NO: 65161 - DNA, 72 bp, Homo sapiens; identical to SEQ ID NO: 44744
  chr16:75019649-75019721
  hypo

SEQ ID NO: 65162 - DNA, 308 bp, Homo sapiens; identical to SEQ ID NO: 44745
  chr16:75148816-75149124
  hypo

SEQ ID NO: 65163 - DNA, 37 bp, Homo sapiens; identical to SEQ ID NO: 44746
  chr16:75171636-75171673
  hypo

SEQ ID NO: 65164 - DNA, 120 bp, Homo sapiens; identical to SEQ ID NO: 44747
  chr16:75183598-75183718
  hypo

SEQ ID NO: 65165 - DNA, 29 bp, Homo sapiens
  chr16:75469090-75469119
  hypo
gtgagccaccgcgccgggcaccttcaagg

SEQ ID NO: 65166 - DNA, 38 bp, Homo sapiens; identical to SEQ ID NO: 44749
  chr16:75658302-75658340
  hypo

SEQ ID NO: 65167 - DNA, 30 bp, Homo sapiens; identical to SEQ ID NO: 44750
  chr16:75733411-75733441
  hypo

SEQ ID NO: 65168 - DNA, 58 bp, Homo sapiens
  chr16:77247382-77247440
  hypo
tctgttaaatgtgtccgccactctggaggccggcatttgggacccaaatccaaaggca

SEQ ID NO: 65169 - DNA, 30 bp, Homo sapiens; identical to SEQ ID NO: 44752
  chr16:77754041-77754071
  hypo

SEQ ID NO: 65170 - DNA, 95 bp, Homo sapiens; identical to SEQ ID NO: 44753
  chr16:80644760-80644855
  hypo

SEQ ID NO: 65171 - DNA, 59 bp, Homo sapiens; identical to SEQ ID NO: 44754
  chr16:80654771-80654830
  hypo

SEQ ID NO: 65172 - DNA, 132 bp, Homo sapiens; identical to SEQ ID NO: 44755
  chr16:80704564-80704696
  hypo

SEQ ID NO: 65173 - DNA, 30 bp, Homo sapiens; identical to SEQ ID NO: 44756
  chr16:80718633-80718663
  hypo

SEQ ID NO: 65174 - DNA, 19 bp, Homo sapiens
  chr16:81042228-81042247
  hypo
ggcgcgctcccggcccctc

SEQ ID NO: 65175 - DNA, 30 bp, Homo sapiens; identical to SEQ ID NO: 16070
  chr16:81533258-81533288
  hypo

SEQ ID NO: 65176 - DNA, 151 bp, Homo sapiens; identical to SEQ ID NO: 44759
  chr16:81569552-81569703
  hypo

SEQ ID NO: 65177 - DNA, 30 bp, Homo sapiens; identical to SEQ ID NO: 44760
  chr16:81627246-81627276
  hypo

SEQ ID NO: 65178 - DNA, 180 bp, Homo sapiens; identical to SEQ ID NO: 16071
  chr16:81632932-81633112
  hypo

SEQ ID NO: 65179 - DNA, 68 bp, Homo sapiens; identical to SEQ ID NO: 44762
  chr16:83968763-83968831
  hypo

SEQ ID NO: 65180 - DNA, 41 bp, Homo sapiens; identical to SEQ ID NO: 16073
  chr16:84075186-84075227
  hypo

SEQ ID NO: 65181 - DNA, 30 bp, Homo sapiens; identical to SEQ ID NO: 44764
  chr16:84129364-84129394
  hypo

SEQ ID NO: 65182 - DNA, 30 bp, Homo sapiens; identical to SEQ ID NO: 44765
  chr16:84152910-84152940
  hypo

SEQ ID NO: 65183 - DNA, 30 bp, Homo sapiens; identical to SEQ ID NO: 44767
  chr16:84593218-84593248
  hypo

SEQ ID NO: 65184 - DNA, 30 bp, Homo sapiens; identical to SEQ ID NO: 44768
  chr16:85001619-85001649
  hypo

SEQ ID NO: 65185 - DNA, 58 bp, Homo sapiens; identical to SEQ ID NO: 16075
  chr16:85007798-85007856
  hypo

SEQ ID NO: 65186 - DNA, 30 bp, Homo sapiens; identical to SEQ ID NO: 44770
  chr16:85010139-85010169
  hypo

SEQ ID NO: 65187 - DNA, 173 bp, Homo sapiens; identical to SEQ ID NO: 16076
  chr16:85028164-85028337
  hypo

SEQ ID NO: 65188 - DNA, 30 bp, Homo sapiens; identical to SEQ ID NO: 44772
  chr16:85028787-85028817
  hypo

SEQ ID NO: 65189 - DNA, 55 bp, Homo sapiens; identical to SEQ ID NO: 16077
  chr16:85033827-85033882
  hypo

SEQ ID NO: 65190 - DNA, 16 bp, Homo sapiens
  chr16:85043890-85043906
  hypo
gcgctgggattacagg

SEQ ID NO: 65191 - DNA, 17 bp, Homo sapiens
  chr16:85075553-85075570
  hypo
tgcgcactcctgtccct

SEQ ID NO: 65192 - DNA, 214 bp, Homo sapiens; identical to SEQ ID NO: 44776
  chr16:85083548-85083762
  hypo

SEQ ID NO: 65193 - DNA, 30 bp, Homo sapiens; identical to SEQ ID NO: 44777
  chr16:85318173-85318203
  hypo

SEQ ID NO: 65194 - DNA, 30 bp, Homo sapiens; identical to SEQ ID NO: 44778
  chr16:85328964-85328994
  hypo

SEQ ID NO: 65195 - DNA, 239 bp, Homo sapiens; identical to SEQ ID NO: 44779
  chr16:85336342-85336581
  hypo

SEQ ID NO: 65196 - DNA, 68 bp, Homo sapiens; identical to SEQ ID NO: 16082
  chr16:85455150-85455218
  hypo

SEQ ID NO: 65197 - DNA, 30 bp, Homo sapiens; identical to SEQ ID NO: 44781
  chr16:85464272-85464302
  hypo

SEQ ID NO: 65198 - DNA, 45 bp, Homo sapiens; identical to SEQ ID NO: 44783
  chr16:85516822-85516867
  hypo

SEQ ID NO: 65199 - DNA, 127 bp, Homo sapiens
  chr16:85517218-85517345
  hypo
gggatcaagtgtctccgaggcggcgggctgagacggatgggcctcctggccgcacacctgagaacatgctggcaaaagcgtttgcttaattaattgactttgagcgagggagcccgtccccgtgtaa

SEQ ID NO: 65200 - DNA, 30 bp, Homo sapiens; identical to SEQ ID NO: 44785
  chr16:85517571-85517601
  hypo

SEQ ID NO: 65201 - DNA, 70 bp, Homo sapiens; identical to SEQ ID NO: 44786
  chr16:85617748-85617818
  hypo

SEQ ID NO: 65202 - DNA, 47 bp, Homo sapiens; identical to SEQ ID NO: 44787
  chr16:85668941-85668988
  hypo

SEQ ID NO: 65203 - DNA, 32 bp, Homo sapiens; identical to SEQ ID NO: 16084
  chr16:85671134-85671166
  hypo

SEQ ID NO: 65204 - DNA, 55 bp, Homo sapiens; identical to SEQ ID NO: 44789
  chr16:85673184-85673239
  hypo

SEQ ID NO: 65205 - DNA, 48 bp, Homo sapiens; identical to SEQ ID NO: 44790
  chr16:85673838-85673886
  hypo

SEQ ID NO: 65206 - DNA, 144 bp, Homo sapiens; identical to SEQ ID NO: 44791
  chr16:85674157-85674301
  hypo

SEQ ID NO: 65207 - DNA, 423 bp, Homo sapiens
  chr16:85678216-85678639
  hypo
gcccttctttagagacggagagccaatgcgtgcggggcctggggagacgggagtggttgctcatgggtagggggttccttttggggtgacggaaatgctctgaaatggattgtggtgatggtcgcacaactctggacgtgctagaaccgtggggccgcgcgctgggtgggtgaattacgcgggatggaatcatagctcggtgaagctataacaactgaaacccaagagccatggaggttccatggaatttttttttttaaacaacgatcctttccctagtttttattttttttccccaaaaacttaaagtgaactttttctcaaaatctaaatacatacagaaaagcgcctagactgccagtgtccagaacgaacccacagatcaggagggctgaggcctgttctcctgtccccaccctctgc

SEQ ID NO: 65208 - DNA, 245 bp, Homo sapiens
  chr16:85684063-85684308
  hypo
ccactgccttgaccccgaccagagctcctggcctagacccaggacgcctcgaggggattccagcgccttttccggcgactcctccgctctgagctggtccctcctcggagggtccttaccgcctcgggaacattgagctaccccagagcagagcaggggcgcgacaggcccgccccagcagtgtaccaccgcggcgcttaatggaacacggtgccgccagggaaggcgcggggccggcagctgga

SEQ ID NO: 65209 - DNA, 137 bp, Homo sapiens
  chr16:85684457-85684594
  hypo
gttgccgggccggaggcttctcggccccttctcggggtcacccctctctcccaggtgtagtgggagctgcgagaggagaaatgagatgaaaaagcctgttttaaagctaacagggcatgtcccgcctgtctgactat

SEQ ID NO: 65210 - DNA, 40 bp, Homo sapiens; identical to SEQ ID NO: 44795
  chr16:85721581-85721621
  hypo

SEQ ID NO: 65211 - DNA, 163 bp, Homo sapiens; identical to SEQ ID NO: 44796
  chr16:85731450-85731613
  hypo

SEQ ID NO: 65212 - DNA, 30 bp, Homo sapiens; identical to SEQ ID NO: 44797
  chr16:85741538-85741568
  hypo

SEQ ID NO: 65213 - DNA, 30 bp, Homo sapiens; identical to SEQ ID NO: 44798
  chr16:85752258-85752288
  hypo

SEQ ID NO: 65214 - DNA, 30 bp, Homo sapiens; identical to SEQ ID NO: 44799
  chr16:85758266-85758296
  hypo

SEQ ID NO: 65215 - DNA, 55 bp, Homo sapiens; identical to SEQ ID NO: 44800
  chr16:86119064-86119119
  hypo

SEQ ID NO: 65216 - DNA, 62 bp, Homo sapiens; identical to SEQ ID NO: 44801
  chr16:86215345-86215407
  hypo

SEQ ID NO: 65217 - DNA, 45 bp, Homo sapiens; identical to SEQ ID NO: 44802
  chr16:86878195-86878240
  hypo

SEQ ID NO: 65218 - DNA, 38 bp, Homo sapiens; identical to SEQ ID NO: 44803
  chr16:86903475-86903513
  hypo

SEQ ID NO: 65219 - DNA, 30 bp, Homo sapiens; identical to SEQ ID NO: 44804
  chr16:87022637-87022667
  hypo

SEQ ID NO: 65220 - DNA, 63 bp, Homo sapiens
  chr16:87092376-87092439
  hypo
tgacaaatatgctctcggatagaacagcccagaaagggcaagagggagagttggaacactcag

SEQ ID NO: 65221 - DNA, 30 bp, Homo sapiens; identical to SEQ ID NO: 44806
  chr16:87188016-87188046
  hypo

SEQ ID NO: 65222 - DNA, 147 bp, Homo sapiens; identical to SEQ ID NO: 16090
  chr16:87296936-87297083
  hypo

SEQ ID NO: 65223 - DNA, 135 bp, Homo sapiens; identical to SEQ ID NO: 44808
  chr16:87354991-87355126
  hypo

SEQ ID NO: 65224 - DNA, 46 bp, Homo sapiens; identical to SEQ ID NO: 44809
  chr16:87356783-87356829
  hypo

SEQ ID NO: 65225 - DNA, 85 bp, Homo sapiens; identical to SEQ ID NO: 44810
  chr16:87421370-87421455
  hypo

SEQ ID NO: 65226 - DNA, 130 bp, Homo sapiens; identical to SEQ ID NO: 44811
  chr16:87594957-87595087
  hypo

SEQ ID NO: 65227 - DNA, 93 bp, Homo sapiens; identical to SEQ ID NO: 44812
  chr16:87648265-87648358
  hypo

SEQ ID NO: 65228 - DNA, 112 bp, Homo sapiens; identical to SEQ ID NO: 44813
  chr16:87688591-87688703
  hypo

SEQ ID NO: 65229 - DNA, 30 bp, Homo sapiens; identical to SEQ ID NO: 44814
  chr16:87701846-87701876
  hypo

SEQ ID NO: 65230 - DNA, 171 bp, Homo sapiens; identical to SEQ ID NO: 44815
  chr16:87723156-87723327
  hypo

SEQ ID NO: 65231 - DNA, 129 bp, Homo sapiens
  chr16:87723606-87723735
  hypo
gcgcggcggcctgctcgtggatgacttccgcacccgaggttcgggccgcaagcagcccgggaaccccaagccgcgggagcggcggacggagtcaccccccgtgttcacgtggacttcccaccaccgggc

SEQ ID NO: 65232 - DNA, 15 bp, Homo sapiens
  chr16:87724098-87724113
  hypo
cgaggagaatgggga

SEQ ID NO: 65233 - DNA, 48 bp, Homo sapiens; identical to SEQ ID NO: 44817
  chr16:88101496-88101544
  hypo

SEQ ID NO: 65234 - DNA, 86 bp, Homo sapiens; identical to SEQ ID NO: 44818
  chr16:88164472-88164558
  hypo

SEQ ID NO: 65235 - DNA, 191 bp, Homo sapiens; identical to SEQ ID NO: 44819
  chr16:88165560-88165751
  hypo

SEQ ID NO: 65236 - DNA, 85 bp, Homo sapiens; identical to SEQ ID NO: 44820
  chr16:88375259-88375344
  hypo

SEQ ID NO: 65237 - DNA, 159 bp, Homo sapiens; identical to SEQ ID NO: 44821
  chr16:88476104-88476263
  hypo

SEQ ID NO: 65238 - DNA, 170 bp, Homo sapiens; identical to SEQ ID NO: 44822
  chr16:88495551-88495721
  hypo

SEQ ID NO: 65239 - DNA, 36 bp, Homo sapiens; identical to SEQ ID NO: 44823
  chr16:88498199-88498235
  hypo

SEQ ID NO: 65240 - DNA, 57 bp, Homo sapiens
  chr16:88498760-88498817
  hypo
cgcgcgttggagaatccactgcacatcgggagggtgcggaatcggctgtggccaccg

SEQ ID NO: 65241 - DNA, 30 bp, Homo sapiens; identical to SEQ ID NO: 44825
  chr16:88502327-88502357
  hypo

SEQ ID NO: 65242 - DNA, 30 bp, Homo sapiens; identical to SEQ ID NO: 44826
  chr16:88502901-88502931
  hypo

SEQ ID NO: 65243 - DNA, 30 bp, Homo sapiens; identical to SEQ ID NO: 16096
  chr16:88503235-88503265
  hypo

SEQ ID NO: 65244 - DNA, 161 bp, Homo sapiens; identical to SEQ ID NO: 44828
  chr16:88503557-88503718
  hypo

SEQ ID NO: 65245 - DNA, 41 bp, Homo sapiens; identical to SEQ ID NO: 25325
  chr16:88504017-88504058
  hypo

SEQ ID NO: 65246 - DNA, 38 bp, Homo sapiens
  chr16:88504315-88504353
  hypo
cccggcagtgcccctgggcccggcgaggacaggcctcc

SEQ ID NO: 65247 - DNA, 30 bp, Homo sapiens; identical to SEQ ID NO: 44830
  chr16:88504602-88504632
  hypo

SEQ ID NO: 65248 - DNA, 15 bp, Homo sapiens
  chr16:88506526-88506541
  hypo
cgcctatttgcaatg

SEQ ID NO: 65249 - DNA, 250 bp, Homo sapiens; identical to SEQ ID NO: 44832
  chr16:88507040-88507290
  hypo

SEQ ID NO: 65250 - DNA, 90 bp, Homo sapiens; identical to SEQ ID NO: 44833
  chr16:88507982-88508072
  hypo

SEQ ID NO: 65251 - DNA, 21 bp, Homo sapiens
  chr16:88512529-88512550
  hypo
gtgcgtcggggtgcagggcac

SEQ ID NO: 65252 - DNA, 124 bp, Homo sapiens; identical to SEQ ID NO: 44835
  chr16:88551425-88551549
  hypo

SEQ ID NO: 65253 - DNA, 30 bp, Homo sapiens; identical to SEQ ID NO: 44836
  chr16:88601644-88601674
  hypo

SEQ ID NO: 65254 - DNA, 51 bp, Homo sapiens; identical to SEQ ID NO: 44837
  chr16:88602946-88602997
  hypo

SEQ ID NO: 65255 - DNA, 16 bp, Homo sapiens
  chr16:88603760-88603776
  hypo
tcgaagcttagggcag

SEQ ID NO: 65256 - DNA, 61 bp, Homo sapiens; identical to SEQ ID NO: 44840
  chr16:88624831-88624892
  hypo

SEQ ID NO: 65257 - DNA, 83 bp, Homo sapiens; identical to SEQ ID NO: 44841
  chr16:88683834-88683917
  hypo

SEQ ID NO: 65258 - DNA, 96 bp, Homo sapiens; identical to SEQ ID NO: 44842
  chr16:88722642-88722738
  hypo

SEQ ID NO: 65259 - DNA, 107 bp, Homo sapiens; identical to SEQ ID NO: 44843
  chr16:88757527-88757634
  hypo

SEQ ID NO: 65260 - DNA, 120 bp, Homo sapiens; identical to SEQ ID NO: 44844
  chr16:88791699-88791819
  hypo

SEQ ID NO: 65261 - DNA, 42 bp, Homo sapiens; identical to SEQ ID NO: 44845
  chr16:88793407-88793449
  hypo

SEQ ID NO: 65262 - DNA, 157 bp, Homo sapiens; identical to SEQ ID NO: 44846
  chr16:88794604-88794761
  hypo

SEQ ID NO: 65263 - DNA, 30 bp, Homo sapiens; identical to SEQ ID NO: 44847
  chr16:88798777-88798807
  hypo

SEQ ID NO: 65264 - DNA, 30 bp, Homo sapiens; identical to SEQ ID NO: 44848
  chr16:88803397-88803427
  hypo

SEQ ID NO: 65265 - DNA, 54 bp, Homo sapiens; identical to SEQ ID NO: 44849
  chr16:88805867-88805921
  hypo

SEQ ID NO: 65266 - DNA, 30 bp, Homo sapiens; identical to SEQ ID NO: 44850
  chr16:88827321-88827351
  hypo

SEQ ID NO: 65267 - DNA, 36 bp, Homo sapiens; identical to SEQ ID NO: 44851
  chr16:88831239-88831275
  hypo

SEQ ID NO: 65268 - DNA, 143 bp, Homo sapiens; identical to SEQ ID NO: 44852
  chr16:88832684-88832827
  hypo

SEQ ID NO: 65269 - DNA, 21 bp, Homo sapiens
  chr16:88881425-88881446
  hypo
ccaccgcgcttggcctcgagc

SEQ ID NO: 65270 - DNA, 397 bp, Homo sapiens
  chr16:88882841-88883238
  hypo
gtccagaggcggggacgccagctgcccaggtccctttgaaggaagggccctgaatatcttcctatgaaacttgccaggcacccccgccccccgccccccaactaacggaggtggccctgccctgcccagtcctaaataaccctgcagggtggactgtccctgggcagggacaaggccatctgccctccatggtcctcactgctggtaggtgctcccgatggccggtgctctcctgttacatccgccggcccacgctgtggctccctggctgttcagagccaccaccttccttcccacggcacggcgggcacccagcggctcccacgctgcagccgggtctggccctggaaagaggcttcagctgggccttttcgcccgcacagcaggagcccaggct

SEQ ID NO: 65271 - DNA, 97 bp, Homo sapiens
  chr16:88883377-88883474
  hypo
tgctcggtgggctctgggcacccaggagcgacaccgcagacctgtgtgtggctcgtttttgccgactagagcgagggccgcacgtgtcccatctgaa

SEQ ID NO: 65272 - DNA, 72 bp, Homo sapiens; identical to SEQ ID NO: 44856
  chr16:88884207-88884279
  hypo

SEQ ID NO: 65273 - DNA, 91 bp, Homo sapiens; identical to SEQ ID NO: 44857
  chr16:88931237-88931328
  hypo

SEQ ID NO: 65274 - DNA, 30 bp, Homo sapiens; identical to SEQ ID NO: 44858
  chr16:88933367-88933397
  hypo

SEQ ID NO: 65275 - DNA, 30 bp, Homo sapiens; identical to SEQ ID NO: 44859
  chr16:88941444-88941474
  hypo

SEQ ID NO: 65276 - DNA, 134 bp, Homo sapiens
  chr16:88941985-88942119
  hypo
aggttggagttggggcgatggggctgagagaggtcggagctggggtgagggggccgagagaggtcggagggcgcggagaggagagaggtagaggaggacgggctggccgagaagcagtgtttcagggaggcctg

SEQ ID NO: 65277 - DNA, 78 bp, Homo sapiens; identical to SEQ ID NO: 44861
  chr16:88943090-88943168
  hypo

SEQ ID NO: 65278 - DNA, 117 bp, Homo sapiens
  chr16:88943442-88943559
  hypo
ccgcagagccggcttcgctggggctggcagcacccacaggcagggaggggcccaggctgtgggcggcttcgggcggtccaggcaccgggtcggccaccacggctgtggggccctgca

SEQ ID NO: 65279 - DNA, 63 bp, Homo sapiens; identical to SEQ ID NO: 44863
  chr16:88944955-88945018
  hypo

SEQ ID NO: 65280 - DNA, 213 bp, Homo sapiens; identical to SEQ ID NO: 25337
  chr16:88945602-88945815
  hypo

SEQ ID NO: 65281 - DNA, 84 bp, Homo sapiens; identical to SEQ ID NO: 25338
  chr16:88945995-88946079
  hypo

SEQ ID NO: 65282 - DNA, 440 bp, Homo sapiens; identical to SEQ ID NO: 44865
  chr16:88948329-88948769
  hypo

SEQ ID NO: 65283 - DNA, 579 bp, Homo sapiens; identical to SEQ ID NO: 44866
  chr16:88952219-88952798
  hypo

SEQ ID NO: 65284 - DNA, 60 bp, Homo sapiens
  chr16:88955189-88955249
  hypo
atgtcccactggccccgggccccgggtgggggcacgaggtgggctggccctgagctccag

SEQ ID NO: 65285 - DNA, 89 bp, Homo sapiens
  chr16:88956141-88956230
  hypo
cttcaaatccctggacgacgccccgcgattcctcctcctccagggacgacgccacgcgattcctcctcctccagggacacttcaaatcc

SEQ ID NO: 65286 - DNA, 118 bp, Homo sapiens; identical to SEQ ID NO: 44869
  chr16:88956594-88956712
  hypo

SEQ ID NO: 65287 - DNA, 138 bp, Homo sapiens
  chr16:88957857-88957995
  hypo
gggtgctggctccaggagggacctgctgcatgtcctgggccctatccccgagccttgcccccacactggcacgtcgtcagtgctcaaaaatcacccgtggagtgagcgagcacattcggccaacggcaaccagaggcg

SEQ ID NO: 65288 - DNA, 52 bp, Homo sapiens
  chr16:88958345-88958397
  hypo
tggaatgaaactcctcgatcgtcaatgtcgagttctgcaggggagaaaaccc

SEQ ID NO: 65289 - DNA, 18 bp, Homo sapiens
  chr16:88958431-88958449
  hypo
cgccgacccacccatgcc

SEQ ID NO: 65290 - DNA, 99 bp, Homo sapiens; identical to SEQ ID NO: 44872
  chr16:88962807-88962906
  hypo

SEQ ID NO: 65291 - DNA, 63 bp, Homo sapiens; identical to SEQ ID NO: 25346
  chr16:88963214-88963277
  hypo

SEQ ID NO: 65292 - DNA, 30 bp, Homo sapiens; identical to SEQ ID NO: 44874
  chr16:88965028-88965058
  hypo

SEQ ID NO: 65293 - DNA, 242 bp, Homo sapiens
  chr16:88966588-88966830
  hypo
gccgttaggctgtttggctcctactgagtgccgggcacatttccagctgtacctgcctctgggcggcacacctgggggcaccccattgctgggccaccccattccccaaccaagtcgggaggctgactcggagccaacatcctacaaacagggccgcaaatctgctgcctgaccgcacagccagtgctctctccagatggaggggagatgatggccaaagccctcggcggagcaggccccca

SEQ ID NO: 65294 - DNA, 224 bp, Homo sapiens; identical to SEQ ID NO: 44876
  chr16:88967701-88967925
  hypo

SEQ ID NO: 65295 - DNA, 417 bp, Homo sapiens
  chr16:88968292-88968709
  hypo
tggagctggggccctcggtgtgtggccgccctgcgagagccgtgccccactccaggcttgaggcttctacagaccagggagtgggcagtgccccgaggcagcggtgccttgctcccacctccatgagcatcccccggggggtgttcagacagacctcagcctcttcccccagtcctgattcagcaggtcaggctgagacccagaatttgcatttccggcatgttcccaggtggcgctgctgctggtctggccctggaagccatggttctaagagtcccttccactttcagatgctagaaggctcccctgggctggggggcgggggacggtgtctgcccagggagaggccggcaggcaggccatttagggcggcaaaacctctattttaaccgtcttctgccccggtgattcacagga

SEQ ID NO: 65296 - DNA, 23 bp, Homo sapiens
  chr16:88968789-88968812
  hypo
ccaggacacgtgattaatgagaa

SEQ ID NO: 65297 - DNA, 30 bp, Homo sapiens; identical to SEQ ID NO: 44878
  chr16:88970496-88970526
  hypo

SEQ ID NO: 65298 - DNA, 50 bp, Homo sapiens; identical to SEQ ID NO: 44879
  chr16:88976653-88976703
  hypo

SEQ ID NO: 65299 - DNA, 74 bp, Homo sapiens
  chr16:88977950-88978024
  hypo
ctctccctgcaggaacggagttggcttttccgtctcctaatctggcctcagttttctcatctgtaaaatgggaa

SEQ ID NO: 65300 - DNA, 50 bp, Homo sapiens
  chr16:88978072-88978122
  hypo
cacgaaaagcgtctagaacagagcgcctggccgctcgccctggccaccca

SEQ ID NO: 65301 - DNA, 30 bp, Homo sapiens; identical to SEQ ID NO: 44881
  chr16:88980132-88980162
  hypo

SEQ ID NO: 65302 - DNA, 272 bp, Homo sapiens; identical to SEQ ID NO: 44883
  chr16:88994398-88994670
  hypo

SEQ ID NO: 65303 - DNA, 17 bp, Homo sapiens
  chr16:89000151-89000168
  hypo
tctatacgcctcacacg

SEQ ID NO: 65304 - DNA, 35 bp, Homo sapiens
  chr16:89000204-89000239
  hypo
agtggccacttcatgccacgcgtatgtgacttggt

SEQ ID NO: 65305 - DNA, 93 bp, Homo sapiens
  chr16:89001001-89001094
  hypo
ggaggcccagaggagcggagaggagtctggcctcgctgcctgcctattcttgctgttggcagggcctggtaaaggaggcagagatgccacgaa

SEQ ID NO: 65306 - DNA, 38 bp, Homo sapiens
  chr16:89001124-89001162
  hypo
tccacccccgaagttcagaaggacgcattctttttttc

SEQ ID NO: 65307 - DNA, 38 bp, Homo sapiens; identical to SEQ ID NO: 16126
  chr16:89025782-89025820
  hypo

SEQ ID NO: 65308 - DNA, 93 bp, Homo sapiens; identical to SEQ ID NO: 44887
  chr16:89026022-89026115
  hypo

SEQ ID NO: 65309 - DNA, 30 bp, Homo sapiens; identical to SEQ ID NO: 44888
  chr16:89028699-89028729
  hypo

SEQ ID NO: 65310 - DNA, 30 bp, Homo sapiens; identical to SEQ ID NO: 44889
  chr16:89029708-89029738
  hypo

SEQ ID NO: 65311 - DNA, 535 bp, Homo sapiens; identical to SEQ ID NO: 44890
  chr16:89055410-89055945
  hypo

SEQ ID NO: 65312 - DNA, 53 bp, Homo sapiens
  chr16:89072774-89072827
  hypo
gagacaaggaactgactgcaagtggaccatttgcagggcgaccccaagggcag

SEQ ID NO: 65313 - DNA, 30 bp, Homo sapiens; identical to SEQ ID NO: 44892
  chr16:89103482-89103512
  hypo

SEQ ID NO: 65314 - DNA, 123 bp, Homo sapiens; identical to SEQ ID NO: 44893
  chr16:89105547-89105670
  hypo

SEQ ID NO: 65315 - DNA, 28 bp, Homo sapiens
  chr16:89107647-89107675
  hypo
ggagggcaaccgagtcggcctgggttca

SEQ ID NO: 65316 - DNA, 52 bp, Homo sapiens; identical to SEQ ID NO: 25353
  chr16:89107732-89107784
  hypo

SEQ ID NO: 65317 - DNA, 177 bp, Homo sapiens; identical to SEQ ID NO: 44895
  chr16:89109482-89109659
  hypo

SEQ ID NO: 65318 - DNA, 30 bp, Homo sapiens; identical to SEQ ID NO: 44896
  chr16:89110091-89110121
  hypo

SEQ ID NO: 65319 - DNA, 30 bp, Homo sapiens; identical to SEQ ID NO: 44897
  chr16:89115322-89115352
  hypo

SEQ ID NO: 65320 - DNA, 87 bp, Homo sapiens
  chr16:89120319-89120406
  hypo
ggcgggcaggtgctggaggactgagtgaggcccctccaggatggctccctgcccctccatgcgctgggtcctcgggccaggacaggt

SEQ ID NO: 65321 - DNA, 24 bp, Homo sapiens
  chr16:89120684-89120708
  hypo
tggctggggctcctgcggccaccc

SEQ ID NO: 65322 - DNA, 63 bp, Homo sapiens
  chr16:89138060-89138123
  hypo
ctcccgaccttctcatttgatcctcctgccctatgcggttggtgccaacgttcatcccatttt

SEQ ID NO: 65323 - DNA, 25 bp, Homo sapiens
  chr16:89139536-89139561
  hypo
cacttacctggagtgcggtggcccc

SEQ ID NO: 65324 - DNA, 52 bp, Homo sapiens; identical to SEQ ID NO: 44902
  chr16:89140367-89140419
  hypo

SEQ ID NO: 65325 - DNA, 30 bp, Homo sapiens; identical to SEQ ID NO: 44903
  chr16:89141923-89141953
  hypo

SEQ ID NO: 65326 - DNA, 402 bp, Homo sapiens; identical to SEQ ID NO: 44904
  chr16:89172134-89172536
  hypo

SEQ ID NO: 65327 - DNA, 44 bp, Homo sapiens; identical to SEQ ID NO: 44905
  chr16:89189859-89189903
  hypo

SEQ ID NO: 65328 - DNA, 54 bp, Homo sapiens; identical to SEQ ID NO: 44906
  chr16:89219318-89219372
  hypo

SEQ ID NO: 65329 - DNA, 257 bp, Homo sapiens
  chr16:89220398-89220655
  hypo
cagggtcccaggggcacctgtccgtactgctgggcgcctgagttcctcctgctgggcactgtcagggcagtgcgcctcaggctgtgcttgtctctgcagaaatgtcctggccccgtacgcggtgccctcggagctggtgctggtggaggagatcccgcggaaccagatgggcaagattgacaagaaggcgctcatcaggcacttccacccctcatgacccggcagactgggactgcgggtctggtggggagcagcag

SEQ ID NO: 65330 - DNA, 112 bp, Homo sapiens
  chr16:89220922-89221034
  hypo
tgcagttgccaggctctccagggcaggtcccagaggtttcccacaaaaaacaaagactccactggaggaaacaagcccctgtcccacgccgtctgcacgtgcctgtgcctca

SEQ ID NO: 65331 - DNA, 82 bp, Homo sapiens; identical to SEQ ID NO: 44908
  chr16:89225881-89225963
  hypo

SEQ ID NO: 65332 - DNA, 390 bp, Homo sapiens; identical to SEQ ID NO: 44909
  chr16:89226330-89226720
  hypo

SEQ ID NO: 65333 - DNA, 112 bp, Homo sapiens; identical to SEQ ID NO: 44910
  chr16:89242936-89243048
  hypo

SEQ ID NO: 65334 - DNA, 151 bp, Homo sapiens; identical to SEQ ID NO: 44911
  chr16:89245291-89245442
  hypo

SEQ ID NO: 65335 - DNA, 102 bp, Homo sapiens; identical to SEQ ID NO: 44912
  chr16:89245643-89245745
  hypo

SEQ ID NO: 65336 - DNA, 20 bp, Homo sapiens
  chr16:89254633-89254653
  hypo
gggcagttcaccatccgcac

SEQ ID NO: 65337 - DNA, 30 bp, Homo sapiens; identical to SEQ ID NO: 44914
  chr16:89311109-89311139
  hypo

SEQ ID NO: 65338 - DNA, 30 bp, Homo sapiens; identical to SEQ ID NO: 44915
  chr16:89531824-89531854
  hypo

SEQ ID NO: 65339 - DNA, 62 bp, Homo sapiens
  chr16:89558703-89558765
  hypo
agtgtttccatatttgcctcactggacgaagtatttggtaaaattgacgaaattcagagtcc

SEQ ID NO: 65340 - DNA, 44 bp, Homo sapiens; identical to SEQ ID NO: 44917
  chr16:89575654-89575698
  hypo

SEQ ID NO: 65341 - DNA, 30 bp, Homo sapiens; identical to SEQ ID NO: 16146
  chr16:89576068-89576098
  hypo

SEQ ID NO: 65342 - DNA, 26 bp, Homo sapiens
  chr16:89637111-89637137
  hypo
acaggaggaggtgagcggggattgga

SEQ ID NO: 65343 - DNA, 30 bp, Homo sapiens; identical to SEQ ID NO: 44920
  chr16:89651651-89651681
  hypo

SEQ ID NO: 65344 - DNA, 79 bp, Homo sapiens; identical to SEQ ID NO: 16147
  chr16:89655054-89655133
  hypo

SEQ ID NO: 65345 - DNA, 30 bp, Homo sapiens; identical to SEQ ID NO: 44922
  chr16:89667452-89667482
  hypo

SEQ ID NO: 65346 - DNA, 30 bp, Homo sapiens; identical to SEQ ID NO: 16148
  chr16:89668379-89668409
  hypo

SEQ ID NO: 65347 - DNA, 79 bp, Homo sapiens; identical to SEQ ID NO: 44924
  chr16:89688162-89688241
  hypo

SEQ ID NO: 65348 - DNA, 255 bp, Homo sapiens; identical to SEQ ID NO: 44925
  chr16:89702746-89703001
  hypo

SEQ ID NO: 65349 - DNA, 48 bp, Homo sapiens; identical to SEQ ID NO: 44926
  chr16:89704648-89704696
  hypo

SEQ ID NO: 65350 - DNA, 30 bp, Homo sapiens; identical to SEQ ID NO: 44927
  chr16:89713595-89713625
  hypo

SEQ ID NO: 65351 - DNA, 37 bp, Homo sapiens; identical to SEQ ID NO: 44928
  chr16:89763835-89763872
  hypo

SEQ ID NO: 65352 - DNA, 50 bp, Homo sapiens
  chr16:89883922-89883972
  hypo
ggcagagcgagactctgtctcaaaacaaaaccaaacataagaattcgtaa

SEQ ID NO: 65353 - DNA, 157 bp, Homo sapiens
  chr16:89884185-89884342
  hypo
cagagtggggccttggattcatgagatggggatggagcagaaatgagaattcggagtccatgaaacccccacaaagactcctgcacggcccgactcggacactttgcaatctgctggttgagggggatggtgtgaactcagggaacagcctgagatc

SEQ ID NO: 65354 - DNA, 70 bp, Homo sapiens
  chr16:89884896-89884966
  hypo
aaccatgaagatggccggaggaaaaagatacgttaaatacagtaacaaaggtaagaattccagcctgggc

SEQ ID NO: 65355 - DNA, 30 bp, Homo sapiens; identical to SEQ ID NO: 44932
  chr16:89896219-89896249
  hypo

SEQ ID NO: 65356 - DNA, 71 bp, Homo sapiens
  chr16:89900384-89900455
  hypo
tgtagatggcattcccgatatagtctcacctctgagcaagggttacctcacaggaaggcagtcctgcagca

SEQ ID NO: 65357 - DNA, 289 bp, Homo sapiens
  chr16:89900526-89900815
  hypo
aagcatagcccgtgtgaatctgtgaacctgcctgcgctcgcggttggccgtcgtagaagcctggataagcatagcccgtgtgaatctgtgaacctgcctgtgctcacggttggccgtcgtagaagcatggataagcatagcccgtgtgaatctgtgaacctgcccgcgctcgcggttggccgtcgtagaaggccccataagcatagcccgtgtgaatctgtgaacctgcctgtgctcacggttggccgtcgtagaagcctggataagcatagcccgtgtgaatctgtga

SEQ ID NO: 65358 - DNA, 30 bp, Homo sapiens; identical to SEQ ID NO: 44935
  chr16:89972205-89972235
  hypo

SEQ ID NO: 65359 - DNA, 40 bp, Homo sapiens; identical to SEQ ID NO: 44936
  chr16:90037700-90037740
  hypo

SEQ ID NO: 65360 - DNA, 321 bp, Homo sapiens; identical to SEQ ID NO: 44937
  chr16:90066626-90066947
  hypo

SEQ ID NO: 65361 - DNA, 133 bp, Homo sapiens; identical to SEQ ID NO: 16154
  chr16:90069191-90069324
  hypo

SEQ ID NO: 65362 - DNA, 12 bp, Homo sapiens
  chr17:616989-617001
  hypo
gcaggcagggcc

SEQ ID NO: 65363 - DNA, 57 bp, Homo sapiens; identical to SEQ ID NO: 44940
  chr17:706526-706583
  hypo

SEQ ID NO: 65364 - DNA, 121 bp, Homo sapiens; identical to SEQ ID NO: 44941
  chr17:745667-745788
  hypo

SEQ ID NO: 65365 - DNA, 30 bp, Homo sapiens; identical to SEQ ID NO: 44942
  chr17:876870-876900
  hypo

SEQ ID NO: 65366 - DNA, 30 bp, Homo sapiens; identical to SEQ ID NO: 44943
  chr17:896321-896351
  hypo

SEQ ID NO: 65367 - DNA, 30 bp, Homo sapiens; identical to SEQ ID NO: 44944
  chr17:915987-916017
  hypo

SEQ ID NO: 65368 - DNA, 34 bp, Homo sapiens; identical to SEQ ID NO: 44945
  chr17:1136687-1136721
  hypo

SEQ ID NO: 65369 - DNA, 30 bp, Homo sapiens; identical to SEQ ID NO: 44946
  chr17:1193094-1193124
  hypo

SEQ ID NO: 65370 - DNA, 121 bp, Homo sapiens; identical to SEQ ID NO: 44947
  chr17:1387772-1387893
  hypo

SEQ ID NO: 65371 - DNA, 51 bp, Homo sapiens; identical to SEQ ID NO: 44948
  chr17:1412412-1412463
  hypo

SEQ ID NO: 65372 - DNA, 18 bp, Homo sapiens
  chr17:1471448-1471466
  hypo
acccggccactctttcat

SEQ ID NO: 65373 - DNA, 18 bp, Homo sapiens
  chr17:1520967-1520985
  hypo
agccgccacacccagccg

SEQ ID NO: 65374 - DNA, 30 bp, Homo sapiens; identical to SEQ ID NO: 44951
  chr17:1536225-1536255
  hypo

SEQ ID NO: 65375 - DNA, 49 bp, Homo sapiens; identical to SEQ ID NO: 44952
  chr17:1543917-1543966
  hypo

SEQ ID NO: 65376 - DNA, 30 bp, Homo sapiens; identical to SEQ ID NO: 44953
  chr17:1544312-1544342
  hypo

SEQ ID NO: 65377 - DNA, 16 bp, Homo sapiens
  chr17:1545305-1545321
  hypo
gcgcccagccagggat

SEQ ID NO: 65378 - DNA, 8 bp, Homo sapiens
  chr17:1546442-1546450
  hypo
ctgtgtcc

SEQ ID NO: 65379 - DNA, 30 bp, Homo sapiens; identical to SEQ ID NO: 44957
  chr17:1819565-1819595
  hypo

SEQ ID NO: 65380 - DNA, 30 bp, Homo sapiens; identical to SEQ ID NO: 44961
  chr17:2264699-2264729
  hypo

SEQ ID NO: 65381 - DNA, 126 bp, Homo sapiens; identical to SEQ ID NO: 44962
  chr17:2298883-2299009
  hypo

SEQ ID NO: 65382 - DNA, 33 bp, Homo sapiens; identical to SEQ ID NO: 44963
  chr17:2495626-2495659
  hypo

SEQ ID NO: 65383 - DNA, 30 bp, Homo sapiens; identical to SEQ ID NO: 44964
  chr17:2634361-2634391
  hypo

SEQ ID NO: 65384 - DNA, 30 bp, Homo sapiens; identical to SEQ ID NO: 44965
  chr17:2859488-2859518
  hypo

SEQ ID NO: 65385 - DNA, 30 bp, Homo sapiens; identical to SEQ ID NO: 44966
  chr17:3541079-3541109
  hypo

SEQ ID NO: 65386 - DNA, 30 bp, Homo sapiens; identical to SEQ ID NO: 44968
  chr17:3686152-3686182
  hypo

SEQ ID NO: 65387 - DNA, 191 bp, Homo sapiens; identical to SEQ ID NO: 44969
  chr17:3741605-3741796
  hypo

SEQ ID NO: 65388 - DNA, 30 bp, Homo sapiens; identical to SEQ ID NO: 44970
  chr17:3792191-3792221
  hypo

SEQ ID NO: 65389 - DNA, 39 bp, Homo sapiens; identical to SEQ ID NO: 16163
  chr17:4236673-4236712
  hypo

SEQ ID NO: 65390 - DNA, 30 bp, Homo sapiens; identical to SEQ ID NO: 44972
  chr17:4446308-4446338
  hypo

SEQ ID NO: 65391 - DNA, 21 bp, Homo sapiens
  chr17:4976841-4976862
  hypo
gtgtaataaagcagacggtgg

SEQ ID NO: 65392 - DNA, 20 bp, Homo sapiens
  chr17:5320631-5320651
  hypo
aagtaaatagccaggcgtgg

SEQ ID NO: 65393 - DNA, 120 bp, Homo sapiens; identical to SEQ ID NO: 44976
  chr17:5320771-5320891
  hypo

SEQ ID NO: 65394 - DNA, 98 bp, Homo sapiens; identical to SEQ ID NO: 44977
  chr17:7047830-7047928
  hypo

SEQ ID NO: 65395 - DNA, 30 bp, Homo sapiens; identical to SEQ ID NO: 44978
  chr17:7107670-7107700
  hypo

SEQ ID NO: 65396 - DNA, 30 bp, Homo sapiens; identical to SEQ ID NO: 44979
  chr17:7156905-7156935
  hypo

SEQ ID NO: 65397 - DNA, 153 bp, Homo sapiens; identical to SEQ ID NO: 44981
  chr17:7466711-7466864
  hypo

SEQ ID NO: 65398 - DNA, 30 bp, Homo sapiens; identical to SEQ ID NO: 44982
  chr17:7727283-7727313
  hypo

SEQ ID NO: 65399 - DNA, 25 bp, Homo sapiens
  chr17:7856920-7856945
  hypo
ccgctcacctcgtgctttgcagtcc

SEQ ID NO: 65400 - DNA, 225 bp, Homo sapiens; identical to SEQ ID NO: 44984
  chr17:8104414-8104639
  hypo

SEQ ID NO: 65401 - DNA, 23 bp, Homo sapiens
  chr17:8104911-8104934
  hypo
tataggctgaaaggccgggcgcg

SEQ ID NO: 65402 - DNA, 25 bp, Homo sapiens
  chr17:8123524-8123549
  hypo
cccatcccaccggttttgtttttca

SEQ ID NO: 65403 - DNA, 30 bp, Homo sapiens; identical to SEQ ID NO: 44987
  chr17:8287729-8287759
  hypo

SEQ ID NO: 65404 - DNA, 149 bp, Homo sapiens; identical to SEQ ID NO: 44988
  chr17:8296142-8296291
  hypo

SEQ ID NO: 65405 - DNA, 228 bp, Homo sapiens; identical to SEQ ID NO: 44989
  chr17:8384676-8384904
  hypo

SEQ ID NO: 65406 - DNA, 18 bp, Homo sapiens
  chr17:8464515-8464533
  hypo
ggggcctctcctctccgg

SEQ ID NO: 65407 - DNA, 30 bp, Homo sapiens; identical to SEQ ID NO: 44991
  chr17:8572387-8572417
  hypo

SEQ ID NO: 65408 - DNA, 30 bp, Homo sapiens; identical to SEQ ID NO: 44992
  chr17:8732186-8732216
  hypo

SEQ ID NO: 65409 - DNA, 38 bp, Homo sapiens; identical to SEQ ID NO: 44993
  chr17:8789494-8789532
  hypo

SEQ ID NO: 65410 - DNA, 30 bp, Homo sapiens; identical to SEQ ID NO: 44994
  chr17:8789780-8789810
  hypo

SEQ ID NO: 65411 - DNA, 36 bp, Homo sapiens; identical to SEQ ID NO: 44995
  chr17:9808139-9808175
  hypo

SEQ ID NO: 65412 - DNA, 137 bp, Homo sapiens; identical to SEQ ID NO: 44996
  chr17:9810182-9810319
  hypo

SEQ ID NO: 65413 - DNA, 194 bp, Homo sapiens; identical to SEQ ID NO: 44997
  chr17:10212814-10213008
  hypo

SEQ ID NO: 65414 - DNA, 30 bp, Homo sapiens; identical to SEQ ID NO: 16169
  chr17:11572707-11572737
  hypo

SEQ ID NO: 65415 - DNA, 165 bp, Homo sapiens; identical to SEQ ID NO: 44999
  chr17:11637555-11637720
  hypo

SEQ ID NO: 65416 - DNA, 144 bp, Homo sapiens; identical to SEQ ID NO: 45000
  chr17:11672360-11672504
  hypo

SEQ ID NO: 65417 - DNA, 24 bp, Homo sapiens
  chr17:15702893-15702917
  hypo
gattacaggcgtgagccaccgcgc

SEQ ID NO: 65418 - DNA, 24 bp, Homo sapiens
  chr17:16120077-16120101
  hypo
cagcctgggcgacagagcctctca

SEQ ID NO: 65419 - DNA, 30 bp, Homo sapiens; identical to SEQ ID NO: 16171
  chr17:16282207-16282237
  hypo

SEQ ID NO: 65420 - DNA, 85 bp, Homo sapiens; identical to SEQ ID NO: 45004
  chr17:16282438-16282523
  hypo

SEQ ID NO: 65421 - DNA, 41 bp, Homo sapiens
  chr17:17123922-17123963
  hypo
tgcccagcacacctgcgtttccagctctcacaaaggcttcg

SEQ ID NO: 65422 - DNA, 30 bp, Homo sapiens; identical to SEQ ID NO: 45006
  chr17:17146203-17146233
  hypo

SEQ ID NO: 65423 - DNA, 77 bp, Homo sapiens; identical to SEQ ID NO: 45007
  chr17:17395970-17396047
  hypo

SEQ ID NO: 65424 - DNA, 187 bp, Homo sapiens; identical to SEQ ID NO: 16172
  chr17:17579341-17579528
  hypo

SEQ ID NO: 65425 - DNA, 39 bp, Homo sapiens; identical to SEQ ID NO: 45009
  chr17:17592178-17592217
  hypo

SEQ ID NO: 65426 - DNA, 108 bp, Homo sapiens; identical to SEQ ID NO: 45010
  chr17:17891258-17891366
  hypo

SEQ ID NO: 65427 - DNA, 40 bp, Homo sapiens; identical to SEQ ID NO: 45011
  chr17:17910311-17910351
  hypo

SEQ ID NO: 65428 - DNA, 38 bp, Homo sapiens; identical to SEQ ID NO: 45012
  chr17:18070928-18070966
  hypo

SEQ ID NO: 65429 - DNA, 29 bp, Homo sapiens
  chr17:18163325-18163354
  hypo
tgttcaagggggctcgccctggctgacac

SEQ ID NO: 65430 - DNA, 21 bp, Homo sapiens
  chr17:18272614-18272635
  hypo
tttttgagaaagtctcgatct

SEQ ID NO: 65431 - DNA, 34 bp, Homo sapiens; identical to SEQ ID NO: 45015
  chr17:19230161-19230195
  hypo

SEQ ID NO: 65432 - DNA, 179 bp, Homo sapiens; identical to SEQ ID NO: 45016
  chr17:19622428-19622607
  hypo

SEQ ID NO: 65433 - DNA, 89 bp, Homo sapiens; identical to SEQ ID NO: 45017
  chr17:19769823-19769912
  hypo

SEQ ID NO: 65434 - DNA, 118 bp, Homo sapiens; identical to SEQ ID NO: 45018
  chr17:19771594-19771712
  hypo

SEQ ID NO: 65435 - DNA, 30 bp, Homo sapiens; identical to SEQ ID NO: 45019
  chr17:20008410-20008440
  hypo

SEQ ID NO: 65436 - DNA, 162 bp, Homo sapiens; identical to SEQ ID NO: 45020
  chr17:20771807-20771969
  hypo

SEQ ID NO: 65437 - DNA, 30 bp, Homo sapiens; identical to SEQ ID NO: 45021
  chr17:20773688-20773718
  hypo

SEQ ID NO: 65438 - DNA, 102 bp, Homo sapiens; identical to SEQ ID NO: 45022
  chr17:20813557-20813659
  hypo

SEQ ID NO: 65439 - DNA, 38 bp, Homo sapiens; identical to SEQ ID NO: 45023
  chr17:20817586-20817624
  hypo

SEQ ID NO: 65440 - DNA, 70 bp, Homo sapiens; identical to SEQ ID NO: 45024
  chr17:21104001-21104071
  hypo

SEQ ID NO: 65441 - DNA, 53 bp, Homo sapiens; identical to SEQ ID NO: 16179
  chr17:21147486-21147539
  hypo

SEQ ID NO: 65442 - DNA, 30 bp, Homo sapiens; identical to SEQ ID NO: 45026
  chr17:21150794-21150824
  hypo

SEQ ID NO: 65443 - DNA, 27 bp, Homo sapiens
  chr17:21168792-21168819
  hypo
acctgaggctcttaacgattctctgga

SEQ ID NO: 65444 - DNA, 37 bp, Homo sapiens; identical to SEQ ID NO: 45028
  chr17:21860030-21860067
  hypo

SEQ ID NO: 65445 - DNA, 30 bp, Homo sapiens; identical to SEQ ID NO: 45029
  chr17:25432186-25432216
  hypo

SEQ ID NO: 65446 - DNA, 78 bp, Homo sapiens
  chr17:25676881-25676959
  hypo
cccccgcctggtgtgcgcatgctaggggcagtgctgacacgctccactggtttcagatcaactttggagaatttggcg

SEQ ID NO: 65447 - DNA, 75 bp, Homo sapiens
  chr17:25907780-25907855
  hypo
acaggctgtaaagaaatacctgaaactggattggttatttatttatttatgagacggcctggagtgcagtggcgc

SEQ ID NO: 65448 - DNA, 116 bp, Homo sapiens; identical to SEQ ID NO: 45034
  chr17:25931618-25931734
  hypo

SEQ ID NO: 65449 - DNA, 30 bp, Homo sapiens; identical to SEQ ID NO: 45035
  chr17:25957285-25957315
  hypo

SEQ ID NO: 65450 - DNA, 22 bp, Homo sapiens
  chr17:26927142-26927164
  hypo
actggatttcaaacacgtcgta

SEQ ID NO: 65451 - DNA, 30 bp, Homo sapiens; identical to SEQ ID NO: 45038
  chr17:26961906-26961936
  hypo

SEQ ID NO: 65452 - DNA, 24 bp, Homo sapiens
  chr17:27056401-27056425
  hypo
ctccctctgtcaccccggctggag

SEQ ID NO: 65453 - DNA, 12 bp, Homo sapiens
  chr17:27056857-27056869
  hypo
caggccagaagt

SEQ ID NO: 65454 - DNA, 30 bp, Homo sapiens; identical to SEQ ID NO: 16185
  chr17:27074858-27074888
  hypo

SEQ ID NO: 65455 - DNA, 22 bp, Homo sapiens
  chr17:27081800-27081822
  hypo
ttttttttcctgagacgggagt

SEQ ID NO: 65456 - DNA, 30 bp, Homo sapiens; identical to SEQ ID NO: 16187
  chr17:27411663-27411693
  hypo

SEQ ID NO: 65457 - DNA, 30 bp, Homo sapiens; identical to SEQ ID NO: 45045
  chr17:27419477-27419507
  hypo

SEQ ID NO: 65458 - DNA, 68 bp, Homo sapiens; identical to SEQ ID NO: 25402
  chr17:27716046-27716114
  hypo

SEQ ID NO: 65459 - DNA, 102 bp, Homo sapiens
  chr17:27716220-27716322
  hypo
ttttattcatgaaactcatataacaggtttatttatttcagtcgttttgttggttaaagaaccaagattttttatgactacactttgtgtacacttttaggt

SEQ ID NO: 65460 - DNA, 30 bp, Homo sapiens; identical to SEQ ID NO: 45048
  chr17:28715779-28715809
  hypo

SEQ ID NO: 65461 - DNA, 17 bp, Homo sapiens
  chr17:28988919-28988936
  hypo
gggtgcggtggctcacg

SEQ ID NO: 65462 - DNA, 47 bp, Homo sapiens
  chr17:30243907-30243954
  hypo
ccctgggctgcgcagccccagccagcccgacccgggctcagcgaccc

SEQ ID NO: 65463 - DNA, 30 bp, Homo sapiens; identical to SEQ ID NO: 45052
  chr17:30333112-30333142
  hypo

SEQ ID NO: 65464 - DNA, 39 bp, Homo sapiens
  chr17:30710888-30710927
  hypo
cagcctggacaaggagtgggactccgtctcaaaaaacaa

SEQ ID NO: 65465 - DNA, 30 bp, Homo sapiens; identical to SEQ ID NO: 45054
  chr17:30822187-30822217
  hypo

SEQ ID NO: 65466 - DNA, 50 bp, Homo sapiens; identical to SEQ ID NO: 45055
  chr17:30954269-30954319
  hypo

SEQ ID NO: 65467 - DNA, 30 bp, Homo sapiens; identical to SEQ ID NO: 45056
  chr17:31162054-31162084
  hypo

SEQ ID NO: 65468 - DNA, 155 bp, Homo sapiens; identical to SEQ ID NO: 45057
  chr17:31214020-31214175
  hypo

SEQ ID NO: 65469 - DNA, 184 bp, Homo sapiens; identical to SEQ ID NO: 45058
  chr17:32237066-32237250
  hypo

SEQ ID NO: 65470 - DNA, 23 bp, Homo sapiens
  chr17:32239704-32239727
  hypo
attatagactagggccgggtgag

SEQ ID NO: 65471 - DNA, 30 bp, Homo sapiens; identical to SEQ ID NO: 45060
  chr17:32275435-32275465
  hypo

SEQ ID NO: 65472 - DNA, 189 bp, Homo sapiens; identical to SEQ ID NO: 45063
  chr17:35061647-35061836
  hypo

SEQ ID NO: 65473 - DNA, 43 bp, Homo sapiens; identical to SEQ ID NO: 45064
  chr17:37011090-37011133
  hypo

SEQ ID NO: 65474 - DNA, 21 bp, Homo sapiens
  chr17:37369159-37369180
  hypo
cagagcatttacccccgcacc

SEQ ID NO: 65475 - DNA, 23 bp, Homo sapiens
  chr17:37606489-37606512
  hypo
actgctcccggcctcacctttcg

SEQ ID NO: 65476 - DNA, 17 bp, Homo sapiens
  chr17:37887620-37887637
  hypo
cccggtgctgatggcat

SEQ ID NO: 65477 - DNA, 33 bp, Homo sapiens; identical to SEQ ID NO: 45069
  chr17:38179589-38179622
  hypo

SEQ ID NO: 65478 - DNA, 17 bp, Homo sapiens
  chr17:38445245-38445262
  hypo
cccggcccatttcaggt

SEQ ID NO: 65479 - DNA, 124 bp, Homo sapiens; identical to SEQ ID NO: 45072
  chr17:39768852-39768976
  hypo

SEQ ID NO: 65480 - DNA, 36 bp, Homo sapiens; identical to SEQ ID NO: 45073
  chr17:39803800-39803836
  hypo

SEQ ID NO: 65481 - DNA, 30 bp, Homo sapiens; identical to SEQ ID NO: 45074
  chr17:39855665-39855695
  hypo

SEQ ID NO: 65482 - DNA, 23 bp, Homo sapiens
  chr17:40477866-40477889
  hypo
accgcgcccggccaatcaatttc

SEQ ID NO: 65483 - DNA, 30 bp, Homo sapiens; identical to SEQ ID NO: 45076
  chr17:40705998-40706028
  hypo

SEQ ID NO: 65484 - DNA, 24 bp, Homo sapiens
  chr17:40801969-40801993
  hypo
ctccctctccgaaaaaaaaaaaac

SEQ ID NO: 65485 - DNA, 30 bp, Homo sapiens; identical to SEQ ID NO: 45079
  chr17:41188525-41188555
  hypo

SEQ ID NO: 65486 - DNA, 56 bp, Homo sapiens
  chr17:41278565-41278621
  hypo
ctttttccgtgtctccggacagctaatcgttttagtgacaggatgagagagccctt

SEQ ID NO: 65487 - DNA, 3 bp, Homo sapiens
  chr17:41278700-41278703
  hypo
cta

SEQ ID NO: 65488 - DNA, 30 bp, Homo sapiens; identical to SEQ ID NO: 45081
  chr17:41416844-41416874
  hypo

SEQ ID NO: 65489 - DNA, 193 bp, Homo sapiens; identical to SEQ ID NO: 45082
  chr17:41464759-41464952
  hypo

SEQ ID NO: 65490 - DNA, 34 bp, Homo sapiens; identical to SEQ ID NO: 45083
  chr17:41957252-41957286
  hypo

SEQ ID NO: 65491 - DNA, 294 bp, Homo sapiens; identical to SEQ ID NO: 45084
  chr17:42330572-42330866
  hypo

SEQ ID NO: 65492 - DNA, 112 bp, Homo sapiens
  chr17:42331659-42331771
  hypo
aaaaagagctctccaaattatacaacttctggtcccacaaaacctggaactgcccctggcttttcactattcctgctagtcgggagggccacacacccgcagggactagctt

SEQ ID NO: 65493 - DNA, 30 bp, Homo sapiens; identical to SEQ ID NO: 45086
  chr17:42335482-42335512
  hypo

SEQ ID NO: 65494 - DNA, 41 bp, Homo sapiens; identical to SEQ ID NO: 16204
  chr17:42395128-42395169
  hypo

SEQ ID NO: 65495 - DNA, 16 bp, Homo sapiens
  chr17:42401285-42401301
  hypo
gcgtgagccaccgcac

SEQ ID NO: 65496 - DNA, 82 bp, Homo sapiens; identical to SEQ ID NO: 45090
  chr17:42787212-42787294
  hypo

SEQ ID NO: 65497 - DNA, 30 bp, Homo sapiens; identical to SEQ ID NO: 45093
  chr17:43318029-43318059
  hypo

SEQ ID NO: 65498 - DNA, 20 bp, Homo sapiens
  chr17:45268837-45268857
  hypo
tacattttttttttccgaga

SEQ ID NO: 65499 - DNA, 30 bp, Homo sapiens; identical to SEQ ID NO: 45095
  chr17:45971018-45971048
  hypo

SEQ ID NO: 65500 - DNA, 39 bp, Homo sapiens; identical to SEQ ID NO: 45096
  chr17:46177212-46177251
  hypo

SEQ ID NO: 65501 - DNA, 116 bp, Homo sapiens; identical to SEQ ID NO: 45097
  chr17:46946208-46946324
  hypo

SEQ ID NO: 65502 - DNA, 30 bp, Homo sapiens; identical to SEQ ID NO: 45098
  chr17:47170202-47170232
  hypo

SEQ ID NO: 65503 - DNA, 95 bp, Homo sapiens; identical to SEQ ID NO: 45099
  chr17:47227368-47227463
  hypo

SEQ ID NO: 65504 - DNA, 30 bp, Homo sapiens; identical to SEQ ID NO: 45100
  chr17:47330524-47330554
  hypo

SEQ ID NO: 65505 - DNA, 30 bp, Homo sapiens; identical to SEQ ID NO: 45101
  chr17:47449030-47449060
  hypo

SEQ ID NO: 65506 - DNA, 36 bp, Homo sapiens
  chr17:47657508-47657544
  hypo
agaccggggttctcccggatctggatggcgccgccc

SEQ ID NO: 65507 - DNA, 11 bp, Homo sapiens
  chr17:47657583-47657594
  hypo
gagcatgtgct

SEQ ID NO: 65508 - DNA, 32 bp, Homo sapiens; identical to SEQ ID NO: 16208
  chr17:47851118-47851150
  hypo

SEQ ID NO: 65509 - DNA, 31 bp, Homo sapiens; identical to SEQ ID NO: 16209
  chr17:47851390-47851421
  hypo

SEQ ID NO: 65510 - DNA, 30 bp, Homo sapiens; identical to SEQ ID NO: 45105
  chr17:48239531-48239561
  hypo

SEQ ID NO: 65511 - DNA, 35 bp, Homo sapiens; identical to SEQ ID NO: 45106
  chr17:48611963-48611998
  hypo

SEQ ID NO: 65512 - DNA, 144 bp, Homo sapiens
  chr17:48652984-48653128
  hypo
ctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctct

SEQ ID NO: 65513 - DNA, 266 bp, Homo sapiens
  chr17:48653158-48653424
  hypo
agcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgca

SEQ ID NO: 65514 - DNA, 64 bp, Homo sapiens; identical to SEQ ID NO: 45109
  chr17:48687158-48687222
  hypo

SEQ ID NO: 65515 - DNA, 4 bp, Homo sapiens
  chr17:48799866-48799870
  hypo
atgc

SEQ ID NO: 65516 - DNA, 30 bp, Homo sapiens; identical to SEQ ID NO: 45112
  chr17:51321147-51321177
  hypo

SEQ ID NO: 65517 - DNA, 39 bp, Homo sapiens; identical to SEQ ID NO: 16215
  chr17:53479136-53479175
  hypo

SEQ ID NO: 65518 - DNA, 40 bp, Homo sapiens; identical to SEQ ID NO: 45114
  chr17:53916938-53916978
  hypo

SEQ ID NO: 65519 - DNA, 30 bp, Homo sapiens; identical to SEQ ID NO: 16216
  chr17:54473510-54473540
  hypo

SEQ ID NO: 65520 - DNA, 34 bp, Homo sapiens; identical to SEQ ID NO: 5202
  chr17:55037248-55037282
  hypo

SEQ ID NO: 65521 - DNA, 44 bp, Homo sapiens; identical to SEQ ID NO: 16218
  chr17:55184791-55184835
  hypo

SEQ ID NO: 65522 - DNA, 181 bp, Homo sapiens; identical to SEQ ID NO: 45118
  chr17:55364048-55364229
  hypo

SEQ ID NO: 65523 - DNA, 70 bp, Homo sapiens; identical to SEQ ID NO: 45119
  chr17:56031530-56031600
  hypo

SEQ ID NO: 65524 - DNA, 30 bp, Homo sapiens; identical to SEQ ID NO: 45121
  chr17:57881555-57881585
  hypo

SEQ ID NO: 65525 - DNA, 21 bp, Homo sapiens
  chr17:58471329-58471350
  hypo
ccaccgcgccccaccaatatt

SEQ ID NO: 65526 - DNA, 110 bp, Homo sapiens; identical to SEQ ID NO: 45123
  chr17:60216644-60216754
  hypo

SEQ ID NO: 65527 - DNA, 41 bp, Homo sapiens; identical to SEQ ID NO: 45124
  chr17:60221577-60221618
  hypo

SEQ ID NO: 65528 - DNA, 30 bp, Homo sapiens; identical to SEQ ID NO: 45125
  chr17:60242060-60242090
  hypo

SEQ ID NO: 65529 - DNA, 35 bp, Homo sapiens; identical to SEQ ID NO: 45126
  chr17:60670444-60670479
  hypo

SEQ ID NO: 65530 - DNA, 54 bp, Homo sapiens; identical to SEQ ID NO: 45127
  chr17:60744566-60744620
  hypo

SEQ ID NO: 65531 - DNA, 59 bp, Homo sapiens; identical to SEQ ID NO: 45128
  chr17:60766944-60767003
  hypo

SEQ ID NO: 65532 - DNA, 234 bp, Homo sapiens; identical to SEQ ID NO: 45129
  chr17:60856637-60856871
  hypo

SEQ ID NO: 65533 - DNA, 80 bp, Homo sapiens; identical to SEQ ID NO: 45130
  chr17:61580796-61580876
  hypo

SEQ ID NO: 65534 - DNA, 19 bp, Homo sapiens
  chr17:61580936-61580955
  hypo
tgcccgatcatatggtaat

SEQ ID NO: 65535 - DNA, 66 bp, Homo sapiens; identical to SEQ ID NO: 45132
  chr17:61607855-61607921
  hypo

SEQ ID NO: 65536 - DNA, 30 bp, Homo sapiens; identical to SEQ ID NO: 45133
  chr17:61677509-61677539
  hypo

SEQ ID NO: 65537 - DNA, 62 bp, Homo sapiens
  chr17:61817955-61818017
  hypo
gctaaatgcttcatgagcagctcacaagtattatcatctctgttttacggatcaggaaattc

SEQ ID NO: 65538 - DNA, 30 bp, Homo sapiens; identical to SEQ ID NO: 45135
  chr17:61847674-61847704
  hypo

SEQ ID NO: 65539 - DNA, 30 bp, Homo sapiens; identical to SEQ ID NO: 45136
  chr17:62020148-62020178
  hypo

SEQ ID NO: 65540 - DNA, 16 bp, Homo sapiens
  chr17:62054818-62054834
  hypo
gcgatagagcaagacc

SEQ ID NO: 65541 - DNA, 35 bp, Homo sapiens
  chr17:64672331-64672366
  hypo
tcccagtaacgtgaccgggaaaatgtgagccagag

SEQ ID NO: 65542 - DNA, 14 bp, Homo sapiens
  chr17:64672544-64672558
  hypo
gaggaagcagaggg

SEQ ID NO: 65543 - DNA, 30 bp, Homo sapiens; identical to SEQ ID NO: 45139
  chr17:65298508-65298538
  hypo

SEQ ID NO: 65544 - DNA, 24 bp, Homo sapiens
  chr17:65789887-65789911
  hypo
cccagcactttgggacgttgaggc

SEQ ID NO: 65545 - DNA, 39 bp, Homo sapiens; identical to SEQ ID NO: 45141
  chr17:66421027-66421066
  hypo

SEQ ID NO: 65546 - DNA, 20 bp, Homo sapiens
  chr17:66462836-66462856
  hypo
gtcaccgtgcccaaccatgt

SEQ ID NO: 65547 - DNA, 30 bp, Homo sapiens; identical to SEQ ID NO: 16224
  chr17:66643303-66643333
  hypo

SEQ ID NO: 65548 - DNA, 30 bp, Homo sapiens; identical to SEQ ID NO: 45144
  chr17:66872616-66872646
  hypo

SEQ ID NO: 65549 - DNA, 13 bp, Homo sapiens
  chr17:67410397-67410410
  hypo
ggaaaaaaacaac

SEQ ID NO: 65550 - DNA, 24 bp, Homo sapiens
  chr17:68268160-68268184
  hypo
ttaaaaaaatattgtcggccgggc

SEQ ID NO: 65551 - DNA, 38 bp, Homo sapiens; identical to SEQ ID NO: 16227
  chr17:70657503-70657541
  hypo

SEQ ID NO: 65552 - DNA, 30 bp, Homo sapiens; identical to SEQ ID NO: 16228
  chr17:70712704-70712734
  hypo

SEQ ID NO: 65553 - DNA, 30 bp, Homo sapiens; identical to SEQ ID NO: 45149
  chr17:71201620-71201650
  hypo

SEQ ID NO: 65554 - DNA, 30 bp, Homo sapiens; identical to SEQ ID NO: 45150
  chr17:71202377-71202407
  hypo

SEQ ID NO: 65555 - DNA, 30 bp, Homo sapiens; identical to SEQ ID NO: 45151
  chr17:71375377-71375407
  hypo

SEQ ID NO: 65556 - DNA, 30 bp, Homo sapiens; identical to SEQ ID NO: 16229
  chr17:71391476-71391506
  hypo

SEQ ID NO: 65557 - DNA, 30 bp, Homo sapiens; identical to SEQ ID NO: 45153
  chr17:71417363-71417393
  hypo

SEQ ID NO: 65558 - DNA, 30 bp, Homo sapiens; identical to SEQ ID NO: 45154
  chr17:71427753-71427783
  hypo

SEQ ID NO: 65559 - DNA, 30 bp, Homo sapiens; identical to SEQ ID NO: 45155
  chr17:71484009-71484039
  hypo

SEQ ID NO: 65560 - DNA, 21 bp, Homo sapiens
  chr17:71879558-71879579
  hypo
ctccaaaatccgaaacgctcc

SEQ ID NO: 65561 - DNA, 30 bp, Homo sapiens; identical to SEQ ID NO: 45157
  chr17:72233647-72233677
  hypo

SEQ ID NO: 65562 - DNA, 119 bp, Homo sapiens; identical to SEQ ID NO: 45158
  chr17:72356210-72356329
  hypo

SEQ ID NO: 65563 - DNA, 30 bp, Homo sapiens; identical to SEQ ID NO: 16232
  chr17:72370768-72370798
  hypo

SEQ ID NO: 65564 - DNA, 30 bp, Homo sapiens; identical to SEQ ID NO: 45160
  chr17:72731669-72731699
  hypo

SEQ ID NO: 65565 - DNA, 30 bp, Homo sapiens; identical to SEQ ID NO: 45161
  chr17:72800435-72800465
  hypo

SEQ ID NO: 65566 - DNA, 30 bp, Homo sapiens; identical to SEQ ID NO: 45162
  chr17:72969610-72969640
  hypo

SEQ ID NO: 65567 - DNA, 16 bp, Homo sapiens
  chr17:73031621-73031637
  hypo
actccagtctctggcc

SEQ ID NO: 65568 - DNA, 26 bp, Homo sapiens
  chr17:73083437-73083463
  hypo
agcgagactcccggccaactgagtac

SEQ ID NO: 65569 - DNA, 257 bp, Homo sapiens; identical to SEQ ID NO: 45165
  chr17:73089693-73089950
  hypo

SEQ ID NO: 65570 - DNA, 105 bp, Homo sapiens; identical to SEQ ID NO: 45166
  chr17:73091075-73091180
  hypo

SEQ ID NO: 65571 - DNA, 30 bp, Homo sapiens; identical to SEQ ID NO: 45167
  chr17:73091437-73091467
  hypo

SEQ ID NO: 65572 - DNA, 30 bp, Homo sapiens; identical to SEQ ID NO: 45168
  chr17:73124882-73124912
  hypo

SEQ ID NO: 65573 - DNA, 17 bp, Homo sapiens
  chr17:73135904-73135921
  hypo
tccgtctcaaaaataaa

SEQ ID NO: 65574 - DNA, 41 bp, Homo sapiens; identical to SEQ ID NO: 45170
  chr17:73179823-73179864
  hypo

SEQ ID NO: 65575 - DNA, 60 bp, Homo sapiens
  chr17:73585955-73586015
  hypo
cccgactgcacccgacgggccttccctcgacgagagcggctccagcagtgaggcggagtt

SEQ ID NO: 65576 - DNA, 48 bp, Homo sapiens; identical to SEQ ID NO: 45172
  chr17:73592635-73592683
  hypo

SEQ ID NO: 65577 - DNA, 52 bp, Homo sapiens; identical to SEQ ID NO: 45173
  chr17:73606380-73606432
  hypo

SEQ ID NO: 65578 - DNA, 200 bp, Homo sapiens; identical to SEQ ID NO: 45175
  chr17:73615929-73616129
  hypo

SEQ ID NO: 65579 - DNA, 30 bp, Homo sapiens; identical to SEQ ID NO: 45176
  chr17:73635801-73635831
  hypo

SEQ ID NO: 65580 - DNA, 7 bp, Homo sapiens
  chr17:73636137-73636144
  hypo
gacaaac

SEQ ID NO: 65581 - DNA, 54 bp, Homo sapiens
  chr17:73636337-73636391
  hypo
caagctgcagagactgccccaggctgagcccgtggagatcgtggccttctcagt

SEQ ID NO: 65582 - DNA, 37 bp, Homo sapiens; identical to SEQ ID NO: 16241
  chr17:73638388-73638425
  hypo

SEQ ID NO: 65583 - DNA, 39 bp, Homo sapiens; identical to SEQ ID NO: 45179
  chr17:73693123-73693162
  hypo

SEQ ID NO: 65584 - DNA, 30 bp, Homo sapiens; identical to SEQ ID NO: 45180
  chr17:73931814-73931844
  hypo

SEQ ID NO: 65585 - DNA, 42 bp, Homo sapiens; identical to SEQ ID NO: 45181
  chr17:74005455-74005497
  hypo

SEQ ID NO: 65586 - DNA, 30 bp, Homo sapiens; identical to SEQ ID NO: 45182
  chr17:74028304-74028334
  hypo

SEQ ID NO: 65587 - DNA, 30 bp, Homo sapiens; identical to SEQ ID NO: 45183
  chr17:74062044-74062074
  hypo

SEQ ID NO: 65588 - DNA, 165 bp, Homo sapiens; identical to SEQ ID NO: 16242
  chr17:74128189-74128354
  hypo

SEQ ID NO: 65589 - DNA, 30 bp, Homo sapiens; identical to SEQ ID NO: 45185
  chr17:74362291-74362321
  hypo

SEQ ID NO: 65590 - DNA, 30 bp, Homo sapiens; identical to SEQ ID NO: 16243
  chr17:74908784-74908814
  hypo

SEQ ID NO: 65591 - DNA, 30 bp, Homo sapiens; identical to SEQ ID NO: 45187
  chr17:74920559-74920589
  hypo

SEQ ID NO: 65592 - DNA, 178 bp, Homo sapiens; identical to SEQ ID NO: 45188
  chr17:75049797-75049975
  hypo

SEQ ID NO: 65593 - DNA, 62 bp, Homo sapiens
  chr17:75523080-75523142
  hypo
agtttgagaagatggcggcctgaaccggagtccttcttcccctcctccctctccgctgctgc

SEQ ID NO: 65594 - DNA, 39 bp, Homo sapiens; identical to SEQ ID NO: 45191
  chr17:75544134-75544173
  hypo

SEQ ID NO: 65595 - DNA, 56 bp, Homo sapiens; identical to SEQ ID NO: 45192
  chr17:75630378-75630434
  hypo

SEQ ID NO: 65596 - DNA, 11 bp, Homo sapiens
  chr17:75733967-75733978
  hypo
acagagaataa

SEQ ID NO: 65597 - DNA, 33 bp, Homo sapiens; identical to SEQ ID NO: 45194
  chr17:75770731-75770764
  hypo

SEQ ID NO: 65598 - DNA, 30 bp, Homo sapiens; identical to SEQ ID NO: 45195
  chr17:75840791-75840821
  hypo

SEQ ID NO: 65599 - DNA, 43 bp, Homo sapiens; identical to SEQ ID NO: 45196
  chr17:75905178-75905221
  hypo

SEQ ID NO: 65600 - DNA, 79 bp, Homo sapiens; identical to SEQ ID NO: 45197
  chr17:76021242-76021321
  hypo

SEQ ID NO: 65601 - DNA, 41 bp, Homo sapiens; identical to SEQ ID NO: 45198
  chr17:76101087-76101128
  hypo

SEQ ID NO: 65602 - DNA, 92 bp, Homo sapiens; identical to SEQ ID NO: 45199
  chr17:76134317-76134409
  hypo

SEQ ID NO: 65603 - DNA, 82 bp, Homo sapiens; identical to SEQ ID NO: 45200
  chr17:76136106-76136188
  hypo

SEQ ID NO: 65604 - DNA, 53 bp, Homo sapiens; identical to SEQ ID NO: 25449
  chr17:76137898-76137951
  hypo

SEQ ID NO: 65605 - DNA, 38 bp, Homo sapiens; identical to SEQ ID NO: 45202
  chr17:76138696-76138734
  hypo

SEQ ID NO: 65606 - DNA, 19 bp, Homo sapiens
  chr17:76146895-76146914
  hypo
agcctacactccaaacggc

SEQ ID NO: 65607 - DNA, 33 bp, Homo sapiens; identical to SEQ ID NO: 45204
  chr17:76211252-76211285
  hypo

SEQ ID NO: 65608 - DNA, 93 bp, Homo sapiens; identical to SEQ ID NO: 45205
  chr17:76211525-76211618
  hypo

SEQ ID NO: 65609 - DNA, 18 bp, Homo sapiens
  chr17:76212036-76212054
  hypo
atccttacagtgggccgg

SEQ ID NO: 65610 - DNA, 30 bp, Homo sapiens; identical to SEQ ID NO: 45207
  chr17:76217104-76217134
  hypo

SEQ ID NO: 65611 - DNA, 125 bp, Homo sapiens; identical to SEQ ID NO: 45208
  chr17:76395588-76395713
  hypo

SEQ ID NO: 65612 - DNA, 44 bp, Homo sapiens; identical to SEQ ID NO: 45209
  chr17:76404759-76404803
  hypo

SEQ ID NO: 65613 - DNA, 30 bp, Homo sapiens; identical to SEQ ID NO: 16251
  chr17:76419409-76419439
  hypo

SEQ ID NO: 65614 - DNA, 53 bp, Homo sapiens; identical to SEQ ID NO: 45211
  chr17:76498919-76498972
  hypo

SEQ ID NO: 65615 - DNA, 99 bp, Homo sapiens; identical to SEQ ID NO: 45212
  chr17:76501675-76501774
  hypo

SEQ ID NO: 65616 - DNA, 30 bp, Homo sapiens; identical to SEQ ID NO: 45213
  chr17:76526202-76526232
  hypo

SEQ ID NO: 65617 - DNA, 66 bp, Homo sapiens; identical to SEQ ID NO: 45214
  chr17:76557445-76557511
  hypo

SEQ ID NO: 65618 - DNA, 78 bp, Homo sapiens; identical to SEQ ID NO: 45215
  chr17:76670740-76670818
  hypo

SEQ ID NO: 65619 - DNA, 112 bp, Homo sapiens; identical to SEQ ID NO: 45216
  chr17:76676225-76676337
  hypo

SEQ ID NO: 65620 - DNA, 80 bp, Homo sapiens; identical to SEQ ID NO: 45217
  chr17:76897106-76897186
  hypo

SEQ ID NO: 65621 - DNA, 33 bp, Homo sapiens; identical to SEQ ID NO: 45218
  chr17:76958740-76958773
  hypo

SEQ ID NO: 65622 - DNA, 183 bp, Homo sapiens
  chr17:76974264-76974447
  hypo
agggggcctggtggacggctgcaatggcatccccagagcttgtcggaaatgcagtcatggctggccttgccctagcccctctgcatgggagtctgcatgaacaagcgccctgggagctgggtgcactggctggtgagcagctttgctctgggactcgtgctcgctggcactgtgcagccaccc

SEQ ID NO: 65623 - DNA, 49 bp, Homo sapiens; identical to SEQ ID NO: 45220
  chr17:76991604-76991653
  hypo

SEQ ID NO: 65624 - DNA, 30 bp, Homo sapiens; identical to SEQ ID NO: 45221
  chr17:76997571-76997601
  hypo

SEQ ID NO: 65625 - DNA, 272 bp, Homo sapiens; identical to SEQ ID NO: 45222
  chr17:77002640-77002912
  hypo

SEQ ID NO: 65626 - DNA, 32 bp, Homo sapiens; identical to SEQ ID NO: 45223
  chr17:77003134-77003166
  hypo

SEQ ID NO: 65627 - DNA, 30 bp, Homo sapiens; identical to SEQ ID NO: 45224
  chr17:77104088-77104118
  hypo

SEQ ID NO: 65628 - DNA, 35 bp, Homo sapiens
  chr17:77105020-77105055
  hypo
cagctctgtcccctgcgttgaacagcgaggatgca

SEQ ID NO: 65629 - DNA, 30 bp, Homo sapiens; identical to SEQ ID NO: 45226
  chr17:77126850-77126880
  hypo

SEQ ID NO: 65630 - DNA, 30 bp, Homo sapiens; identical to SEQ ID NO: 16254
  chr17:77127147-77127177
  hypo

SEQ ID NO: 65631 - DNA, 72 bp, Homo sapiens; identical to SEQ ID NO: 45228
  chr17:77135878-77135950
  hypo

SEQ ID NO: 65632 - DNA, 206 bp, Homo sapiens; identical to SEQ ID NO: 45229
  chr17:77143891-77144097
  hypo

SEQ ID NO: 65633 - DNA, 41 bp, Homo sapiens
  chr17:77145242-77145283
  hypo
aaatgcgacgtctgtgctattattgccggggttacaccagg

SEQ ID NO: 65634 - DNA, 45 bp, Homo sapiens; identical to SEQ ID NO: 45231
  chr17:77147241-77147286
  hypo

SEQ ID NO: 65635 - DNA, 30 bp, Homo sapiens; identical to SEQ ID NO: 45232
  chr17:77174895-77174925
  hypo

SEQ ID NO: 65636 - DNA, 30 bp, Homo sapiens; identical to SEQ ID NO: 45233
  chr17:77365458-77365488
  hypo

SEQ ID NO: 65637 - DNA, 34 bp, Homo sapiens; identical to SEQ ID NO: 45234
  chr17:77390969-77391003
  hypo

SEQ ID NO: 65638 - DNA, 34 bp, Homo sapiens; identical to SEQ ID NO: 45235
  chr17:77807459-77807493
  hypo

SEQ ID NO: 65639 - DNA, 244 bp, Homo sapiens; identical to SEQ ID NO: 45236
  chr17:77807717-77807961
  hypo

SEQ ID NO: 65640 - DNA, 78 bp, Homo sapiens; identical to SEQ ID NO: 45237
  chr17:77808479-77808557
  hypo

SEQ ID NO: 65641 - DNA, 217 bp, Homo sapiens; identical to SEQ ID NO: 45238
  chr17:77825381-77825598
  hypo

SEQ ID NO: 65642 - DNA, 78 bp, Homo sapiens; identical to SEQ ID NO: 16257
  chr17:77926480-77926558
  hypo

SEQ ID NO: 65643 - DNA, 211 bp, Homo sapiens; identical to SEQ ID NO: 45240
  chr17:77948908-77949119
  hypo

SEQ ID NO: 65644 - DNA, 57 bp, Homo sapiens; identical to SEQ ID NO: 45241
  chr17:78078914-78078971
  hypo

SEQ ID NO: 65645 - DNA, 40 bp, Homo sapiens; identical to SEQ ID NO: 45242
  chr17:78083747-78083787
  hypo

SEQ ID NO: 65646 - DNA, 8 bp, Homo sapiens
  chr17:78122150-78122158
  hypo
gcacctgg

SEQ ID NO: 65647 - DNA, 63 bp, Homo sapiens; identical to SEQ ID NO: 25460
  chr17:78122190-78122253
  hypo

SEQ ID NO: 65648 - DNA, 60 bp, Homo sapiens; identical to SEQ ID NO: 45244
  chr17:78151768-78151828
  hypo

SEQ ID NO: 65649 - DNA, 30 bp, Homo sapiens; identical to SEQ ID NO: 45245
  chr17:78152480-78152510
  hypo

SEQ ID NO: 65650 - DNA, 45 bp, Homo sapiens; identical to SEQ ID NO: 45246
  chr17:78447074-78447119
  hypo

SEQ ID NO: 65651 - DNA, 92 bp, Homo sapiens; identical to SEQ ID NO: 25462
  chr17:78667900-78667992
  hypo

SEQ ID NO: 65652 - DNA, 30 bp, Homo sapiens; identical to SEQ ID NO: 45249
  chr17:78820077-78820107
  hypo

SEQ ID NO: 65653 - DNA, 76 bp, Homo sapiens; identical to SEQ ID NO: 45250
  chr17:78872638-78872714
  hypo

SEQ ID NO: 65654 - DNA, 101 bp, Homo sapiens; identical to SEQ ID NO: 45251
  chr17:78975561-78975662
  hypo

SEQ ID NO: 65655 - DNA, 30 bp, Homo sapiens; identical to SEQ ID NO: 45252
  chr17:79001034-79001064
  hypo

SEQ ID NO: 65656 - DNA, 30 bp, Homo sapiens; identical to SEQ ID NO: 45253
  chr17:79066768-79066798
  hypo

SEQ ID NO: 65657 - DNA, 215 bp, Homo sapiens
  chr17:79093967-79094182
  hypo
gccccgggcagaccccgggtggcggcggcccacctggtcaaagaggtagacggtgacgtcgtcgaagaaggacacggccttcttcttgcgttccaggtcctcgcagaaggtctcggacagcaggctgggcatcttgagcaggctgcgcaggttgcgcgcgctctggctctcagccaccaccacgggcaccgccggcgcctcctcttcgctgtcct

SEQ ID NO: 65658 - DNA, 236 bp, Homo sapiens
  chr17:79094245-79094481
  hypo
cctcctcctcctcctccggccggccctccaaggccgcagggaggccgggcagagccaggcggagtggggctctgggggtgcctgggccccccatccgcttttgtggggccggccctgacaacagtcctgggggcccctggaactcagagctgttgccttctgatctcagcggaaccggggtcagcaggaaaaactgggagcagctggggctgggcccaggccgcaccttggctggg

SEQ ID NO: 65659 - DNA, 46 bp, Homo sapiens; identical to SEQ ID NO: 45255
  chr17:79094742-79094788
  hypo

SEQ ID NO: 65660 - DNA, 35 bp, Homo sapiens; identical to SEQ ID NO: 16262
  chr17:79096981-79097016
  hypo

SEQ ID NO: 65661 - DNA, 48 bp, Homo sapiens; identical to SEQ ID NO: 45257
  chr17:79098155-79098203
  hypo

SEQ ID NO: 65662 - DNA, 9 bp, Homo sapiens
  chr17:79099761-79099770
  hypo
ggcgtctgg

SEQ ID NO: 65663 - DNA, 9 bp, Homo sapiens
  chr17:79099799-79099808
  hypo
ttcttccag

SEQ ID NO: 65664 - DNA, 75 bp, Homo sapiens; identical to SEQ ID NO: 45259
  chr17:79100184-79100259
  hypo

SEQ ID NO: 65665 - DNA, 120 bp, Homo sapiens; identical to SEQ ID NO: 45260
  chr17:79104885-79105005
  hypo

SEQ ID NO: 65666 - DNA, 30 bp, Homo sapiens; identical to SEQ ID NO: 16265
  chr17:79107633-79107663
  hypo

SEQ ID NO: 65667 - DNA, 149 bp, Homo sapiens; identical to SEQ ID NO: 45262
  chr17:79158112-79158261
  hypo

SEQ ID NO: 65668 - DNA, 125 bp, Homo sapiens; identical to SEQ ID NO: 45263
  chr17:79211706-79211831
  hypo

SEQ ID NO: 65669 - DNA, 30 bp, Homo sapiens; identical to SEQ ID NO: 45264
  chr17:79226304-79226334
  hypo

SEQ ID NO: 65670 - DNA, 17 bp, Homo sapiens
  chr17:79292579-79292596
  hypo
ggccgggcatggtggcg

SEQ ID NO: 65671 - DNA, 30 bp, Homo sapiens; identical to SEQ ID NO: 45266
  chr17:79505417-79505447
  hypo

SEQ ID NO: 65672 - DNA, 30 bp, Homo sapiens; identical to SEQ ID NO: 45267
  chr17:79544264-79544294
  hypo

SEQ ID NO: 65673 - DNA, 48 bp, Homo sapiens; identical to SEQ ID NO: 16267
  chr17:79609256-79609304
  hypo

SEQ ID NO: 65674 - DNA, 161 bp, Homo sapiens; identical to SEQ ID NO: 45269
  chr17:79619136-79619297
  hypo

SEQ ID NO: 65675 - DNA, 102 bp, Homo sapiens; identical to SEQ ID NO: 45270
  chr17:79626311-79626413
  hypo

SEQ ID NO: 65676 - DNA, 30 bp, Homo sapiens; identical to SEQ ID NO: 45271
  chr17:79643888-79643918
  hypo

SEQ ID NO: 65677 - DNA, 145 bp, Homo sapiens; identical to SEQ ID NO: 45272
  chr17:79668589-79668734
  hypo

SEQ ID NO: 65678 - DNA, 22 bp, Homo sapiens
  chr17:79695451-79695473
  hypo
gagccaccgcacctggccagct

SEQ ID NO: 65679 - DNA, 69 bp, Homo sapiens
  chr17:79769364-79769433
  hypo
gggctgctcaggacccgctacagccagaaaattggcgacgacctcagtgtcagcacctggctcagtgat

SEQ ID NO: 65680 - DNA, 30 bp, Homo sapiens; identical to SEQ ID NO: 16269
  chr17:79774960-79774990
  hypo

SEQ ID NO: 65681 - DNA, 30 bp, Homo sapiens; identical to SEQ ID NO: 16270
  chr17:79847763-79847793
  hypo

SEQ ID NO: 65682 - DNA, 86 bp, Homo sapiens; identical to SEQ ID NO: 45277
  chr17:79870436-79870522
  hypo

SEQ ID NO: 65683 - DNA, 173 bp, Homo sapiens; identical to SEQ ID NO: 16272
  chr17:79874854-79875027
  hypo

SEQ ID NO: 65684 - DNA, 195 bp, Homo sapiens; identical to SEQ ID NO: 45279
  chr17:79887606-79887801
  hypo

SEQ ID NO: 65685 - DNA, 23 bp, Homo sapiens
  chr17:79913143-79913166
  hypo
actgcgcccggcctacaagacct

SEQ ID NO: 65686 - DNA, 30 bp, Homo sapiens; identical to SEQ ID NO: 45281
  chr17:80163670-80163700
  hypo

SEQ ID NO: 65687 - DNA, 30 bp, Homo sapiens; identical to SEQ ID NO: 45282
  chr17:80201941-80201971
  hypo

SEQ ID NO: 65688 - DNA, 44 bp, Homo sapiens; identical to SEQ ID NO: 45283
  chr17:80229940-80229984
  hypo

SEQ ID NO: 65689 - DNA, 82 bp, Homo sapiens; identical to SEQ ID NO: 45284
  chr17:80251922-80252004
  hypo

SEQ ID NO: 65690 - DNA, 9 bp, Homo sapiens
  chr17:80254257-80254266
  hypo
ctgcgggac

SEQ ID NO: 65691 - DNA, 40 bp, Homo sapiens
  chr17:80254296-80254336
  hypo
cgttgacggacacttaggcgagttccgtaccttgattgca

SEQ ID NO: 65692 - DNA, 49 bp, Homo sapiens; identical to SEQ ID NO: 45286
  chr17:80281082-80281131
  hypo

SEQ ID NO: 65693 - DNA, 111 bp, Homo sapiens
  chr17:80289310-80289421
  hypo
caggcccctctcaggtcaccaggcacatctggtcacatctgagtctcagataaacaaccaatgatgtcctggtgaaagcttgtcccgtgggacactcgggacacacttata

SEQ ID NO: 65694 - DNA, 28 bp, Homo sapiens
  chr17:80294427-80294455
  hypo
ctgggattacaggcgtgagccactgtgc

SEQ ID NO: 65695 - DNA, 135 bp, Homo sapiens; identical to SEQ ID NO: 45289
  chr17:80300182-80300317
  hypo

SEQ ID NO: 65696 - DNA, 151 bp, Homo sapiens; identical to SEQ ID NO: 45290
  chr17:80338743-80338894
  hypo

SEQ ID NO: 65697 - DNA, 34 bp, Homo sapiens; identical to SEQ ID NO: 45291
  chr17:80448159-80448193
  hypo

SEQ ID NO: 65698 - DNA, 209 bp, Homo sapiens; identical to SEQ ID NO: 45293
  chr17:80518148-80518357
  hypo

SEQ ID NO: 65699 - DNA, 130 bp, Homo sapiens
  chr17:80655013-80655143
  hypo
atctcagctgctcccccaaactctgcccattcctcaccccgtcccctaagctgaggtgtggccgggcacctgagtcccaccccacgctccacagtctcaggccaccccctccagccgtgccacactccct

SEQ ID NO: 65700 - DNA, 16 bp, Homo sapiens
  chr17:80692834-80692850
  hypo
gcgccactgcactgca

SEQ ID NO: 65701 - DNA, 30 bp, Homo sapiens; identical to SEQ ID NO: 45296
  chr17:80747022-80747052
  hypo

SEQ ID NO: 65702 - DNA, 40 bp, Homo sapiens; identical to SEQ ID NO: 45297
  chr17:80772901-80772941
  hypo

SEQ ID NO: 65703 - DNA, 375 bp, Homo sapiens; identical to SEQ ID NO: 25479
  chr17:80798345-80798720
  hypo

SEQ ID NO: 65704 - DNA, 233 bp, Homo sapiens
  chr17:80832479-80832712
  hypo
gtcaggcttgtccaacgggttcttagagaacctgggccccatccctccttggcccacgcagactccaggcatccggccgggcgggctgtgagtcaggctgcaccaggtgagcgtgtgggatgctgctggtgcgagcctccctgcccaggagccctgcgcacccgggtatcggttggggtgtgcccttccagatctccctcccttggtttgtcataggtgaccacattttaatt

SEQ ID NO: 65705 - DNA, 30 bp, Homo sapiens; identical to SEQ ID NO: 45300
  chr17:80882906-80882936
  hypo

SEQ ID NO: 65706 - DNA, 50 bp, Homo sapiens; identical to SEQ ID NO: 45301
  chr17:80972320-80972370
  hypo

SEQ ID NO: 65707 - DNA, 59 bp, Homo sapiens
  chr17:81008826-81008885
  hypo
tgggcaagtgtgccgggaatgtgtgacggcagacgtgtggggtgcgaggttgtgtgggg

SEQ ID NO: 65708 - DNA, 166 bp, Homo sapiens; identical to SEQ ID NO: 45303
  chr17:81015300-81015466
  hypo

SEQ ID NO: 65709 - DNA, 30 bp, Homo sapiens; identical to SEQ ID NO: 45304
  chr17:81015900-81015930
  hypo

SEQ ID NO: 65710 - DNA, 30 bp, Homo sapiens; identical to SEQ ID NO: 45305
  chr17:81021226-81021256
  hypo

SEQ ID NO: 65711 - DNA, 30 bp, Homo sapiens; identical to SEQ ID NO: 45306
  chr17:81024242-81024272
  hypo

SEQ ID NO: 65712 - DNA, 98 bp, Homo sapiens; identical to SEQ ID NO: 45308
  chr17:81043026-81043124
  hypo

SEQ ID NO: 65713 - DNA, 32 bp, Homo sapiens; identical to SEQ ID NO: 45309
  chr17:81047925-81047957
  hypo

SEQ ID NO: 65714 - DNA, 58 bp, Homo sapiens; identical to SEQ ID NO: 16285
  chr17:81048783-81048841
  hypo

SEQ ID NO: 65715 - DNA, 147 bp, Homo sapiens; identical to SEQ ID NO: 45311
  chr17:81050193-81050340
  hypo

SEQ ID NO: 65716 - DNA, 48 bp, Homo sapiens; identical to SEQ ID NO: 45312
  chr17:81050936-81050984
  hypo

SEQ ID NO: 65717 - DNA, 69 bp, Homo sapiens; identical to SEQ ID NO: 45313
  chr17:81062099-81062168
  hypo

SEQ ID NO: 65718 - DNA, 55 bp, Homo sapiens; identical to SEQ ID NO: 45314
  chr17:81065766-81065821
  hypo

SEQ ID NO: 65719 - DNA, 30 bp, Homo sapiens; identical to SEQ ID NO: 45315
  chr17:81068659-81068689
  hypo

SEQ ID NO: 65720 - DNA, 82 bp, Homo sapiens; identical to SEQ ID NO: 45316
  chr17:81076347-81076429
  hypo

SEQ ID NO: 65721 - DNA, 23 bp, Homo sapiens
  chr17:81081890-81081913
  hypo
gggcgacgctcagggcggccgtg

SEQ ID NO: 65722 - DNA, 38 bp, Homo sapiens; identical to SEQ ID NO: 45318
  chr17:81087525-81087563
  hypo

SEQ ID NO: 65723 - DNA, 78 bp, Homo sapiens; identical to SEQ ID NO: 45319
  chr18:597381-597459
  hypo

SEQ ID NO: 65724 - DNA, 19 bp, Homo sapiens
  chr18:1522199-1522218
  hypo
agaccggagctgttcctat

SEQ ID NO: 65725 - DNA, 122 bp, Homo sapiens; identical to SEQ ID NO: 45322
  chr18:3616285-3616407
  hypo

SEQ ID NO: 65726 - DNA, 86 bp, Homo sapiens; identical to SEQ ID NO: 45323
  chr18:3930506-3930592
  hypo

SEQ ID NO: 65727 - DNA, 25 bp, Homo sapiens
  chr18:5133182-5133207
  hypo
cagctccaccaccaccgaccacgat

SEQ ID NO: 65728 - DNA, 30 bp, Homo sapiens; identical to SEQ ID NO: 45325
  chr18:6929750-6929780
  hypo

SEQ ID NO: 65729 - DNA, 97 bp, Homo sapiens; identical to SEQ ID NO: 45326
  chr18:8570976-8571073
  hypo

SEQ ID NO: 65730 - DNA, 40 bp, Homo sapiens; identical to SEQ ID NO: 16294
  chr18:8845133-8845173
  hypo

SEQ ID NO: 65731 - DNA, 30 bp, Homo sapiens; identical to SEQ ID NO: 45329
  chr18:9333406-9333436
  hypo

SEQ ID NO: 65732 - DNA, 143 bp, Homo sapiens; identical to SEQ ID NO: 45330
  chr18:9364378-9364521
  hypo

SEQ ID NO: 65733 - DNA, 30 bp, Homo sapiens; identical to SEQ ID NO: 45331
  chr18:9547786-9547816
  hypo

SEQ ID NO: 65734 - DNA, 30 bp, Homo sapiens; identical to SEQ ID NO: 45332
  chr18:9737972-9738002
  hypo

SEQ ID NO: 65735 - DNA, 76 bp, Homo sapiens; identical to SEQ ID NO: 45333
  chr18:9797320-9797396
  hypo

SEQ ID NO: 65736 - DNA, 50 bp, Homo sapiens
  chr18:10589046-10589096
  hypo
gtttctcgtgtgctccgggagtgtgagccccagcttctgctttcactgaa

SEQ ID NO: 65737 - DNA, 232 bp, Homo sapiens
  chr18:10589348-10589580
  hypo
gaaggcaccgccgccgcccgccgcgggaggcttccgcggagactcagggctgcagagccagcggaggctgaaggaagagaaaggtaattttcctactcgcatatattaatttcagtaaacagataaaacaattagtaaatcaaacatataaaacagaatttttaaagaaaataatctcccaaaatatataaaagtagaatagttaaaaaaacagaaccgaatattttaatgt

SEQ ID NO: 65738 - DNA, 30 bp, Homo sapiens; identical to SEQ ID NO: 45335
  chr18:10664802-10664832
  hypo

SEQ ID NO: 65739 - DNA, 36 bp, Homo sapiens; identical to SEQ ID NO: 45336
  chr18:10696324-10696360
  hypo

SEQ ID NO: 65740 - DNA, 30 bp, Homo sapiens; identical to SEQ ID NO: 45337
  chr18:10832633-10832663
  hypo

SEQ ID NO: 65741 - DNA, 25 bp, Homo sapiens
  chr18:10906877-10906902
  hypo
tgtcttttgtcgccttcctgagccc

SEQ ID NO: 65742 - DNA, 86 bp, Homo sapiens; identical to SEQ ID NO: 45339
  chr18:11009583-11009669
  hypo

SEQ ID NO: 65743 - DNA, 17 bp, Homo sapiens
  chr18:11014809-11014826
  hypo
tccggggccccctcatt

SEQ ID NO: 65744 - DNA, 30 bp, Homo sapiens; identical to SEQ ID NO: 45341
  chr18:11533320-11533350
  hypo

SEQ ID NO: 65745 - DNA, 30 bp, Homo sapiens; identical to SEQ ID NO: 16298
  chr18:11979044-11979074
  hypo

SEQ ID NO: 65746 - DNA, 15 bp, Homo sapiens
  chr18:11979861-11979876
  hypo
cggcctctgtcttaa

SEQ ID NO: 65747 - DNA, 30 bp, Homo sapiens; identical to SEQ ID NO: 45344
  chr18:11989410-11989440
  hypo

SEQ ID NO: 65748 - DNA, 30 bp, Homo sapiens; identical to SEQ ID NO: 45345
  chr18:12076093-12076123
  hypo

SEQ ID NO: 65749 - DNA, 120 bp, Homo sapiens; identical to SEQ ID NO: 45346
  chr18:12375353-12375473
  hypo

SEQ ID NO: 65750 - DNA, 32 bp, Homo sapiens
  chr18:12376129-12376161
  hypo
tccccttacagtgaagacgttgagctgactac

SEQ ID NO: 65751 - DNA, 30 bp, Homo sapiens; identical to SEQ ID NO: 16300
  chr18:12701811-12701841
  hypo

SEQ ID NO: 65752 - DNA, 26 bp, Homo sapiens
  chr18:12949149-12949175
  hypo
gccaccgcgcccggcctacaagcaga

SEQ ID NO: 65753 - DNA, 88 bp, Homo sapiens; identical to SEQ ID NO: 45350
  chr18:13231230-13231318
  hypo

SEQ ID NO: 65754 - DNA, 30 bp, Homo sapiens; identical to SEQ ID NO: 45351
  chr18:13295972-13296002
  hypo

SEQ ID NO: 65755 - DNA, 61 bp, Homo sapiens; identical to SEQ ID NO: 45352
  chr18:13319261-13319322
  hypo

SEQ ID NO: 65756 - DNA, 30 bp, Homo sapiens; identical to SEQ ID NO: 45353
  chr18:13430352-13430382
  hypo

SEQ ID NO: 65757 - DNA, 30 bp, Homo sapiens; identical to SEQ ID NO: 45354
  chr18:13452326-13452356
  hypo

SEQ ID NO: 65758 - DNA, 111 bp, Homo sapiens; identical to SEQ ID NO: 45355
  chr18:13452723-13452834
  hypo

SEQ ID NO: 65759 - DNA, 283 bp, Homo sapiens; identical to SEQ ID NO: 45356
  chr18:13461100-13461383
  hypo

SEQ ID NO: 65760 - DNA, 32 bp, Homo sapiens; identical to SEQ ID NO: 45357
  chr18:13486501-13486533
  hypo

SEQ ID NO: 65761 - DNA, 30 bp, Homo sapiens; identical to SEQ ID NO: 45358
  chr18:13486818-13486848
  hypo

SEQ ID NO: 65762 - DNA, 85 bp, Homo sapiens; identical to SEQ ID NO: 45359
  chr18:13583740-13583825
  hypo

SEQ ID NO: 65763 - DNA, 30 bp, Homo sapiens; identical to SEQ ID NO: 45360
  chr18:13603756-13603786
  hypo

SEQ ID NO: 65764 - DNA, 67 bp, Homo sapiens; identical to SEQ ID NO: 45361
  chr18:13621659-13621726
  hypo

SEQ ID NO: 65765 - DNA, 237 bp, Homo sapiens; identical to SEQ ID NO: 45362
  chr18:13621998-13622235
  hypo

SEQ ID NO: 65766 - DNA, 60 bp, Homo sapiens
  chr18:13826333-13826393
  hypo
catctccatgttcttcgctatgctgttcctcctggtgtctctgtacatacacatgttcct

SEQ ID NO: 65767 - DNA, 180 bp, Homo sapiens; identical to SEQ ID NO: 45364
  chr18:13836794-13836974
  hypo

SEQ ID NO: 65768 - DNA, 59 bp, Homo sapiens; identical to SEQ ID NO: 16304
  chr18:13940522-13940581
  hypo

SEQ ID NO: 65769 - DNA, 30 bp, Homo sapiens; identical to SEQ ID NO: 45366
  chr18:19243727-19243757
  hypo

SEQ ID NO: 65770 - DNA, 197 bp, Homo sapiens
  chr18:20911344-20911541
  hypo
gtgaaacctgccccccgccaccacctgtagtacaggagacaccacaaagcaagaggccccagggctctgctcgggaagctgccgggcctgtttttcctcccagtggccaacaaacaggagggcaggttcagcacgttgggctctgctttctgagcgccgcaccattacagcatccacatccgatttttaaaactgaa

SEQ ID NO: 65771 - DNA, 25 bp, Homo sapiens
  chr18:21168944-21168969
  hypo
gctcccagcccgcttttcttttcgg

SEQ ID NO: 65772 - DNA, 40 bp, Homo sapiens; identical to SEQ ID NO: 45369
  chr18:23841433-23841473
  hypo

SEQ ID NO: 65773 - DNA, 30 bp, Homo sapiens; identical to SEQ ID NO: 45370
  chr18:24465773-24465803
  hypo

SEQ ID NO: 65774 - DNA, 36 bp, Homo sapiens; identical to SEQ ID NO: 45371
  chr18:25089977-25090013
  hypo

SEQ ID NO: 65775 - DNA, 30 bp, Homo sapiens; identical to SEQ ID NO: 45372
  chr18:43254053-43254083
  hypo

SEQ ID NO: 65776 - DNA, 45 bp, Homo sapiens; identical to SEQ ID NO: 45373
  chr18:44140380-44140425
  hypo

SEQ ID NO: 65777 - DNA, 81 bp, Homo sapiens; identical to SEQ ID NO: 45374
  chr18:47344091-47344172
  hypo

SEQ ID NO: 65778 - DNA, 145 bp, Homo sapiens; identical to SEQ ID NO: 45375
  chr18:48493743-48493888
  hypo

SEQ ID NO: 65779 - DNA, 44 bp, Homo sapiens; identical to SEQ ID NO: 45376
  chr18:52627111-52627155
  hypo

SEQ ID NO: 65780 - DNA, 103 bp, Homo sapiens; identical to SEQ ID NO: 45377
  chr18:52961793-52961896
  hypo

SEQ ID NO: 65781 - DNA, 180 bp, Homo sapiens; identical to SEQ ID NO: 45378
  chr18:53074296-53074476
  hypo

SEQ ID NO: 65782 - DNA, 181 bp, Homo sapiens; identical to SEQ ID NO: 16306
  chr18:53968903-53969084
  hypo

SEQ ID NO: 65783 - DNA, 47 bp, Homo sapiens; identical to SEQ ID NO: 45380
  chr18:54483265-54483312
  hypo

SEQ ID NO: 65784 - DNA, 30 bp, Homo sapiens; identical to SEQ ID NO: 45382
  chr18:56483562-56483592
  hypo

SEQ ID NO: 65785 - DNA, 23 bp, Homo sapiens
  chr18:56816117-56816140
  hypo
attacaggcgtgagccactgtgc

SEQ ID NO: 65786 - DNA, 170 bp, Homo sapiens; identical to SEQ ID NO: 45385
  chr18:57652629-57652799
  hypo

SEQ ID NO: 65787 - DNA, 30 bp, Homo sapiens; identical to SEQ ID NO: 45386
  chr18:59137607-59137637
  hypo

SEQ ID NO: 65788 - DNA, 30 bp, Homo sapiens; identical to SEQ ID NO: 45387
  chr18:60056441-60056471
  hypo

SEQ ID NO: 65789 - DNA, 30 bp, Homo sapiens; identical to SEQ ID NO: 45388
  chr18:60557827-60557857
  hypo

SEQ ID NO: 65790 - DNA, 27 bp, Homo sapiens
  chr18:60759984-60760011
  hypo
acagctgccccccatcgctcacatgac

SEQ ID NO: 65791 - DNA, 31 bp, Homo sapiens; identical to SEQ ID NO: 45390
  chr18:62165289-62165320
  hypo

SEQ ID NO: 65792 - DNA, 35 bp, Homo sapiens; identical to SEQ ID NO: 45391
  chr18:68051409-68051444
  hypo

SEQ ID NO: 65793 - DNA, 19 bp, Homo sapiens
  chr18:68699219-68699238
  hypo
ccaccggccgctcccagtg

SEQ ID NO: 65794 - DNA, 17 bp, Homo sapiens
  chr18:72263664-72263681
  hypo
atgatttttttgagacg

SEQ ID NO: 65795 - DNA, 17 bp, Homo sapiens
  chr18:72263921-72263938
  hypo
ggcgtaagccaccccgc

SEQ ID NO: 65796 - DNA, 30 bp, Homo sapiens; identical to SEQ ID NO: 45395
  chr18:72347499-72347529
  hypo

SEQ ID NO: 65797 - DNA, 45 bp, Homo sapiens; identical to SEQ ID NO: 45396
  chr18:72896219-72896264
  hypo

SEQ ID NO: 65798 - DNA, 41 bp, Homo sapiens; identical to SEQ ID NO: 45397
  chr18:74062274-74062315
  hypo

SEQ ID NO: 65799 - DNA, 88 bp, Homo sapiens; identical to SEQ ID NO: 45398
  chr18:74107215-74107303
  hypo

SEQ ID NO: 65800 - DNA, 38 bp, Homo sapiens; identical to SEQ ID NO: 45399
  chr18:74113912-74113950
  hypo

SEQ ID NO: 65801 - DNA, 158 bp, Homo sapiens; identical to SEQ ID NO: 45400
  chr18:74114010-74114168
  hypo

SEQ ID NO: 65802 - DNA, 37 bp, Homo sapiens; identical to SEQ ID NO: 45401
  chr18:74396499-74396536
  hypo

SEQ ID NO: 65803 - DNA, 30 bp, Homo sapiens; identical to SEQ ID NO: 45402
  chr18:74497491-74497521
  hypo

SEQ ID NO: 65804 - DNA, 76 bp, Homo sapiens; identical to SEQ ID NO: 45403
  chr18:74501216-74501292
  hypo

SEQ ID NO: 65805 - DNA, 30 bp, Homo sapiens; identical to SEQ ID NO: 45404
  chr18:74504480-74504510
  hypo

SEQ ID NO: 65806 - DNA, 30 bp, Homo sapiens; identical to SEQ ID NO: 45405
  chr18:74695927-74695957
  hypo

SEQ ID NO: 65807 - DNA, 30 bp, Homo sapiens; identical to SEQ ID NO: 45406
  chr18:74755472-74755502
  hypo

SEQ ID NO: 65808 - DNA, 32 bp, Homo sapiens; identical to SEQ ID NO: 45407
  chr18:74877184-74877216
  hypo

SEQ ID NO: 65809 - DNA, 143 bp, Homo sapiens; identical to SEQ ID NO: 16311
  chr18:75229713-75229856
  hypo

SEQ ID NO: 65810 - DNA, 176 bp, Homo sapiens; identical to SEQ ID NO: 45409
  chr18:75230687-75230863
  hypo

SEQ ID NO: 65811 - DNA, 46 bp, Homo sapiens; identical to SEQ ID NO: 45410
  chr18:75617810-75617856
  hypo

SEQ ID NO: 65812 - DNA, 30 bp, Homo sapiens; identical to SEQ ID NO: 45411
  chr18:75631688-75631718
  hypo

SEQ ID NO: 65813 - DNA, 395 bp, Homo sapiens; identical to SEQ ID NO: 45412
  chr18:75998625-75999020
  hypo

SEQ ID NO: 65814 - DNA, 93 bp, Homo sapiens; identical to SEQ ID NO: 45413
  chr18:76073259-76073352
  hypo

SEQ ID NO: 65815 - DNA, 174 bp, Homo sapiens; identical to SEQ ID NO: 45414
  chr18:76123720-76123894
  hypo

SEQ ID NO: 65816 - DNA, 172 bp, Homo sapiens; identical to SEQ ID NO: 45415
  chr18:76161408-76161580
  hypo

SEQ ID NO: 65817 - DNA, 49 bp, Homo sapiens; identical to SEQ ID NO: 45416
  chr18:76189823-76189872
  hypo

SEQ ID NO: 65818 - DNA, 66 bp, Homo sapiens
  chr18:76239475-76239541
  hypo
gggttaaccagagtccggagtcagagaaataatttggtgtttcagggtcgcctgctgcagggcaat

SEQ ID NO: 65819 - DNA, 43 bp, Homo sapiens; identical to SEQ ID NO: 45418
  chr18:76412736-76412779
  hypo

SEQ ID NO: 65820 - DNA, 94 bp, Homo sapiens; identical to SEQ ID NO: 45419
  chr18:76415372-76415466
  hypo

SEQ ID NO: 65821 - DNA, 158 bp, Homo sapiens; identical to SEQ ID NO: 45420
  chr18:76477472-76477630
  hypo

SEQ ID NO: 65822 - DNA, 74 bp, Homo sapiens; identical to SEQ ID NO: 45421
  chr18:76486799-76486873
  hypo

SEQ ID NO: 65823 - DNA, 20 bp, Homo sapiens
  chr18:76501459-76501479
  hypo
agagctcaggaagtgcggct

SEQ ID NO: 65824 - DNA, 165 bp, Homo sapiens
  chr18:76501509-76501674
  hypo
ccgctgttctcaactcaccgaatgacagtaaaatcaaagccttgtatcatattcagaagattcagcgccaagactcagcatgtggcggtgtcttctttaggacgcagcagtgcgatggagaaggtagagggtaactctggcagggtgcatcggtaaccagcaaga

SEQ ID NO: 65825 - DNA, 36 bp, Homo sapiens; identical to SEQ ID NO: 45423
  chr18:76540366-76540402
  hypo

SEQ ID NO: 65826 - DNA, 36 bp, Homo sapiens; identical to SEQ ID NO: 45424
  chr18:76541554-76541590
  hypo

SEQ ID NO: 65827 - DNA, 33 bp, Homo sapiens; identical to SEQ ID NO: 45425
  chr18:76564667-76564700
  hypo

SEQ ID NO: 65828 - DNA, 16 bp, Homo sapiens
  chr18:76571588-76571604
  hypo
ccgctcatctcctgct

SEQ ID NO: 65829 - DNA, 159 bp, Homo sapiens; identical to SEQ ID NO: 45427
  chr18:76626246-76626405
  hypo

SEQ ID NO: 65830 - DNA, 30 bp, Homo sapiens; identical to SEQ ID NO: 16321
  chr18:76686197-76686227
  hypo

SEQ ID NO: 65831 - DNA, 68 bp, Homo sapiens
  chr18:77167756-77167824
  hypo
tattgacattactgttctctctccggtgcaggagactgcgtggctcccgtcctcttgagggcatttct

SEQ ID NO: 65832 - DNA, 53 bp, Homo sapiens; identical to SEQ ID NO: 45430
  chr18:77176557-77176610
  hypo

SEQ ID NO: 65833 - DNA, 86 bp, Homo sapiens
  chr18:77181269-77181355
  hypo
actgttcccagaactcgagggttccctgacaccaagatgacatgtggcacagacctggaatcacgaggaaatgcccgtcctcctcc

SEQ ID NO: 65834 - DNA, 17 bp, Homo sapiens
  chr18:77181409-77181426
  hypo
agcgcctggatgacgtc

SEQ ID NO: 65835 - DNA, 30 bp, Homo sapiens; identical to SEQ ID NO: 45432
  chr18:77181779-77181809
  hypo

SEQ ID NO: 65836 - DNA, 290 bp, Homo sapiens; identical to SEQ ID NO: 45434
  chr18:77201979-77202269
  hypo

SEQ ID NO: 65837 - DNA, 40 bp, Homo sapiens; identical to SEQ ID NO: 45435
  chr18:77203641-77203681
  hypo

SEQ ID NO: 65838 - DNA, 167 bp, Homo sapiens; identical to SEQ ID NO: 45436
  chr18:77209978-77210145
  hypo

SEQ ID NO: 65839 - DNA, 63 bp, Homo sapiens; identical to SEQ ID NO: 45437
  chr18:77229435-77229498
  hypo

SEQ ID NO: 65840 - DNA, 30 bp, Homo sapiens; identical to SEQ ID NO: 45438
  chr18:77230030-77230060
  hypo

SEQ ID NO: 65841 - DNA, 59 bp, Homo sapiens; identical to SEQ ID NO: 45439
  chr18:77236179-77236238
  hypo

SEQ ID NO: 65842 - DNA, 135 bp, Homo sapiens; identical to SEQ ID NO: 45440
  chr18:77236516-77236651
  hypo

SEQ ID NO: 65843 - DNA, 91 bp, Homo sapiens; identical to SEQ ID NO: 45441
  chr18:77246511-77246602
  hypo

SEQ ID NO: 65844 - DNA, 38 bp, Homo sapiens; identical to SEQ ID NO: 45442
  chr18:77247301-77247339
  hypo

SEQ ID NO: 65845 - DNA, 38 bp, Homo sapiens; identical to SEQ ID NO: 45443
  chr18:77271051-77271089
  hypo

SEQ ID NO: 65846 - DNA, 78 bp, Homo sapiens; identical to SEQ ID NO: 45444
  chr18:77272049-77272127
  hypo

SEQ ID NO: 65847 - DNA, 39 bp, Homo sapiens; identical to SEQ ID NO: 45445
  chr18:77272999-77273038
  hypo

SEQ ID NO: 65848 - DNA, 27 bp, Homo sapiens
  chr18:77285870-77285897
  hypo
gcaaggctgaaccagcgcagtgggaaa

SEQ ID NO: 65849 - DNA, 86 bp, Homo sapiens
  chr18:77286028-77286114
  hypo
agcctagggcatttgggtggggacgtgcgacccccacacagaacagagccgtctttctctctgcgttgtgccgaggccccgcagcg

SEQ ID NO: 65850 - DNA, 55 bp, Homo sapiens; identical to SEQ ID NO: 45447
  chr18:77288237-77288292
  hypo

SEQ ID NO: 65851 - DNA, 30 bp, Homo sapiens; identical to SEQ ID NO: 45448
  chr18:77290969-77290999
  hypo

SEQ ID NO: 65852 - DNA, 48 bp, Homo sapiens; identical to SEQ ID NO: 45449
  chr18:77308327-77308375
  hypo

SEQ ID NO: 65853 - DNA, 84 bp, Homo sapiens; identical to SEQ ID NO: 45450
  chr18:77313917-77314001
  hypo

SEQ ID NO: 65854 - DNA, 188 bp, Homo sapiens; identical to SEQ ID NO: 45451
  chr18:77320324-77320512
  hypo

SEQ ID NO: 65855 - DNA, 100 bp, Homo sapiens; identical to SEQ ID NO: 45453
  chr18:77357908-77358008
  hypo

SEQ ID NO: 65856 - DNA, 261 bp, Homo sapiens; identical to SEQ ID NO: 45454
  chr18:77364366-77364627
  hypo

SEQ ID NO: 65857 - DNA, 77 bp, Homo sapiens; identical to SEQ ID NO: 45455
  chr18:77365747-77365824
  hypo

SEQ ID NO: 65858 - DNA, 30 bp, Homo sapiens; identical to SEQ ID NO: 16334
  chr18:77410108-77410138
  hypo

SEQ ID NO: 65859 - DNA, 80 bp, Homo sapiens; identical to SEQ ID NO: 45457
  chr18:77509599-77509679
  hypo

SEQ ID NO: 65860 - DNA, 69 bp, Homo sapiens; identical to SEQ ID NO: 45458
  chr18:77533378-77533447
  hypo

SEQ ID NO: 65861 - DNA, 30 bp, Homo sapiens; identical to SEQ ID NO: 45459
  chr18:77534970-77535000
  hypo

SEQ ID NO: 65862 - DNA, 46 bp, Homo sapiens; identical to SEQ ID NO: 45460
  chr18:77542905-77542951
  hypo

SEQ ID NO: 65863 - DNA, 19 bp, Homo sapiens
  chr18:77543230-77543249
  hypo
catccccgtgagctccgcc

SEQ ID NO: 65864 - DNA, 80 bp, Homo sapiens; identical to SEQ ID NO: 45463
  chr18:77544682-77544762
  hypo

SEQ ID NO: 65865 - DNA, 110 bp, Homo sapiens
  chr18:77550096-77550206
  hypo
gttcaccctgggccccggagactagtgatcccgctccccagcagagcaccgccaaaagccccgggtgccggagctgtcctgcaagaatgaacgggcaggagacacaagag

SEQ ID NO: 65866 - DNA, 63 bp, Homo sapiens
  chr18:77550367-77550430
  hypo
tgtttaaaagatgagcacacaaaggactgtgcacctgccgcggagtggcgtcctctgggagaa

SEQ ID NO: 65867 - DNA, 147 bp, Homo sapiens
  chr18:77577043-77577190
  hypo
gatgttacacggctgtcatacagctgtcacacggctgccactcacatgcctgtcacgtttgtcacacggctgccacatggctgtcacgcagctgccacatggatgttacacggctgtcatacagctgtcacacggctgccactcaca

SEQ ID NO: 65868 - DNA, 30 bp, Homo sapiens; identical to SEQ ID NO: 45466
  chr18:77609629-77609659
  hypo

SEQ ID NO: 65869 - DNA, 40 bp, Homo sapiens; identical to SEQ ID NO: 45467
  chr18:77612204-77612244
  hypo

SEQ ID NO: 65870 - DNA, 30 bp, Homo sapiens; identical to SEQ ID NO: 45468
  chr18:77622551-77622581
  hypo

SEQ ID NO: 65871 - DNA, 30 bp, Homo sapiens; identical to SEQ ID NO: 45469
  chr18:77627798-77627828
  hypo

SEQ ID NO: 65872 - DNA, 49 bp, Homo sapiens; identical to SEQ ID NO: 45470
  chr18:77628385-77628434
  hypo

SEQ ID NO: 65873 - DNA, 30 bp, Homo sapiens; identical to SEQ ID NO: 45471
  chr18:77628965-77628995
  hypo

SEQ ID NO: 65874 - DNA, 71 bp, Homo sapiens; identical to SEQ ID NO: 45472
  chr18:77631844-77631915
  hypo

SEQ ID NO: 65875 - DNA, 40 bp, Homo sapiens; identical to SEQ ID NO: 45473
  chr18:77636150-77636190
  hypo

SEQ ID NO: 65876 - DNA, 178 bp, Homo sapiens
  chr18:77636621-77636799
  hypo
cctgtgtctgtgacgctggtgccctgagggcagggccagccccctctctcggcacagctgggtgaatcatcaacgacacccttggcaccgtgagcacttgcacctgcagaccgcctggtctcgctcttgggcaccagccgtgccaggcccgggccaccaactccgtgtccttcttgca

SEQ ID NO: 65877 - DNA, 36 bp, Homo sapiens; identical to SEQ ID NO: 45475
  chr18:77644664-77644700
  hypo

SEQ ID NO: 65878 - DNA, 30 bp, Homo sapiens; identical to SEQ ID NO: 45476
  chr18:77713124-77713154
  hypo

SEQ ID NO: 65879 - DNA, 115 bp, Homo sapiens; identical to SEQ ID NO: 45477
  chr19:292109-292224
  hypo

SEQ ID NO: 65880 - DNA, 26 bp, Homo sapiens
  chr19:349162-349188
  hypo
ataaagcaccacggatgaggtagttt

SEQ ID NO: 65881 - DNA, 118 bp, Homo sapiens; identical to SEQ ID NO: 45479
  chr19:400972-401090
  hypo

SEQ ID NO: 65882 - DNA, 30 bp, Homo sapiens; identical to SEQ ID NO: 45480
  chr19:401481-401511
  hypo

SEQ ID NO: 65883 - DNA, 171 bp, Homo sapiens; identical to SEQ ID NO: 25536
  chr19:403367-403538
  hypo

SEQ ID NO: 65884 - DNA, 65 bp, Homo sapiens
  chr19:407124-407189
  hypo
gcagctccttctccccgagcagcgtgtcccgcttgaggctgctgcccttgttcaccaccttgatc

SEQ ID NO: 65885 - DNA, 350 bp, Homo sapiens
  chr19:407320-407670
  hypo
gcccacgcagcagttgatgctgcgggcgtcgcacaggcggtcgtagaggccctcggcggccagcaggtgcacccgcaggcgggcctggccggcctcgtactcggccagcagccgcacgctgccccgagggcccacgtggaccgtgtgctccccacgcgcctggcccgactcggggccaggttccgggggtgcccggcgggtcaggcggcgccggctcccggggctggcgtccggggtgctgtcgtccgcagacagggagccgtggcggcccacggagtgccggagctggctcaccttggcctggctgtcctgggcgaaacctttgagcagagacacggagcgggacagca

SEQ ID NO: 65886 - DNA, 30 bp, Homo sapiens; identical to SEQ ID NO: 45483
  chr19:413211-413241
  hypo

SEQ ID NO: 65887 - DNA, 119 bp, Homo sapiens; identical to SEQ ID NO: 45484
  chr19:426860-426979
  hypo

SEQ ID NO: 65888 - DNA, 38 bp, Homo sapiens
  chr19:468719-468757
  hypo
cacggccccacagaccgtctgtgcacacatgctgtaca

SEQ ID NO: 65889 - DNA, 272 bp, Homo sapiens; identical to SEQ ID NO: 45486
  chr19:470863-471135
  hypo

SEQ ID NO: 65890 - DNA, 216 bp, Homo sapiens; identical to SEQ ID NO: 45488
  chr19:491311-491527
  hypo

SEQ ID NO: 65891 - DNA, 30 bp, Homo sapiens; identical to SEQ ID NO: 45489
  chr19:499792-499822
  hypo

SEQ ID NO: 65892 - DNA, 41 bp, Homo sapiens; identical to SEQ ID NO: 45490
  chr19:508329-508370
  hypo

SEQ ID NO: 65893 - DNA, 176 bp, Homo sapiens; identical to SEQ ID NO: 45491
  chr19:524057-524233
  hypo

SEQ ID NO: 65894 - DNA, 224 bp, Homo sapiens; identical to SEQ ID NO: 45492
  chr19:530256-530480
  hypo

SEQ ID NO: 65895 - DNA, 206 bp, Homo sapiens; identical to SEQ ID NO: 45493
  chr19:548497-548703
  hypo

SEQ ID NO: 65896 - DNA, 47 bp, Homo sapiens
  chr19:549314-549361
  hypo
cactggcaggggtcccgtttctcaggtgcagaaactgaggctcagac

SEQ ID NO: 65897 - DNA, 229 bp, Homo sapiens; identical to SEQ ID NO: 25542
  chr19:549451-549680
  hypo

SEQ ID NO: 65898 - DNA, 111 bp, Homo sapiens; identical to SEQ ID NO: 16352
  chr19:550388-550499
  hypo

SEQ ID NO: 65899 - DNA, 37 bp, Homo sapiens; identical to SEQ ID NO: 45496
  chr19:557261-557298
  hypo

SEQ ID NO: 65900 - DNA, 24 bp, Homo sapiens
  chr19:558037-558061
  hypo
gatgccaaggtcaggcgccgtcgc

SEQ ID NO: 65901 - DNA, 30 bp, Homo sapiens; identical to SEQ ID NO: 45498
  chr19:559762-559792
  hypo

SEQ ID NO: 65902 - DNA, 140 bp, Homo sapiens; identical to SEQ ID NO: 25544
  chr19:593150-593290
  hypo

SEQ ID NO: 65903 - DNA, 22 bp, Homo sapiens
  chr19:599192-599214
  hypo
ctcttccttttggaccgtttcc

SEQ ID NO: 65904 - DNA, 107 bp, Homo sapiens
  chr19:599333-599440
  hypo
aggtcccggcggccacgccagcgatgagctcccaggtttttctttattggtgttaactttggggagtccctccagtccctcagcatctcctccgaaaggatgtgggg

SEQ ID NO: 65905 - DNA, 46 bp, Homo sapiens; identical to SEQ ID NO: 45501
  chr19:601680-601726
  hypo

SEQ ID NO: 65906 - DNA, 30 bp, Homo sapiens; identical to SEQ ID NO: 45502
  chr19:602546-602576
  hypo

SEQ ID NO: 65907 - DNA, 34 bp, Homo sapiens; identical to SEQ ID NO: 45503
  chr19:623991-624025
  hypo

SEQ ID NO: 65908 - DNA, 84 bp, Homo sapiens; identical to SEQ ID NO: 45504
  chr19:634304-634388
  hypo

SEQ ID NO: 65909 - DNA, 30 bp, Homo sapiens; identical to SEQ ID NO: 45505
  chr19:638382-638412
  hypo

SEQ ID NO: 65910 - DNA, 58 bp, Homo sapiens; identical to SEQ ID NO: 45506
  chr19:640949-641007
  hypo

SEQ ID NO: 65911 - DNA, 50 bp, Homo sapiens
  chr19:690838-690888
  hypo
tacaccgtccctggcaaggtgacaggccgctgcggctctgcgctggtgtg

SEQ ID NO: 65912 - DNA, 30 bp, Homo sapiens; identical to SEQ ID NO: 45508
  chr19:696867-696897
  hypo

SEQ ID NO: 65913 - DNA, 33 bp, Homo sapiens; identical to SEQ ID NO: 45509
  chr19:727028-727061
  hypo

SEQ ID NO: 65914 - DNA, 30 bp, Homo sapiens; identical to SEQ ID NO: 45510
  chr19:748479-748509
  hypo

SEQ ID NO: 65915 - DNA, 55 bp, Homo sapiens
  chr19:752081-752136
  hypo
cacttgctctgtcatcgctgtgtgacctcagatgagcaggttctcctctctgggt

SEQ ID NO: 65916 - DNA, 39 bp, Homo sapiens; identical to SEQ ID NO: 45512
  chr19:793780-793819
  hypo

SEQ ID NO: 65917 - DNA, 87 bp, Homo sapiens; identical to SEQ ID NO: 45513
  chr19:814462-814549
  hypo

SEQ ID NO: 65918 - DNA, 30 bp, Homo sapiens; identical to SEQ ID NO: 45514
  chr19:850011-850041
  hypo

SEQ ID NO: 65919 - DNA, 42 bp, Homo sapiens; identical to SEQ ID NO: 25546
  chr19:883582-883624
  hypo

SEQ ID NO: 65920 - DNA, 227 bp, Homo sapiens; identical to SEQ ID NO: 25547
  chr19:883791-884018
  hypo

SEQ ID NO: 65921 - DNA, 52 bp, Homo sapiens; identical to SEQ ID NO: 25548
  chr19:884162-884214
  hypo

SEQ ID NO: 65922 - DNA, 30 bp, Homo sapiens; identical to SEQ ID NO: 45516
  chr19:885082-885112
  hypo

SEQ ID NO: 65923 - DNA, 41 bp, Homo sapiens; identical to SEQ ID NO: 45518
  chr19:893910-893951
  hypo

SEQ ID NO: 65924 - DNA, 228 bp, Homo sapiens; identical to SEQ ID NO: 45519
  chr19:900821-901049
  hypo

SEQ ID NO: 65925 - DNA, 113 bp, Homo sapiens; identical to SEQ ID NO: 45520
  chr19:945999-946112
  hypo

SEQ ID NO: 65926 - DNA, 38 bp, Homo sapiens; identical to SEQ ID NO: 25550
  chr19:955719-955757
  hypo

SEQ ID NO: 65927 - DNA, 315 bp, Homo sapiens
  chr19:956237-956552
  hypo
ctcgtcctgtccccctctccgccctgtccccctctccgccctgcccggctcacttttgcagctgagaaaatcaaggttcaagtaacgagcatttattaggcaactgctgtgtgctcggctgattccagactctgggaacaaaacagactaaaccccagatacactcctagatccgtgactcggtgatggacggggtctcggaggaagaacgtggaggggagggggcggcagccgggccggggtcagaggacgaggccgggcgtgtggccatgtgtgcgtgcctgtgctcatgggacccaccggcccggccagccg

SEQ ID NO: 65928 - DNA, 230 bp, Homo sapiens; identical to SEQ ID NO: 45522
  chr19:957171-957401
  hypo

SEQ ID NO: 65929 - DNA, 32 bp, Homo sapiens; identical to SEQ ID NO: 45523
  chr19:959587-959619
  hypo

SEQ ID NO: 65930 - DNA, 65 bp, Homo sapiens; identical to SEQ ID NO: 45524
  chr19:963980-964045
  hypo

SEQ ID NO: 65931 - DNA, 128 bp, Homo sapiens
  chr19:1003177-1003305
  hypo
tggatgtgctggtggcggtgctgcaggcgcacgcctgggaagacgtcggcctggccctgtgccgcactcaggaccccggcggcctggtggccctctggacaagccgggctggccggcccccacagctg

SEQ ID NO: 65932 - DNA, 285 bp, Homo sapiens
  chr19:1003384-1003669
  hypo
gtgaagcaccggtacccgcggcggtcctcctcggctgtgacatcgcccgtgcccgtcgggtgctggaggccgtacctcccggcccccactggctgttggggacaccactgccgcccaaggccctgcccaccgcggggctgccaccagggctgctggcgctgggcgaggtggcacgacccccgctggaggccgccatccatgacattgtgcaactggtggcccgggcgctgggcagtgcggcccaggtgcagccgaagcgagccctcctccccgccccggtcaact

SEQ ID NO: 65933 - DNA, 68 bp, Homo sapiens
  chr19:1003734-1003802
  hypo
ctgcttcccttaggagggtgtccaggccactgagtctgcactgctcatggatcacaaaaggcaacgtg

SEQ ID NO: 65934 - DNA, 140 bp, Homo sapiens
  chr19:1004775-1004915
  hypo
ccatttgtgtttgcccgtgatccagacgaagacgggcagtgcccagcggggcagctgtgcctggaccctggcaccaacgactcggccaccctggacgcactgttcgccgcgctggccaacggctcagcgccccgtgccct

SEQ ID NO: 65935 - DNA, 84 bp, Homo sapiens
  chr19:1030092-1030176
  hypo
cctcagtgctgtctccgcggtcactagtggctggatagggacactcgaggtccccactggtgcacacccactgcccaggagcac

SEQ ID NO: 65936 - DNA, 56 bp, Homo sapiens; identical to SEQ ID NO: 45528
  chr19:1042258-1042314
  hypo

SEQ ID NO: 65937 - DNA, 178 bp, Homo sapiens; identical to SEQ ID NO: 45530
  chr19:1051366-1051544
  hypo

SEQ ID NO: 65938 - DNA, 32 bp, Homo sapiens; identical to SEQ ID NO: 45531
  chr19:1083719-1083751
  hypo

SEQ ID NO: 65939 - DNA, 118 bp, Homo sapiens; identical to SEQ ID NO: 45532
  chr19:1085976-1086094
  hypo

SEQ ID NO: 65940 - DNA, 186 bp, Homo sapiens; identical to SEQ ID NO: 45533
  chr19:1105541-1105727
  hypo

SEQ ID NO: 65941 - DNA, 158 bp, Homo sapiens; identical to SEQ ID NO: 45534
  chr19:1112603-1112761
  hypo

SEQ ID NO: 65942 - DNA, 25 bp, Homo sapiens
  chr19:1128398-1128423
  hypo
tttttttttttgagacggattctta

SEQ ID NO: 65943 - DNA, 56 bp, Homo sapiens; identical to SEQ ID NO: 45536
  chr19:1156227-1156283
  hypo

SEQ ID NO: 65944 - DNA, 60 bp, Homo sapiens; identical to SEQ ID NO: 45537
  chr19:1156568-1156628
  hypo

SEQ ID NO: 65945 - DNA, 30 bp, Homo sapiens; identical to SEQ ID NO: 45538
  chr19:1167293-1167323
  hypo

SEQ ID NO: 65946 - DNA, 31 bp, Homo sapiens
  chr19:1171068-1171099
  hypo
cacacaacacaaacacgggtgcacaggcaca

SEQ ID NO: 65947 - DNA, 98 bp, Homo sapiens
  chr19:1171324-1171422
  hypo
aagaatacacacatccatacaacacacaggcacacaacacacatgtgcatgcacatggcgcaacatacagatacacaaagacacgtgtacacacacat

SEQ ID NO: 65948 - DNA, 30 bp, Homo sapiens; identical to SEQ ID NO: 45540
  chr19:1208940-1208970
  hypo

SEQ ID NO: 65949 - DNA, 92 bp, Homo sapiens; identical to SEQ ID NO: 45542
  chr19:1227516-1227608
  hypo

SEQ ID NO: 65950 - DNA, 30 bp, Homo sapiens; identical to SEQ ID NO: 45543
  chr19:1234905-1234935
  hypo

SEQ ID NO: 65951 - DNA, 30 bp, Homo sapiens; identical to SEQ ID NO: 16369
  chr19:1236238-1236268
  hypo

SEQ ID NO: 65952 - DNA, 30 bp, Homo sapiens; identical to SEQ ID NO: 45546
  chr19:1257622-1257652
  hypo

SEQ ID NO: 65953 - DNA, 30 bp, Homo sapiens; identical to SEQ ID NO: 45547
  chr19:1274097-1274127
  hypo

SEQ ID NO: 65954 - DNA, 85 bp, Homo sapiens
  chr19:1274693-1274778
  hypo
ctggagcacgggctgcggtgcgccggcagcttacggggcggccagtccttgcccacaacgatgtggagccctgtgaaagtcggat

SEQ ID NO: 65955 - DNA, 48 bp, Homo sapiens; identical to SEQ ID NO: 45549
  chr19:1289247-1289295
  hypo

SEQ ID NO: 65956 - DNA, 32 bp, Homo sapiens; identical to SEQ ID NO: 45550
  chr19:1301313-1301345
  hypo

SEQ ID NO: 65957 - DNA, 168 bp, Homo sapiens; identical to SEQ ID NO: 45551
  chr19:1308177-1308345
  hypo

SEQ ID NO: 65958 - DNA, 80 bp, Homo sapiens; identical to SEQ ID NO: 45552
  chr19:1311273-1311353
  hypo

SEQ ID NO: 65959 - DNA, 30 bp, Homo sapiens; identical to SEQ ID NO: 16373
  chr19:1325942-1325972
  hypo

SEQ ID NO: 65960 - DNA, 35 bp, Homo sapiens; identical to SEQ ID NO: 45554
  chr19:1329520-1329555
  hypo

SEQ ID NO: 65961 - DNA, 40 bp, Homo sapiens; identical to SEQ ID NO: 45555
  chr19:1409921-1409961
  hypo

SEQ ID NO: 65962 - DNA, 39 bp, Homo sapiens; identical to SEQ ID NO: 45556
  chr19:1424255-1424294
  hypo

SEQ ID NO: 65963 - DNA, 30 bp, Homo sapiens; identical to SEQ ID NO: 45557
  chr19:1437261-1437291
  hypo

SEQ ID NO: 65964 - DNA, 30 bp, Homo sapiens; identical to SEQ ID NO: 45558
  chr19:1440112-1440142
  hypo

SEQ ID NO: 65965 - DNA, 149 bp, Homo sapiens; identical to SEQ ID NO: 45559
  chr19:1481985-1482134
  hypo

SEQ ID NO: 65966 - DNA, 198 bp, Homo sapiens; identical to SEQ ID NO: 45560
  chr19:1482359-1482557
  hypo

SEQ ID NO: 65967 - DNA, 30 bp, Homo sapiens; identical to SEQ ID NO: 45561
  chr19:1495370-1495400
  hypo

SEQ ID NO: 65968 - DNA, 26 bp, Homo sapiens
  chr19:1496387-1496413
  hypo
agacagaatcatgaacgacctcagcg

SEQ ID NO: 65969 - DNA, 204 bp, Homo sapiens
  chr19:1496450-1496654
  hypo
cggtgggtgctcgcaggcgcctggctgcctcaggccatctcccgggtctggacctgtctctctccaccttgcctccctttctgactttggccgccccctctcactgtccgcctctctctctcacgcttccgggaaccagtcttgcaggtcctggcccgtagccgggcaggcatcaccccggtggctgtggccgggccctccact

SEQ ID NO: 65970 - DNA, 21 bp, Homo sapiens
  chr19:1525960-1525981
  hypo
tgtgaccgcctgggcccatca

SEQ ID NO: 65971 - DNA, 43 bp, Homo sapiens; identical to SEQ ID NO: 45564
  chr19:1526480-1526523
  hypo

SEQ ID NO: 65972 - DNA, 33 bp, Homo sapiens; identical to SEQ ID NO: 45566
  chr19:1528123-1528156
  hypo

SEQ ID NO: 65973 - DNA, 30 bp, Homo sapiens; identical to SEQ ID NO: 16379
  chr19:1533726-1533756
  hypo

SEQ ID NO: 65974 - DNA, 49 bp, Homo sapiens; identical to SEQ ID NO: 45568
  chr19:1654563-1654612
  hypo

SEQ ID NO: 65975 - DNA, 46 bp, Homo sapiens; identical to SEQ ID NO: 45569
  chr19:1672993-1673039
  hypo

SEQ ID NO: 65976 - DNA, 46 bp, Homo sapiens; identical to SEQ ID NO: 45570
  chr19:1729230-1729276
  hypo

SEQ ID NO: 65977 - DNA, 48 bp, Homo sapiens; identical to SEQ ID NO: 16380
  chr19:1799852-1799900
  hypo

SEQ ID NO: 65978 - DNA, 64 bp, Homo sapiens; identical to SEQ ID NO: 45572
  chr19:1802584-1802648
  hypo

SEQ ID NO: 65979 - DNA, 30 bp, Homo sapiens; identical to SEQ ID NO: 45573
  chr19:1807179-1807209
  hypo

SEQ ID NO: 65980 - DNA, 27 bp, Homo sapiens
  chr19:1808413-1808440
  hypo
ctcacttggcctcgcccagcatcctct

SEQ ID NO: 65981 - DNA, 377 bp, Homo sapiens; identical to SEQ ID NO: 16382
  chr19:1809512-1809889
  hypo

SEQ ID NO: 65982 - DNA, 141 bp, Homo sapiens; identical to SEQ ID NO: 45576
  chr19:1810575-1810716
  hypo

SEQ ID NO: 65983 - DNA, 78 bp, Homo sapiens; identical to SEQ ID NO: 45577
  chr19:1896317-1896395
  hypo

SEQ ID NO: 65984 - DNA, 51 bp, Homo sapiens; identical to SEQ ID NO: 45578
  chr19:1908389-1908440
  hypo

SEQ ID NO: 65985 - DNA, 37 bp, Homo sapiens; identical to SEQ ID NO: 16383
  chr19:1912092-1912129
  hypo

SEQ ID NO: 65986 - DNA, 48 bp, Homo sapiens; identical to SEQ ID NO: 45580
  chr19:1912374-1912422
  hypo

SEQ ID NO: 65987 - DNA, 150 bp, Homo sapiens; identical to SEQ ID NO: 45581
  chr19:1969956-1970106
  hypo

SEQ ID NO: 65988 - DNA, 99 bp, Homo sapiens; identical to SEQ ID NO: 45582
  chr19:1970425-1970524
  hypo

SEQ ID NO: 65989 - DNA, 30 bp, Homo sapiens; identical to SEQ ID NO: 45583
  chr19:1970740-1970770
  hypo

SEQ ID NO: 65990 - DNA, 649 bp, Homo sapiens; identical to SEQ ID NO: 45584
  chr19:1978313-1978962
  hypo

SEQ ID NO: 65991 - DNA, 385 bp, Homo sapiens; identical to SEQ ID NO: 45585
  chr19:1992849-1993234
  hypo

SEQ ID NO: 65992 - DNA, 44 bp, Homo sapiens; identical to SEQ ID NO: 45586
  chr19:2191591-2191635
  hypo

SEQ ID NO: 65993 - DNA, 30 bp, Homo sapiens; identical to SEQ ID NO: 45587
  chr19:2214092-2214122
  hypo

SEQ ID NO: 65994 - DNA, 56 bp, Homo sapiens; identical to SEQ ID NO: 45588
  chr19:2243515-2243571
  hypo

SEQ ID NO: 65995 - DNA, 55 bp, Homo sapiens; identical to SEQ ID NO: 16388
  chr19:2274600-2274655
  hypo

SEQ ID NO: 65996 - DNA, 197 bp, Homo sapiens; identical to SEQ ID NO: 45590
  chr19:2275743-2275940
  hypo

SEQ ID NO: 65997 - DNA, 140 bp, Homo sapiens
  chr19:2331273-2331413
  hypo
acagtcacttggaagcggggtttctaagcctagtagtttctgaacctgtgtgcggttgcaaagcgtttgtgctgcaattgtgaaggatttggaggtcgaggcttgggctttgagcctgtccttgtagcctgagctttttc

SEQ ID NO: 65998 - DNA, 125 bp, Homo sapiens; identical to SEQ ID NO: 45592
  chr19:2331903-2332028
  hypo

SEQ ID NO: 65999 - DNA, 204 bp, Homo sapiens; identical to SEQ ID NO: 45593
  chr19:2358959-2359163
  hypo

SEQ ID NO: 66000 - DNA, 99 bp, Homo sapiens; identical to SEQ ID NO: 45594
  chr19:2360711-2360810
  hypo

SEQ ID NO: 66001 - DNA, 127 bp, Homo sapiens; identical to SEQ ID NO: 45595
  chr19:2363057-2363184
  hypo

SEQ ID NO: 66002 - DNA, 42 bp, Homo sapiens; identical to SEQ ID NO: 45596
  chr19:2471261-2471303
  hypo

SEQ ID NO: 66003 - DNA, 29 bp, Homo sapiens
  chr19:2471700-2471729
  hypo
aaatacggtgactcacgcctgtaattcca

SEQ ID NO: 66004 - DNA, 50 bp, Homo sapiens
  chr19:2513200-2513250
  hypo
ccaagcagggatccccgcctcacgggcctgcacggaggacctgggcggcc

SEQ ID NO: 66005 - DNA, 209 bp, Homo sapiens
  chr19:2513285-2513494
  hypo
ctgtctccactggggccggagggacaggactaggctagttttattctactacttgcttctaggccagccccgtggagggggtcggggcggccaggcctcctgcgatcagggctgcgtggggtccatctcaggtgtggccgcaggtgatgccggcaggccctggaagatgtggctgcacctgctcccgtccgtgccgcagaggaggacgc

SEQ ID NO: 66006 - DNA, 60 bp, Homo sapiens; identical to SEQ ID NO: 45599
  chr19:2518493-2518553
  hypo

SEQ ID NO: 66007 - DNA, 124 bp, Homo sapiens; identical to SEQ ID NO: 45600
  chr19:2524811-2524935
  hypo

SEQ ID NO: 66008 - DNA, 20 bp, Homo sapiens
  chr19:2683891-2683911
  hypo
gctggtggacagcatcggcc

SEQ ID NO: 66009 - DNA, 30 bp, Homo sapiens; identical to SEQ ID NO: 45602
  chr19:2895788-2895818
  hypo

SEQ ID NO: 66010 - DNA, 22 bp, Homo sapiens
  chr19:2899962-2899984
  hypo
caggaggctgggaaacgtttgg

SEQ ID NO: 66011 - DNA, 22 bp, Homo sapiens
  chr19:3050735-3050757
  hypo
gggcgcggtggctcacgcctgt

SEQ ID NO: 66012 - DNA, 6 bp, Homo sapiens
  chr19:3219506-3219512
  hypo
gctggg

SEQ ID NO: 66013 - DNA, 89 bp, Homo sapiens
  chr19:3219565-3219654
  hypo
gtaacatccatggcacgggcatcctgcagtgaccgatgcccaccagactgcatccgctaacaagacagggagaccggcctgtggtaccc

SEQ ID NO: 66014 - DNA, 15 bp, Homo sapiens
  chr19:3296598-3296613
  hypo
catgccaatctgcct

SEQ ID NO: 66015 - DNA, 25 bp, Homo sapiens
  chr19:3296670-3296695
  hypo
gagtgtgtgccggtgtgcagttgta

SEQ ID NO: 66016 - DNA, 30 bp, Homo sapiens; identical to SEQ ID NO: 45607
  chr19:3308117-3308147
  hypo

SEQ ID NO: 66017 - DNA, 122 bp, Homo sapiens; identical to SEQ ID NO: 45608
  chr19:3344938-3345060
  hypo

SEQ ID NO: 66018 - DNA, 32 bp, Homo sapiens; identical to SEQ ID NO: 45609
  chr19:3456167-3456199
  hypo

SEQ ID NO: 66019 - DNA, 32 bp, Homo sapiens; identical to SEQ ID NO: 45611
  chr19:3570187-3570219
  hypo

SEQ ID NO: 66020 - DNA, 88 bp, Homo sapiens; identical to SEQ ID NO: 45612
  chr19:3571371-3571459
  hypo

SEQ ID NO: 66021 - DNA, 30 bp, Homo sapiens; identical to SEQ ID NO: 45614
  chr19:3747990-3748020
  hypo

SEQ ID NO: 66022 - DNA, 40 bp, Homo sapiens; identical to SEQ ID NO: 45615
  chr19:3760214-3760254
  hypo

SEQ ID NO: 66023 - DNA, 23 bp, Homo sapiens
  chr19:3778394-3778417
  hypo
acggcctccgacacctctttcag

SEQ ID NO: 66024 - DNA, 268 bp, Homo sapiens
  chr19:3779009-3779277
  hypo
gcgccgtccacttgacgggcagccggcttgagtctagccccttccgctcggctttggccaggccaaagtcgctgaccttggccaccaggtcctctgagaccaggatgttgcgggcggccaggtcgcggtgcacaagcttcttgctctccaggtactccatgccctcggccacgtgcctgggggtagtagggggcagtgggggctcaggtgccaggatgcccacattcagggctcagaaagctcggggtgcctggggccacaagctcac

SEQ ID NO: 66025 - DNA, 6 bp, Homo sapiens
  chr19:3779435-3779441
  hypo
ttcacc

SEQ ID NO: 66026 - DNA, 33 bp, Homo sapiens
  chr19:3821011-3821044
  hypo
agggacaccgggggtcgggggacacaggtcaca

SEQ ID NO: 66027 - DNA, 37 bp, Homo sapiens
  chr19:3821217-3821254
  hypo
ccccactgctcgagagctcacacggaggagctccgta

SEQ ID NO: 66028 - DNA, 58 bp, Homo sapiens
  chr19:3855595-3855653
  hypo
aattcaacgcgatctgatggttctcatgccgccgggaaggacgcggcaagggggtgtg

SEQ ID NO: 66029 - DNA, 120 bp, Homo sapiens; identical to SEQ ID NO: 45620
  chr19:3907807-3907927
  hypo

SEQ ID NO: 66030 - DNA, 105 bp, Homo sapiens; identical to SEQ ID NO: 45621
  chr19:3982749-3982854
  hypo

SEQ ID NO: 66031 - DNA, 34 bp, Homo sapiens; identical to SEQ ID NO: 45622
  chr19:4043284-4043318
  hypo

SEQ ID NO: 66032 - DNA, 206 bp, Homo sapiens; identical to SEQ ID NO: 45623
  chr19:4053834-4054040
  hypo

SEQ ID NO: 66033 - DNA, 34 bp, Homo sapiens; identical to SEQ ID NO: 45624
  chr19:4054641-4054675
  hypo

SEQ ID NO: 66034 - DNA, 41 bp, Homo sapiens; identical to SEQ ID NO: 45625
  chr19:4096416-4096457
  hypo

SEQ ID NO: 66035 - DNA, 37 bp, Homo sapiens; identical to SEQ ID NO: 45626
  chr19:4131483-4131520
  hypo

SEQ ID NO: 66036 - DNA, 188 bp, Homo sapiens; identical to SEQ ID NO: 45627
  chr19:4212361-4212549
  hypo

SEQ ID NO: 66037 - DNA, 30 bp, Homo sapiens; identical to SEQ ID NO: 45628
  chr19:4290546-4290576
  hypo

SEQ ID NO: 66038 - DNA, 30 bp, Homo sapiens; identical to SEQ ID NO: 45629
  chr19:4305764-4305794
  hypo

SEQ ID NO: 66039 - DNA, 131 bp, Homo sapiens; identical to SEQ ID NO: 45630
  chr19:4361539-4361670
  hypo

SEQ ID NO: 66040 - DNA, 30 bp, Homo sapiens; identical to SEQ ID NO: 45631
  chr19:4363376-4363406
  hypo

SEQ ID NO: 66041 - DNA, 48 bp, Homo sapiens; identical to SEQ ID NO: 45632
  chr19:4512122-4512170
  hypo

SEQ ID NO: 66042 - DNA, 136 bp, Homo sapiens
  chr19:4547998-4548134
  hypo
cttgcttcccgcccacggctggcctggggtggacactcacttcatacaccccgagtactgctggcagcgagccacaggcactcggaccacgcagcgggggaaggcagccagcaggccccccgaagctgcgtccagc

SEQ ID NO: 66043 - DNA, 26 bp, Homo sapiens
  chr19:4548364-4548390
  hypo
aggaccgtccccgcctcagaacccag

SEQ ID NO: 66044 - DNA, 114 bp, Homo sapiens; identical to SEQ ID NO: 45634
  chr19:4550904-4551018
  hypo

SEQ ID NO: 66045 - DNA, 166 bp, Homo sapiens; identical to SEQ ID NO: 45635
  chr19:4554076-4554242
  hypo

SEQ ID NO: 66046 - DNA, 62 bp, Homo sapiens; identical to SEQ ID NO: 45636
  chr19:4554999-4555061
  hypo

SEQ ID NO: 66047 - DNA, 44 bp, Homo sapiens
  chr19:4556112-4556156
  hypo
acaggaggaagcggggagcgcgatgtgggcgtggtcatggtgat

SEQ ID NO: 66048 - DNA, 170 bp, Homo sapiens
  chr19:4556928-4557098
  hypo
cgcaggggccgggaccgagccagggccaactcacctcctgtttgcccttcatccgacacacgtttatgtcgctggggttagatctccaggtcagcttctgcagacagagagagctggtgagggggtaacgggtcccagcagccctgagtgaccccgccgtgctgggccga

SEQ ID NO: 66049 - DNA, 101 bp, Homo sapiens
  chr19:4557235-4557336
  hypo
ctgggggaggggcatagttagtgagaactgggggctccgccaccctctcccgttccatccttcccactgccaatgtggtgtgcacacgggggcatgcaggg

SEQ ID NO: 66050 - DNA, 42 bp, Homo sapiens; identical to SEQ ID NO: 45639
  chr19:4572555-4572597
  hypo

SEQ ID NO: 66051 - DNA, 40 bp, Homo sapiens
  chr19:4670725-4670765
  hypo
aaggtcaccattaggcgaacttctcataatcgttgcagcc

SEQ ID NO: 66052 - DNA, 50 bp, Homo sapiens; identical to SEQ ID NO: 45641
  chr19:4672854-4672904
  hypo

SEQ ID NO: 66053 - DNA, 40 bp, Homo sapiens; identical to SEQ ID NO: 45642
  chr19:4725551-4725591
  hypo

SEQ ID NO: 66054 - DNA, 78 bp, Homo sapiens; identical to SEQ ID NO: 45643
  chr19:4789954-4790032
  hypo

SEQ ID NO: 66055 - DNA, 194 bp, Homo sapiens; identical to SEQ ID NO: 45644
  chr19:4792866-4793060
  hypo

SEQ ID NO: 66056 - DNA, 30 bp, Homo sapiens; identical to SEQ ID NO: 45645
  chr19:4794081-4794111
  hypo

SEQ ID NO: 66057 - DNA, 30 bp, Homo sapiens; identical to SEQ ID NO: 45646
  chr19:4795123-4795153
  hypo

SEQ ID NO: 66058 - DNA, 35 bp, Homo sapiens; identical to SEQ ID NO: 45647
  chr19:4798716-4798751
  hypo

SEQ ID NO: 66059 - DNA, 30 bp, Homo sapiens; identical to SEQ ID NO: 16414
  chr19:4800545-4800575
  hypo

SEQ ID NO: 66060 - DNA, 30 bp, Homo sapiens; identical to SEQ ID NO: 45649
  chr19:4835700-4835730
  hypo

SEQ ID NO: 66061 - DNA, 30 bp, Homo sapiens; identical to SEQ ID NO: 45650
  chr19:5041081-5041111
  hypo

SEQ ID NO: 66062 - DNA, 200 bp, Homo sapiens; identical to SEQ ID NO: 45651
  chr19:5046161-5046361
  hypo

SEQ ID NO: 66063 - DNA, 236 bp, Homo sapiens; identical to SEQ ID NO: 45652
  chr19:5155177-5155413
  hypo

SEQ ID NO: 66064 - DNA, 229 bp, Homo sapiens; identical to SEQ ID NO: 45653
  chr19:5587354-5587583
  hypo

SEQ ID NO: 66065 - DNA, 362 bp, Homo sapiens; identical to SEQ ID NO: 45654
  chr19:5587840-5588202
  hypo

SEQ ID NO: 66066 - DNA, 103 bp, Homo sapiens; identical to SEQ ID NO: 45655
  chr19:5676808-5676911
  hypo

SEQ ID NO: 66067 - DNA, 30 bp, Homo sapiens; identical to SEQ ID NO: 45656
  chr19:5688079-5688109
  hypo

SEQ ID NO: 66068 - DNA, 16 bp, Homo sapiens
  chr19:5759774-5759790
  hypo
gactcagacttaagaa

SEQ ID NO: 66069 - DNA, 30 bp, Homo sapiens; identical to SEQ ID NO: 16417
  chr19:5789897-5789927
  hypo

SEQ ID NO: 66070 - DNA, 37 bp, Homo sapiens; identical to SEQ ID NO: 16418
  chr19:5790176-5790213
  hypo

SEQ ID NO: 66071 - DNA, 34 bp, Homo sapiens; identical to SEQ ID NO: 45660
  chr19:5825328-5825362
  hypo

SEQ ID NO: 66072 - DNA, 17 bp, Homo sapiens
  chr19:5857648-5857665
  hypo
accgacgtgcgtgacac

SEQ ID NO: 66073 - DNA, 36 bp, Homo sapiens; identical to SEQ ID NO: 45662
  chr19:5897722-5897758
  hypo

SEQ ID NO: 66074 - DNA, 33 bp, Homo sapiens; identical to SEQ ID NO: 45663
  chr19:5905436-5905469
  hypo

SEQ ID NO: 66075 - DNA, 39 bp, Homo sapiens
  chr19:5914953-5914992
  hypo
cccatgtcccaggcccgggaggctgtcatcgcagctgca

SEQ ID NO: 66076 - DNA, 57 bp, Homo sapiens
  chr19:5915060-5915117
  hypo
ccgtgcccaccccaaggtgcgcagtggggagtggaccgaggacgaggtgctgcgccg

SEQ ID NO: 66077 - DNA, 87 bp, Homo sapiens; identical to SEQ ID NO: 45666
  chr19:5915421-5915508
  hypo

SEQ ID NO: 66078 - DNA, 30 bp, Homo sapiens; identical to SEQ ID NO: 16422
  chr19:5915925-5915955
  hypo

SEQ ID NO: 66079 - DNA, 30 bp, Homo sapiens; identical to SEQ ID NO: 45668
  chr19:6333625-6333655
  hypo

SEQ ID NO: 66080 - DNA, 45 bp, Homo sapiens; identical to SEQ ID NO: 45669
  chr19:6351083-6351128
  hypo

SEQ ID NO: 66081 - DNA, 215 bp, Homo sapiens; identical to SEQ ID NO: 45670
  chr19:6358251-6358466
  hypo

SEQ ID NO: 66082 - DNA, 21 bp, Homo sapiens
  chr19:6623980-6624001
  hypo
accctaagggccaggcgtggt

SEQ ID NO: 66083 - DNA, 32 bp, Homo sapiens; identical to SEQ ID NO: 45672
  chr19:6779828-6779860
  hypo

SEQ ID NO: 66084 - DNA, 38 bp, Homo sapiens; identical to SEQ ID NO: 45673
  chr19:7168432-7168470
  hypo

SEQ ID NO: 66085 - DNA, 38 bp, Homo sapiens; identical to SEQ ID NO: 45674
  chr19:7184325-7184363
  hypo

SEQ ID NO: 66086 - DNA, 104 bp, Homo sapiens; identical to SEQ ID NO: 45675
  chr19:7542252-7542356
  hypo

SEQ ID NO: 66087 - DNA, 30 bp, Homo sapiens; identical to SEQ ID NO: 45676
  chr19:7543713-7543743
  hypo

SEQ ID NO: 66088 - DNA, 99 bp, Homo sapiens; identical to SEQ ID NO: 45677
  chr19:7627750-7627849
  hypo

SEQ ID NO: 66089 - DNA, 43 bp, Homo sapiens; identical to SEQ ID NO: 45678
  chr19:7706504-7706547
  hypo

SEQ ID NO: 66090 - DNA, 127 bp, Homo sapiens; identical to SEQ ID NO: 45679
  chr19:7727784-7727911
  hypo

SEQ ID NO: 66091 - DNA, 38 bp, Homo sapiens; identical to SEQ ID NO: 45680
  chr19:7752437-7752475
  hypo

SEQ ID NO: 66092 - DNA, 84 bp, Homo sapiens; identical to SEQ ID NO: 45681
  chr19:7914950-7915034
  hypo

SEQ ID NO: 66093 - DNA, 48 bp, Homo sapiens; identical to SEQ ID NO: 45682
  chr19:7970450-7970498
  hypo

SEQ ID NO: 66094 - DNA, 56 bp, Homo sapiens; identical to SEQ ID NO: 45683
  chr19:8009581-8009637
  hypo

SEQ ID NO: 66095 - DNA, 30 bp, Homo sapiens; identical to SEQ ID NO: 45684
  chr19:8091663-8091693
  hypo

SEQ ID NO: 66096 - DNA, 30 bp, Homo sapiens; identical to SEQ ID NO: 45685
  chr19:8124555-8124585
  hypo

SEQ ID NO: 66097 - DNA, 34 bp, Homo sapiens; identical to SEQ ID NO: 45686
  chr19:8194085-8194119
  hypo

SEQ ID NO: 66098 - DNA, 16 bp, Homo sapiens
  chr19:8253828-8253844
  hypo
tggcaacgggctggac

SEQ ID NO: 66099 - DNA, 100 bp, Homo sapiens; identical to SEQ ID NO: 45688
  chr19:8475425-8475525
  hypo

SEQ ID NO: 66100 - DNA, 11 bp, Homo sapiens
  chr19:8576903-8576914
  hypo
ctgtgcaatgc

SEQ ID NO: 66101 - DNA, 88 bp, Homo sapiens; identical to SEQ ID NO: 45690
  chr19:9129141-9129229
  hypo

SEQ ID NO: 66102 - DNA, 30 bp, Homo sapiens; identical to SEQ ID NO: 45691
  chr19:9261611-9261641
  hypo

SEQ ID NO: 66103 - DNA, 125 bp, Homo sapiens
  chr19:9937386-9937511
  hypo
ggaccaaaccagtaaggagcagctctttaggcataagcacgcgcattaaagacaaaaagtatccttaacatgataaggataaccagctcattagcgctcatgcatatggacggcatatcatgaat

SEQ ID NO: 66104 - DNA, 30 bp, Homo sapiens; identical to SEQ ID NO: 16430
  chr19:10231504-10231534
  hypo

SEQ ID NO: 66105 - DNA, 232 bp, Homo sapiens; identical to SEQ ID NO: 45696
  chr19:10370332-10370564
  hypo

SEQ ID NO: 66106 - DNA, 30 bp, Homo sapiens; identical to SEQ ID NO: 45697
  chr19:10394324-10394354
  hypo

SEQ ID NO: 66107 - DNA, 185 bp, Homo sapiens; identical to SEQ ID NO: 45698
  chr19:10562119-10562304
  hypo

SEQ ID NO: 66108 - DNA, 30 bp, Homo sapiens; identical to SEQ ID NO: 16433
  chr19:10570365-10570395
  hypo

SEQ ID NO: 66109 - DNA, 139 bp, Homo sapiens; identical to SEQ ID NO: 45700
  chr19:10711944-10712083
  hypo

SEQ ID NO: 66110 - DNA, 30 bp, Homo sapiens; identical to SEQ ID NO: 45701
  chr19:10762205-10762235
  hypo

SEQ ID NO: 66111 - DNA, 75 bp, Homo sapiens; identical to SEQ ID NO: 45702
  chr19:10872535-10872610
  hypo

SEQ ID NO: 66112 - DNA, 202 bp, Homo sapiens; identical to SEQ ID NO: 45703
  chr19:10875905-10876107
  hypo

SEQ ID NO: 66113 - DNA, 30 bp, Homo sapiens; identical to SEQ ID NO: 16436
  chr19:10954418-10954448
  hypo

SEQ ID NO: 66114 - DNA, 30 bp, Homo sapiens; identical to SEQ ID NO: 45705
  chr19:11002349-11002379
  hypo

SEQ ID NO: 66115 - DNA, 95 bp, Homo sapiens; identical to SEQ ID NO: 45706
  chr19:11002992-11003087
  hypo

SEQ ID NO: 66116 - DNA, 30 bp, Homo sapiens; identical to SEQ ID NO: 16438
  chr19:11005335-11005365
  hypo

SEQ ID NO: 66117 - DNA, 25 bp, Homo sapiens
  chr19:11008369-11008394
  hypo
atgctagctctgggccgggcacggt

SEQ ID NO: 66118 - DNA, 55 bp, Homo sapiens; identical to SEQ ID NO: 45709
  chr19:11030140-11030195
  hypo

SEQ ID NO: 66119 - DNA, 90 bp, Homo sapiens; identical to SEQ ID NO: 45710
  chr19:11052037-11052127
  hypo

SEQ ID NO: 66120 - DNA, 36 bp, Homo sapiens; identical to SEQ ID NO: 45711
  chr19:11053260-11053296
  hypo

SEQ ID NO: 66121 - DNA, 42 bp, Homo sapiens; identical to SEQ ID NO: 45712
  chr19:11129719-11129761
  hypo

SEQ ID NO: 66122 - DNA, 30 bp, Homo sapiens; identical to SEQ ID NO: 16440
  chr19:11252737-11252767
  hypo

SEQ ID NO: 66123 - DNA, 30 bp, Homo sapiens; identical to SEQ ID NO: 45714
  chr19:11406534-11406564
  hypo

SEQ ID NO: 66124 - DNA, 104 bp, Homo sapiens; identical to SEQ ID NO: 45715
  chr19:11658653-11658757
  hypo

SEQ ID NO: 66125 - DNA, 101 bp, Homo sapiens; identical to SEQ ID NO: 45716
  chr19:12220383-12220484
  hypo

SEQ ID NO: 66126 - DNA, 132 bp, Homo sapiens; identical to SEQ ID NO: 45717
  chr19:12222626-12222758
  hypo

SEQ ID NO: 66127 - DNA, 40 bp, Homo sapiens; identical to SEQ ID NO: 45718
  chr19:12675871-12675911
  hypo

SEQ ID NO: 66128 - DNA, 23 bp, Homo sapiens
  chr19:12846825-12846848
  hypo
tggagctgaagtccccgtctgag

SEQ ID NO: 66129 - DNA, 84 bp, Homo sapiens
  chr19:12863520-12863604
  hypo
ttccttgggttctacatggcgctgagtgctgcctaccggtgaggctgccctgaggtgctcatgttctagcggagggggggcagc

SEQ ID NO: 66130 - DNA, 45 bp, Homo sapiens; identical to SEQ ID NO: 45721
  chr19:12977473-12977518
  hypo

SEQ ID NO: 66131 - DNA, 30 bp, Homo sapiens; identical to SEQ ID NO: 16444
  chr19:13335742-13335772
  hypo

SEQ ID NO: 66132 - DNA, 163 bp, Homo sapiens; identical to SEQ ID NO: 45723
  chr19:13781908-13782071
  hypo

SEQ ID NO: 66133 - DNA, 39 bp, Homo sapiens; identical to SEQ ID NO: 45724
  chr19:13943608-13943647
  hypo

SEQ ID NO: 66134 - DNA, 465 bp, Homo sapiens; identical to SEQ ID NO: 45725
  chr19:13988295-13988760
  hypo

SEQ ID NO: 66135 - DNA, 40 bp, Homo sapiens; identical to SEQ ID NO: 45726
  chr19:14042824-14042864
  hypo

SEQ ID NO: 66136 - DNA, 79 bp, Homo sapiens; identical to SEQ ID NO: 45728
  chr19:14209036-14209115
  hypo

SEQ ID NO: 66137 - DNA, 85 bp, Homo sapiens; identical to SEQ ID NO: 45729
  chr19:14244905-14244990
  hypo

SEQ ID NO: 66138 - DNA, 30 bp, Homo sapiens; identical to SEQ ID NO: 45730
  chr19:14616913-14616943
  hypo

SEQ ID NO: 66139 - DNA, 36 bp, Homo sapiens; identical to SEQ ID NO: 16449
  chr19:14630627-14630663
  hypo

SEQ ID NO: 66140 - DNA, 44 bp, Homo sapiens; identical to SEQ ID NO: 45732
  chr19:14675028-14675072
  hypo

SEQ ID NO: 66141 - DNA, 40 bp, Homo sapiens; identical to SEQ ID NO: 45733
  chr19:14797872-14797912
  hypo

SEQ ID NO: 66142 - DNA, 80 bp, Homo sapiens; identical to SEQ ID NO: 45734
  chr19:14877987-14878067
  hypo

SEQ ID NO: 66143 - DNA, 47 bp, Homo sapiens; identical to SEQ ID NO: 45735
  chr19:15220624-15220671
  hypo

SEQ ID NO: 66144 - DNA, 123 bp, Homo sapiens; identical to SEQ ID NO: 45736
  chr19:15272392-15272515
  hypo

SEQ ID NO: 66145 - DNA, 95 bp, Homo sapiens
  chr19:15292289-15292384
  hypo
aggactcccccaagtcgttgctgtccccacttcgtcccaggtcccaggccccatcccaagccagagtccctgctctccaagcagaggccccgccc

SEQ ID NO: 66146 - DNA, 46 bp, Homo sapiens
  chr19:15292499-15292545
  hypo
gctcaggcactcatccacatcgcgggcgcatcgtgggccggcgaaa

SEQ ID NO: 66147 - DNA, 38 bp, Homo sapiens; identical to SEQ ID NO: 45738
  chr19:15488546-15488584
  hypo

SEQ ID NO: 66148 - DNA, 30 bp, Homo sapiens; identical to SEQ ID NO: 45739
  chr19:15547714-15547744
  hypo

SEQ ID NO: 66149 - DNA, 174 bp, Homo sapiens; identical to SEQ ID NO: 45740
  chr19:15558347-15558521
  hypo

SEQ ID NO: 66150 - DNA, 30 bp, Homo sapiens; identical to SEQ ID NO: 45741
  chr19:16232444-16232474
  hypo

SEQ ID NO: 66151 - DNA, 136 bp, Homo sapiens; identical to SEQ ID NO: 16452
  chr19:16275694-16275830
  hypo

SEQ ID NO: 66152 - DNA, 30 bp, Homo sapiens; identical to SEQ ID NO: 16453
  chr19:16638285-16638315
  hypo

SEQ ID NO: 66153 - DNA, 68 bp, Homo sapiens; identical to SEQ ID NO: 45744
  chr19:16638668-16638736
  hypo

SEQ ID NO: 66154 - DNA, 191 bp, Homo sapiens; identical to SEQ ID NO: 45745
  chr19:16939668-16939859
  hypo

SEQ ID NO: 66155 - DNA, 44 bp, Homo sapiens; identical to SEQ ID NO: 45746
  chr19:17049224-17049268
  hypo

SEQ ID NO: 66156 - DNA, 42 bp, Homo sapiens; identical to SEQ ID NO: 45747
  chr19:17265055-17265097
  hypo

SEQ ID NO: 66157 - DNA, 62 bp, Homo sapiens; identical to SEQ ID NO: 45748
  chr19:17365683-17365745
  hypo

SEQ ID NO: 66158 - DNA, 23 bp, Homo sapiens
  chr19:17379245-17379268
  hypo
tttttttttttgagacggagttt

SEQ ID NO: 66159 - DNA, 798 bp, Homo sapiens; identical to SEQ ID NO: 45750
  chr19:17404613-17405411
  hypo

SEQ ID NO: 66160 - DNA, 438 bp, Homo sapiens; identical to SEQ ID NO: 45751
  chr19:17438085-17438523
  hypo

SEQ ID NO: 66161 - DNA, 30 bp, Homo sapiens; identical to SEQ ID NO: 45752
  chr19:17644708-17644738
  hypo

SEQ ID NO: 66162 - DNA, 66 bp, Homo sapiens; identical to SEQ ID NO: 45753
  chr19:17687961-17688027
  hypo

SEQ ID NO: 66163 - DNA, 79 bp, Homo sapiens; identical to SEQ ID NO: 45755
  chr19:17759753-17759832
  hypo

SEQ ID NO: 66164 - DNA, 30 bp, Homo sapiens; identical to SEQ ID NO: 45756
  chr19:17767185-17767215
  hypo

SEQ ID NO: 66165 - DNA, 46 bp, Homo sapiens; identical to SEQ ID NO: 45757
  chr19:17836551-17836597
  hypo

SEQ ID NO: 66166 - DNA, 39 bp, Homo sapiens; identical to SEQ ID NO: 25638
  chr19:18041203-18041242
  hypo

SEQ ID NO: 66167 - DNA, 181 bp, Homo sapiens; identical to SEQ ID NO: 45759
  chr19:18054301-18054482
  hypo

SEQ ID NO: 66168 - DNA, 82 bp, Homo sapiens; identical to SEQ ID NO: 45760
  chr19:18054758-18054840
  hypo

SEQ ID NO: 66169 - DNA, 51 bp, Homo sapiens; identical to SEQ ID NO: 45761
  chr19:18084967-18085018
  hypo

SEQ ID NO: 66170 - DNA, 310 bp, Homo sapiens; identical to SEQ ID NO: 45762
  chr19:18092490-18092800
  hypo

SEQ ID NO: 66171 - DNA, 11 bp, Homo sapiens
  chr19:18103700-18103711
  hypo
acctccccaga

SEQ ID NO: 66172 - DNA, 124 bp, Homo sapiens
  chr19:18103741-18103865
  hypo
cccgcgcggggccctagggtggcatccccgggaggtgggcagggttgggtacatgccgaacaactgtgctgaggttaaaattgccttgtgatttttctcctgctctgcccggtcctgccagggc

SEQ ID NO: 66173 - DNA, 42 bp, Homo sapiens; identical to SEQ ID NO: 25643
  chr19:18104430-18104472
  hypo

SEQ ID NO: 66174 - DNA, 76 bp, Homo sapiens; identical to SEQ ID NO: 45765
  chr19:18207919-18207995
  hypo

SEQ ID NO: 66175 - DNA, 18 bp, Homo sapiens
  chr19:18227706-18227724
  hypo
gagcgaaactctgtctca

SEQ ID NO: 66176 - DNA, 105 bp, Homo sapiens; identical to SEQ ID NO: 45767
  chr19:18272708-18272813
  hypo

SEQ ID NO: 66177 - DNA, 18 bp, Homo sapiens
  chr19:18298268-18298286
  hypo
acaggcataagccaccga

SEQ ID NO: 66178 - DNA, 40 bp, Homo sapiens; identical to SEQ ID NO: 25646
  chr19:18330991-18331031
  hypo

SEQ ID NO: 66179 - DNA, 73 bp, Homo sapiens
  chr19:18331136-18331209
  hypo
ggagagaaggtgaagaccgtgatgatggggcaccgtgggccgaggcaggtgagctcagcgatctgccccacct

SEQ ID NO: 66180 - DNA, 30 bp, Homo sapiens; identical to SEQ ID NO: 45771
  chr19:18600783-18600813
  hypo

SEQ ID NO: 66181 - DNA, 30 bp, Homo sapiens; identical to SEQ ID NO: 45773
  chr19:18707421-18707451
  hypo

SEQ ID NO: 66182 - DNA, 42 bp, Homo sapiens; identical to SEQ ID NO: 16472
  chr19:18788397-18788439
  hypo

SEQ ID NO: 66183 - DNA, 30 bp, Homo sapiens; identical to SEQ ID NO: 45775
  chr19:18878375-18878405
  hypo

SEQ ID NO: 66184 - DNA, 101 bp, Homo sapiens; identical to SEQ ID NO: 45776
  chr19:18880013-18880114
  hypo

SEQ ID NO: 66185 - DNA, 30 bp, Homo sapiens; identical to SEQ ID NO: 16473
  chr19:18883509-18883539
  hypo

SEQ ID NO: 66186 - DNA, 111 bp, Homo sapiens; identical to SEQ ID NO: 45778
  chr19:18883973-18884084
  hypo

SEQ ID NO: 66187 - DNA, 30 bp, Homo sapiens; identical to SEQ ID NO: 45779
  chr19:18895773-18895803
  hypo

SEQ ID NO: 66188 - DNA, 30 bp, Homo sapiens; identical to SEQ ID NO: 45780
  chr19:18975090-18975120
  hypo

SEQ ID NO: 66189 - DNA, 83 bp, Homo sapiens; identical to SEQ ID NO: 16475
  chr19:18988902-18988985
  hypo

SEQ ID NO: 66190 - DNA, 126 bp, Homo sapiens
  chr19:18989695-18989821
  hypo
cactaaaggagggaacgcggggtgcgggcccctccacactcactcggctttgctgggcttcaggctctgggcctcggctgtgtcatactcccgcaggtccttcagctcgtgcacctggcctgtcaa

SEQ ID NO: 66191 - DNA, 207 bp, Homo sapiens
  chr19:18994680-18994887
  hypo
tccctcaggaatctccgggcccacatcccctcctcagccttcctgcctctggtctgtcccctcgtcggacccctgagcactctgaccttggaaccctgagcactccgacctgatgtgatcccctccacggcctcctctgtgccccgccgcaacatcagcctccgcactctgtgtgggctgtgcctcggccccctgccacccgatcct

SEQ ID NO: 66192 - DNA, 41 bp, Homo sapiens
  chr19:18995206-18995247
  hypo
gctttccattcccaattctatttttttttttttttctttga

SEQ ID NO: 66193 - DNA, 57 bp, Homo sapiens; identical to SEQ ID NO: 45784
  chr19:19042770-19042827
  hypo

SEQ ID NO: 66194 - DNA, 30 bp, Homo sapiens; identical to SEQ ID NO: 45785
  chr19:19214217-19214247
  hypo

SEQ ID NO: 66195 - DNA, 200 bp, Homo sapiens; identical to SEQ ID NO: 45786
  chr19:19218598-19218798
  hypo

SEQ ID NO: 66196 - DNA, 30 bp, Homo sapiens
  chr19:19334915-19334945
  hypo
atcattgcagcccctcggcatctacaggct

SEQ ID NO: 66197 - DNA, 50 bp, Homo sapiens; identical to SEQ ID NO: 45788
  chr19:19335175-19335225
  hypo

SEQ ID NO: 66198 - DNA, 183 bp, Homo sapiens; identical to SEQ ID NO: 45789
  chr19:19391386-19391569
  hypo

SEQ ID NO: 66199 - DNA, 39 bp, Homo sapiens; identical to SEQ ID NO: 45790
  chr19:19391907-19391946
  hypo

SEQ ID NO: 66200 - DNA, 30 bp, Homo sapiens; identical to SEQ ID NO: 45791
  chr19:19737618-19737648
  hypo

SEQ ID NO: 66201 - DNA, 22 bp, Homo sapiens
  chr19:21265857-21265879
  hypo
tttaagatggagtttcgctctt

SEQ ID NO: 66202 - DNA, 30 bp, Homo sapiens; identical to SEQ ID NO: 45793
  chr19:21727297-21727327
  hypo

SEQ ID NO: 66203 - DNA, 42 bp, Homo sapiens; identical to SEQ ID NO: 45794
  chr19:22017749-22017791
  hypo

SEQ ID NO: 66204 - DNA, 120 bp, Homo sapiens; identical to SEQ ID NO: 45795
  chr19:22606112-22606232
  hypo

SEQ ID NO: 66205 - DNA, 171 bp, Homo sapiens; identical to SEQ ID NO: 45796
  chr19:28402178-28402349
  hypo

SEQ ID NO: 66206 - DNA, 54 bp, Homo sapiens; identical to SEQ ID NO: 45797
  chr19:29145984-29146038
  hypo

SEQ ID NO: 66207 - DNA, 85 bp, Homo sapiens; identical to SEQ ID NO: 45798
  chr19:29425113-29425198
  hypo

SEQ ID NO: 66208 - DNA, 103 bp, Homo sapiens; identical to SEQ ID NO: 45799
  chr19:29716608-29716711
  hypo

SEQ ID NO: 66209 - DNA, 30 bp, Homo sapiens; identical to SEQ ID NO: 45800
  chr19:29920756-29920786
  hypo

SEQ ID NO: 66210 - DNA, 49 bp, Homo sapiens; identical to SEQ ID NO: 45801
  chr19:29930941-29930990
  hypo

SEQ ID NO: 66211 - DNA, 45 bp, Homo sapiens; identical to SEQ ID NO: 45802
  chr19:30056272-30056317
  hypo

SEQ ID NO: 66212 - DNA, 30 bp, Homo sapiens; identical to SEQ ID NO: 45803
  chr19:30244714-30244744
  hypo

SEQ ID NO: 66213 - DNA, 341 bp, Homo sapiens
  chr19:30555376-30555717
  hypo
gcggcccactgtgctcccggcagccctcctgacgtcaacggcagccgcggggacgctgcctcctctgccacacgttgctcacaaagtgtaggcaaaaggcaggcgtccaattgctgcggatgaggaagagaaataatttcgtttctaaatcaggactcagtaccggtggccaggccccggaaggggcatctgtcggctgcacggcagccactcctgcaatggaggagatggtccagttctccatggggacttggggggctccccagctctggccctgggtgccgaaagccctgagaacaagccatctgaaaattaggattctgcgtcgcctgtcaatcccc

SEQ ID NO: 66214 - DNA, 30 bp, Homo sapiens; identical to SEQ ID NO: 45805
  chr19:30562726-30562756
  hypo

SEQ ID NO: 66215 - DNA, 184 bp, Homo sapiens; identical to SEQ ID NO: 45806
  chr19:30579049-30579233
  hypo

SEQ ID NO: 66216 - DNA, 33 bp, Homo sapiens; identical to SEQ ID NO: 45807
  chr19:30636005-30636038
  hypo

SEQ ID NO: 66217 - DNA, 39 bp, Homo sapiens
  chr19:30637531-30637570
  hypo
gcaagcacgtgacatccagtactacgtgaggtgctgaca

SEQ ID NO: 66218 - DNA, 45 bp, Homo sapiens; identical to SEQ ID NO: 45809
  chr19:31017337-31017382
  hypo

SEQ ID NO: 66219 - DNA, 205 bp, Homo sapiens; identical to SEQ ID NO: 45810
  chr19:31587355-31587560
  hypo

SEQ ID NO: 66220 - DNA, 138 bp, Homo sapiens; identical to SEQ ID NO: 45811
  chr19:31780548-31780686
  hypo

SEQ ID NO: 66221 - DNA, 30 bp, Homo sapiens; identical to SEQ ID NO: 45812
  chr19:32026024-32026054
  hypo

SEQ ID NO: 66222 - DNA, 59 bp, Homo sapiens; identical to SEQ ID NO: 45813
  chr19:32083683-32083742
  hypo

SEQ ID NO: 66223 - DNA, 32 bp, Homo sapiens; identical to SEQ ID NO: 45814
  chr19:32232273-32232305
  hypo

SEQ ID NO: 66224 - DNA, 143 bp, Homo sapiens
  chr19:32364403-32364546
  hypo
tacatgaaagccctccttacaagccttccttgtaccctatggctccaggatctggccccttcacctccccagagtcagagttaccacggtgcagtggcgcaccagtgggcctccggcaatgctgctcccgcttcccaccttcc

SEQ ID NO: 66225 - DNA, 48 bp, Homo sapiens
  chr19:32516351-32516399
  hypo
aactcccctgcggcccgtccctgcctcaccgcatggcccggctttgca

SEQ ID NO: 66226 - DNA, 89 bp, Homo sapiens; identical to SEQ ID NO: 45817
  chr19:32672320-32672409
  hypo

SEQ ID NO: 66227 - DNA, 81 bp, Homo sapiens; identical to SEQ ID NO: 45818
  chr19:32718922-32719003
  hypo

SEQ ID NO: 66228 - DNA, 89 bp, Homo sapiens; identical to SEQ ID NO: 45819
  chr19:32835111-32835200
  hypo

SEQ ID NO: 66229 - DNA, 16 bp, Homo sapiens
  chr19:33143466-33143482
  hypo
gcgaaactccatcccg

SEQ ID NO: 66230 - DNA, 156 bp, Homo sapiens; identical to SEQ ID NO: 45822
  chr19:33415273-33415429
  hypo

SEQ ID NO: 66231 - DNA, 13 bp, Homo sapiens
  chr19:33468055-33468068
  hypo
tctgagttcagct

SEQ ID NO: 66232 - DNA, 75 bp, Homo sapiens; identical to SEQ ID NO: 45824
  chr19:33557281-33557356
  hypo

SEQ ID NO: 66233 - DNA, 18 bp, Homo sapiens
  chr19:33557746-33557764
  hypo
aaaaaaaaaaaagtccgg

SEQ ID NO: 66234 - DNA, 30 bp, Homo sapiens; identical to SEQ ID NO: 45826
  chr19:33908049-33908079
  hypo

SEQ ID NO: 66235 - DNA, 40 bp, Homo sapiens; identical to SEQ ID NO: 45827
  chr19:34263232-34263272
  hypo

SEQ ID NO: 66236 - DNA, 30 bp, Homo sapiens; identical to SEQ ID NO: 16489
  chr19:34263853-34263883
  hypo

SEQ ID NO: 66237 - DNA, 34 bp, Homo sapiens; identical to SEQ ID NO: 45829
  chr19:34558340-34558374
  hypo

SEQ ID NO: 66238 - DNA, 3 bp, Homo sapiens
  chr19:34896321-34896324
  hypo
att

SEQ ID NO: 66239 - DNA, 16 bp, Homo sapiens
  chr19:35497210-35497226
  hypo
gcgactctttgtctcc

SEQ ID NO: 66240 - DNA, 33 bp, Homo sapiens; identical to SEQ ID NO: 45832
  chr19:35524590-35524623
  hypo

SEQ ID NO: 66241 - DNA, 30 bp, Homo sapiens; identical to SEQ ID NO: 45833
  chr19:35607399-35607429
  hypo

SEQ ID NO: 66242 - DNA, 30 bp, Homo sapiens; identical to SEQ ID NO: 45834
  chr19:35608942-35608972
  hypo

SEQ ID NO: 66243 - DNA, 54 bp, Homo sapiens; identical to SEQ ID NO: 45835
  chr19:35615955-35616009
  hypo

SEQ ID NO: 66244 - DNA, 85 bp, Homo sapiens; identical to SEQ ID NO: 25666
  chr19:35616256-35616341
  hypo

SEQ ID NO: 66245 - DNA, 80 bp, Homo sapiens
  chr19:35616397-35616477
  hypo
tcccagcgcatgacctgtgggggtgtggccagtgagggcctggggtcccgggggtctctgggggccgtggaacagcttgg

SEQ ID NO: 66246 - DNA, 151 bp, Homo sapiens
  chr19:35781223-35781374
  hypo
ccgtgcatggcctcaattccggtttttaagccacccagtttgtgaaactttgttgtaacagccctggaaaactgatacacctgctctctcgtaaaagatcagctgatacggcagcaccggccactggatctgcgggtcagttgtcccctta

SEQ ID NO: 66247 - DNA, 25 bp, Homo sapiens
  chr19:35781459-35781484
  hypo
cctggagacccgagttgctgatgtc

SEQ ID NO: 66248 - DNA, 7 bp, Homo sapiens
  chr19:35797909-35797916
  hypo
aaaagat

SEQ ID NO: 66249 - DNA, 156 bp, Homo sapiens; identical to SEQ ID NO: 45839
  chr19:35827208-35827364
  hypo

SEQ ID NO: 66250 - DNA, 35 bp, Homo sapiens; identical to SEQ ID NO: 45840
  chr19:35842975-35843010
  hypo

SEQ ID NO: 66251 - DNA, 30 bp, Homo sapiens; identical to SEQ ID NO: 45841
  chr19:35921023-35921053
  hypo

SEQ ID NO: 66252 - DNA, 195 bp, Homo sapiens; identical to SEQ ID NO: 45842
  chr19:35940942-35941137
  hypo

SEQ ID NO: 66253 - DNA, 30 bp, Homo sapiens; identical to SEQ ID NO: 45843
  chr19:36199677-36199707
  hypo

SEQ ID NO: 66254 - DNA, 417 bp, Homo sapiens; identical to SEQ ID NO: 45844
  chr19:36221572-36221989
  hypo

SEQ ID NO: 66255 - DNA, 57 bp, Homo sapiens
  chr19:36249972-36250029
  hypo
gtctggaatgggaaccgcgcgcctgtaacgttgaaaagcccctcctagactggatcc

SEQ ID NO: 66256 - DNA, 115 bp, Homo sapiens
  chr19:36250134-36250249
  hypo
gcaacggtgcttcatggaaatgacagtccgtctcctccaggaatctatgggaattgtctggttctgccctcctctaatgtccccctccccagggctgcggcgaaaccacgtgctg

SEQ ID NO: 66257 - DNA, 339 bp, Homo sapiens; identical to SEQ ID NO: 45847
  chr19:36604439-36604778
  hypo

SEQ ID NO: 66258 - DNA, 150 bp, Homo sapiens; identical to SEQ ID NO: 45848
  chr19:36640992-36641142
  hypo

SEQ ID NO: 66259 - DNA, 196 bp, Homo sapiens; identical to SEQ ID NO: 45849
  chr19:36704661-36704857
  hypo

SEQ ID NO: 66260 - DNA, 101 bp, Homo sapiens; identical to SEQ ID NO: 45850
  chr19:36747803-36747904
  hypo

SEQ ID NO: 66261 - DNA, 30 bp, Homo sapiens; identical to SEQ ID NO: 45851
  chr19:37110908-37110938
  hypo

SEQ ID NO: 66262 - DNA, 98 bp, Homo sapiens; identical to SEQ ID NO: 45853
  chr19:38228271-38228369
  hypo

SEQ ID NO: 66263 - DNA, 6 bp, Homo sapiens
  chr19:38481038-38481044
  hypo
agccag

SEQ ID NO: 66264 - DNA, 24 bp, Homo sapiens
  chr19:38782535-38782559
  hypo
atggtctacctgatccgggtggca

SEQ ID NO: 66265 - DNA, 214 bp, Homo sapiens; identical to SEQ ID NO: 45856
  chr19:38828121-38828335
  hypo

SEQ ID NO: 66266 - DNA, 200 bp, Homo sapiens
  chr19:38873965-38874165
  hypo
ttccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaag

SEQ ID NO: 66267 - DNA, 30 bp, Homo sapiens
  chr19:38905702-38905732
  hypo
tgcggcggtagcgggcgtagttgttgtggg

SEQ ID NO: 66268 - DNA, 112 bp, Homo sapiens; identical to SEQ ID NO: 45859
  chr19:38934459-38934571
  hypo

SEQ ID NO: 66269 - DNA, 87 bp, Homo sapiens; identical to SEQ ID NO: 45860
  chr19:38956890-38956977
  hypo

SEQ ID NO: 66270 - DNA, 321 bp, Homo sapiens; identical to SEQ ID NO: 45862
  chr19:38976340-38976661
  hypo

SEQ ID NO: 66271 - DNA, 145 bp, Homo sapiens; identical to SEQ ID NO: 45863
  chr19:38990607-38990752
  hypo

SEQ ID NO: 66272 - DNA, 53 bp, Homo sapiens; identical to SEQ ID NO: 45864
  chr19:38991499-38991552
  hypo

SEQ ID NO: 66273 - DNA, 30 bp, Homo sapiens; identical to SEQ ID NO: 45865
  chr19:38996547-38996577
  hypo

SEQ ID NO: 66274 - DNA, 80 bp, Homo sapiens; identical to SEQ ID NO: 45866
  chr19:38998362-38998442
  hypo

SEQ ID NO: 66275 - DNA, 41 bp, Homo sapiens; identical to SEQ ID NO: 45867
  chr19:39006715-39006756
  hypo

SEQ ID NO: 66276 - DNA, 52 bp, Homo sapiens; identical to SEQ ID NO: 45868
  chr19:39071019-39071071
  hypo

SEQ ID NO: 66277 - DNA, 30 bp, Homo sapiens; identical to SEQ ID NO: 45869
  chr19:39101480-39101510
  hypo

SEQ ID NO: 66278 - DNA, 30 bp, Homo sapiens; identical to SEQ ID NO: 45871
  chr19:39151783-39151813
  hypo

SEQ ID NO: 66279 - DNA, 30 bp, Homo sapiens; identical to SEQ ID NO: 45872
  chr19:39191735-39191765
  hypo

SEQ ID NO: 66280 - DNA, 42 bp, Homo sapiens; identical to SEQ ID NO: 45873
  chr19:39222079-39222121
  hypo

SEQ ID NO: 66281 - DNA, 30 bp, Homo sapiens; identical to SEQ ID NO: 45874
  chr19:39235148-39235178
  hypo

SEQ ID NO: 66282 - DNA, 30 bp, Homo sapiens; identical to SEQ ID NO: 45875
  chr19:39266345-39266375
  hypo

SEQ ID NO: 66283 - DNA, 30 bp, Homo sapiens; identical to SEQ ID NO: 45876
  chr19:39329609-39329639
  hypo

SEQ ID NO: 66284 - DNA, 30 bp, Homo sapiens; identical to SEQ ID NO: 45877
  chr19:39329947-39329977
  hypo

SEQ ID NO: 66285 - DNA, 30 bp, Homo sapiens; identical to SEQ ID NO: 16504
  chr19:39330221-39330251
  hypo

SEQ ID NO: 66286 - DNA, 19 bp, Homo sapiens
  chr19:39393000-39393019
  hypo
cgcccggcctcattttatt

SEQ ID NO: 66287 - DNA, 30 bp, Homo sapiens; identical to SEQ ID NO: 45880
  chr19:39524876-39524906
  hypo

SEQ ID NO: 66288 - DNA, 94 bp, Homo sapiens; identical to SEQ ID NO: 45881
  chr19:39646149-39646243
  hypo

SEQ ID NO: 66289 - DNA, 30 bp, Homo sapiens; identical to SEQ ID NO: 45882
  chr19:39672405-39672435
  hypo

SEQ ID NO: 66290 - DNA, 30 bp, Homo sapiens; identical to SEQ ID NO: 45883
  chr19:39815860-39815890
  hypo

SEQ ID NO: 66291 - DNA, 101 bp, Homo sapiens
  chr19:39817085-39817186
  hypo
actcctcattggatagtgcagtctgttctggcctctctgattggtccttccacaatccctagctgtactccctctgcattggactgcgcctgtgagccacc

SEQ ID NO: 66292 - DNA, 19 bp, Homo sapiens
  chr19:39996557-39996576
  hypo
agattaaatgcggcccggc

SEQ ID NO: 66293 - DNA, 189 bp, Homo sapiens; identical to SEQ ID NO: 16507
  chr19:40218707-40218896
  hypo

SEQ ID NO: 66294 - DNA, 114 bp, Homo sapiens; identical to SEQ ID NO: 45888
  chr19:40889727-40889841
  hypo

SEQ ID NO: 66295 - DNA, 30 bp, Homo sapiens; identical to SEQ ID NO: 45889
  chr19:40901793-40901823
  hypo

SEQ ID NO: 66296 - DNA, 147 bp, Homo sapiens
  chr19:40902278-40902425
  hypo
cgggagctgcacttccgggaggtgcacatcgggcacagccatctcgggcaccttcgggagtttcacctcagggagtttcatctcagggagcttcatctctgggacttttggaagctgcacttctgggaggtgcacatcgggcacggc

SEQ ID NO: 66297 - DNA, 16 bp, Homo sapiens
  chr19:40908674-40908690
  hypo
ccgtctcaaaaaaaaa

SEQ ID NO: 66298 - DNA, 49 bp, Homo sapiens; identical to SEQ ID NO: 16509
  chr19:41062945-41062994
  hypo

SEQ ID NO: 66299 - DNA, 47 bp, Homo sapiens; identical to SEQ ID NO: 45894
  chr19:41198165-41198212
  hypo

SEQ ID NO: 66300 - DNA, 30 bp, Homo sapiens; identical to SEQ ID NO: 45895
  chr19:41615907-41615937
  hypo

SEQ ID NO: 66301 - DNA, 67 bp, Homo sapiens
  chr19:41881467-41881534
  hypo
ccactgcgcccggcccgtgagcccgtttctttatctgcaaaacagggattaaaaacaagccaacacc

SEQ ID NO: 66302 - DNA, 40 bp, Homo sapiens; identical to SEQ ID NO: 45897
  chr19:41956303-41956343
  hypo

SEQ ID NO: 66303 - DNA, 31 bp, Homo sapiens; identical to SEQ ID NO: 16511
  chr19:42202366-42202397
  hypo

SEQ ID NO: 66304 - DNA, 127 bp, Homo sapiens; identical to SEQ ID NO: 16512
  chr19:42349306-42349433
  hypo

SEQ ID NO: 66305 - DNA, 154 bp, Homo sapiens; identical to SEQ ID NO: 45900
  chr19:42373753-42373907
  hypo

SEQ ID NO: 66306 - DNA, 97 bp, Homo sapiens
  chr19:42408203-42408300
  hypo
gaagaaattggtccacgagggcccactgacgtggcgggtgactaaggacaaggcagtgggtgagtgccagagcagctgcctagtgcagggtgttggg

SEQ ID NO: 66307 - DNA, 364 bp, Homo sapiens
  chr19:42408330-42408694
  hypo
gcgggggcacgccgtgtgagcactgctcgccccgtagaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccggtgagtgcagccactgcatggcccagggcagagggtgtcttttttgggcagagctgcctgtggagtggggagcagaaccctctagagagccagggagccagcattctagcaaagaggttgagaagtaggtggaggtgggcagggcggggccaggcctag

SEQ ID NO: 66308 - DNA, 30 bp, Homo sapiens; identical to SEQ ID NO: 45902
  chr19:42507833-42507863
  hypo

SEQ ID NO: 66309 - DNA, 34 bp, Homo sapiens; identical to SEQ ID NO: 45903
  chr19:42579050-42579084
  hypo

SEQ ID NO: 66310 - DNA, 43 bp, Homo sapiens; identical to SEQ ID NO: 45904
  chr19:42697082-42697125
  hypo

SEQ ID NO: 66311 - DNA, 71 bp, Homo sapiens; identical to SEQ ID NO: 45905
  chr19:42722668-42722739
  hypo

SEQ ID NO: 66312 - DNA, 41 bp, Homo sapiens; identical to SEQ ID NO: 45906
  chr19:42907251-42907292
  hypo

SEQ ID NO: 66313 - DNA, 30 bp, Homo sapiens; identical to SEQ ID NO: 45909
  chr19:45279887-45279917
  hypo

SEQ ID NO: 66314 - DNA, 33 bp, Homo sapiens; identical to SEQ ID NO: 16517
  chr19:45381918-45381951
  hypo

SEQ ID NO: 66315 - DNA, 15 bp, Homo sapiens
  chr19:45570386-45570401
  hypo
tgagtgtatctagag

SEQ ID NO: 66316 - DNA, 43 bp, Homo sapiens
  chr19:45570450-45570493
  hypo
tggagggagagtagcaggagaggagagtcgagcctgtcaccct

SEQ ID NO: 66317 - DNA, 205 bp, Homo sapiens
  chr19:45574495-45574700
  hypo
cacatgggcccctttgcccagggcctctggcgacaggtccgggcctctccccgccctcgcctcagcccctgccctggcctcgcccgcactaggaactgggagcgcagctttctgtgccagtcctgctgcgccccaggcactgggggctggccgttccctcaccccctcactccaaaccggtctgtccagccgtccaccccacgga

SEQ ID NO: 66318 - DNA, 38 bp, Homo sapiens; identical to SEQ ID NO: 45913
  chr19:45575118-45575156
  hypo

SEQ ID NO: 66319 - DNA, 30 bp, Homo sapiens; identical to SEQ ID NO: 45914
  chr19:45601584-45601614
  hypo

SEQ ID NO: 66320 - DNA, 30 bp, Homo sapiens; identical to SEQ ID NO: 45915
  chr19:45616778-45616808
  hypo

SEQ ID NO: 66321 - DNA, 30 bp, Homo sapiens; identical to SEQ ID NO: 16518
  chr19:45626698-45626728
  hypo

SEQ ID NO: 66322 - DNA, 30 bp, Homo sapiens; identical to SEQ ID NO: 45917
  chr19:45627017-45627047
  hypo

SEQ ID NO: 66323 - DNA, 30 bp, Homo sapiens; identical to SEQ ID NO: 16519
  chr19:45709152-45709182
  hypo

SEQ ID NO: 66324 - DNA, 30 bp, Homo sapiens; identical to SEQ ID NO: 45919
  chr19:45751388-45751418
  hypo

SEQ ID NO: 66325 - DNA, 99 bp, Homo sapiens
  chr19:45810003-45810102
  hypo
gcgcctacttctgggcggggatcatgtcgtcaatggactggcctttctccaacttcttctccatttccaccatgagcttcacaccatccaccaccagct

SEQ ID NO: 66326 - DNA, 92 bp, Homo sapiens; identical to SEQ ID NO: 45921
  chr19:45810770-45810862
  hypo

SEQ ID NO: 66327 - DNA, 201 bp, Homo sapiens; identical to SEQ ID NO: 45923
  chr19:45851193-45851394
  hypo

SEQ ID NO: 66328 - DNA, 112 bp, Homo sapiens
  chr19:45997416-45997528
  hypo
tgcttacctagaaggcgtggctccaccgtgaattctaattggtccgtgctatcgaggcactgtccccttactggctctcgctccagtggcccccactgcttttcttcctctt

SEQ ID NO: 66329 - DNA, 67 bp, Homo sapiens
  chr19:45997584-45997651
  hypo
gtaccggcctggggtgtcccagagcccggactgagctggggagtcaagacctcgggcgatgagggct

SEQ ID NO: 66330 - DNA, 17 bp, Homo sapiens
  chr19:46144063-46144080
  hypo
tccgcctcccaaactgc

SEQ ID NO: 66331 - DNA, 112 bp, Homo sapiens
  chr19:46234887-46234999
  hypo
tacctcctgatttacaaatgagaaaattaagccttaggaggaaggaaagtcccatacattaggagttagtccacatcatagaatagcagctccacatcgctcgagcccagga

SEQ ID NO: 66332 - DNA, 30 bp, Homo sapiens; identical to SEQ ID NO: 45927
  chr19:46269160-46269190
  hypo

SEQ ID NO: 66333 - DNA, 64 bp, Homo sapiens; identical to SEQ ID NO: 45928
  chr19:46321335-46321399
  hypo

SEQ ID NO: 66334 - DNA, 121 bp, Homo sapiens; identical to SEQ ID NO: 45929
  chr19:46327091-46327212
  hypo

SEQ ID NO: 66335 - DNA, 30 bp, Homo sapiens; identical to SEQ ID NO: 45930
  chr19:46346873-46346903
  hypo

SEQ ID NO: 66336 - DNA, 95 bp, Homo sapiens; identical to SEQ ID NO: 45931
  chr19:46356540-46356635
  hypo

SEQ ID NO: 66337 - DNA, 46 bp, Homo sapiens
  chr19:46404601-46404647
  hypo
gctgtgaagagggggccgcagggggctcctccgccccagcacctgc

SEQ ID NO: 66338 - DNA, 39 bp, Homo sapiens; identical to SEQ ID NO: 45933
  chr19:46811882-46811921
  hypo

SEQ ID NO: 66339 - DNA, 30 bp, Homo sapiens; identical to SEQ ID NO: 45934
  chr19:47116936-47116966
  hypo

SEQ ID NO: 66340 - DNA, 29 bp, Homo sapiens
  chr19:47200536-47200565
  hypo
cccagtccctatcccgtggagctgcttgg

SEQ ID NO: 66341 - DNA, 37 bp, Homo sapiens; identical to SEQ ID NO: 45936
  chr19:47284561-47284598
  hypo

SEQ ID NO: 66342 - DNA, 44 bp, Homo sapiens; identical to SEQ ID NO: 16528
  chr19:47429440-47429484
  hypo

SEQ ID NO: 66343 - DNA, 30 bp, Homo sapiens; identical to SEQ ID NO: 45938
  chr19:47593170-47593200
  hypo

SEQ ID NO: 66344 - DNA, 30 bp, Homo sapiens; identical to SEQ ID NO: 45939
  chr19:47633375-47633405
  hypo

SEQ ID NO: 66345 - DNA, 30 bp, Homo sapiens; identical to SEQ ID NO: 45940
  chr19:47783598-47783628
  hypo

SEQ ID NO: 66346 - DNA, 30 bp, Homo sapiens; identical to SEQ ID NO: 45941
  chr19:47847634-47847664
  hypo

SEQ ID NO: 66347 - DNA, 23 bp, Homo sapiens
  chr19:47864411-47864434
  hypo
atgacaatggcaggccgtcccgg

SEQ ID NO: 66348 - DNA, 47 bp, Homo sapiens; identical to SEQ ID NO: 45943
  chr19:47986518-47986565
  hypo

SEQ ID NO: 66349 - DNA, 42 bp, Homo sapiens; identical to SEQ ID NO: 16529
  chr19:48003498-48003540
  hypo

SEQ ID NO: 66350 - DNA, 32 bp, Homo sapiens; identical to SEQ ID NO: 45945
  chr19:48003977-48004009
  hypo

SEQ ID NO: 66351 - DNA, 41 bp, Homo sapiens; identical to SEQ ID NO: 45946
  chr19:48106984-48107025
  hypo

SEQ ID NO: 66352 - DNA, 30 bp, Homo sapiens; identical to SEQ ID NO: 45947
  chr19:48137321-48137351
  hypo

SEQ ID NO: 66353 - DNA, 74 bp, Homo sapiens
  chr19:48151337-48151411
  hypo
cgtctccctgttttcctgttaccgtctccccgtccctctctctgtctctctgaactgctcgttccctccttgcc

SEQ ID NO: 66354 - DNA, 34 bp, Homo sapiens; identical to SEQ ID NO: 45949
  chr19:48237374-48237408
  hypo

SEQ ID NO: 66355 - DNA, 25 bp, Homo sapiens
  chr19:48293267-48293292
  hypo
tcactgtgcccggccacacaggcgt

SEQ ID NO: 66356 - DNA, 30 bp, Homo sapiens; identical to SEQ ID NO: 45951
  chr19:48586347-48586377
  hypo

SEQ ID NO: 66357 - DNA, 13 bp, Homo sapiens
  chr19:48614830-48614843
  hypo
aagcccagcacta

SEQ ID NO: 66358 - DNA, 54 bp, Homo sapiens; identical to SEQ ID NO: 45953
  chr19:48775999-48776053
  hypo

SEQ ID NO: 66359 - DNA, 74 bp, Homo sapiens
  chr19:48800769-48800843
  hypo
ctccacctgcagggaaggtgaactgggccccgacacacactgaggcctggccccacccccgcaggccccactct

SEQ ID NO: 66360 - DNA, 39 bp, Homo sapiens; identical to SEQ ID NO: 45955
  chr19:48806604-48806643
  hypo

SEQ ID NO: 66361 - DNA, 16 bp, Homo sapiens
  chr19:48834248-48834264
  hypo
tggagtgcagtggtac

SEQ ID NO: 66362 - DNA, 30 bp, Homo sapiens; identical to SEQ ID NO: 45957
  chr19:48844484-48844514
  hypo

SEQ ID NO: 66363 - DNA, 40 bp, Homo sapiens; identical to SEQ ID NO: 45958
  chr19:48902532-48902572
  hypo

SEQ ID NO: 66364 - DNA, 202 bp, Homo sapiens
  chr19:49119027-49119229
  hypo
tggggctggctggtacgagggataggagaagcagcccaagtgtggccaggcctggccctgcaggctgagtctggggagagggcagggctgggggcctgatactcacttggtgtggctgtgcggggttcctggggccttgccgaaatgccggtacacctctcggcccttgcgaggacctagggaaggggaaggagaaccgggt

SEQ ID NO: 66365 - DNA, 142 bp, Homo sapiens
  chr19:49119259-49119401
  hypo
ctcccagatccaggagggtgaaggctgccagtagccacacagctcagtccaaacccgtcgaccacgtatcactcaccggagagcaggacagtgccacagcccttaggggagtccagggccagctggtcgaaagtgaggatct

SEQ ID NO: 66366 - DNA, 23 bp, Homo sapiens
  chr19:49266813-49266836
  hypo
cgagactccgtctatttaaaaaa

SEQ ID NO: 66367 - DNA, 76 bp, Homo sapiens; identical to SEQ ID NO: 45962
  chr19:49328490-49328566
  hypo

SEQ ID NO: 66368 - DNA, 44 bp, Homo sapiens; identical to SEQ ID NO: 45963
  chr19:49402394-49402438
  hypo

SEQ ID NO: 66369 - DNA, 38 bp, Homo sapiens; identical to SEQ ID NO: 45964
  chr19:49463885-49463923
  hypo

SEQ ID NO: 66370 - DNA, 30 bp, Homo sapiens; identical to SEQ ID NO: 45965
  chr19:49482126-49482156
  hypo

SEQ ID NO: 66371 - DNA, 45 bp, Homo sapiens; identical to SEQ ID NO: 45966
  chr19:49541866-49541911
  hypo

SEQ ID NO: 66372 - DNA, 30 bp, Homo sapiens; identical to SEQ ID NO: 45967
  chr19:49553727-49553757
  hypo

SEQ ID NO: 66373 - DNA, 30 bp, Homo sapiens; identical to SEQ ID NO: 45968
  chr19:49703569-49703599
  hypo

SEQ ID NO: 66374 - DNA, 41 bp, Homo sapiens; identical to SEQ ID NO: 45970
  chr19:49971866-49971907
  hypo

SEQ ID NO: 66375 - DNA, 18 bp, Homo sapiens
  chr19:49997380-49997398
  hypo
gcccggccaatttttttt

SEQ ID NO: 66376 - DNA, 21 bp, Homo sapiens
  chr19:50050812-50050833
  hypo
tttttttttggaagacgaatc

SEQ ID NO: 66377 - DNA, 20 bp, Homo sapiens
  chr19:50053089-50053109
  hypo
atccacactgtagcccgtgt

SEQ ID NO: 66378 - DNA, 205 bp, Homo sapiens; identical to SEQ ID NO: 45975
  chr19:50166617-50166822
  hypo

SEQ ID NO: 66379 - DNA, 130 bp, Homo sapiens; identical to SEQ ID NO: 45976
  chr19:50216075-50216205
  hypo

SEQ ID NO: 66380 - DNA, 174 bp, Homo sapiens; identical to SEQ ID NO: 45977
  chr19:50216693-50216867
  hypo

SEQ ID NO: 66381 - DNA, 30 bp, Homo sapiens; identical to SEQ ID NO: 45978
  chr19:50292243-50292273
  hypo

SEQ ID NO: 66382 - DNA, 30 bp, Homo sapiens; identical to SEQ ID NO: 45979
  chr19:50306672-50306702
  hypo

SEQ ID NO: 66383 - DNA, 120 bp, Homo sapiens; identical to SEQ ID NO: 45980
  chr19:50319641-50319761
  hypo

SEQ ID NO: 66384 - DNA, 45 bp, Homo sapiens; identical to SEQ ID NO: 45981
  chr19:50331949-50331994
  hypo

SEQ ID NO: 66385 - DNA, 242 bp, Homo sapiens
  chr19:50353152-50353394
  hypo
aacactgatgactcccgaatttctctctccaggctatgacatcaatatctatctacattgtttagtcaacatccgaaacagaagtagggactccgtctctaacctcctacagctgtgtctatttctcctctctaccttcactcgactccgcccacactggctcccttttattccttctactttcaggatttgtctttgctgttctgtcctctttgcacacttttccagccatctggaatggc

SEQ ID NO: 66386 - DNA, 4 bp, Homo sapiens
  chr19:50353574-50353578
  hypo
acag

SEQ ID NO: 66387 - DNA, 30 bp, Homo sapiens; identical to SEQ ID NO: 45983
  chr19:50362485-50362515
  hypo

SEQ ID NO: 66388 - DNA, 254 bp, Homo sapiens; identical to SEQ ID NO: 45984
  chr19:50364908-50365162
  hypo

SEQ ID NO: 66389 - DNA, 45 bp, Homo sapiens; identical to SEQ ID NO: 45985
  chr19:50395086-50395131
  hypo

SEQ ID NO: 66390 - DNA, 51 bp, Homo sapiens; identical to SEQ ID NO: 45986
  chr19:50481531-50481582
  hypo

SEQ ID NO: 66391 - DNA, 212 bp, Homo sapiens; identical to SEQ ID NO: 45987
  chr19:50919863-50920075
  hypo

SEQ ID NO: 66392 - DNA, 95 bp, Homo sapiens; identical to SEQ ID NO: 45988
  chr19:50926491-50926586
  hypo

SEQ ID NO: 66393 - DNA, 21 bp, Homo sapiens
  chr19:50938691-50938712
  hypo
gcccctcggctggcatcggct

SEQ ID NO: 66394 - DNA, 44 bp, Homo sapiens; identical to SEQ ID NO: 45990
  chr19:50947800-50947844
  hypo

SEQ ID NO: 66395 - DNA, 74 bp, Homo sapiens; identical to SEQ ID NO: 45991
  chr19:50967770-50967844
  hypo

SEQ ID NO: 66396 - DNA, 35 bp, Homo sapiens; identical to SEQ ID NO: 45992
  chr19:51022774-51022809
  hypo

SEQ ID NO: 66397 - DNA, 58 bp, Homo sapiens; identical to SEQ ID NO: 45993
  chr19:51046474-51046532
  hypo

SEQ ID NO: 66398 - DNA, 33 bp, Homo sapiens; identical to SEQ ID NO: 45994
  chr19:51128766-51128799
  hypo

SEQ ID NO: 66399 - DNA, 82 bp, Homo sapiens; identical to SEQ ID NO: 45995
  chr19:51203231-51203313
  hypo

SEQ ID NO: 66400 - DNA, 48 bp, Homo sapiens; identical to SEQ ID NO: 45997
  chr19:51340799-51340847
  hypo

SEQ ID NO: 66401 - DNA, 30 bp, Homo sapiens; identical to SEQ ID NO: 45998
  chr19:51684708-51684738
  hypo

SEQ ID NO: 66402 - DNA, 30 bp, Homo sapiens; identical to SEQ ID NO: 45999
  chr19:51715131-51715161
  hypo

SEQ ID NO: 66403 - DNA, 40 bp, Homo sapiens; identical to SEQ ID NO: 46000
  chr19:51754542-51754582
  hypo

SEQ ID NO: 66404 - DNA, 41 bp, Homo sapiens; identical to SEQ ID NO: 46001
  chr19:52086376-52086417
  hypo

SEQ ID NO: 66405 - DNA, 30 bp, Homo sapiens; identical to SEQ ID NO: 46002
  chr19:52091303-52091333
  hypo

SEQ ID NO: 66406 - DNA, 82 bp, Homo sapiens; identical to SEQ ID NO: 46003
  chr19:52248361-52248443
  hypo

SEQ ID NO: 66407 - DNA, 23 bp, Homo sapiens
  chr19:52512149-52512172
  hypo
ggttgggaaagaggccgggcgcg

SEQ ID NO: 66408 - DNA, 137 bp, Homo sapiens; identical to SEQ ID NO: 46005
  chr19:52780320-52780457
  hypo

SEQ ID NO: 66409 - DNA, 149 bp, Homo sapiens; identical to SEQ ID NO: 46006
  chr19:52893581-52893730
  hypo

SEQ ID NO: 66410 - DNA, 25 bp, Homo sapiens
  chr19:52983447-52983472
  hypo
cgtgcccagtcgattatgaatctta

SEQ ID NO: 66411 - DNA, 39 bp, Homo sapiens; identical to SEQ ID NO: 46009
  chr19:53105829-53105868
  hypo

SEQ ID NO: 66412 - DNA, 76 bp, Homo sapiens; identical to SEQ ID NO: 46010
  chr19:53148247-53148323
  hypo

SEQ ID NO: 66413 - DNA, 30 bp, Homo sapiens; identical to SEQ ID NO: 46011
  chr19:53225425-53225455
  hypo

SEQ ID NO: 66414 - DNA, 30 bp, Homo sapiens; identical to SEQ ID NO: 46012
  chr19:53299504-53299534
  hypo

SEQ ID NO: 66415 - DNA, 30 bp, Homo sapiens; identical to SEQ ID NO: 46013
  chr19:53387507-53387537
  hypo

SEQ ID NO: 66416 - DNA, 30 bp, Homo sapiens; identical to SEQ ID NO: 46014
  chr19:53412458-53412488
  hypo

SEQ ID NO: 66417 - DNA, 24 bp, Homo sapiens
  chr19:53429320-53429344
  hypo
ataagaagggacaatcggccaggt

SEQ ID NO: 66418 - DNA, 41 bp, Homo sapiens; identical to SEQ ID NO: 46016
  chr19:53702028-53702069
  hypo

SEQ ID NO: 66419 - DNA, 23 bp, Homo sapiens
  chr19:53728478-53728501
  hypo
ttacccatgtggggccgggtgcg

SEQ ID NO: 66420 - DNA, 38 bp, Homo sapiens; identical to SEQ ID NO: 46018
  chr19:53965321-53965359
  hypo

SEQ ID NO: 66421 - DNA, 114 bp, Homo sapiens; identical to SEQ ID NO: 46019
  chr19:54033275-54033389
  hypo

SEQ ID NO: 66422 - DNA, 21 bp, Homo sapiens
  chr19:54039855-54039876
  hypo
tttaaaaattattctcgactg

SEQ ID NO: 66423 - DNA, 30 bp, Homo sapiens; identical to SEQ ID NO: 46021
  chr19:54046025-54046055
  hypo

SEQ ID NO: 66424 - DNA, 39 bp, Homo sapiens; identical to SEQ ID NO: 46022
  chr19:54314338-54314377
  hypo

SEQ ID NO: 66425 - DNA, 126 bp, Homo sapiens; identical to SEQ ID NO: 46023
  chr19:54403466-54403592
  hypo

SEQ ID NO: 66426 - DNA, 44 bp, Homo sapiens; identical to SEQ ID NO: 46024
  chr19:55645710-55645754
  hypo

SEQ ID NO: 66427 - DNA, 16 bp, Homo sapiens
  chr19:55727832-55727848
  hypo
gcgattagatcattga

SEQ ID NO: 66428 - DNA, 30 bp, Homo sapiens; identical to SEQ ID NO: 46026
  chr19:55798634-55798664
  hypo

SEQ ID NO: 66429 - DNA, 58 bp, Homo sapiens; identical to SEQ ID NO: 46027
  chr19:55853009-55853067
  hypo

SEQ ID NO: 66430 - DNA, 30 bp, Homo sapiens; identical to SEQ ID NO: 46028
  chr19:55912333-55912363
  hypo

SEQ ID NO: 66431 - DNA, 30 bp, Homo sapiens; identical to SEQ ID NO: 46029
  chr19:55927698-55927728
  hypo

SEQ ID NO: 66432 - DNA, 54 bp, Homo sapiens; identical to SEQ ID NO: 46030
  chr19:55976843-55976897
  hypo

SEQ ID NO: 66433 - DNA, 30 bp, Homo sapiens; identical to SEQ ID NO: 46031
  chr19:55982821-55982851
  hypo

SEQ ID NO: 66434 - DNA, 39 bp, Homo sapiens; identical to SEQ ID NO: 46032
  chr19:56179648-56179687
  hypo

SEQ ID NO: 66435 - DNA, 79 bp, Homo sapiens; identical to SEQ ID NO: 46033
  chr19:56181818-56181897
  hypo

SEQ ID NO: 66436 - DNA, 100 bp, Homo sapiens; identical to SEQ ID NO: 46034
  chr19:56200496-56200596
  hypo

SEQ ID NO: 66437 - DNA, 51 bp, Homo sapiens; identical to SEQ ID NO: 46035
  chr19:56205745-56205796
  hypo

SEQ ID NO: 66438 - DNA, 34 bp, Homo sapiens; identical to SEQ ID NO: 46036
  chr19:56354394-56354428
  hypo

SEQ ID NO: 66439 - DNA, 84 bp, Homo sapiens; identical to SEQ ID NO: 46037
  chr19:56539038-56539122
  hypo

SEQ ID NO: 66440 - DNA, 30 bp, Homo sapiens; identical to SEQ ID NO: 46038
  chr19:56543855-56543885
  hypo

SEQ ID NO: 66441 - DNA, 30 bp, Homo sapiens; identical to SEQ ID NO: 46039
  chr19:56603841-56603871
  hypo

SEQ ID NO: 66442 - DNA, 52 bp, Homo sapiens; identical to SEQ ID NO: 46040
  chr19:56617216-56617268
  hypo

SEQ ID NO: 66443 - DNA, 40 bp, Homo sapiens; identical to SEQ ID NO: 46041
  chr19:56686390-56686430
  hypo

SEQ ID NO: 66444 - DNA, 35 bp, Homo sapiens; identical to SEQ ID NO: 46042
  chr19:56688387-56688422
  hypo

SEQ ID NO: 66445 - DNA, 30 bp, Homo sapiens; identical to SEQ ID NO: 46043
  chr19:56727704-56727734
  hypo

SEQ ID NO: 66446 - DNA, 35 bp, Homo sapiens; identical to SEQ ID NO: 46044
  chr19:56987547-56987582
  hypo

SEQ ID NO: 66447 - DNA, 30 bp, Homo sapiens; identical to SEQ ID NO: 46045
  chr19:57334846-57334876
  hypo

SEQ ID NO: 66448 - DNA, 30 bp, Homo sapiens; identical to SEQ ID NO: 46046
  chr19:57399477-57399507
  hypo

SEQ ID NO: 66449 - DNA, 30 bp, Homo sapiens; identical to SEQ ID NO: 46047
  chr19:57477131-57477161
  hypo

SEQ ID NO: 66450 - DNA, 49 bp, Homo sapiens; identical to SEQ ID NO: 46048
  chr19:57491242-57491291
  hypo

SEQ ID NO: 66451 - DNA, 18 bp, Homo sapiens
  chr19:58032743-58032761
  hypo
ctccgtctcaaaaaaaaa

SEQ ID NO: 66452 - DNA, 130 bp, Homo sapiens; identical to SEQ ID NO: 46050
  chr19:58046095-58046225
  hypo

SEQ ID NO: 66453 - DNA, 179 bp, Homo sapiens; identical to SEQ ID NO: 46051
  chr19:58101908-58102087
  hypo

SEQ ID NO: 66454 - DNA, 30 bp, Homo sapiens; identical to SEQ ID NO: 46052
  chr19:58233563-58233593
  hypo

SEQ ID NO: 66455 - DNA, 30 bp, Homo sapiens; identical to SEQ ID NO: 46053
  chr19:58438364-58438394
  hypo

SEQ ID NO: 66456 - DNA, 30 bp, Homo sapiens; identical to SEQ ID NO: 46054
  chr19:58447467-58447497
  hypo

SEQ ID NO: 66457 - DNA, 30 bp, Homo sapiens; identical to SEQ ID NO: 46055
  chr19:58448066-58448096
  hypo

SEQ ID NO: 66458 - DNA, 190 bp, Homo sapiens; identical to SEQ ID NO: 46056
  chr19:58457382-58457572
  hypo

SEQ ID NO: 66459 - DNA, 30 bp, Homo sapiens; identical to SEQ ID NO: 46057
  chr19:58512170-58512200
  hypo

SEQ ID NO: 66460 - DNA, 75 bp, Homo sapiens; identical to SEQ ID NO: 46058
  chr19:58517427-58517502
  hypo

SEQ ID NO: 66461 - DNA, 41 bp, Homo sapiens; identical to SEQ ID NO: 46059
  chr19:58536175-58536216
  hypo

SEQ ID NO: 66462 - DNA, 157 bp, Homo sapiens; identical to SEQ ID NO: 46060
  chr19:58836900-58837057
  hypo

SEQ ID NO: 66463 - DNA, 75 bp, Homo sapiens; identical to SEQ ID NO: 46062
  chr19:58891154-58891229
  hypo

SEQ ID NO: 66464 - DNA, 2 bp, Homo sapiens
  chr19:58964266-58964268
  hypo
ca

SEQ ID NO: 66465 - DNA, 20 bp, Homo sapiens
  chr20:277026-277046
  hypo
gctaccggccgggcgcggtg

SEQ ID NO: 66466 - DNA, 68 bp, Homo sapiens
  chr20:399939-400007
  hypo
gtggaccaagtgggccgcgtggaaccaccaccctttaaccctcctccacagatctgggcttcaaggac

SEQ ID NO: 66467 - DNA, 38 bp, Homo sapiens
  chr20:400087-400125
  hypo
agatgcagtgcctgagcccccaccggtaagctgtcctt

SEQ ID NO: 66468 - DNA, 104 bp, Homo sapiens
  chr20:401049-401153
  hypo
ccccactcctgttcccgtctcagctcctcggcttcgtcacttccccacccctgacgttgagtggctccaccagccctggcccgggccctgccctgctacctgac

SEQ ID NO: 66469 - DNA, 408 bp, Homo sapiens
  chr20:401183-401591
  hypo
ccttgctgccattgctgtctcacctggcgccttccgtggctacctggccggcctcccctcccttggcttccccacctccacctggcctcactcccagccccgcccctcccaacctgcctgctcctgcccatcccccaccccccaccccccatcccccagccccacccccatcccccacccccgtcccccatcccccatccctactggctcccagctttgcctgtggctggtctgacccagccctgaccacgccccctggcccttcccccttcggggtctgacccgcccccgaggccctgacccgccccgtggccccgccccgtgtgcccagcggaagcagcagcagcaggaggggaactacctgcagcacgtccagctggaccagaggagcctggtgctgaacacgga

SEQ ID NO: 66470 - DNA, 415 bp, Homo sapiens
  chr20:401756-402171
  hypo
gtgctctgatacctcattggacgcccgcgaaaacctacgaggtaggctccgtctccccatgttgcggacgaggaacctgagggaaagagaggcccagcgccttaccccaggcccacggctcatgagagaagcagcctagacgtgagcgcaggcgtggggggagactcccttcccctctacctttcgccgcccgggctcctgcagccacgctgctctcagcctcgctgtgggcatctgccagtttctgagtctcctgtcatggcccccccacccctgaatgtggggaacacagacccgctcaccacagcggacccttgtggagccgcccctgggtgacaggctccgtgcctgcctcctgcagcttacattccagcagagaggctgatgagaatcggataatcgctggttgatgtct

SEQ ID NO: 66471 - DNA, 143 bp, Homo sapiens; identical to SEQ ID NO: 46067
  chr20:741900-742043
  hypo

SEQ ID NO: 66472 - DNA, 27 bp, Homo sapiens
  chr20:799706-799733
  hypo
gagccaccgcgccgggcccagcttctg

SEQ ID NO: 66473 - DNA, 41 bp, Homo sapiens; identical to SEQ ID NO: 16556
  chr20:1323452-1323493
  hypo

SEQ ID NO: 66474 - DNA, 30 bp, Homo sapiens; identical to SEQ ID NO: 16557
  chr20:1692274-1692304
  hypo

SEQ ID NO: 66475 - DNA, 30 bp, Homo sapiens; identical to SEQ ID NO: 46072
  chr20:2058766-2058796
  hypo

SEQ ID NO: 66476 - DNA, 147 bp, Homo sapiens; identical to SEQ ID NO: 5237
  chr20:2113428-2113575
  hypo

SEQ ID NO: 66477 - DNA, 41 bp, Homo sapiens; identical to SEQ ID NO: 46074
  chr20:2444391-2444432
  hypo

SEQ ID NO: 66478 - DNA, 32 bp, Homo sapiens; identical to SEQ ID NO: 16560
  chr20:2645508-2645540
  hypo

SEQ ID NO: 66479 - DNA, 30 bp, Homo sapiens; identical to SEQ ID NO: 46076
  chr20:3001373-3001403
  hypo

SEQ ID NO: 66480 - DNA, 30 bp, Homo sapiens; identical to SEQ ID NO: 46078
  chr20:3202086-3202116
  hypo

SEQ ID NO: 66481 - DNA, 91 bp, Homo sapiens; identical to SEQ ID NO: 16562
  chr20:3202418-3202509
  hypo

SEQ ID NO: 66482 - DNA, 23 bp, Homo sapiens
  chr20:3204952-3204975
  hypo
atgccacacgcccttactctgtg

SEQ ID NO: 66483 - DNA, 30 bp, Homo sapiens; identical to SEQ ID NO: 46081
  chr20:3729991-3730021
  hypo

SEQ ID NO: 66484 - DNA, 30 bp, Homo sapiens; identical to SEQ ID NO: 16564
  chr20:3763473-3763503
  hypo

SEQ ID NO: 66485 - DNA, 34 bp, Homo sapiens; identical to SEQ ID NO: 46083
  chr20:3764967-3765001
  hypo

SEQ ID NO: 66486 - DNA, 105 bp, Homo sapiens; identical to SEQ ID NO: 16565
  chr20:3820924-3821029
  hypo

SEQ ID NO: 66487 - DNA, 17 bp, Homo sapiens
  chr20:4657798-4657815
  hypo
tccgtctaaaaaaaaaa

SEQ ID NO: 66488 - DNA, 30 bp, Homo sapiens; identical to SEQ ID NO: 46086
  chr20:4677123-4677153
  hypo

SEQ ID NO: 66489 - DNA, 76 bp, Homo sapiens; identical to SEQ ID NO: 46087
  chr20:4690696-4690772
  hypo

SEQ ID NO: 66490 - DNA, 30 bp, Homo sapiens; identical to SEQ ID NO: 46088
  chr20:4749380-4749410
  hypo

SEQ ID NO: 66491 - DNA, 48 bp, Homo sapiens; identical to SEQ ID NO: 46089
  chr20:5762556-5762604
  hypo

SEQ ID NO: 66492 - DNA, 30 bp, Homo sapiens; identical to SEQ ID NO: 46090
  chr20:10641102-10641132
  hypo

SEQ ID NO: 66493 - DNA, 207 bp, Homo sapiens; identical to SEQ ID NO: 46091
  chr20:13243380-13243587
  hypo

SEQ ID NO: 66494 - DNA, 142 bp, Homo sapiens; identical to SEQ ID NO: 46092
  chr20:16554594-16554736
  hypo

SEQ ID NO: 66495 - DNA, 142 bp, Homo sapiens; identical to SEQ ID NO: 46093
  chr20:16555036-16555178
  hypo

SEQ ID NO: 66496 - DNA, 179 bp, Homo sapiens; identical to SEQ ID NO: 46094
  chr20:17482564-17482743
  hypo

SEQ ID NO: 66497 - DNA, 30 bp, Homo sapiens; identical to SEQ ID NO: 46095
  chr20:17702368-17702398
  hypo

SEQ ID NO: 66498 - DNA, 154 bp, Homo sapiens; identical to SEQ ID NO: 46096
  chr20:18233341-18233495
  hypo

SEQ ID NO: 66499 - DNA, 196 bp, Homo sapiens
  chr20:18489658-18489854
  hypo
ccggccgccagtgccttttaataaagaacgttttgagagagagacggttatttaatgaaatctgctgacatacttgctgagagttgtgatagaacttgctttcattccgactttagttatccctttgcttcccatgaagctccagagtgcttcctgtgcacacagtgcttcaggttcttgccgttgccagaaataa

SEQ ID NO: 66500 - DNA, 197 bp, Homo sapiens; identical to SEQ ID NO: 46098
  chr20:19080645-19080842
  hypo

SEQ ID NO: 66501 - DNA, 40 bp, Homo sapiens; identical to SEQ ID NO: 46099
  chr20:19674013-19674053
  hypo

SEQ ID NO: 66502 - DNA, 30 bp, Homo sapiens; identical to SEQ ID NO: 46101
  chr20:19961658-19961688
  hypo

SEQ ID NO: 66503 - DNA, 30 bp, Homo sapiens; identical to SEQ ID NO: 46102
  chr20:20376922-20376952
  hypo

SEQ ID NO: 66504 - DNA, 30 bp, Homo sapiens; identical to SEQ ID NO: 46103
  chr20:20377191-20377221
  hypo

SEQ ID NO: 66505 - DNA, 30 bp, Homo sapiens; identical to SEQ ID NO: 46104
  chr20:20421168-20421198
  hypo

SEQ ID NO: 66506 - DNA, 32 bp, Homo sapiens; identical to SEQ ID NO: 46105
  chr20:20914015-20914047
  hypo

SEQ ID NO: 66507 - DNA, 30 bp, Homo sapiens; identical to SEQ ID NO: 46106
  chr20:23117794-23117824
  hypo

SEQ ID NO: 66508 - DNA, 37 bp, Homo sapiens; identical to SEQ ID NO: 46107
  chr20:23138450-23138487
  hypo

SEQ ID NO: 66509 - DNA, 94 bp, Homo sapiens; identical to SEQ ID NO: 46108
  chr20:24467593-24467687
  hypo

SEQ ID NO: 66510 - DNA, 174 bp, Homo sapiens; identical to SEQ ID NO: 46109
  chr20:24523871-24524045
  hypo

SEQ ID NO: 66511 - DNA, 134 bp, Homo sapiens; identical to SEQ ID NO: 46110
  chr20:24571035-24571169
  hypo

SEQ ID NO: 66512 - DNA, 77 bp, Homo sapiens; identical to SEQ ID NO: 46111
  chr20:24571472-24571549
  hypo

SEQ ID NO: 66513 - DNA, 46 bp, Homo sapiens; identical to SEQ ID NO: 46112
  chr20:24872951-24872997
  hypo

SEQ ID NO: 66514 - DNA, 246 bp, Homo sapiens; identical to SEQ ID NO: 46113
  chr20:25028280-25028526
  hypo

SEQ ID NO: 66515 - DNA, 152 bp, Homo sapiens; identical to SEQ ID NO: 46114
  chr20:25230352-25230504
  hypo

SEQ ID NO: 66516 - DNA, 156 bp, Homo sapiens
  chr20:25230799-25230955
  hypo
attgtctaagtggcggatggcaaggacatagctctgccttcacattcaagggcatttccttggagctggaccaggactcagctctacaccttagggtgcccattggagtatttatgtataatcacatcctggagaggccagcgatgggctcaggga

SEQ ID NO: 66517 - DNA, 97 bp, Homo sapiens; identical to SEQ ID NO: 46116
  chr20:25251463-25251560
  hypo

SEQ ID NO: 66518 - DNA, 30 bp, Homo sapiens; identical to SEQ ID NO: 46117
  chr20:25603036-25603066
  hypo

SEQ ID NO: 66519 - DNA, 30 bp, Homo sapiens; identical to SEQ ID NO: 46118
  chr20:30022593-30022623
  hypo

SEQ ID NO: 66520 - DNA, 28 bp, Homo sapiens
  chr20:30134312-30134340
  hypo
ggaggctgaggcaggcggatgacttgag

SEQ ID NO: 66521 - DNA, 47 bp, Homo sapiens; identical to SEQ ID NO: 46121
  chr20:30153940-30153987
  hypo

SEQ ID NO: 66522 - DNA, 20 bp, Homo sapiens
  chr20:30181151-30181171
  hypo
cacatcgttgcttttgcatc

SEQ ID NO: 66523 - DNA, 30 bp, Homo sapiens; identical to SEQ ID NO: 46123
  chr20:30464460-30464490
  hypo

SEQ ID NO: 66524 - DNA, 33 bp, Homo sapiens; identical to SEQ ID NO: 46124
  chr20:30468280-30468313
  hypo

SEQ ID NO: 66525 - DNA, 51 bp, Homo sapiens; identical to SEQ ID NO: 46125
  chr20:30585053-30585104
  hypo

SEQ ID NO: 66526 - DNA, 30 bp, Homo sapiens; identical to SEQ ID NO: 46126
  chr20:30671697-30671727
  hypo

SEQ ID NO: 66527 - DNA, 30 bp, Homo sapiens; identical to SEQ ID NO: 46127
  chr20:30770464-30770494
  hypo

SEQ ID NO: 66528 - DNA, 153 bp, Homo sapiens; identical to SEQ ID NO: 5243
  chr20:30864866-30865019
  hypo

SEQ ID NO: 66529 - DNA, 48 bp, Homo sapiens; identical to SEQ ID NO: 46129
  chr20:31108565-31108613
  hypo

SEQ ID NO: 66530 - DNA, 66 bp, Homo sapiens
  chr20:31115617-31115683
  hypo
gctctccacatgcatcgagtagatgatgtcaaagaaatcttccaccacagcgacccgcttcagaga

SEQ ID NO: 66531 - DNA, 31 bp, Homo sapiens
  chr20:31115799-31115830
  hypo
ggacgggcaatgcctccgacagtgggtcttg

SEQ ID NO: 66532 - DNA, 30 bp, Homo sapiens; identical to SEQ ID NO: 46131
  chr20:31147343-31147373
  hypo

SEQ ID NO: 66533 - DNA, 30 bp, Homo sapiens; identical to SEQ ID NO: 46132
  chr20:31151622-31151652
  hypo

SEQ ID NO: 66534 - DNA, 159 bp, Homo sapiens; identical to SEQ ID NO: 46133
  chr20:31226664-31226823
  hypo

SEQ ID NO: 66535 - DNA, 30 bp, Homo sapiens; identical to SEQ ID NO: 46134
  chr20:31553994-31554024
  hypo

SEQ ID NO: 66536 - DNA, 30 bp, Homo sapiens; identical to SEQ ID NO: 46135
  chr20:31940171-31940201
  hypo

SEQ ID NO: 66537 - DNA, 223 bp, Homo sapiens; identical to SEQ ID NO: 46136
  chr20:32242529-32242752
  hypo

SEQ ID NO: 66538 - DNA, 30 bp, Homo sapiens; identical to SEQ ID NO: 46138
  chr20:32414088-32414118
  hypo

SEQ ID NO: 66539 - DNA, 116 bp, Homo sapiens
  chr20:32450427-32450543
  hypo
gacttcaggggcaaatgtacattgggaatctccaagggacatctcccaaactacctgaccagggtgtgggttccgccgaatatcttttgggaaacgctgtgcgggggtccctagag

SEQ ID NO: 66540 - DNA, 38 bp, Homo sapiens; identical to SEQ ID NO: 46140
  chr20:32459722-32459760
  hypo

SEQ ID NO: 66541 - DNA, 30 bp, Homo sapiens; identical to SEQ ID NO: 16581
  chr20:32524318-32524348
  hypo

SEQ ID NO: 66542 - DNA, 30 bp, Homo sapiens; identical to SEQ ID NO: 46142
  chr20:32950057-32950087
  hypo

SEQ ID NO: 66543 - DNA, 123 bp, Homo sapiens; identical to SEQ ID NO: 46143
  chr20:33134858-33134981
  hypo

SEQ ID NO: 66544 - DNA, 30 bp, Homo sapiens; identical to SEQ ID NO: 46144
  chr20:33137930-33137960
  hypo

SEQ ID NO: 66545 - DNA, 29 bp, Homo sapiens
  chr20:33290324-33290353
  hypo
ttatcactagagtgccgggcacggtggct

SEQ ID NO: 66546 - DNA, 30 bp, Homo sapiens; identical to SEQ ID NO: 16583
  chr20:33547626-33547656
  hypo

SEQ ID NO: 66547 - DNA, 30 bp, Homo sapiens; identical to SEQ ID NO: 46147
  chr20:33574865-33574895
  hypo

SEQ ID NO: 66548 - DNA, 45 bp, Homo sapiens; identical to SEQ ID NO: 46148
  chr20:33834734-33834779
  hypo

SEQ ID NO: 66549 - DNA, 41 bp, Homo sapiens; identical to SEQ ID NO: 46149
  chr20:33855099-33855140
  hypo

SEQ ID NO: 66550 - DNA, 30 bp, Homo sapiens; identical to SEQ ID NO: 16584
  chr20:33866905-33866935
  hypo

SEQ ID NO: 66551 - DNA, 244 bp, Homo sapiens; identical to SEQ ID NO: 46151
  chr20:33879984-33880228
  hypo

SEQ ID NO: 66552 - DNA, 30 bp, Homo sapiens; identical to SEQ ID NO: 46153
  chr20:34147200-34147230
  hypo

SEQ ID NO: 66553 - DNA, 42 bp, Homo sapiens
  chr20:34147978-34148020
  hypo
aagggtccagacctgcgccagacgctcacctcccgctccgtg

SEQ ID NO: 66554 - DNA, 63 bp, Homo sapiens; identical to SEQ ID NO: 46155
  chr20:34710619-34710682
  hypo

SEQ ID NO: 66555 - DNA, 131 bp, Homo sapiens; identical to SEQ ID NO: 46156
  chr20:35089026-35089157
  hypo

SEQ ID NO: 66556 - DNA, 256 bp, Homo sapiens; identical to SEQ ID NO: 46157
  chr20:35924156-35924412
  hypo

SEQ ID NO: 66557 - DNA, 33 bp, Homo sapiens; identical to SEQ ID NO: 46158
  chr20:36049828-36049861
  hypo

SEQ ID NO: 66558 - DNA, 39 bp, Homo sapiens; identical to SEQ ID NO: 16588
  chr20:36151122-36151161
  hypo

SEQ ID NO: 66559 - DNA, 35 bp, Homo sapiens; identical to SEQ ID NO: 46160
  chr20:36526859-36526894
  hypo

SEQ ID NO: 66560 - DNA, 96 bp, Homo sapiens; identical to SEQ ID NO: 46161
  chr20:36571234-36571330
  hypo

SEQ ID NO: 66561 - DNA, 30 bp, Homo sapiens; identical to SEQ ID NO: 46162
  chr20:36767887-36767917
  hypo

SEQ ID NO: 66562 - DNA, 63 bp, Homo sapiens; identical to SEQ ID NO: 46163
  chr20:36775268-36775331
  hypo

SEQ ID NO: 66563 - DNA, 40 bp, Homo sapiens; identical to SEQ ID NO: 46164
  chr20:39687444-39687484
  hypo

SEQ ID NO: 66564 - DNA, 30 bp, Homo sapiens; identical to SEQ ID NO: 46165
  chr20:40715181-40715211
  hypo

SEQ ID NO: 66565 - DNA, 107 bp, Homo sapiens; identical to SEQ ID NO: 46166
  chr20:42088631-42088738
  hypo

SEQ ID NO: 66566 - DNA, 143 bp, Homo sapiens; identical to SEQ ID NO: 46167
  chr20:42199155-42199298
  hypo

SEQ ID NO: 66567 - DNA, 30 bp, Homo sapiens; identical to SEQ ID NO: 25751
  chr20:42218664-42218694
  hypo

SEQ ID NO: 66568 - DNA, 30 bp, Homo sapiens; identical to SEQ ID NO: 46169
  chr20:42853157-42853187
  hypo

SEQ ID NO: 66569 - DNA, 128 bp, Homo sapiens; identical to SEQ ID NO: 16591
  chr20:43065628-43065756
  hypo

SEQ ID NO: 66570 - DNA, 113 bp, Homo sapiens; identical to SEQ ID NO: 46171
  chr20:43276908-43277021
  hypo

SEQ ID NO: 66571 - DNA, 37 bp, Homo sapiens; identical to SEQ ID NO: 46172
  chr20:43385586-43385623
  hypo

SEQ ID NO: 66572 - DNA, 31 bp, Homo sapiens; identical to SEQ ID NO: 46173
  chr20:43952328-43952359
  hypo

SEQ ID NO: 66573 - DNA, 40 bp, Homo sapiens; identical to SEQ ID NO: 46174
  chr20:44477901-44477941
  hypo

SEQ ID NO: 66574 - DNA, 30 bp, Homo sapiens; identical to SEQ ID NO: 46175
  chr20:44562147-44562177
  hypo

SEQ ID NO: 66575 - DNA, 40 bp, Homo sapiens; identical to SEQ ID NO: 46176
  chr20:44601506-44601546
  hypo

SEQ ID NO: 66576 - DNA, 288 bp, Homo sapiens
  chr20:44601786-44602074
  hypo
gcgacagagcgagaccctctttcaaaaaataaataaatacaagtcaactacctatcctttaaaagtggagaaagaaaaaaaattttaattaaaagtcagctgcccttaaggtatgtccttcctccggaaatgtcaccttctgttttaagacttttagcagtttgcagtggaagagcacaagagggagtaaggcgctctggtttttgtccctaagtctctgtagttccataggctattttccttaattgaaagatacaaattttgggggaaaaaaatctcaaaaaaact

SEQ ID NO: 66577 - DNA, 82 bp, Homo sapiens
  chr20:44602364-44602446
  hypo
caaacaaacaaacaaaaagtcctaaggagaagacctattaataaggagaaaaggtccgggctcggtgggtcacacctgtaat

SEQ ID NO: 66578 - DNA, 47 bp, Homo sapiens; identical to SEQ ID NO: 46179
  chr20:44756555-44756602
  hypo

SEQ ID NO: 66579 - DNA, 30 bp, Homo sapiens; identical to SEQ ID NO: 46180
  chr20:44845534-44845564
  hypo

SEQ ID NO: 66580 - DNA, 199 bp, Homo sapiens
  chr20:45337605-45337804
  hypo
tgcctaacccaccaccgtagtttaactttctgcctagtctttatcactagctgatatttctcaggatcctttagttacttctttttcgtcttcccctcctagaatgtaaactcttcccctcctagaaggtaaacaaaagacctgttctgttttgttcttcggcccatcccaagcctagcgtagtgcctggtatgtggtg

SEQ ID NO: 66581 - DNA, 76 bp, Homo sapiens; identical to SEQ ID NO: 25758
  chr20:45337945-45338021
  hypo

SEQ ID NO: 66582 - DNA, 30 bp, Homo sapiens; identical to SEQ ID NO: 46182
  chr20:45834171-45834201
  hypo

SEQ ID NO: 66583 - DNA, 32 bp, Homo sapiens; identical to SEQ ID NO: 46183
  chr20:45949151-45949183
  hypo

SEQ ID NO: 66584 - DNA, 30 bp, Homo sapiens; identical to SEQ ID NO: 46184
  chr20:45951653-45951683
  hypo

SEQ ID NO: 66585 - DNA, 146 bp, Homo sapiens; identical to SEQ ID NO: 46185
  chr20:46013515-46013661
  hypo

SEQ ID NO: 66586 - DNA, 30 bp, Homo sapiens; identical to SEQ ID NO: 46186
  chr20:46175625-46175655
  hypo

SEQ ID NO: 66587 - DNA, 30 bp, Homo sapiens; identical to SEQ ID NO: 46187
  chr20:46315525-46315555
  hypo

SEQ ID NO: 66588 - DNA, 36 bp, Homo sapiens; identical to SEQ ID NO: 46188
  chr20:46365599-46365635
  hypo

SEQ ID NO: 66589 - DNA, 30 bp, Homo sapiens; identical to SEQ ID NO: 46189
  chr20:46582135-46582165
  hypo

SEQ ID NO: 66590 - DNA, 30 bp, Homo sapiens; identical to SEQ ID NO: 46190
  chr20:46823521-46823551
  hypo

SEQ ID NO: 66591 - DNA, 30 bp, Homo sapiens; identical to SEQ ID NO: 46191
  chr20:47128746-47128776
  hypo

SEQ ID NO: 66592 - DNA, 38 bp, Homo sapiens; identical to SEQ ID NO: 25760
  chr20:47247201-47247239
  hypo

SEQ ID NO: 66593 - DNA, 36 bp, Homo sapiens; identical to SEQ ID NO: 46193
  chr20:47252955-47252991
  hypo

SEQ ID NO: 66594 - DNA, 36 bp, Homo sapiens; identical to SEQ ID NO: 46194
  chr20:47260725-47260761
  hypo

SEQ ID NO: 66595 - DNA, 182 bp, Homo sapiens; identical to SEQ ID NO: 46195
  chr20:47274120-47274302
  hypo

SEQ ID NO: 66596 - DNA, 30 bp, Homo sapiens; identical to SEQ ID NO: 46196
  chr20:47274646-47274676
  hypo

SEQ ID NO: 66597 - DNA, 133 bp, Homo sapiens
  chr20:47296231-47296364
  hypo
ccatcgtcgtagcggaagcgatacatcacctgctcattcttgaactggtgcttgtcggaaactggagagacaggaggacctgtgacgctgggcacgccccctcagcccctcccagccacgccccccagcattg

SEQ ID NO: 66598 - DNA, 184 bp, Homo sapiens; identical to SEQ ID NO: 16602
  chr20:47428537-47428721
  hypo

SEQ ID NO: 66599 - DNA, 118 bp, Homo sapiens; identical to SEQ ID NO: 46199
  chr20:47837088-47837206
  hypo

SEQ ID NO: 66600 - DNA, 76 bp, Homo sapiens
  chr20:47905350-47905426
  hypo
taaacattttgccaacgcaggtacaatatgggattcaataaaagtacagaattaaagttgtcttattagagattgg

SEQ ID NO: 66601 - DNA, 33 bp, Homo sapiens; identical to SEQ ID NO: 46201
  chr20:48252895-48252928
  hypo

SEQ ID NO: 66602 - DNA, 30 bp, Homo sapiens; identical to SEQ ID NO: 16604
  chr20:48477511-48477541
  hypo

SEQ ID NO: 66603 - DNA, 88 bp, Homo sapiens; identical to SEQ ID NO: 46203
  chr20:48673896-48673984
  hypo

SEQ ID NO: 66604 - DNA, 21 bp, Homo sapiens
  chr20:48720805-48720826
  hypo
agactccgtctcaaaaaaaaa

SEQ ID NO: 66605 - DNA, 154 bp, Homo sapiens; identical to SEQ ID NO: 46205
  chr20:48767027-48767181
  hypo

SEQ ID NO: 66606 - DNA, 25 bp, Homo sapiens
  chr20:48771341-48771366
  hypo
ttccatacaggcagccgggcgcggt

SEQ ID NO: 66607 - DNA, 180 bp, Homo sapiens; identical to SEQ ID NO: 46207
  chr20:48863456-48863636
  hypo

SEQ ID NO: 66608 - DNA, 142 bp, Homo sapiens; identical to SEQ ID NO: 46208
  chr20:49047022-49047164
  hypo

SEQ ID NO: 66609 - DNA, 30 bp, Homo sapiens; identical to SEQ ID NO: 46209
  chr20:49194287-49194317
  hypo

SEQ ID NO: 66610 - DNA, 111 bp, Homo sapiens; identical to SEQ ID NO: 46210
  chr20:49200439-49200550
  hypo

SEQ ID NO: 66611 - DNA, 99 bp, Homo sapiens; identical to SEQ ID NO: 46212
  chr20:49218709-49218808
  hypo

SEQ ID NO: 66612 - DNA, 26 bp, Homo sapiens
  chr20:49250786-49250812
  hypo
aggattatagccgtgagccaccgcgc

SEQ ID NO: 66613 - DNA, 79 bp, Homo sapiens; identical to SEQ ID NO: 46214
  chr20:49252062-49252141
  hypo

SEQ ID NO: 66614 - DNA, 42 bp, Homo sapiens; identical to SEQ ID NO: 25770
  chr20:49261761-49261803
  hypo

SEQ ID NO: 66615 - DNA, 44 bp, Homo sapiens
  chr20:49262104-49262148
  hypo
ctaagggcactgggaaccctgtgggcatgcgcagttcaagccca

SEQ ID NO: 66616 - DNA, 114 bp, Homo sapiens; identical to SEQ ID NO: 46216
  chr20:49286780-49286894
  hypo

SEQ ID NO: 66617 - DNA, 56 bp, Homo sapiens; identical to SEQ ID NO: 46218
  chr20:49345671-49345727
  hypo

SEQ ID NO: 66618 - DNA, 295 bp, Homo sapiens; identical to SEQ ID NO: 46219
  chr20:49346464-49346759
  hypo

SEQ ID NO: 66619 - DNA, 26 bp, Homo sapiens
  chr20:49350870-49350896
  hypo
aactaggtagtgtgccggtccttttt

SEQ ID NO: 66620 - DNA, 28 bp, Homo sapiens
  chr20:49378043-49378071
  hypo
ggcggagtttttgcgctaggttatctac

SEQ ID NO: 66621 - DNA, 30 bp, Homo sapiens; identical to SEQ ID NO: 16619
  chr20:49380822-49380852
  hypo

SEQ ID NO: 66622 - DNA, 30 bp, Homo sapiens; identical to SEQ ID NO: 46224
  chr20:49502935-49502965
  hypo

SEQ ID NO: 66623 - DNA, 20 bp, Homo sapiens
  chr20:52275978-52275998
  hypo
tttttttttttgagacggag

SEQ ID NO: 66624 - DNA, 76 bp, Homo sapiens; identical to SEQ ID NO: 46226
  chr20:52341635-52341711
  hypo

SEQ ID NO: 66625 - DNA, 30 bp, Homo sapiens; identical to SEQ ID NO: 46227
  chr20:52484713-52484743
  hypo

SEQ ID NO: 66626 - DNA, 40 bp, Homo sapiens; identical to SEQ ID NO: 46228
  chr20:52693155-52693195
  hypo

SEQ ID NO: 66627 - DNA, 99 bp, Homo sapiens; identical to SEQ ID NO: 46229
  chr20:52693375-52693474
  hypo

SEQ ID NO: 66628 - DNA, 30 bp, Homo sapiens; identical to SEQ ID NO: 46230
  chr20:52773951-52773981
  hypo

SEQ ID NO: 66629 - DNA, 198 bp, Homo sapiens; identical to SEQ ID NO: 46231
  chr20:52867324-52867522
  hypo

SEQ ID NO: 66630 - DNA, 79 bp, Homo sapiens; identical to SEQ ID NO: 46232
  chr20:53051998-53052077
  hypo

SEQ ID NO: 66631 - DNA, 24 bp, Homo sapiens
  chr20:53209356-53209380
  hypo
caccacgcccggccagataaattt

SEQ ID NO: 66632 - DNA, 23 bp, Homo sapiens
  chr20:53535735-53535758
  hypo
aaaaccaggaggggccgggcgcg

SEQ ID NO: 66633 - DNA, 30 bp, Homo sapiens; identical to SEQ ID NO: 46235
  chr20:53866697-53866727
  hypo

SEQ ID NO: 66634 - DNA, 18 bp, Homo sapiens
  chr20:54585945-54585963
  hypo
tttgaggtgcagtctcgc

SEQ ID NO: 66635 - DNA, 101 bp, Homo sapiens; identical to SEQ ID NO: 46237
  chr20:55378966-55379067
  hypo

SEQ ID NO: 66636 - DNA, 38 bp, Homo sapiens; identical to SEQ ID NO: 46238
  chr20:55379439-55379477
  hypo

SEQ ID NO: 66637 - DNA, 146 bp, Homo sapiens
  chr20:55693381-55693527
  hypo
accccacctaagcaccgctcaccccactacacccgcagcactgcccgcctcacagagcagggccccacctgcctcagagtaagaaaccagcagctccaccacccctggaggctgccttggcgcagcactggaaacattcataagaa

SEQ ID NO: 66638 - DNA, 3 bp, Homo sapiens
  chr20:55693662-55693665
  hypo
gta

SEQ ID NO: 66639 - DNA, 30 bp, Homo sapiens; identical to SEQ ID NO: 16624
  chr20:55925381-55925411
  hypo

SEQ ID NO: 66640 - DNA, 215 bp, Homo sapiens; identical to SEQ ID NO: 46241
  chr20:55958990-55959205
  hypo

SEQ ID NO: 66641 - DNA, 94 bp, Homo sapiens; identical to SEQ ID NO: 46242
  chr20:55959325-55959419
  hypo

SEQ ID NO: 66642 - DNA, 117 bp, Homo sapiens; identical to SEQ ID NO: 46243
  chr20:55969858-55969975
  hypo

SEQ ID NO: 66643 - DNA, 35 bp, Homo sapiens; identical to SEQ ID NO: 46244
  chr20:55989687-55989722
  hypo

SEQ ID NO: 66644 - DNA, 30 bp, Homo sapiens; identical to SEQ ID NO: 46245
  chr20:56041897-56041927
  hypo

SEQ ID NO: 66645 - DNA, 23 bp, Homo sapiens
  chr20:56053945-56053968
  hypo
gttatccaaattagccgggcacg

SEQ ID NO: 66646 - DNA, 30 bp, Homo sapiens; identical to SEQ ID NO: 46247
  chr20:56065208-56065238
  hypo

SEQ ID NO: 66647 - DNA, 30 bp, Homo sapiens; identical to SEQ ID NO: 46248
  chr20:56265981-56266011
  hypo

SEQ ID NO: 66648 - DNA, 180 bp, Homo sapiens; identical to SEQ ID NO: 46249
  chr20:56271495-56271675
  hypo

SEQ ID NO: 66649 - DNA, 30 bp, Homo sapiens; identical to SEQ ID NO: 46250
  chr20:56385780-56385810
  hypo

SEQ ID NO: 66650 - DNA, 60 bp, Homo sapiens
  chr20:56766190-56766250
  hypo
tctggtcagttagaatcctccatcctggccgggcgcggtggctcacgcctgtaatcccag

SEQ ID NO: 66651 - DNA, 30 bp, Homo sapiens; identical to SEQ ID NO: 46252
  chr20:56771631-56771661
  hypo

SEQ ID NO: 66652 - DNA, 305 bp, Homo sapiens; identical to SEQ ID NO: 46253
  chr20:56771994-56772299
  hypo

SEQ ID NO: 66653 - DNA, 30 bp, Homo sapiens; identical to SEQ ID NO: 46254
  chr20:56780688-56780718
  hypo

SEQ ID NO: 66654 - DNA, 40 bp, Homo sapiens; identical to SEQ ID NO: 46255
  chr20:56781064-56781104
  hypo

SEQ ID NO: 66655 - DNA, 30 bp, Homo sapiens; identical to SEQ ID NO: 46256
  chr20:56839640-56839670
  hypo

SEQ ID NO: 66656 - DNA, 30 bp, Homo sapiens; identical to SEQ ID NO: 16627
  chr20:57198958-57198988
  hypo

SEQ ID NO: 66657 - DNA, 32 bp, Homo sapiens; identical to SEQ ID NO: 46258
  chr20:57268913-57268945
  hypo

SEQ ID NO: 66658 - DNA, 38 bp, Homo sapiens; identical to SEQ ID NO: 46259
  chr20:57392369-57392407
  hypo

SEQ ID NO: 66659 - DNA, 30 bp, Homo sapiens; identical to SEQ ID NO: 46260
  chr20:57398016-57398046
  hypo

SEQ ID NO: 66660 - DNA, 76 bp, Homo sapiens; identical to SEQ ID NO: 46261
  chr20:57622769-57622845
  hypo

SEQ ID NO: 66661 - DNA, 76 bp, Homo sapiens; identical to SEQ ID NO: 46262
  chr20:57622905-57622981
  hypo

SEQ ID NO: 66662 - DNA, 51 bp, Homo sapiens; identical to SEQ ID NO: 46263
  chr20:57699771-57699822
  hypo

SEQ ID NO: 66663 - DNA, 197 bp, Homo sapiens; identical to SEQ ID NO: 46264
  chr20:58283870-58284067
  hypo

SEQ ID NO: 66664 - DNA, 159 bp, Homo sapiens; identical to SEQ ID NO: 46265
  chr20:58311576-58311735
  hypo

SEQ ID NO: 66665 - DNA, 68 bp, Homo sapiens; identical to SEQ ID NO: 46266
  chr20:58348402-58348470
  hypo

SEQ ID NO: 66666 - DNA, 317 bp, Homo sapiens; identical to SEQ ID NO: 46267
  chr20:58507720-58508037
  hypo

SEQ ID NO: 66667 - DNA, 303 bp, Homo sapiens; identical to SEQ ID NO: 46268
  chr20:58514097-58514400
  hypo

SEQ ID NO: 66668 - DNA, 30 bp, Homo sapiens; identical to SEQ ID NO: 46269
  chr20:58671797-58671827
  hypo

SEQ ID NO: 66669 - DNA, 99 bp, Homo sapiens; identical to SEQ ID NO: 46270
  chr20:59005702-59005801
  hypo

SEQ ID NO: 66670 - DNA, 31 bp, Homo sapiens; identical to SEQ ID NO: 46271
  chr20:59185805-59185836
  hypo

SEQ ID NO: 66671 - DNA, 185 bp, Homo sapiens; identical to SEQ ID NO: 46272
  chr20:59232938-59233123
  hypo

SEQ ID NO: 66672 - DNA, 30 bp, Homo sapiens; identical to SEQ ID NO: 46273
  chr20:59598638-59598668
  hypo

SEQ ID NO: 66673 - DNA, 185 bp, Homo sapiens; identical to SEQ ID NO: 46274
  chr20:59708146-59708331
  hypo

SEQ ID NO: 66674 - DNA, 94 bp, Homo sapiens; identical to SEQ ID NO: 46275
  chr20:59821803-59821897
  hypo

SEQ ID NO: 66675 - DNA, 30 bp, Homo sapiens; identical to SEQ ID NO: 46276
  chr20:59855416-59855446
  hypo

SEQ ID NO: 66676 - DNA, 7 bp, Homo sapiens
  chr20:59910346-59910353
  hypo
attatat

SEQ ID NO: 66677 - DNA, 30 bp, Homo sapiens; identical to SEQ ID NO: 46278
  chr20:59967982-59968012
  hypo

SEQ ID NO: 66678 - DNA, 33 bp, Homo sapiens
  chr20:59973072-59973105
  hypo
catggcaagcttcacctgcgtgtcctgaaccag

SEQ ID NO: 66679 - DNA, 158 bp, Homo sapiens; identical to SEQ ID NO: 46280
  chr20:60120725-60120883
  hypo

SEQ ID NO: 66680 - DNA, 30 bp, Homo sapiens; identical to SEQ ID NO: 46281
  chr20:60121193-60121223
  hypo

SEQ ID NO: 66681 - DNA, 30 bp, Homo sapiens; identical to SEQ ID NO: 46282
  chr20:60122026-60122056
  hypo

SEQ ID NO: 66682 - DNA, 36 bp, Homo sapiens; identical to SEQ ID NO: 46283
  chr20:60162590-60162626
  hypo

SEQ ID NO: 66683 - DNA, 30 bp, Homo sapiens; identical to SEQ ID NO: 46284
  chr20:60174306-60174336
  hypo

SEQ ID NO: 66684 - DNA, 159 bp, Homo sapiens; identical to SEQ ID NO: 46285
  chr20:60175455-60175614
  hypo

SEQ ID NO: 66685 - DNA, 30 bp, Homo sapiens; identical to SEQ ID NO: 46286
  chr20:60176588-60176618
  hypo

SEQ ID NO: 66686 - DNA, 30 bp, Homo sapiens; identical to SEQ ID NO: 16634
  chr20:60202364-60202394
  hypo

SEQ ID NO: 66687 - DNA, 21 bp, Homo sapiens
  chr20:60202624-60202645
  hypo
ttgtgtcgaccatgactgctt

SEQ ID NO: 66688 - DNA, 30 bp, Homo sapiens; identical to SEQ ID NO: 46289
  chr20:60210184-60210214
  hypo

SEQ ID NO: 66689 - DNA, 164 bp, Homo sapiens; identical to SEQ ID NO: 46290
  chr20:60225027-60225191
  hypo

SEQ ID NO: 66690 - DNA, 182 bp, Homo sapiens; identical to SEQ ID NO: 46291
  chr20:60227182-60227364
  hypo

SEQ ID NO: 66691 - DNA, 158 bp, Homo sapiens; identical to SEQ ID NO: 46293
  chr20:60237356-60237514
  hypo

SEQ ID NO: 66692 - DNA, 90 bp, Homo sapiens; identical to SEQ ID NO: 25792
  chr20:60238291-60238381
  hypo

SEQ ID NO: 66693 - DNA, 29 bp, Homo sapiens
  chr20:60238848-60238877
  hypo
gggcaccactgaacacggggtaaaccaat

SEQ ID NO: 66694 - DNA, 67 bp, Homo sapiens
  chr20:60238980-60239047
  hypo
tgacactgtcctctgtccagcaccggtccacgttgaggtgtctgtgtgccaccgggacccttccgta

SEQ ID NO: 66695 - DNA, 27 bp, Homo sapiens
  chr20:60244107-60244134
  hypo
ttccttcaccctcggggatggtgcctg

SEQ ID NO: 66696 - DNA, 54 bp, Homo sapiens; identical to SEQ ID NO: 46297
  chr20:60281411-60281465
  hypo

SEQ ID NO: 66697 - DNA, 71 bp, Homo sapiens; identical to SEQ ID NO: 46298
  chr20:60281806-60281877
  hypo

SEQ ID NO: 66698 - DNA, 183 bp, Homo sapiens; identical to SEQ ID NO: 46299
  chr20:60304145-60304328
  hypo

SEQ ID NO: 66699 - DNA, 56 bp, Homo sapiens; identical to SEQ ID NO: 46301
  chr20:60355322-60355378
  hypo

SEQ ID NO: 66700 - DNA, 100 bp, Homo sapiens
  chr20:60359749-60359849
  hypo
gtaatcccagttcctcgggacagttctcaaggccctccgatatcctgtgcccccaggagaatgtaagcccagttcctcggaacagttctccaggccctca

SEQ ID NO: 66701 - DNA, 127 bp, Homo sapiens
  chr20:60374909-60375036
  hypo
agcctcataacaccacggtccctgcggggcctcgagtggggcctctgcagtggctctgccccgctccccatctctcatgcaacctccctgagagcccagggccatctccgcttgtcttcatggcccg

SEQ ID NO: 66702 - DNA, 250 bp, Homo sapiens
  chr20:60375070-60375320
  hypo
tcggtgggcacagtcaccgggccggcttccccgcctgtgcttcctctgaggggttccccagcccacagcatggtccagggccgggtggggccagcatcctctactccctccttgaagcctgtgcagggctgcatcttctttgtgtgcaagcaagcgagcggcctgcagccccaagggccctttgtgagtgctgcaaagccccgaagaccagaccgcactccctcgagtgcacacacggtgcttctgggaa

SEQ ID NO: 66703 - DNA, 164 bp, Homo sapiens; identical to SEQ ID NO: 46304
  chr20:60385207-60385371
  hypo

SEQ ID NO: 66704 - DNA, 243 bp, Homo sapiens; identical to SEQ ID NO: 46305
  chr20:60415719-60415962
  hypo

SEQ ID NO: 66705 - DNA, 72 bp, Homo sapiens; identical to SEQ ID NO: 46306
  chr20:60428149-60428221
  hypo

SEQ ID NO: 66706 - DNA, 30 bp, Homo sapiens; identical to SEQ ID NO: 46307
  chr20:60439765-60439795
  hypo

SEQ ID NO: 66707 - DNA, 30 bp, Homo sapiens; identical to SEQ ID NO: 46308
  chr20:60447479-60447509
  hypo

SEQ ID NO: 66708 - DNA, 241 bp, Homo sapiens; identical to SEQ ID NO: 46309
  chr20:60448710-60448951
  hypo

SEQ ID NO: 66709 - DNA, 30 bp, Homo sapiens; identical to SEQ ID NO: 46310
  chr20:60449466-60449496
  hypo

SEQ ID NO: 66710 - DNA, 152 bp, Homo sapiens; identical to SEQ ID NO: 46311
  chr20:60452936-60453088
  hypo

SEQ ID NO: 66711 - DNA, 136 bp, Homo sapiens; identical to SEQ ID NO: 46313
  chr20:60454749-60454885
  hypo

SEQ ID NO: 66712 - DNA, 30 bp, Homo sapiens; identical to SEQ ID NO: 46314
  chr20:60457286-60457316
  hypo

SEQ ID NO: 66713 - DNA, 30 bp, Homo sapiens; identical to SEQ ID NO: 46316
  chr20:60492778-60492808
  hypo

SEQ ID NO: 66714 - DNA, 30 bp, Homo sapiens; identical to SEQ ID NO: 46317
  chr20:60495131-60495161
  hypo

SEQ ID NO: 66715 - DNA, 111 bp, Homo sapiens; identical to SEQ ID NO: 46318
  chr20:60502200-60502311
  hypo

SEQ ID NO: 66716 - DNA, 40 bp, Homo sapiens; identical to SEQ ID NO: 46319
  chr20:60502586-60502626
  hypo

SEQ ID NO: 66717 - DNA, 198 bp, Homo sapiens
  chr20:60502832-60503030
  hypo
ggctgtgagtttccacgtgaatgccacaccccgctgtgtgcgtgtgtgcaggtgtgggtgtggccgtgtgctctgccgtgtctgttgaggtgccgtgcgcagtggctgtgtgcgtgtgtgcagctgcgggtgtgggtgtggccgtgtgctttgccgtgtctgttgaggtgccgtacgcagtggtgtggctgcccatgg

SEQ ID NO: 66718 - DNA, 179 bp, Homo sapiens; identical to SEQ ID NO: 46321
  chr20:60515823-60516002
  hypo

SEQ ID NO: 66719 - DNA, 107 bp, Homo sapiens; identical to SEQ ID NO: 46322
  chr20:60552230-60552337
  hypo

SEQ ID NO: 66720 - DNA, 46 bp, Homo sapiens; identical to SEQ ID NO: 46323
  chr20:60578805-60578851
  hypo

SEQ ID NO: 66721 - DNA, 179 bp, Homo sapiens; identical to SEQ ID NO: 46325
  chr20:60781327-60781506
  hypo

SEQ ID NO: 66722 - DNA, 52 bp, Homo sapiens
  chr20:60790124-60790176
  hypo
tggcgaagcggcccctgcccgggcacctcctctggaccgcccctgcacgcct

SEQ ID NO: 66723 - DNA, 34 bp, Homo sapiens; identical to SEQ ID NO: 46327
  chr20:60803825-60803859
  hypo

SEQ ID NO: 66724 - DNA, 66 bp, Homo sapiens; identical to SEQ ID NO: 46329
  chr20:60921238-60921304
  hypo

SEQ ID NO: 66725 - DNA, 41 bp, Homo sapiens; identical to SEQ ID NO: 46330
  chr20:60921597-60921638
  hypo

SEQ ID NO: 66726 - DNA, 61 bp, Homo sapiens; identical to SEQ ID NO: 46331
  chr20:60921962-60922023
  hypo

SEQ ID NO: 66727 - DNA, 260 bp, Homo sapiens; identical to SEQ ID NO: 46332
  chr20:60925281-60925541
  hypo

SEQ ID NO: 66728 - DNA, 110 bp, Homo sapiens; identical to SEQ ID NO: 46333
  chr20:60925847-60925957
  hypo

SEQ ID NO: 66729 - DNA, 228 bp, Homo sapiens; identical to SEQ ID NO: 46334
  chr20:60953312-60953540
  hypo

SEQ ID NO: 66730 - DNA, 20 bp, Homo sapiens
  chr20:60970933-60970953
  hypo
ctctcagggtgcagccggtg

SEQ ID NO: 66731 - DNA, 120 bp, Homo sapiens
  chr20:60984010-60984130
  hypo
tgagggacaaggaggaatgctgaggaaggaacggggtctcttcctgggtctggtgaacccccttgctaggctcccgctgccagtcttctcccctccccagggtgtcgatgggtggccaaa

SEQ ID NO: 66732 - DNA, 30 bp, Homo sapiens; identical to SEQ ID NO: 16655
  chr20:60984485-60984515
  hypo

SEQ ID NO: 66733 - DNA, 52 bp, Homo sapiens
  chr20:61288016-61288068
  hypo
gggacccatgaggtgcggtacgtctcggccgggcagagcgtggcgtgcggct

SEQ ID NO: 66734 - DNA, 307 bp, Homo sapiens; identical to SEQ ID NO: 25807
  chr20:61288156-61288463
  hypo

SEQ ID NO: 66735 - DNA, 319 bp, Homo sapiens; identical to SEQ ID NO: 46339
  chr20:61291131-61291450
  hypo

SEQ ID NO: 66736 - DNA, 116 bp, Homo sapiens
  chr20:61294577-61294693
  hypo
taactagggctgcaccgtctgttcctgattcttcagaatccatttacatttggccacctcctcaaacaagagcatttgaatgttccaggcattcagagttgcgttcatcggaacca

SEQ ID NO: 66737 - DNA, 15 bp, Homo sapiens
  chr20:61294857-61294872
  hypo
cgacatggacatgtc

SEQ ID NO: 66738 - DNA, 84 bp, Homo sapiens; identical to SEQ ID NO: 46341
  chr20:61305619-61305703
  hypo

SEQ ID NO: 66739 - DNA, 30 bp, Homo sapiens; identical to SEQ ID NO: 46342
  chr20:61305919-61305949
  hypo

SEQ ID NO: 66740 - DNA, 50 bp, Homo sapiens; identical to SEQ ID NO: 46343
  chr20:61312710-61312760
  hypo

SEQ ID NO: 66741 - DNA, 34 bp, Homo sapiens; identical to SEQ ID NO: 46344
  chr20:61314672-61314706
  hypo

SEQ ID NO: 66742 - DNA, 30 bp, Homo sapiens; identical to SEQ ID NO: 46345
  chr20:61318633-61318663
  hypo

SEQ ID NO: 66743 - DNA, 115 bp, Homo sapiens; identical to SEQ ID NO: 46346
  chr20:61321299-61321414
  hypo

SEQ ID NO: 66744 - DNA, 160 bp, Homo sapiens; identical to SEQ ID NO: 46347
  chr20:61329188-61329348
  hypo

SEQ ID NO: 66745 - DNA, 131 bp, Homo sapiens; identical to SEQ ID NO: 46348
  chr20:61330920-61331051
  hypo

SEQ ID NO: 66746 - DNA, 30 bp, Homo sapiens; identical to SEQ ID NO: 46349
  chr20:61368079-61368109
  hypo

SEQ ID NO: 66747 - DNA, 136 bp, Homo sapiens; identical to SEQ ID NO: 46350
  chr20:61374450-61374586
  hypo

SEQ ID NO: 66748 - DNA, 215 bp, Homo sapiens; identical to SEQ ID NO: 46351
  chr20:61393835-61394050
  hypo

SEQ ID NO: 66749 - DNA, 22 bp, Homo sapiens
  chr20:61411096-61411118
  hypo
agttagaaagctcttcgttgtg

SEQ ID NO: 66750 - DNA, 126 bp, Homo sapiens
  chr20:61412187-61412313
  hypo
gagcccaggtgccaccgagggaatgcaacgtgccacaccccaagacatgacacttgtgagaacagtgtggcccagcccccactccgggcacagcctcggacaccctgcccgcctccgcccatggag

SEQ ID NO: 66751 - DNA, 30 bp, Homo sapiens; identical to SEQ ID NO: 46354
  chr20:61424994-61425024
  hypo

SEQ ID NO: 66752 - DNA, 58 bp, Homo sapiens; identical to SEQ ID NO: 46355
  chr20:61472103-61472161
  hypo

SEQ ID NO: 66753 - DNA, 206 bp, Homo sapiens
  chr20:61506330-61506536
  hypo
ctgggagtgacccaccccccacccccattttcttcatcagtcaccgaaactttcgccccacaggtagctgaccctaaattcagtgaaatccagaactttcctggcacactggagaggacggcagaacgctgggatggatttatcgtgcaagaccagcttgatgtccttagggcttggaggtcaccccttcacgaggattgtgagga

SEQ ID NO: 66754 - DNA, 30 bp, Homo sapiens; identical to SEQ ID NO: 46357
  chr20:61541112-61541142
  hypo

SEQ ID NO: 66755 - DNA, 76 bp, Homo sapiens; identical to SEQ ID NO: 46358
  chr20:61567431-61567507
  hypo

SEQ ID NO: 66756 - DNA, 331 bp, Homo sapiens; identical to SEQ ID NO: 46359
  chr20:61570543-61570874
  hypo

SEQ ID NO: 66757 - DNA, 30 bp, Homo sapiens; identical to SEQ ID NO: 46360
  chr20:61571213-61571243
  hypo

SEQ ID NO: 66758 - DNA, 30 bp, Homo sapiens; identical to SEQ ID NO: 46361
  chr20:61618995-61619025
  hypo

SEQ ID NO: 66759 - DNA, 39 bp, Homo sapiens; identical to SEQ ID NO: 46362
  chr20:61655625-61655664
  hypo

SEQ ID NO: 66760 - DNA, 30 bp, Homo sapiens; identical to SEQ ID NO: 46363
  chr20:61666827-61666857
  hypo

SEQ ID NO: 66761 - DNA, 105 bp, Homo sapiens; identical to SEQ ID NO: 46364
  chr20:61695646-61695751
  hypo

SEQ ID NO: 66762 - DNA, 189 bp, Homo sapiens; identical to SEQ ID NO: 46365
  chr20:61714761-61714950
  hypo

SEQ ID NO: 66763 - DNA, 136 bp, Homo sapiens; identical to SEQ ID NO: 16663
  chr20:61725275-61725411
  hypo

SEQ ID NO: 66764 - DNA, 34 bp, Homo sapiens; identical to SEQ ID NO: 46367
  chr20:61749778-61749812
  hypo

SEQ ID NO: 66765 - DNA, 41 bp, Homo sapiens
  chr20:61763628-61763669
  hypo
tatgtctgttacgccgggcgccggcccgagtcctaaagata

SEQ ID NO: 66766 - DNA, 30 bp, Homo sapiens; identical to SEQ ID NO: 46370
  chr20:61799802-61799832
  hypo

SEQ ID NO: 66767 - DNA, 30 bp, Homo sapiens; identical to SEQ ID NO: 46371
  chr20:61820146-61820176
  hypo

SEQ ID NO: 66768 - DNA, 35 bp, Homo sapiens; identical to SEQ ID NO: 46372
  chr20:61823119-61823154
  hypo

SEQ ID NO: 66769 - DNA, 18 bp, Homo sapiens
  chr20:61838526-61838544
  hypo
cagctgcattaaccccgg

SEQ ID NO: 66770 - DNA, 102 bp, Homo sapiens; identical to SEQ ID NO: 46374
  chr20:61883273-61883375
  hypo

SEQ ID NO: 66771 - DNA, 33 bp, Homo sapiens; identical to SEQ ID NO: 46375
  chr20:61941734-61941767
  hypo

SEQ ID NO: 66772 - DNA, 30 bp, Homo sapiens; identical to SEQ ID NO: 46376
  chr20:61965232-61965262
  hypo

SEQ ID NO: 66773 - DNA, 345 bp, Homo sapiens
  chr20:61973846-61974191
  hypo
cctgagaggaggtaacgtcgatgcaaccacgttggcaaacccttcgtcagcagctcattgagccgaccacgcacccttccttcccacggcagagcgggagctcctgggtcagcctccctgccaaagtctgttcacagcagccccgagctggcgacgggtaaataagatggtggagccacgcggcggagcccgcagcacagtggccgcgcagcgagcaatgacccgggatcgggagccgacagaagggcacgcctggcgcggccacgcacagaacccagggccaggcaacgcggggcagaggtgttgggtgacctcgggcgggtcgtggccggccgggctgggcag

SEQ ID NO: 66774 - DNA, 55 bp, Homo sapiens
  chr20:61974354-61974409
  hypo
gcagacagggagtgtaaacggcacagtcacgtggaagacacgttggcattatctc

SEQ ID NO: 66775 - DNA, 150 bp, Homo sapiens
  chr20:61980710-61980860
  hypo
cctgtggcccctcaccgtgccgtccgccgaggcccactgtgtcccaaagccagagacggcaccgggatccaccctgtgccagccactcggggccccctgccccgctcagcctgggacctgcggccacatagcaggcttgggaagaggctg

SEQ ID NO: 66776 - DNA, 361 bp, Homo sapiens
  chr20:61980975-61981336
  hypo
cgcccaacacagccatgggcgggacttaccgagaagtctgtgtcttcggccttcaggtggtctgcaatgtactggacgccctccaccgcccgggtcagggccggcgacaggggcaggtgcgggggcggcgctttggtgctgcgggtcttgaccgtggcgctcggggacaccgaagagggctccttcttgcatgtgcatttgcacggagagggctggtctgggggtgggagctcagccgagtgggtgttgcgagaggccagggcgccggcagcctggccatctgcctcgggggcggcatcgtctcggggaacacagtactggatgctccgagaccggcaccggacgccgccttccaccgctt

SEQ ID NO: 66777 - DNA, 98 bp, Homo sapiens; identical to SEQ ID NO: 46379
  chr20:61982236-61982334
  hypo

SEQ ID NO: 66778 - DNA, 36 bp, Homo sapiens; identical to SEQ ID NO: 46380
  chr20:61982611-61982647
  hypo

SEQ ID NO: 66779 - DNA, 30 bp, Homo sapiens; identical to SEQ ID NO: 46381
  chr20:61986659-61986689
  hypo

SEQ ID NO: 66780 - DNA, 183 bp, Homo sapiens; identical to SEQ ID NO: 46382
  chr20:61990886-61991069
  hypo

SEQ ID NO: 66781 - DNA, 89 bp, Homo sapiens; identical to SEQ ID NO: 46383
  chr20:62011874-62011963
  hypo

SEQ ID NO: 66782 - DNA, 116 bp, Homo sapiens; identical to SEQ ID NO: 46384
  chr20:62031637-62031753
  hypo

SEQ ID NO: 66783 - DNA, 85 bp, Homo sapiens
  chr20:62031973-62032058
  hypo
gacagccagaggcaacggcgcaaatggggaagctgcagccaccgtcacggccagaggatggcagactgcaatggcgtggggcgcg

SEQ ID NO: 66784 - DNA, 270 bp, Homo sapiens
  chr20:62032095-62032365
  hypo
cagagggatggcgtccagcgggaccaccagctctgggcgcctcagtgcgagacccctccgtgagacccctcctgccctgcgcgtgtctctggagcccgtcccttgggcccctcgcccgccccacctgttcgcagggtccagggcgtccgtacctggcacagccagggggcatggggcgacctcagggagttcctgtccacatgcattaaggcaacgactttgtaaaacccaggcggagttggcgtgtggcgatggcgatgtgcacgtgcc

SEQ ID NO: 66785 - DNA, 159 bp, Homo sapiens; identical to SEQ ID NO: 46386
  chr20:62033495-62033654
  hypo

SEQ ID NO: 66786 - DNA, 36 bp, Homo sapiens
  chr20:62037523-62037559
  hypo
gcccggaaaccccaccgggacccaaggccgcaggtc

SEQ ID NO: 66787 - DNA, 134 bp, Homo sapiens
  chr20:62037598-62037732
  hypo
aacaggcctgccctttgtgcctcccctgggctcggctgagacaaccccccgcctgttgccacgctggcaacaccccgtcatcactcccgcccctcctcacaccgggctgatgtcggccgcggccctgagcagag

SEQ ID NO: 66788 - DNA, 86 bp, Homo sapiens; identical to SEQ ID NO: 46388
  chr20:62038039-62038125
  hypo

SEQ ID NO: 66789 - DNA, 183 bp, Homo sapiens; identical to SEQ ID NO: 46389
  chr20:62038491-62038674
  hypo

SEQ ID NO: 66790 - DNA, 26 bp, Homo sapiens
  chr20:62046201-62046227
  hypo
caccacatccatccccggagaggatg

SEQ ID NO: 66791 - DNA, 161 bp, Homo sapiens
  chr20:62046421-62046582
  hypo
cttggcagccacgcctcgggggctggagaagacacgatctttcaaactgaccttctggctgctcccacgggaaccgacagacagacagaaaaacagggagagaagtcactctgcaaagaacacaggccgtgtctgctcatggccgacgccgcccatgcgcc

SEQ ID NO: 66792 - DNA, 54 bp, Homo sapiens; identical to SEQ ID NO: 46391
  chr20:62050926-62050980
  hypo

SEQ ID NO: 66793 - DNA, 30 bp, Homo sapiens; identical to SEQ ID NO: 46392
  chr20:62052467-62052497
  hypo

SEQ ID NO: 66794 - DNA, 122 bp, Homo sapiens; identical to SEQ ID NO: 46393
  chr20:62053217-62053339
  hypo

SEQ ID NO: 66795 - DNA, 38 bp, Homo sapiens; identical to SEQ ID NO: 16678
  chr20:62054264-62054302
  hypo

SEQ ID NO: 66796 - DNA, 30 bp, Homo sapiens; identical to SEQ ID NO: 46396
  chr20:62090117-62090147
  hypo

SEQ ID NO: 66797 - DNA, 110 bp, Homo sapiens
  chr20:62090414-62090524
  hypo
tgaggtccgtccgtgcggccacaggaaggacgaggcagcggcccccagacacggagaggatgaaggagtaccctaaacacgaaggaacctgagggcaggctcggcaagga

SEQ ID NO: 66798 - DNA, 39 bp, Homo sapiens; identical to SEQ ID NO: 16681
  chr20:62097848-62097887
  hypo

SEQ ID NO: 66799 - DNA, 79 bp, Homo sapiens
  chr20:62115266-62115345
  hypo
ccctgacttcaggacctgctctggggcctcagcggccccaggactgaccctgagtcccagtggccgccagtcagagcca

SEQ ID NO: 66800 - DNA, 57 bp, Homo sapiens
  chr20:62126061-62126118
  hypo
ggccctcgacctccccgtgccacctgccggtgcctcgctctgggccagggggtccag

SEQ ID NO: 66801 - DNA, 45 bp, Homo sapiens
  chr20:62126429-62126474
  hypo
ccacgatcagcactgcgcagtccgcctgcccggcaggggacacag

SEQ ID NO: 66802 - DNA, 30 bp, Homo sapiens; identical to SEQ ID NO: 46401
  chr20:62132074-62132104
  hypo

SEQ ID NO: 66803 - DNA, 96 bp, Homo sapiens; identical to SEQ ID NO: 46402
  chr20:62153366-62153462
  hypo

SEQ ID NO: 66804 - DNA, 33 bp, Homo sapiens; identical to SEQ ID NO: 25834
  chr20:62165598-62165631
  hypo

SEQ ID NO: 66805 - DNA, 93 bp, Homo sapiens
  chr20:62165762-62165855
  hypo
tccccacagttgctgttggtgcttcctcagtaccacccctgcctcccctccctcagaacggctccctcctgccctgcacgctctggccaagct

SEQ ID NO: 66806 - DNA, 30 bp, Homo sapiens; identical to SEQ ID NO: 16686
  chr20:62167765-62167795
  hypo

SEQ ID NO: 66807 - DNA, 237 bp, Homo sapiens; identical to SEQ ID NO: 46405
  chr20:62168240-62168477
  hypo

SEQ ID NO: 66808 - DNA, 16 bp, Homo sapiens
  chr20:62170163-62170179
  hypo
atgtccaggaagcctc

SEQ ID NO: 66809 - DNA, 252 bp, Homo sapiens; identical to SEQ ID NO: 46407
  chr20:62172062-62172314
  hypo

SEQ ID NO: 66810 - DNA, 278 bp, Homo sapiens; identical to SEQ ID NO: 25839
  chr20:62172667-62172945
  hypo

SEQ ID NO: 66811 - DNA, 83 bp, Homo sapiens; identical to SEQ ID NO: 46409
  chr20:62204292-62204375
  hypo

SEQ ID NO: 66812 - DNA, 56 bp, Homo sapiens; identical to SEQ ID NO: 46410
  chr20:62221347-62221403
  hypo

SEQ ID NO: 66813 - DNA, 35 bp, Homo sapiens; identical to SEQ ID NO: 46411
  chr20:62274577-62274612
  hypo

SEQ ID NO: 66814 - DNA, 87 bp, Homo sapiens; identical to SEQ ID NO: 46412
  chr20:62281540-62281627
  hypo

SEQ ID NO: 66815 - DNA, 30 bp, Homo sapiens; identical to SEQ ID NO: 46413
  chr20:62310644-62310674
  hypo

SEQ ID NO: 66816 - DNA, 30 bp, Homo sapiens; identical to SEQ ID NO: 46414
  chr20:62311251-62311281
  hypo

SEQ ID NO: 66817 - DNA, 283 bp, Homo sapiens; identical to SEQ ID NO: 25841
  chr20:62320923-62321206
  hypo

SEQ ID NO: 66818 - DNA, 297 bp, Homo sapiens
  chr20:62321341-62321638
  hypo
agcgtggggcccctgcagcagatgagggtcttcacttcggtgaactgaacccttgaagcggctgtgggcagggcagcagggctatggccaccccccaggttcgcctttgccgacgcaagagcccaactgccctcctgggtgcgtccccacgtcagggtgtatgacaactttggccatgtcatccgagacgtggcccagttcttccgtgttgccgagcgaactgtgagttcctgcccagggaggggatgagggtgttgtccccagaggagccagaaatgggtccacccacccccatgg

SEQ ID NO: 66819 - DNA, 30 bp, Homo sapiens; identical to SEQ ID NO: 16693
  chr20:62329526-62329556
  hypo

SEQ ID NO: 66820 - DNA, 30 bp, Homo sapiens; identical to SEQ ID NO: 46417
  chr20:62331916-62331946
  hypo

SEQ ID NO: 66821 - DNA, 45 bp, Homo sapiens; identical to SEQ ID NO: 46418
  chr20:62340242-62340287
  hypo

SEQ ID NO: 66822 - DNA, 81 bp, Homo sapiens
  chr20:62383137-62383218
  hypo
atgaagccccgcccccggtgggtctccccatgaagccccgccccccggtgggtctcccatgaagccccgccccccggtggg

SEQ ID NO: 66823 - DNA, 427 bp, Homo sapiens
  chr20:62383289-62383716
  hypo
cagcgatgctccagagcctcttccgccccgacagcagccccacctctgcccggagcccggggcgcctccactgcctctcctcacacagctgcccgccgcgagctccccctgcaccctgcgcctcggggtgggcgttccaggactccccgaacccttggggccgccccgctctgggctgcctgtgccccacccgcctcactggttgatctcacccacttgagatgccctcgccaggccttttttggcaaatctgcctccctgttcccaggctgcctttttctattatttcctccccaagcaaatccatccactccacacctgctacctgacaacgacctgccagtgctgagctccagggtgggcgcggtgggtgcagacaggtcggcaggcacaaggacagggttctccctcccgaggcagggcgggg

SEQ ID NO: 66824 - DNA, 266 bp, Homo sapiens; identical to SEQ ID NO: 46420
  chr20:62383922-62384188
  hypo

SEQ ID NO: 66825 - DNA, 30 bp, Homo sapiens; identical to SEQ ID NO: 46421
  chr20:62398516-62398546
  hypo

SEQ ID NO: 66826 - DNA, 98 bp, Homo sapiens; identical to SEQ ID NO: 46422
  chr20:62400802-62400900
  hypo

SEQ ID NO: 66827 - DNA, 212 bp, Homo sapiens; identical to SEQ ID NO: 46423
  chr20:62481430-62481642
  hypo

SEQ ID NO: 66828 - DNA, 69 bp, Homo sapiens; identical to SEQ ID NO: 25849
  chr20:62488224-62488293
  hypo

SEQ ID NO: 66829 - DNA, 96 bp, Homo sapiens
  chr20:62488350-62488446
  hypo
acacagtggtgccagggcaggaaccctgggggcatttgcaggcctgtgctgcgagactgcagtggcgctcaggacacacctcggagaagagcaagc

SEQ ID NO: 66830 - DNA, 36 bp, Homo sapiens; identical to SEQ ID NO: 46425
  chr20:62662189-62662225
  hypo

SEQ ID NO: 66831 - DNA, 171 bp, Homo sapiens; identical to SEQ ID NO: 46426
  chr20:62722776-62722947
  hypo

SEQ ID NO: 66832 - DNA, 30 bp, Homo sapiens; identical to SEQ ID NO: 46427
  chr20:62737760-62737790
  hypo

SEQ ID NO: 66833 - DNA, 36 bp, Homo sapiens; identical to SEQ ID NO: 16700
  chr20:62762699-62762735
  hypo

SEQ ID NO: 66834 - DNA, 100 bp, Homo sapiens; identical to SEQ ID NO: 46429
  chr20:62766351-62766451
  hypo

SEQ ID NO: 66835 - DNA, 45 bp, Homo sapiens; identical to SEQ ID NO: 46430
  chr20:62871836-62871881
  hypo

SEQ ID NO: 66836 - DNA, 30 bp, Homo sapiens; identical to SEQ ID NO: 46431
  chr20:62873290-62873320
  hypo

SEQ ID NO: 66837 - DNA, 33 bp, Homo sapiens; identical to SEQ ID NO: 46432
  chr21:15442571-15442604
  hypo

SEQ ID NO: 66838 - DNA, 30 bp, Homo sapiens; identical to SEQ ID NO: 46433
  chr21:15444814-15444844
  hypo

SEQ ID NO: 66839 - DNA, 60 bp, Homo sapiens; identical to SEQ ID NO: 46434
  chr21:15446528-15446588
  hypo

SEQ ID NO: 66840 - DNA, 85 bp, Homo sapiens; identical to SEQ ID NO: 46435
  chr21:15694247-15694332
  hypo

SEQ ID NO: 66841 - DNA, 30 bp, Homo sapiens; identical to SEQ ID NO: 46436
  chr21:15762808-15762838
  hypo

SEQ ID NO: 66842 - DNA, 19 bp, Homo sapiens
  chr21:15869848-15869867
  hypo
gtcgcggtgagccgagatc

SEQ ID NO: 66843 - DNA, 81 bp, Homo sapiens; identical to SEQ ID NO: 46438
  chr21:19274379-19274460
  hypo

SEQ ID NO: 66844 - DNA, 172 bp, Homo sapiens; identical to SEQ ID NO: 46439
  chr21:20359980-20360152
  hypo

SEQ ID NO: 66845 - DNA, 33 bp, Homo sapiens; identical to SEQ ID NO: 46440
  chr21:23970030-23970063
  hypo

SEQ ID NO: 66846 - DNA, 41 bp, Homo sapiens; identical to SEQ ID NO: 46441
  chr21:25338183-25338224
  hypo

SEQ ID NO: 66847 - DNA, 23 bp, Homo sapiens
  chr21:26737215-26737238
  hypo
actgcgcccggccgagggatttt

SEQ ID NO: 66848 - DNA, 243 bp, Homo sapiens; identical to SEQ ID NO: 58899
  chr21:28217690-28217933
  hypo

SEQ ID NO: 66849 - DNA, 17 bp, Homo sapiens
  chr21:30266890-30266907
  hypo
tccgtctcaaaaaaaaa

SEQ ID NO: 66850 - DNA, 38 bp, Homo sapiens; identical to SEQ ID NO: 46445
  chr21:31057101-31057139
  hypo

SEQ ID NO: 66851 - DNA, 139 bp, Homo sapiens; identical to SEQ ID NO: 46446
  chr21:31059342-31059481
  hypo

SEQ ID NO: 66852 - DNA, 30 bp, Homo sapiens; identical to SEQ ID NO: 46447
  chr21:32592616-32592646
  hypo

SEQ ID NO: 66853 - DNA, 30 bp, Homo sapiens; identical to SEQ ID NO: 46448
  chr21:33630406-33630436
  hypo

SEQ ID NO: 66854 - DNA, 30 bp, Homo sapiens; identical to SEQ ID NO: 46449
  chr21:33694588-33694618
  hypo

SEQ ID NO: 66855 - DNA, 278 bp, Homo sapiens; identical to SEQ ID NO: 46451
  chr21:33954157-33954435
  hypo

SEQ ID NO: 66856 - DNA, 30 bp, Homo sapiens; identical to SEQ ID NO: 46453
  chr21:34127723-34127753
  hypo

SEQ ID NO: 66857 - DNA, 95 bp, Homo sapiens; identical to SEQ ID NO: 16704
  chr21:34459377-34459472
  hypo

SEQ ID NO: 66858 - DNA, 30 bp, Homo sapiens; identical to SEQ ID NO: 46455
  chr21:34466163-34466193
  hypo

SEQ ID NO: 66859 - DNA, 62 bp, Homo sapiens; identical to SEQ ID NO: 46456
  chr21:34471025-34471087
  hypo

SEQ ID NO: 66860 - DNA, 222 bp, Homo sapiens; identical to SEQ ID NO: 46457
  chr21:34508376-34508598
  hypo

SEQ ID NO: 66861 - DNA, 64 bp, Homo sapiens
  chr21:37527958-37528022
  hypo
cacagctgggtggggacagggcctgtgctcaggtgagcactgcctaccgcgcaccctccaggtg

SEQ ID NO: 66862 - DNA, 19 bp, Homo sapiens
  chr21:37699121-37699140
  hypo
ttttttttttgagaccgag

SEQ ID NO: 66863 - DNA, 133 bp, Homo sapiens; identical to SEQ ID NO: 46460
  chr21:37750031-37750164
  hypo

SEQ ID NO: 66864 - DNA, 78 bp, Homo sapiens; identical to SEQ ID NO: 25857
  chr21:37758492-37758570
  hypo

SEQ ID NO: 66865 - DNA, 17 bp, Homo sapiens
  chr21:37775141-37775158
  hypo
cacgccaggtgtgtttc

SEQ ID NO: 66866 - DNA, 30 bp, Homo sapiens; identical to SEQ ID NO: 46463
  chr21:37781662-37781692
  hypo

SEQ ID NO: 66867 - DNA, 79 bp, Homo sapiens
  chr21:38092100-38092179
  hypo
gacccttcccttccacggcaggtggagctcacgggcaacagtatttatgaatacatccatccttctgaccacgatgaga

SEQ ID NO: 66868 - DNA, 68 bp, Homo sapiens
  chr21:38092221-38092289
  hypo
tgctccaaggtattccatccagagggaaaaaaaaaaacagactaaaagcaaggcgacattcttaaatg

SEQ ID NO: 66869 - DNA, 40 bp, Homo sapiens; identical to SEQ ID NO: 46465
  chr21:38363098-38363138
  hypo

SEQ ID NO: 66870 - DNA, 30 bp, Homo sapiens; identical to SEQ ID NO: 46467
  chr21:38823635-38823665
  hypo

SEQ ID NO: 66871 - DNA, 72 bp, Homo sapiens; identical to SEQ ID NO: 46468
  chr21:38918489-38918561
  hypo

SEQ ID NO: 66872 - DNA, 98 bp, Homo sapiens
  chr21:38935380-38935478
  hypo
ggagaccatttttcacgcctggccggctctgtgcttaagtggccccatcgcagccagagtagcctcattacagctgaagtccctggtaggtctcctcc

SEQ ID NO: 66873 - DNA, 30 bp, Homo sapiens; identical to SEQ ID NO: 46470
  chr21:38987670-38987700
  hypo

SEQ ID NO: 66874 - DNA, 30 bp, Homo sapiens; identical to SEQ ID NO: 46471
  chr21:40510674-40510704
  hypo

SEQ ID NO: 66875 - DNA, 39 bp, Homo sapiens; identical to SEQ ID NO: 46472
  chr21:42448116-42448155
  hypo

SEQ ID NO: 66876 - DNA, 30 bp, Homo sapiens; identical to SEQ ID NO: 16710
  chr21:42613756-42613786
  hypo

SEQ ID NO: 66877 - DNA, 30 bp, Homo sapiens; identical to SEQ ID NO: 46474
  chr21:42953643-42953673
  hypo

SEQ ID NO: 66878 - DNA, 30 bp, Homo sapiens; identical to SEQ ID NO: 46475
  chr21:43033404-43033434
  hypo

SEQ ID NO: 66879 - DNA, 382 bp, Homo sapiens; identical to SEQ ID NO: 46476
  chr21:43248539-43248921
  hypo

SEQ ID NO: 66880 - DNA, 42 bp, Homo sapiens; identical to SEQ ID NO: 46477
  chr21:43255693-43255735
  hypo

SEQ ID NO: 66881 - DNA, 38 bp, Homo sapiens; identical to SEQ ID NO: 46479
  chr21:43493035-43493073
  hypo

SEQ ID NO: 66882 - DNA, 70 bp, Homo sapiens; identical to SEQ ID NO: 46480
  chr21:43725826-43725896
  hypo

SEQ ID NO: 66883 - DNA, 187 bp, Homo sapiens
  chr21:43786496-43786683
  hypo
gagcaggaagaagcacgccttacctgtctgggcctcggccagggtgccgagggccagcatggacaccaggaccagggcgcagatcaccttgttctccatggtggccattgcctcctctctgctccaaaggcgaccccgagtcagggatgagaggccgcccgagccccggattttatagggcaggctc

SEQ ID NO: 66884 - DNA, 28 bp, Homo sapiens
  chr21:43786713-43786741
  hypo
gcctaaggaggcccggggatcctctgag

SEQ ID NO: 66885 - DNA, 45 bp, Homo sapiens; identical to SEQ ID NO: 46482
  chr21:43864728-43864773
  hypo

SEQ ID NO: 66886 - DNA, 30 bp, Homo sapiens; identical to SEQ ID NO: 46483
  chr21:43991300-43991330
  hypo

SEQ ID NO: 66887 - DNA, 30 bp, Homo sapiens; identical to SEQ ID NO: 46484
  chr21:44093215-44093245
  hypo

SEQ ID NO: 66888 - DNA, 378 bp, Homo sapiens; identical to SEQ ID NO: 46486
  chr21:44338174-44338552
  hypo

SEQ ID NO: 66889 - DNA, 46 bp, Homo sapiens; identical to SEQ ID NO: 46487
  chr21:44480679-44480725
  hypo

SEQ ID NO: 66890 - DNA, 30 bp, Homo sapiens; identical to SEQ ID NO: 46488
  chr21:44482657-44482687
  hypo

SEQ ID NO: 66891 - DNA, 34 bp, Homo sapiens; identical to SEQ ID NO: 46489
  chr21:44482920-44482954
  hypo

SEQ ID NO: 66892 - DNA, 242 bp, Homo sapiens
  chr21:44836846-44837088
  hypo
cagcagcgggagccccgacgtgaggagggtgctggggagcggggcagccccagggccatcacagggggcgatcacaaacggggcaggggccggctggggggcctgggagcagccgggtgcagcggccgggtggtgctgtaactggagcagcctgtgggaacagaggacaggtggtcactgcgccggctcgcagggttctcgggtttccgagtgcccgtgtggcagggcccgcccgaggagct

SEQ ID NO: 66893 - DNA, 43 bp, Homo sapiens; identical to SEQ ID NO: 46491
  chr21:44837378-44837421
  hypo

SEQ ID NO: 66894 - DNA, 51 bp, Homo sapiens
  chr21:44866552-44866603
  hypo
tactggcacttgggccggtgtgaagccacccccctgccatgaaaaatggct

SEQ ID NO: 66895 - DNA, 192 bp, Homo sapiens; identical to SEQ ID NO: 25865
  chr21:44866711-44866903
  hypo

SEQ ID NO: 66896 - DNA, 30 bp, Homo sapiens; identical to SEQ ID NO: 46493
  chr21:44871839-44871869
  hypo

SEQ ID NO: 66897 - DNA, 58 bp, Homo sapiens; identical to SEQ ID NO: 46494
  chr21:45140870-45140928
  hypo

SEQ ID NO: 66898 - DNA, 57 bp, Homo sapiens; identical to SEQ ID NO: 16716
  chr21:45170351-45170408
  hypo

SEQ ID NO: 66899 - DNA, 9 bp, Homo sapiens
  chr21:45195319-45195328
  hypo
acagggaag

SEQ ID NO: 66900 - DNA, 36 bp, Homo sapiens; identical to SEQ ID NO: 46497
  chr21:45201243-45201279
  hypo

SEQ ID NO: 66901 - DNA, 30 bp, Homo sapiens; identical to SEQ ID NO: 16718
  chr21:45232947-45232977
  hypo

SEQ ID NO: 66902 - DNA, 30 bp, Homo sapiens; identical to SEQ ID NO: 16719
  chr21:45247147-45247177
  hypo

SEQ ID NO: 66903 - DNA, 30 bp, Homo sapiens; identical to SEQ ID NO: 46500
  chr21:45268919-45268949
  hypo

SEQ ID NO: 66904 - DNA, 30 bp, Homo sapiens; identical to SEQ ID NO: 46501
  chr21:45273343-45273373
  hypo

SEQ ID NO: 66905 - DNA, 138 bp, Homo sapiens
  chr21:45273579-45273717
  hypo
ggtgatcctatgaaccgccccagagaaacactcctgcatctcacagcgttctccctcgtgctcttgtcttctctttcctaccagattccaaattctcttcccaagaggtggcatgaacctgtgagtcccagctgcaac

SEQ ID NO: 66906 - DNA, 99 bp, Homo sapiens; identical to SEQ ID NO: 46503
  chr21:45276620-45276719
  hypo

SEQ ID NO: 66907 - DNA, 30 bp, Homo sapiens; identical to SEQ ID NO: 46504
  chr21:45299990-45300020
  hypo

SEQ ID NO: 66908 - DNA, 30 bp, Homo sapiens; identical to SEQ ID NO: 46505
  chr21:45352946-45352976
  hypo

SEQ ID NO: 66909 - DNA, 97 bp, Homo sapiens; identical to SEQ ID NO: 46506
  chr21:45365737-45365834
  hypo

SEQ ID NO: 66910 - DNA, 34 bp, Homo sapiens; identical to SEQ ID NO: 46507
  chr21:45411880-45411914
  hypo

SEQ ID NO: 66911 - DNA, 65 bp, Homo sapiens; identical to SEQ ID NO: 46508
  chr21:45516505-45516570
  hypo

SEQ ID NO: 66912 - DNA, 88 bp, Homo sapiens; identical to SEQ ID NO: 46509
  chr21:45583747-45583835
  hypo

SEQ ID NO: 66913 - DNA, 30 bp, Homo sapiens; identical to SEQ ID NO: 46510
  chr21:45657028-45657058
  hypo

SEQ ID NO: 66914 - DNA, 131 bp, Homo sapiens; identical to SEQ ID NO: 46511
  chr21:45681620-45681751
  hypo

SEQ ID NO: 66915 - DNA, 79 bp, Homo sapiens; identical to SEQ ID NO: 46512
  chr21:45682528-45682607
  hypo

SEQ ID NO: 66916 - DNA, 30 bp, Homo sapiens; identical to SEQ ID NO: 46513
  chr21:45710106-45710136
  hypo

SEQ ID NO: 66917 - DNA, 30 bp, Homo sapiens; identical to SEQ ID NO: 46514
  chr21:45713048-45713078
  hypo

SEQ ID NO: 66918 - DNA, 34 bp, Homo sapiens; identical to SEQ ID NO: 46515
  chr21:45713421-45713455
  hypo

SEQ ID NO: 66919 - DNA, 30 bp, Homo sapiens; identical to SEQ ID NO: 46516
  chr21:45727181-45727211
  hypo

SEQ ID NO: 66920 - DNA, 30 bp, Homo sapiens; identical to SEQ ID NO: 46517
  chr21:45749126-45749156
  hypo

SEQ ID NO: 66921 - DNA, 106 bp, Homo sapiens; identical to SEQ ID NO: 46518
  chr21:45750020-45750126
  hypo

SEQ ID NO: 66922 - DNA, 30 bp, Homo sapiens; identical to SEQ ID NO: 46519
  chr21:45753810-45753840
  hypo

SEQ ID NO: 66923 - DNA, 45 bp, Homo sapiens
  chr21:45791109-45791154
  hypo
ccatggccgcctccctccagtctctgcctccgtgtcccgtggccg

SEQ ID NO: 66924 - DNA, 30 bp, Homo sapiens; identical to SEQ ID NO: 46521
  chr21:45824465-45824495
  hypo

SEQ ID NO: 66925 - DNA, 68 bp, Homo sapiens; identical to SEQ ID NO: 46522
  chr21:45844751-45844819
  hypo

SEQ ID NO: 66926 - DNA, 196 bp, Homo sapiens; identical to SEQ ID NO: 46523
  chr21:45929175-45929371
  hypo

SEQ ID NO: 66927 - DNA, 30 bp, Homo sapiens; identical to SEQ ID NO: 46524
  chr21:45939784-45939814
  hypo

SEQ ID NO: 66928 - DNA, 135 bp, Homo sapiens; identical to SEQ ID NO: 46525
  chr21:45959906-45960041
  hypo

SEQ ID NO: 66929 - DNA, 30 bp, Homo sapiens; identical to SEQ ID NO: 16724
  chr21:46015435-46015465
  hypo

SEQ ID NO: 66930 - DNA, 38 bp, Homo sapiens; identical to SEQ ID NO: 46527
  chr21:46035197-46035235
  hypo

SEQ ID NO: 66931 - DNA, 70 bp, Homo sapiens
  chr21:46036572-46036642
  hypo
ggtcagcacccaattcgagagctctgctcagcagtgagaatgagacaccgtgacaatgcggctgcgcacc

SEQ ID NO: 66932 - DNA, 60 bp, Homo sapiens; identical to SEQ ID NO: 25875
  chr21:46036767-46036827
  hypo

SEQ ID NO: 66933 - DNA, 58 bp, Homo sapiens; identical to SEQ ID NO: 46529
  chr21:46068645-46068703
  hypo

SEQ ID NO: 66934 - DNA, 30 bp, Homo sapiens; identical to SEQ ID NO: 46530
  chr21:46169786-46169816
  hypo

SEQ ID NO: 66935 - DNA, 33 bp, Homo sapiens; identical to SEQ ID NO: 46531
  chr21:46184045-46184078
  hypo

SEQ ID NO: 66936 - DNA, 102 bp, Homo sapiens; identical to SEQ ID NO: 46532
  chr21:46184437-46184539
  hypo

SEQ ID NO: 66937 - DNA, 30 bp, Homo sapiens; identical to SEQ ID NO: 46533
  chr21:46206196-46206226
  hypo

SEQ ID NO: 66938 - DNA, 202 bp, Homo sapiens; identical to SEQ ID NO: 46534
  chr21:46238872-46239074
  hypo

SEQ ID NO: 66939 - DNA, 199 bp, Homo sapiens
  chr21:46256917-46257116
  hypo
agtcacgcgaggctccgaggcagcaggtttcaggggcacctccgtgcagtccccggcacccagggtgcagcccccagcacctccgtgtagcccccgacacccagggtgcagcccccggcacctccgtgtagcccccggcacccaggcagtccccggcacctccgtgtagctcccggcacccagggtgcagctcctggcc

SEQ ID NO: 66940 - DNA, 43 bp, Homo sapiens
  chr21:46257273-46257316
  hypo
tcatgaattagcctggtagacaggaggccggagaagcccggat

SEQ ID NO: 66941 - DNA, 175 bp, Homo sapiens; identical to SEQ ID NO: 46536
  chr21:46257708-46257883
  hypo

SEQ ID NO: 66942 - DNA, 78 bp, Homo sapiens; identical to SEQ ID NO: 46537
  chr21:46273062-46273140
  hypo

SEQ ID NO: 66943 - DNA, 353 bp, Homo sapiens; identical to SEQ ID NO: 46538
  chr21:46308526-46308879
  hypo

SEQ ID NO: 66944 - DNA, 40 bp, Homo sapiens; identical to SEQ ID NO: 46539
  chr21:46309364-46309404
  hypo

SEQ ID NO: 66945 - DNA, 292 bp, Homo sapiens
  chr21:46310491-46310783
  hypo
ggccagtggggactcggcactgcctcctgccacagccccgccctccctcctgcgttcgtgcactgacaggccaggttgtgggagaatgcagggacaaggggtttttacagatgtggaagctggcatcaagccgctggcaggcaggagccacacacaccctgaggcatcctcagagacggcactgccacgggctctcctgctccccagaggaggaagctgcaggaccgagtgtctgagtacctgtggcagggcaccccccgacacctgccaagtgttccgactgagtcacccc

SEQ ID NO: 66946 - DNA, 122 bp, Homo sapiens; identical to SEQ ID NO: 46541
  chr21:46311753-46311875
  hypo

SEQ ID NO: 66947 - DNA, 58 bp, Homo sapiens; identical to SEQ ID NO: 46542
  chr21:46317030-46317088
  hypo

SEQ ID NO: 66948 - DNA, 54 bp, Homo sapiens; identical to SEQ ID NO: 46544
  chr21:46318785-46318839
  hypo

SEQ ID NO: 66949 - DNA, 13 bp, Homo sapiens
  chr21:46319143-46319156
  hypo
gtctgccccgctc

SEQ ID NO: 66950 - DNA, 46 bp, Homo sapiens; identical to SEQ ID NO: 25882
  chr21:46319459-46319505
  hypo

SEQ ID NO: 66951 - DNA, 38 bp, Homo sapiens; identical to SEQ ID NO: 46546
  chr21:46321598-46321636
  hypo

SEQ ID NO: 66952 - DNA, 23 bp, Homo sapiens
  chr21:46359164-46359187
  hypo
gatgagcagggctcccgttccca

SEQ ID NO: 66953 - DNA, 117 bp, Homo sapiens
  chr21:46359248-46359365
  hypo
ttctaaagaactgttctgaggactaaatggaatagtgtaaaaaataaattgacatgaagtgaaggtcaattaaaatgcactagcttggccaggcgcagtgtggctcatgcctgtaat

SEQ ID NO: 66954 - DNA, 33 bp, Homo sapiens; identical to SEQ ID NO: 46548
  chr21:46424460-46424493
  hypo

SEQ ID NO: 66955 - DNA, 65 bp, Homo sapiens; identical to SEQ ID NO: 46549
  chr21:46431841-46431906
  hypo

SEQ ID NO: 66956 - DNA, 46 bp, Homo sapiens; identical to SEQ ID NO: 46550
  chr21:46439310-46439356
  hypo

SEQ ID NO: 66957 - DNA, 94 bp, Homo sapiens; identical to SEQ ID NO: 25884
  chr21:46452280-46452374
  hypo

SEQ ID NO: 66958 - DNA, 34 bp, Homo sapiens; identical to SEQ ID NO: 46552
  chr21:46549475-46549509
  hypo

SEQ ID NO: 66959 - DNA, 85 bp, Homo sapiens; identical to SEQ ID NO: 46553
  chr21:46677808-46677893
  hypo

SEQ ID NO: 66960 - DNA, 30 bp, Homo sapiens; identical to SEQ ID NO: 46554
  chr21:46839039-46839069
  hypo

SEQ ID NO: 66961 - DNA, 62 bp, Homo sapiens; identical to SEQ ID NO: 46555
  chr21:46844701-46844763
  hypo

SEQ ID NO: 66962 - DNA, 30 bp, Homo sapiens; identical to SEQ ID NO: 46556
  chr21:46848585-46848615
  hypo

SEQ ID NO: 66963 - DNA, 30 bp, Homo sapiens; identical to SEQ ID NO: 46557
  chr21:46853427-46853457
  hypo

SEQ ID NO: 66964 - DNA, 83 bp, Homo sapiens; identical to SEQ ID NO: 46558
  chr21:46863752-46863835
  hypo

SEQ ID NO: 66965 - DNA, 305 bp, Homo sapiens; identical to SEQ ID NO: 46559
  chr21:46864146-46864451
  hypo

SEQ ID NO: 66966 - DNA, 79 bp, Homo sapiens; identical to SEQ ID NO: 46560
  chr21:46894771-46894850
  hypo

SEQ ID NO: 66967 - DNA, 30 bp, Homo sapiens; identical to SEQ ID NO: 46561
  chr21:46895400-46895430
  hypo

SEQ ID NO: 66968 - DNA, 106 bp, Homo sapiens; identical to SEQ ID NO: 46562
  chr21:46908905-46909011
  hypo

SEQ ID NO: 66969 - DNA, 30 bp, Homo sapiens; identical to SEQ ID NO: 46563
  chr21:46909213-46909243
  hypo

SEQ ID NO: 66970 - DNA, 35 bp, Homo sapiens; identical to SEQ ID NO: 46564
  chr21:46909499-46909534
  hypo

SEQ ID NO: 66971 - DNA, 388 bp, Homo sapiens; identical to SEQ ID NO: 46565
  chr21:46912094-46912482
  hypo

SEQ ID NO: 66972 - DNA, 163 bp, Homo sapiens; identical to SEQ ID NO: 46566
  chr21:46921470-46921633
  hypo

SEQ ID NO: 66973 - DNA, 84 bp, Homo sapiens; identical to SEQ ID NO: 46567
  chr21:46925361-46925445
  hypo

SEQ ID NO: 66974 - DNA, 26 bp, Homo sapiens
  chr21:46925754-46925780
  hypo
aggctctgggctacacgccaggccat

SEQ ID NO: 66975 - DNA, 20 bp, Homo sapiens
  chr21:46926439-46926459
  hypo
ggtggcaggagtggccgctc

SEQ ID NO: 66976 - DNA, 19 bp, Homo sapiens
  chr21:46926565-46926584
  hypo
catccgtgggagcctccat

SEQ ID NO: 66977 - DNA, 89 bp, Homo sapiens; identical to SEQ ID NO: 46570
  chr21:46934071-46934160
  hypo

SEQ ID NO: 66978 - DNA, 34 bp, Homo sapiens
  chr21:46935936-46935970
  hypo
cctgggccgggggctgccgcgggtggtggccccg

SEQ ID NO: 66979 - DNA, 30 bp, Homo sapiens; identical to SEQ ID NO: 46572
  chr21:46978498-46978528
  hypo

SEQ ID NO: 66980 - DNA, 54 bp, Homo sapiens; identical to SEQ ID NO: 46573
  chr21:46999805-46999859
  hypo

SEQ ID NO: 66981 - DNA, 77 bp, Homo sapiens; identical to SEQ ID NO: 46574
  chr21:47013235-47013312
  hypo

SEQ ID NO: 66982 - DNA, 49 bp, Homo sapiens; identical to SEQ ID NO: 46575
  chr21:47019157-47019206
  hypo

SEQ ID NO: 66983 - DNA, 39 bp, Homo sapiens; identical to SEQ ID NO: 46576
  chr21:47026381-47026420
  hypo

SEQ ID NO: 66984 - DNA, 67 bp, Homo sapiens; identical to SEQ ID NO: 46577
  chr21:47026666-47026733
  hypo

SEQ ID NO: 66985 - DNA, 30 bp, Homo sapiens; identical to SEQ ID NO: 46578
  chr21:47036096-47036126
  hypo

SEQ ID NO: 66986 - DNA, 120 bp, Homo sapiens; identical to SEQ ID NO: 46579
  chr21:47213460-47213580
  hypo

SEQ ID NO: 66987 - DNA, 69 bp, Homo sapiens; identical to SEQ ID NO: 46580
  chr21:47287081-47287150
  hypo

SEQ ID NO: 66988 - DNA, 32 bp, Homo sapiens; identical to SEQ ID NO: 46581
  chr21:47287393-47287425
  hypo

SEQ ID NO: 66989 - DNA, 30 bp, Homo sapiens; identical to SEQ ID NO: 46582
  chr21:47328429-47328459
  hypo

SEQ ID NO: 66990 - DNA, 30 bp, Homo sapiens; identical to SEQ ID NO: 46583
  chr21:47365874-47365904
  hypo

SEQ ID NO: 66991 - DNA, 157 bp, Homo sapiens
  chr21:47404017-47404174
  hypo
gccttccaggagggccggcctcagggccacagggcaagtccagctgtgtgtcagccacggccagggtggggcagcctgtccatctgggtgacgtcgcgccctgggacgggtagcgatggcgccaggggccgcccgcctcacgcccgccgtgcctgtt

SEQ ID NO: 66992 - DNA, 35 bp, Homo sapiens; identical to SEQ ID NO: 46585
  chr21:47417760-47417795
  hypo

SEQ ID NO: 66993 - DNA, 30 bp, Homo sapiens; identical to SEQ ID NO: 46586
  chr21:47418458-47418488
  hypo

SEQ ID NO: 66994 - DNA, 30 bp, Homo sapiens; identical to SEQ ID NO: 46587
  chr21:47420466-47420496
  hypo

SEQ ID NO: 66995 - DNA, 34 bp, Homo sapiens; identical to SEQ ID NO: 46588
  chr21:47421299-47421333
  hypo

SEQ ID NO: 66996 - DNA, 92 bp, Homo sapiens; identical to SEQ ID NO: 46589
  chr21:47422662-47422754
  hypo

SEQ ID NO: 66997 - DNA, 142 bp, Homo sapiens; identical to SEQ ID NO: 46590
  chr21:47425521-47425663
  hypo

SEQ ID NO: 66998 - DNA, 53 bp, Homo sapiens; identical to SEQ ID NO: 46591
  chr21:47457442-47457495
  hypo

SEQ ID NO: 66999 - DNA, 35 bp, Homo sapiens; identical to SEQ ID NO: 46592
  chr21:47459822-47459857
  hypo

SEQ ID NO: 67000 - DNA, 65 bp, Homo sapiens; identical to SEQ ID NO: 46593
  chr21:47471074-47471139
  hypo

SEQ ID NO: 67001 - DNA, 67 bp, Homo sapiens; identical to SEQ ID NO: 46594
  chr21:47475296-47475363
  hypo

SEQ ID NO: 67002 - DNA, 30 bp, Homo sapiens; identical to SEQ ID NO: 46595
  chr21:47487782-47487812
  hypo

SEQ ID NO: 67003 - DNA, 78 bp, Homo sapiens; identical to SEQ ID NO: 46596
  chr21:47489936-47490014
  hypo

SEQ ID NO: 67004 - DNA, 30 bp, Homo sapiens; identical to SEQ ID NO: 16747
  chr21:47501864-47501894
  hypo

SEQ ID NO: 67005 - DNA, 34 bp, Homo sapiens; identical to SEQ ID NO: 16748
  chr21:47503061-47503095
  hypo

SEQ ID NO: 67006 - DNA, 93 bp, Homo sapiens; identical to SEQ ID NO: 46600
  chr21:47531922-47532015
  hypo

SEQ ID NO: 67007 - DNA, 30 bp, Homo sapiens; identical to SEQ ID NO: 46601
  chr21:47539603-47539633
  hypo

SEQ ID NO: 67008 - DNA, 30 bp, Homo sapiens; identical to SEQ ID NO: 46602
  chr21:47546044-47546074
  hypo

SEQ ID NO: 67009 - DNA, 43 bp, Homo sapiens; identical to SEQ ID NO: 46603
  chr21:47565176-47565219
  hypo

SEQ ID NO: 67010 - DNA, 62 bp, Homo sapiens; identical to SEQ ID NO: 46604
  chr21:47570296-47570358
  hypo

SEQ ID NO: 67011 - DNA, 30 bp, Homo sapiens; identical to SEQ ID NO: 46605
  chr21:47689638-47689668
  hypo

SEQ ID NO: 67012 - DNA, 37 bp, Homo sapiens; identical to SEQ ID NO: 16750
  chr21:47737928-47737965
  hypo

SEQ ID NO: 67013 - DNA, 92 bp, Homo sapiens; identical to SEQ ID NO: 25901
  chr21:47746178-47746270
  hypo

SEQ ID NO: 67014 - DNA, 21 bp, Homo sapiens
  chr21:47746393-47746414
  hypo
agagtccggtaaccaaggagg

SEQ ID NO: 67015 - DNA, 30 bp, Homo sapiens; identical to SEQ ID NO: 46608
  chr21:47771781-47771811
  hypo

SEQ ID NO: 67016 - DNA, 30 bp, Homo sapiens; identical to SEQ ID NO: 46609
  chr21:47772056-47772086
  hypo

SEQ ID NO: 67017 - DNA, 44 bp, Homo sapiens; identical to SEQ ID NO: 46610
  chr21:47799181-47799225
  hypo

SEQ ID NO: 67018 - DNA, 37 bp, Homo sapiens; identical to SEQ ID NO: 46611
  chr22:17330739-17330776
  hypo

SEQ ID NO: 67019 - DNA, 4 bp, Homo sapiens
  chr22:18009965-18009969
  hypo
ggct

SEQ ID NO: 67020 - DNA, 96 bp, Homo sapiens
  chr22:18110593-18110689
  hypo
aaaaagaaaaaaagaaaaaaacacagttcataaagtgaacgaccttgtcaaaacactggttggaagcaggtctcttccctccgcactgtttcctat

SEQ ID NO: 67021 - DNA, 30 bp, Homo sapiens; identical to SEQ ID NO: 46614
  chr22:18265801-18265831
  hypo

SEQ ID NO: 67022 - DNA, 34 bp, Homo sapiens
  chr22:18328093-18328127
  hypo
gggtaacgtggggaacgcatactgtctggcaaga

SEQ ID NO: 67023 - DNA, 30 bp, Homo sapiens; identical to SEQ ID NO: 46616
  chr22:18355680-18355710
  hypo

SEQ ID NO: 67024 - DNA, 30 bp, Homo sapiens; identical to SEQ ID NO: 16753
  chr22:18553893-18553923
  hypo

SEQ ID NO: 67025 - DNA, 53 bp, Homo sapiens; identical to SEQ ID NO: 46618
  chr22:18634479-18634532
  hypo

SEQ ID NO: 67026 - DNA, 27 bp, Homo sapiens
  chr22:19117537-19117564
  hypo
catgcactgcagccccgacccacccat

SEQ ID NO: 67027 - DNA, 82 bp, Homo sapiens
  chr22:19117594-19117676
  hypo
gactcacctgcccggctctctaccctgaggggcctgccgcctctgctcccaaacacagagctgctttcgtctaccaggcttg

SEQ ID NO: 67028 - DNA, 30 bp, Homo sapiens; identical to SEQ ID NO: 46620
  chr22:19444363-19444393
  hypo

SEQ ID NO: 67029 - DNA, 43 bp, Homo sapiens; identical to SEQ ID NO: 46621
  chr22:19771799-19771842
  hypo

SEQ ID NO: 67030 - DNA, 78 bp, Homo sapiens; identical to SEQ ID NO: 46622
  chr22:19965000-19965078
  hypo

SEQ ID NO: 67031 - DNA, 151 bp, Homo sapiens; identical to SEQ ID NO: 46623
  chr22:20166058-20166209
  hypo

SEQ ID NO: 67032 - DNA, 33 bp, Homo sapiens; identical to SEQ ID NO: 46624
  chr22:20308760-20308793
  hypo

SEQ ID NO: 67033 - DNA, 39 bp, Homo sapiens; identical to SEQ ID NO: 46625
  chr22:20749338-20749377
  hypo

SEQ ID NO: 67034 - DNA, 22 bp, Homo sapiens
  chr22:20765425-20765447
  hypo
ccgtgcccggccaaaaaggact

SEQ ID NO: 67035 - DNA, 20 bp, Homo sapiens
  chr22:20851286-20851306
  hypo
gggcttggtggctggcgcct

SEQ ID NO: 67036 - DNA, 34 bp, Homo sapiens; identical to SEQ ID NO: 46628
  chr22:21024902-21024936
  hypo

SEQ ID NO: 67037 - DNA, 88 bp, Homo sapiens; identical to SEQ ID NO: 46629
  chr22:21105305-21105393
  hypo

SEQ ID NO: 67038 - DNA, 30 bp, Homo sapiens; identical to SEQ ID NO: 46630
  chr22:21150528-21150558
  hypo

SEQ ID NO: 67039 - DNA, 23 bp, Homo sapiens
  chr22:21154000-21154023
  hypo
gccaagaacgcctccacaatcac

SEQ ID NO: 67040 - DNA, 91 bp, Homo sapiens; identical to SEQ ID NO: 46632
  chr22:21214252-21214343
  hypo

SEQ ID NO: 67041 - DNA, 34 bp, Homo sapiens; identical to SEQ ID NO: 46633
  chr22:21380309-21380343
  hypo

SEQ ID NO: 67042 - DNA, 58 bp, Homo sapiens; identical to SEQ ID NO: 46634
  chr22:21982983-21983041
  hypo

SEQ ID NO: 67043 - DNA, 87 bp, Homo sapiens; identical to SEQ ID NO: 46635
  chr22:21986707-21986794
  hypo

SEQ ID NO: 67044 - DNA, 30 bp, Homo sapiens; identical to SEQ ID NO: 46636
  chr22:22058379-22058409
  hypo

SEQ ID NO: 67045 - DNA, 30 bp, Homo sapiens; identical to SEQ ID NO: 46637
  chr22:22344036-22344066
  hypo

SEQ ID NO: 67046 - DNA, 321 bp, Homo sapiens; identical to SEQ ID NO: 46638
  chr22:22899633-22899954
  hypo

SEQ ID NO: 67047 - DNA, 153 bp, Homo sapiens; identical to SEQ ID NO: 46640
  chr22:23453131-23453284
  hypo

SEQ ID NO: 67048 - DNA, 15 bp, Homo sapiens
  chr22:23791432-23791447
  hypo
cggggccagtccctg

SEQ ID NO: 67049 - DNA, 82 bp, Homo sapiens; identical to SEQ ID NO: 46642
  chr22:23915601-23915683
  hypo

SEQ ID NO: 67050 - DNA, 42 bp, Homo sapiens; identical to SEQ ID NO: 16758
  chr22:24374229-24374271
  hypo

SEQ ID NO: 67051 - DNA, 42 bp, Homo sapiens; identical to SEQ ID NO: 46645
  chr22:24646515-24646557
  hypo

SEQ ID NO: 67052 - DNA, 30 bp, Homo sapiens; identical to SEQ ID NO: 46646
  chr22:25091239-25091269
  hypo

SEQ ID NO: 67053 - DNA, 21 bp, Homo sapiens
  chr22:25171155-25171176
  hypo
tcctcacgtggaagagtggaa

SEQ ID NO: 67054 - DNA, 30 bp, Homo sapiens; identical to SEQ ID NO: 46648
  chr22:26763231-26763261
  hypo

SEQ ID NO: 67055 - DNA, 38 bp, Homo sapiens; identical to SEQ ID NO: 46649
  chr22:26932483-26932521
  hypo

SEQ ID NO: 67056 - DNA, 19 bp, Homo sapiens
  chr22:26965186-26965205
  hypo
accccgttccagtaacagt

SEQ ID NO: 67057 - DNA, 21 bp, Homo sapiens
  chr22:26991250-26991271
  hypo
gcctgtgaggccaggcgcagt

SEQ ID NO: 67058 - DNA, 20 bp, Homo sapiens
  chr22:27010657-27010677
  hypo
taaaaacaagtaaatcggcc

SEQ ID NO: 67059 - DNA, 71 bp, Homo sapiens; identical to SEQ ID NO: 46653
  chr22:27045927-27045998
  hypo

SEQ ID NO: 67060 - DNA, 64 bp, Homo sapiens; identical to SEQ ID NO: 46654
  chr22:28007163-28007227
  hypo

SEQ ID NO: 67061 - DNA, 45 bp, Homo sapiens
  chr22:28371679-28371724
  hypo
tcatatatagtggcataaaatcgtttgtagcgttttcttattctt

SEQ ID NO: 67062 - DNA, 30 bp, Homo sapiens; identical to SEQ ID NO: 46656
  chr22:29167679-29167709
  hypo

SEQ ID NO: 67063 - DNA, 30 bp, Homo sapiens; identical to SEQ ID NO: 46657
  chr22:29168256-29168286
  hypo

SEQ ID NO: 67064 - DNA, 160 bp, Homo sapiens
  chr22:29445592-29445752
  hypo
agggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccag

SEQ ID NO: 67065 - DNA, 402 bp, Homo sapiens
  chr22:29445923-29446325
  hypo
cttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctc

SEQ ID NO: 67066 - DNA, 20 bp, Homo sapiens
  chr22:29701033-29701053
  hypo
ccggccgggaatgttaagac

SEQ ID NO: 67067 - DNA, 30 bp, Homo sapiens; identical to SEQ ID NO: 46660
  chr22:29736031-29736061
  hypo

SEQ ID NO: 67068 - DNA, 24 bp, Homo sapiens
  chr22:29977939-29977963
  hypo
agtggaagccgtcctcttgtgctg

SEQ ID NO: 67069 - DNA, 34 bp, Homo sapiens; identical to SEQ ID NO: 46663
  chr22:29997189-29997223
  hypo

SEQ ID NO: 67070 - DNA, 36 bp, Homo sapiens; identical to SEQ ID NO: 46664
  chr22:29998650-29998686
  hypo

SEQ ID NO: 67071 - DNA, 30 bp, Homo sapiens; identical to SEQ ID NO: 46665
  chr22:30091110-30091140
  hypo

SEQ ID NO: 67072 - DNA, 29 bp, Homo sapiens
  chr22:30233129-30233158
  hypo
gtaggcagggctgggcgcgatggctcacg

SEQ ID NO: 67073 - DNA, 30 bp, Homo sapiens; identical to SEQ ID NO: 46668
  chr22:30768004-30768034
  hypo

SEQ ID NO: 67074 - DNA, 102 bp, Homo sapiens; identical to SEQ ID NO: 46669
  chr22:30783894-30783996
  hypo

SEQ ID NO: 67075 - DNA, 319 bp, Homo sapiens; identical to SEQ ID NO: 46670
  chr22:30857340-30857659
  hypo

SEQ ID NO: 67076 - DNA, 30 bp, Homo sapiens; identical to SEQ ID NO: 46671
  chr22:30924831-30924861
  hypo

SEQ ID NO: 67077 - DNA, 30 bp, Homo sapiens; identical to SEQ ID NO: 46672
  chr22:30940902-30940932
  hypo

SEQ ID NO: 67078 - DNA, 30 bp, Homo sapiens; identical to SEQ ID NO: 46673
  chr22:31460423-31460453
  hypo

SEQ ID NO: 67079 - DNA, 35 bp, Homo sapiens; identical to SEQ ID NO: 16768
  chr22:32014233-32014268
  hypo

SEQ ID NO: 67080 - DNA, 29 bp, Homo sapiens
  chr22:32356777-32356806
  hypo
aaaaactccgtccccgccccccccccccc

SEQ ID NO: 67081 - DNA, 80 bp, Homo sapiens; identical to SEQ ID NO: 46676
  chr22:32701637-32701717
  hypo

SEQ ID NO: 67082 - DNA, 30 bp, Homo sapiens; identical to SEQ ID NO: 46677
  chr22:32748880-32748910
  hypo

SEQ ID NO: 67083 - DNA, 24 bp, Homo sapiens
  chr22:33170623-33170647
  hypo
gctggagtgcaatggcgcacgatc

SEQ ID NO: 67084 - DNA, 149 bp, Homo sapiens; identical to SEQ ID NO: 46679
  chr22:33255195-33255344
  hypo

SEQ ID NO: 67085 - DNA, 35 bp, Homo sapiens; identical to SEQ ID NO: 46680
  chr22:35079349-35079384
  hypo

SEQ ID NO: 67086 - DNA, 30 bp, Homo sapiens; identical to SEQ ID NO: 5266
  chr22:35768487-35768517
  hypo

SEQ ID NO: 67087 - DNA, 96 bp, Homo sapiens; identical to SEQ ID NO: 46682
  chr22:35822686-35822782
  hypo

SEQ ID NO: 67088 - DNA, 34 bp, Homo sapiens
  chr22:35848324-35848358
  hypo
gtcacaccctggaaccgtgtggtgtttctgttgt

SEQ ID NO: 67089 - DNA, 30 bp, Homo sapiens; identical to SEQ ID NO: 46684
  chr22:35964914-35964944
  hypo

SEQ ID NO: 67090 - DNA, 25 bp, Homo sapiens
  chr22:36246202-36246227
  hypo
ccgtgtgcacgcatgcgcattctct

SEQ ID NO: 67091 - DNA, 25 bp, Homo sapiens
  chr22:36246287-36246312
  hypo
tcactgtctccggcagagacaggtg

SEQ ID NO: 67092 - DNA, 70 bp, Homo sapiens; identical to SEQ ID NO: 46687
  chr22:36585930-36586000
  hypo

SEQ ID NO: 67093 - DNA, 150 bp, Homo sapiens; identical to SEQ ID NO: 46688
  chr22:36684196-36684346
  hypo

SEQ ID NO: 67094 - DNA, 30 bp, Homo sapiens; identical to SEQ ID NO: 16776
  chr22:36878964-36878994
  hypo

SEQ ID NO: 67095 - DNA, 126 bp, Homo sapiens; identical to SEQ ID NO: 46690
  chr22:36902430-36902556
  hypo

SEQ ID NO: 67096 - DNA, 41 bp, Homo sapiens; identical to SEQ ID NO: 46691
  chr22:36906156-36906197
  hypo

SEQ ID NO: 67097 - DNA, 117 bp, Homo sapiens; identical to SEQ ID NO: 46692
  chr22:37321872-37321989
  hypo

SEQ ID NO: 67098 - DNA, 82 bp, Homo sapiens; identical to SEQ ID NO: 46693
  chr22:37328816-37328898
  hypo

SEQ ID NO: 67099 - DNA, 30 bp, Homo sapiens; identical to SEQ ID NO: 46694
  chr22:37334157-37334187
  hypo

SEQ ID NO: 67100 - DNA, 50 bp, Homo sapiens; identical to SEQ ID NO: 46695
  chr22:37335158-37335208
  hypo

SEQ ID NO: 67101 - DNA, 30 bp, Homo sapiens; identical to SEQ ID NO: 46696
  chr22:37348896-37348926
  hypo

SEQ ID NO: 67102 - DNA, 30 bp, Homo sapiens; identical to SEQ ID NO: 46697
  chr22:37367531-37367561
  hypo

SEQ ID NO: 67103 - DNA, 30 bp, Homo sapiens; identical to SEQ ID NO: 46698
  chr22:37367799-37367829
  hypo

SEQ ID NO: 67104 - DNA, 30 bp, Homo sapiens; identical to SEQ ID NO: 46699
  chr22:37395982-37396012
  hypo

SEQ ID NO: 67105 - DNA, 30 bp, Homo sapiens; identical to SEQ ID NO: 46700
  chr22:37770782-37770812
  hypo

SEQ ID NO: 67106 - DNA, 30 bp, Homo sapiens; identical to SEQ ID NO: 46701
  chr22:38085235-38085265
  hypo

SEQ ID NO: 67107 - DNA, 89 bp, Homo sapiens
  chr22:38199680-38199769
  hypo
gaccataccgggatgcgttcatcattttgaccagcaacaaactcccactcccagggtattgtttaagtgaacagtgaccggcctctatg

SEQ ID NO: 67108 - DNA, 99 bp, Homo sapiens
  chr22:38199894-38199993
  hypo
ctagggtctctgaggtctctcctgctggcctctgggcccctaaagcccctcgagcttcagaactccctacagacagtggcgccccgtgtccgcctcgtc

SEQ ID NO: 67109 - DNA, 30 bp, Homo sapiens; identical to SEQ ID NO: 16779
  chr22:38520276-38520306
  hypo

SEQ ID NO: 67110 - DNA, 84 bp, Homo sapiens; identical to SEQ ID NO: 46704
  chr22:38578330-38578414
  hypo

SEQ ID NO: 67111 - DNA, 24 bp, Homo sapiens
  chr22:38578714-38578738
  hypo
gcccggctccgaaatttttaacat

SEQ ID NO: 67112 - DNA, 136 bp, Homo sapiens; identical to SEQ ID NO: 46706
  chr22:38679362-38679498
  hypo

SEQ ID NO: 67113 - DNA, 89 bp, Homo sapiens; identical to SEQ ID NO: 46707
  chr22:38694504-38694593
  hypo

SEQ ID NO: 67114 - DNA, 30 bp, Homo sapiens; identical to SEQ ID NO: 46708
  chr22:38841845-38841875
  hypo

SEQ ID NO: 67115 - DNA, 30 bp, Homo sapiens; identical to SEQ ID NO: 46709
  chr22:39228205-39228235
  hypo

SEQ ID NO: 67116 - DNA, 32 bp, Homo sapiens; identical to SEQ ID NO: 46710
  chr22:39530973-39531005
  hypo

SEQ ID NO: 67117 - DNA, 182 bp, Homo sapiens; identical to SEQ ID NO: 46711
  chr22:39756856-39757038
  hypo

SEQ ID NO: 67118 - DNA, 79 bp, Homo sapiens; identical to SEQ ID NO: 46712
  chr22:39770483-39770562
  hypo

SEQ ID NO: 67119 - DNA, 135 bp, Homo sapiens; identical to SEQ ID NO: 46713
  chr22:39877264-39877399
  hypo

SEQ ID NO: 67120 - DNA, 206 bp, Homo sapiens; identical to SEQ ID NO: 46715
  chr22:40018133-40018339
  hypo

SEQ ID NO: 67121 - DNA, 50 bp, Homo sapiens; identical to SEQ ID NO: 46716
  chr22:40037034-40037084
  hypo

SEQ ID NO: 67122 - DNA, 37 bp, Homo sapiens; identical to SEQ ID NO: 25931
  chr22:40042590-40042627
  hypo

SEQ ID NO: 67123 - DNA, 117 bp, Homo sapiens; identical to SEQ ID NO: 25932
  chr22:40042743-40042860
  hypo

SEQ ID NO: 67124 - DNA, 41 bp, Homo sapiens; identical to SEQ ID NO: 46718
  chr22:40055020-40055061
  hypo

SEQ ID NO: 67125 - DNA, 30 bp, Homo sapiens; identical to SEQ ID NO: 46719
  chr22:40055554-40055584
  hypo

SEQ ID NO: 67126 - DNA, 97 bp, Homo sapiens; identical to SEQ ID NO: 46720
  chr22:40073967-40074064
  hypo

SEQ ID NO: 67127 - DNA, 37 bp, Homo sapiens; identical to SEQ ID NO: 46721
  chr22:40095526-40095563
  hypo

SEQ ID NO: 67128 - DNA, 30 bp, Homo sapiens; identical to SEQ ID NO: 46722
  chr22:40113507-40113537
  hypo

SEQ ID NO: 67129 - DNA, 26 bp, Homo sapiens
  chr22:40548285-40548311
  hypo
cctcaaaattttggacggaaaagttt

SEQ ID NO: 67130 - DNA, 20 bp, Homo sapiens
  chr22:40991418-40991438
  hypo
ccggccgagaaatgcctttt

SEQ ID NO: 67131 - DNA, 81 bp, Homo sapiens; identical to SEQ ID NO: 46726
  chr22:41578499-41578580
  hypo

SEQ ID NO: 67132 - DNA, 313 bp, Homo sapiens
  chr22:41634542-41634855
  hypo
aaggccatggcgggcaggtaaaccagggcgttgtgggccaggtttagcgtggccagcgcacccagtgccccgaacgtccccggccgcagctcctccagtgcgttcccctccagctccagccgccgcaacgagcccagcccgtccagcgcctcctggggcagctcacgcaggtggttggaggccaggttgagcaggagcaggcggcccaggccacggaaggcgccctcggccaccagctccacctcgcagtggcgcaggtccaggtgtgtgaggtgaggcacgccctggaaggcggctgcggggatcaccttca

SEQ ID NO: 67133 - DNA, 30 bp, Homo sapiens; identical to SEQ ID NO: 16787
  chr22:41637166-41637196
  hypo

SEQ ID NO: 67134 - DNA, 66 bp, Homo sapiens
  chr22:41657350-41657416
  hypo
ggttgagtgccagccctgggattagcatccagaactgtcagcctactatgccgagtgcacctcaag

SEQ ID NO: 67135 - DNA, 30 bp, Homo sapiens; identical to SEQ ID NO: 46730
  chr22:41668138-41668168
  hypo

SEQ ID NO: 67136 - DNA, 44 bp, Homo sapiens; identical to SEQ ID NO: 46731
  chr22:41776124-41776168
  hypo

SEQ ID NO: 67137 - DNA, 81 bp, Homo sapiens; identical to SEQ ID NO: 46732
  chr22:41839301-41839382
  hypo

SEQ ID NO: 67138 - DNA, 21 bp, Homo sapiens
  chr22:41839922-41839943
  hypo
cccggccggaaggtttttcag

SEQ ID NO: 67139 - DNA, 18 bp, Homo sapiens
  chr22:41939343-41939361
  hypo
tgcattgacccgaggcga

SEQ ID NO: 67140 - DNA, 42 bp, Homo sapiens; identical to SEQ ID NO: 46735
  chr22:42109080-42109122
  hypo

SEQ ID NO: 67141 - DNA, 127 bp, Homo sapiens; identical to SEQ ID NO: 46736
  chr22:42395163-42395290
  hypo

SEQ ID NO: 67142 - DNA, 51 bp, Homo sapiens; identical to SEQ ID NO: 46737
  chr22:42667191-42667242
  hypo

SEQ ID NO: 67143 - DNA, 30 bp, Homo sapiens; identical to SEQ ID NO: 46738
  chr22:42675831-42675861
  hypo

SEQ ID NO: 67144 - DNA, 30 bp, Homo sapiens; identical to SEQ ID NO: 46739
  chr22:42829925-42829955
  hypo

SEQ ID NO: 67145 - DNA, 47 bp, Homo sapiens; identical to SEQ ID NO: 46740
  chr22:42963266-42963313
  hypo

SEQ ID NO: 67146 - DNA, 30 bp, Homo sapiens; identical to SEQ ID NO: 16790
  chr22:42995705-42995735
  hypo

SEQ ID NO: 67147 - DNA, 30 bp, Homo sapiens; identical to SEQ ID NO: 16792
  chr22:43083005-43083035
  hypo

SEQ ID NO: 67148 - DNA, 21 bp, Homo sapiens
  chr22:43434477-43434498
  hypo
agccatcgctcctcccacagc

SEQ ID NO: 67149 - DNA, 194 bp, Homo sapiens; identical to SEQ ID NO: 46745
  chr22:43524923-43525117
  hypo

SEQ ID NO: 67150 - DNA, 30 bp, Homo sapiens; identical to SEQ ID NO: 46746
  chr22:43570284-43570314
  hypo

SEQ ID NO: 67151 - DNA, 30 bp, Homo sapiens; identical to SEQ ID NO: 16795
  chr22:43581330-43581360
  hypo

SEQ ID NO: 67152 - DNA, 262 bp, Homo sapiens; identical to SEQ ID NO: 46748
  chr22:43601093-43601355
  hypo

SEQ ID NO: 67153 - DNA, 202 bp, Homo sapiens; identical to SEQ ID NO: 46749
  chr22:43603869-43604071
  hypo

SEQ ID NO: 67154 - DNA, 30 bp, Homo sapiens; identical to SEQ ID NO: 46750
  chr22:43665130-43665160
  hypo

SEQ ID NO: 67155 - DNA, 119 bp, Homo sapiens; identical to SEQ ID NO: 46751
  chr22:43677877-43677996
  hypo

SEQ ID NO: 67156 - DNA, 30 bp, Homo sapiens; identical to SEQ ID NO: 46752
  chr22:43689691-43689721
  hypo

SEQ ID NO: 67157 - DNA, 30 bp, Homo sapiens; identical to SEQ ID NO: 46753
  chr22:43735330-43735360
  hypo

SEQ ID NO: 67158 - DNA, 107 bp, Homo sapiens; identical to SEQ ID NO: 25942
  chr22:44455600-44455707
  hypo

SEQ ID NO: 67159 - DNA, 14 bp, Homo sapiens
  chr22:44455740-44455754
  hypo
gtgtttgctcagca

SEQ ID NO: 67160 - DNA, 30 bp, Homo sapiens; identical to SEQ ID NO: 46755
  chr22:44484781-44484811
  hypo

SEQ ID NO: 67161 - DNA, 36 bp, Homo sapiens; identical to SEQ ID NO: 46756
  chr22:44527455-44527491
  hypo

SEQ ID NO: 67162 - DNA, 39 bp, Homo sapiens; identical to SEQ ID NO: 16798
  chr22:44538737-44538776
  hypo

SEQ ID NO: 67163 - DNA, 60 bp, Homo sapiens; identical to SEQ ID NO: 46758
  chr22:44564136-44564196
  hypo

SEQ ID NO: 67164 - DNA, 63 bp, Homo sapiens; identical to SEQ ID NO: 46759
  chr22:44564434-44564497
  hypo

SEQ ID NO: 67165 - DNA, 62 bp, Homo sapiens; identical to SEQ ID NO: 46760
  chr22:44580537-44580599
  hypo

SEQ ID NO: 67166 - DNA, 180 bp, Homo sapiens; identical to SEQ ID NO: 46761
  chr22:44664413-44664593
  hypo

SEQ ID NO: 67167 - DNA, 30 bp, Homo sapiens; identical to SEQ ID NO: 46762
  chr22:44671280-44671310
  hypo

SEQ ID NO: 67168 - DNA, 93 bp, Homo sapiens; identical to SEQ ID NO: 46763
  chr22:44681409-44681502
  hypo

SEQ ID NO: 67169 - DNA, 70 bp, Homo sapiens; identical to SEQ ID NO: 46764
  chr22:44698506-44698576
  hypo

SEQ ID NO: 67170 - DNA, 133 bp, Homo sapiens; identical to SEQ ID NO: 46765
  chr22:45020626-45020759
  hypo

SEQ ID NO: 67171 - DNA, 163 bp, Homo sapiens; identical to SEQ ID NO: 46766
  chr22:45075725-45075888
  hypo

SEQ ID NO: 67172 - DNA, 23 bp, Homo sapiens
  chr22:45088743-45088766
  hypo
tctcagcacggggccaggcacag

SEQ ID NO: 67173 - DNA, 41 bp, Homo sapiens; identical to SEQ ID NO: 46768
  chr22:45093092-45093133
  hypo

SEQ ID NO: 67174 - DNA, 104 bp, Homo sapiens; identical to SEQ ID NO: 46769
  chr22:45137806-45137910
  hypo

SEQ ID NO: 67175 - DNA, 161 bp, Homo sapiens
  chr22:45277322-45277483
  hypo
aatgcatacttggcacagagtagccaatatagaagacgtgtgcctcacacggttcactttgttcatcaataaaagaatataaaaatcttgttcacccagtggtaagtgtattaaaatagatctgtatcatacagcacagtttctcccggagtcgtgagaat

SEQ ID NO: 67176 - DNA, 30 bp, Homo sapiens; identical to SEQ ID NO: 46772
  chr22:45604343-45604373
  hypo

SEQ ID NO: 67177 - DNA, 106 bp, Homo sapiens; identical to SEQ ID NO: 46773
  chr22:45931289-45931395
  hypo

SEQ ID NO: 67178 - DNA, 30 bp, Homo sapiens; identical to SEQ ID NO: 46774
  chr22:45981309-45981339
  hypo

SEQ ID NO: 67179 - DNA, 86 bp, Homo sapiens; identical to SEQ ID NO: 46776
  chr22:46521906-46521992
  hypo

SEQ ID NO: 67180 - DNA, 38 bp, Homo sapiens; identical to SEQ ID NO: 46777
  chr22:46719152-46719190
  hypo

SEQ ID NO: 67181 - DNA, 120 bp, Homo sapiens; identical to SEQ ID NO: 46778
  chr22:46805005-46805125
  hypo

SEQ ID NO: 67182 - DNA, 148 bp, Homo sapiens; identical to SEQ ID NO: 46779
  chr22:46929253-46929401
  hypo

SEQ ID NO: 67183 - DNA, 57 bp, Homo sapiens; identical to SEQ ID NO: 46780
  chr22:46929652-46929709
  hypo

SEQ ID NO: 67184 - DNA, 252 bp, Homo sapiens; identical to SEQ ID NO: 46781
  chr22:46931788-46932040
  hypo

SEQ ID NO: 67185 - DNA, 7 bp, Homo sapiens
  chr22:47005073-47005080
  hypo
cccagag

SEQ ID NO: 67186 - DNA, 92 bp, Homo sapiens
  chr22:47005154-47005246
  hypo
ccgcgcaggagcctgggtccaccttctcctggctgtgtgcttccttaaacacggaaggtgttccgcagcctgctgtgcggggtagccctgtg

SEQ ID NO: 67187 - DNA, 57 bp, Homo sapiens; identical to SEQ ID NO: 46783
  chr22:47005505-47005562
  hypo

SEQ ID NO: 67188 - DNA, 77 bp, Homo sapiens; identical to SEQ ID NO: 46784
  chr22:47054535-47054612
  hypo

SEQ ID NO: 67189 - DNA, 36 bp, Homo sapiens; identical to SEQ ID NO: 46786
  chr22:47428866-47428902
  hypo

SEQ ID NO: 67190 - DNA, 141 bp, Homo sapiens
  chr22:47525705-47525846
  hypo
gtggggctgtgtcagcgtcactgccgctgagtcaccacgtgcactgtgcctgtcatccctttctgggacagcatgtcactttccttggtgtcaccaatcatctcccttaggagtctgtgaaccacccactccctccctccc

SEQ ID NO: 67191 - DNA, 39 bp, Homo sapiens; identical to SEQ ID NO: 25952
  chr22:47525885-47525924
  hypo

SEQ ID NO: 67192 - DNA, 30 bp, Homo sapiens; identical to SEQ ID NO: 46788
  chr22:47840461-47840491
  hypo

SEQ ID NO: 67193 - DNA, 68 bp, Homo sapiens; identical to SEQ ID NO: 46789
  chr22:48027676-48027744
  hypo

SEQ ID NO: 67194 - DNA, 34 bp, Homo sapiens; identical to SEQ ID NO: 46790
  chr22:48553477-48553511
  hypo

SEQ ID NO: 67195 - DNA, 30 bp, Homo sapiens; identical to SEQ ID NO: 46791
  chr22:48661129-48661159
  hypo

SEQ ID NO: 67196 - DNA, 30 bp, Homo sapiens; identical to SEQ ID NO: 46792
  chr22:48728717-48728747
  hypo

SEQ ID NO: 67197 - DNA, 30 bp, Homo sapiens; identical to SEQ ID NO: 46793
  chr22:48793754-48793784
  hypo

SEQ ID NO: 67198 - DNA, 119 bp, Homo sapiens; identical to SEQ ID NO: 46794
  chr22:48917425-48917544
  hypo

SEQ ID NO: 67199 - DNA, 54 bp, Homo sapiens
  chr22:48931827-48931881
  hypo
ccccccaggagtgcccgtgttgtcgagcccccgccacagagctgcaccgccgct

SEQ ID NO: 67200 - DNA, 41 bp, Homo sapiens; identical to SEQ ID NO: 25954
  chr22:48932027-48932068
  hypo

SEQ ID NO: 67201 - DNA, 106 bp, Homo sapiens; identical to SEQ ID NO: 46796
  chr22:48976157-48976263
  hypo

SEQ ID NO: 67202 - DNA, 144 bp, Homo sapiens; identical to SEQ ID NO: 46797
  chr22:48987212-48987356
  hypo

SEQ ID NO: 67203 - DNA, 80 bp, Homo sapiens; identical to SEQ ID NO: 46798
  chr22:49048024-49048104
  hypo

SEQ ID NO: 67204 - DNA, 177 bp, Homo sapiens; identical to SEQ ID NO: 46799
  chr22:49115640-49115817
  hypo

SEQ ID NO: 67205 - DNA, 30 bp, Homo sapiens; identical to SEQ ID NO: 16811
  chr22:49117093-49117123
  hypo

SEQ ID NO: 67206 - DNA, 30 bp, Homo sapiens; identical to SEQ ID NO: 46801
  chr22:49138471-49138501
  hypo

SEQ ID NO: 67207 - DNA, 30 bp, Homo sapiens; identical to SEQ ID NO: 46802
  chr22:49145839-49145869
  hypo

SEQ ID NO: 67208 - DNA, 30 bp, Homo sapiens; identical to SEQ ID NO: 46803
  chr22:49147007-49147037
  hypo

SEQ ID NO: 67209 - DNA, 30 bp, Homo sapiens; identical to SEQ ID NO: 46804
  chr22:49247250-49247280
  hypo

SEQ ID NO: 67210 - DNA, 30 bp, Homo sapiens; identical to SEQ ID NO: 46805
  chr22:49277436-49277466
  hypo

SEQ ID NO: 67211 - DNA, 40 bp, Homo sapiens; identical to SEQ ID NO: 46806
  chr22:49387651-49387691
  hypo

SEQ ID NO: 67212 - DNA, 39 bp, Homo sapiens; identical to SEQ ID NO: 46807
  chr22:49447333-49447372
  hypo

SEQ ID NO: 67213 - DNA, 36 bp, Homo sapiens; identical to SEQ ID NO: 46808
  chr22:49491699-49491735
  hypo

SEQ ID NO: 67214 - DNA, 100 bp, Homo sapiens; identical to SEQ ID NO: 46809
  chr22:49508009-49508109
  hypo

SEQ ID NO: 67215 - DNA, 30 bp, Homo sapiens; identical to SEQ ID NO: 46810
  chr22:49510169-49510199
  hypo

SEQ ID NO: 67216 - DNA, 253 bp, Homo sapiens; identical to SEQ ID NO: 46811
  chr22:49637528-49637781
  hypo

SEQ ID NO: 67217 - DNA, 30 bp, Homo sapiens; identical to SEQ ID NO: 46812
  chr22:49694859-49694889
  hypo

SEQ ID NO: 67218 - DNA, 39 bp, Homo sapiens; identical to SEQ ID NO: 46813
  chr22:49785322-49785361
  hypo

SEQ ID NO: 67219 - DNA, 30 bp, Homo sapiens; identical to SEQ ID NO: 46814
  chr22:49814696-49814726
  hypo

SEQ ID NO: 67220 - DNA, 32 bp, Homo sapiens; identical to SEQ ID NO: 46815
  chr22:49831409-49831441
  hypo

SEQ ID NO: 67221 - DNA, 40 bp, Homo sapiens; identical to SEQ ID NO: 46816
  chr22:49831947-49831987
  hypo

SEQ ID NO: 67222 - DNA, 30 bp, Homo sapiens; identical to SEQ ID NO: 46817
  chr22:49851741-49851771
  hypo

SEQ ID NO: 67223 - DNA, 30 bp, Homo sapiens; identical to SEQ ID NO: 46818
  chr22:49852487-49852517
  hypo

SEQ ID NO: 67224 - DNA, 149 bp, Homo sapiens; identical to SEQ ID NO: 46819
  chr22:49864707-49864856
  hypo

SEQ ID NO: 67225 - DNA, 43 bp, Homo sapiens; identical to SEQ ID NO: 46820
  chr22:49868142-49868185
  hypo

SEQ ID NO: 67226 - DNA, 39 bp, Homo sapiens; identical to SEQ ID NO: 46821
  chr22:49888284-49888323
  hypo

SEQ ID NO: 67227 - DNA, 58 bp, Homo sapiens; identical to SEQ ID NO: 46822
  chr22:49911506-49911564
  hypo

SEQ ID NO: 67228 - DNA, 99 bp, Homo sapiens; identical to SEQ ID NO: 46823
  chr22:49934854-49934953
  hypo

SEQ ID NO: 67229 - DNA, 30 bp, Homo sapiens; identical to SEQ ID NO: 46824
  chr22:49937851-49937881
  hypo

SEQ ID NO: 67230 - DNA, 39 bp, Homo sapiens; identical to SEQ ID NO: 46825
  chr22:49941794-49941833
  hypo

SEQ ID NO: 67231 - DNA, 51 bp, Homo sapiens; identical to SEQ ID NO: 46826
  chr22:49943168-49943219
  hypo

SEQ ID NO: 67232 - DNA, 30 bp, Homo sapiens; identical to SEQ ID NO: 46827
  chr22:49948590-49948620
  hypo

SEQ ID NO: 67233 - DNA, 30 bp, Homo sapiens; identical to SEQ ID NO: 46828
  chr22:49959175-49959205
  hypo

SEQ ID NO: 67234 - DNA, 30 bp, Homo sapiens; identical to SEQ ID NO: 46829
  chr22:49963888-49963918
  hypo

SEQ ID NO: 67235 - DNA, 175 bp, Homo sapiens; identical to SEQ ID NO: 46830
  chr22:49967997-49968172
  hypo

SEQ ID NO: 67236 - DNA, 74 bp, Homo sapiens; identical to SEQ ID NO: 46831
  chr22:49970518-49970592
  hypo

SEQ ID NO: 67237 - DNA, 30 bp, Homo sapiens; identical to SEQ ID NO: 46832
  chr22:49977657-49977687
  hypo

SEQ ID NO: 67238 - DNA, 33 bp, Homo sapiens; identical to SEQ ID NO: 25960
  chr22:49979613-49979646
  hypo

SEQ ID NO: 67239 - DNA, 187 bp, Homo sapiens; identical to SEQ ID NO: 46834
  chr22:49980189-49980376
  hypo

SEQ ID NO: 67240 - DNA, 30 bp, Homo sapiens; identical to SEQ ID NO: 46835
  chr22:49980591-49980621
  hypo

SEQ ID NO: 67241 - DNA, 189 bp, Homo sapiens; identical to SEQ ID NO: 46836
  chr22:49983668-49983857
  hypo

SEQ ID NO: 67242 - DNA, 33 bp, Homo sapiens; identical to SEQ ID NO: 46837
  chr22:49992716-49992749
  hypo

SEQ ID NO: 67243 - DNA, 35 bp, Homo sapiens; identical to SEQ ID NO: 46838
  chr22:49994264-49994299
  hypo

SEQ ID NO: 67244 - DNA, 30 bp, Homo sapiens; identical to SEQ ID NO: 46839
  chr22:49996899-49996929
  hypo

SEQ ID NO: 67245 - DNA, 30 bp, Homo sapiens; identical to SEQ ID NO: 46840
  chr22:50000658-50000688
  hypo

SEQ ID NO: 67246 - DNA, 38 bp, Homo sapiens
  chr22:50001661-50001699
  hypo
taccatgattaatgtcgtgcgcaggcctctcctgggtg

SEQ ID NO: 67247 - DNA, 219 bp, Homo sapiens
  chr22:50002568-50002787
  hypo
agctggagacattctcgtgttcacggtcacagctctgctcctttgagaaataagcggcacgatgtttttctagtgggtttgcctttttctcagtgatggtaaaagtgctgtgtatgttaaggtgagtgactcaggaccaaggtgagtcttgactcctcttggctttgcgctgagagcacctgggagagtcaagggagcacacaggacagtccctgcttc

SEQ ID NO: 67248 - DNA, 48 bp, Homo sapiens; identical to SEQ ID NO: 25963
  chr22:50003234-50003282
  hypo

SEQ ID NO: 67249 - DNA, 176 bp, Homo sapiens; identical to SEQ ID NO: 46844
  chr22:50007867-50008043
  hypo

SEQ ID NO: 67250 - DNA, 38 bp, Homo sapiens; identical to SEQ ID NO: 46845
  chr22:50008747-50008785
  hypo

SEQ ID NO: 67251 - DNA, 135 bp, Homo sapiens
  chr22:50010258-50010393
  hypo
atcttttcaagaaaagataaagaaagaaacaagagtaacaggaggccagaagcaagggcatctactgcagacagcggtgccgcggggctggagctgaagctacccaaggagccccaggctcgggagcctccaggc

SEQ ID NO: 67252 - DNA, 30 bp, Homo sapiens; identical to SEQ ID NO: 16820
  chr22:50010606-50010636
  hypo

SEQ ID NO: 67253 - DNA, 46 bp, Homo sapiens; identical to SEQ ID NO: 46848
  chr22:50013222-50013268
  hypo

SEQ ID NO: 67254 - DNA, 158 bp, Homo sapiens; identical to SEQ ID NO: 46849
  chr22:50015975-50016133
  hypo

SEQ ID NO: 67255 - DNA, 30 bp, Homo sapiens; identical to SEQ ID NO: 16821
  chr22:50024083-50024113
  hypo

SEQ ID NO: 67256 - DNA, 30 bp, Homo sapiens; identical to SEQ ID NO: 46851
  chr22:50025118-50025148
  hypo

SEQ ID NO: 67257 - DNA, 30 bp, Homo sapiens; identical to SEQ ID NO: 46852
  chr22:50025649-50025679
  hypo

SEQ ID NO: 67258 - DNA, 100 bp, Homo sapiens; identical to SEQ ID NO: 46853
  chr22:50031154-50031254
  hypo

SEQ ID NO: 67259 - DNA, 46 bp, Homo sapiens; identical to SEQ ID NO: 46855
  chr22:50032443-50032489
  hypo

SEQ ID NO: 67260 - DNA, 30 bp, Homo sapiens; identical to SEQ ID NO: 46856
  chr22:50041973-50042003
  hypo

SEQ ID NO: 67261 - DNA, 34 bp, Homo sapiens; identical to SEQ ID NO: 46857
  chr22:50054601-50054635
  hypo

SEQ ID NO: 67262 - DNA, 60 bp, Homo sapiens; identical to SEQ ID NO: 46858
  chr22:50119416-50119476
  hypo

SEQ ID NO: 67263 - DNA, 132 bp, Homo sapiens
  chr22:50149299-50149431
  hypo
ccctttccatggcaacgccccataaggtgccacccctttccatggcaacgacccataaggtgccacccctttccatggcaacgccccatacggtgccacccctttccatggcaacgccccatacggtgccac

SEQ ID NO: 67264 - DNA, 152 bp, Homo sapiens; identical to SEQ ID NO: 46860
  chr22:50170583-50170735
  hypo

SEQ ID NO: 67265 - DNA, 65 bp, Homo sapiens; identical to SEQ ID NO: 46861
  chr22:50251106-50251171
  hypo

SEQ ID NO: 67266 - DNA, 30 bp, Homo sapiens; identical to SEQ ID NO: 46862
  chr22:50439060-50439090
  hypo

SEQ ID NO: 67267 - DNA, 115 bp, Homo sapiens
  chr22:50466890-50467005
  hypo
ctgcaggaggaacttcgcctcccgtggggcaagaggcatctccgtgagtgggtcccagcccctgaatcgcagtgggaatcagggaggcggcaacacctgcgtgccgtcataaaga

SEQ ID NO: 67268 - DNA, 10 bp, Homo sapiens
  chr22:50467035-50467045
  hypo
cacaccgtcc

SEQ ID NO: 67269 - DNA, 30 bp, Homo sapiens; identical to SEQ ID NO: 46864
  chr22:50470583-50470613
  hypo

SEQ ID NO: 67270 - DNA, 92 bp, Homo sapiens; identical to SEQ ID NO: 46865
  chr22:50507025-50507117
  hypo

SEQ ID NO: 67271 - DNA, 30 bp, Homo sapiens; identical to SEQ ID NO: 46866
  chr22:50509901-50509931
  hypo

SEQ ID NO: 67272 - DNA, 57 bp, Homo sapiens; identical to SEQ ID NO: 46867
  chr22:50512688-50512745
  hypo

SEQ ID NO: 67273 - DNA, 30 bp, Homo sapiens; identical to SEQ ID NO: 46868
  chr22:50526328-50526358
  hypo

SEQ ID NO: 67274 - DNA, 75 bp, Homo sapiens; identical to SEQ ID NO: 46869
  chr22:50529523-50529598
  hypo

SEQ ID NO: 67275 - DNA, 45 bp, Homo sapiens; identical to SEQ ID NO: 46870
  chr22:50582635-50582680
  hypo

SEQ ID NO: 67276 - DNA, 287 bp, Homo sapiens; identical to SEQ ID NO: 46871
  chr22:50686625-50686912
  hypo

SEQ ID NO: 67277 - DNA, 158 bp, Homo sapiens; identical to SEQ ID NO: 46872
  chr22:50695362-50695520
  hypo

SEQ ID NO: 67278 - DNA, 30 bp, Homo sapiens; identical to SEQ ID NO: 46873
  chr22:50764712-50764742
  hypo

SEQ ID NO: 67279 - DNA, 24 bp, Homo sapiens
  chr22:50899269-50899293
  hypo
tgtatctgtgtcacacgaaggcaa

SEQ ID NO: 67280 - DNA, 36 bp, Homo sapiens
  chr22:50899672-50899708
  hypo
agcgcagccaccgggaaggagcggaccaccacctgc

SEQ ID NO: 67281 - DNA, 50 bp, Homo sapiens; identical to SEQ ID NO: 46875
  chr22:50922613-50922663
  hypo

SEQ ID NO: 67282 - DNA, 63 bp, Homo sapiens
  chr22:50943262-50943325
  hypo
gcaccacctcaggccgtccaccaagcccagtcatgcggcggaagaggccgtaggagttggcca

SEQ ID NO: 67283 - DNA, 96 bp, Homo sapiens; identical to SEQ ID NO: 46877
  chr22:50944404-50944500
  hypo

SEQ ID NO: 67284 - DNA, 69 bp, Homo sapiens; identical to SEQ ID NO: 46878
  chr22:50954977-50955046
  hypo

SEQ ID NO: 67285 - DNA, 41 bp, Homo sapiens; identical to SEQ ID NO: 46879
  chr22:50977129-50977170
  hypo

SEQ ID NO: 67286 - DNA, 143 bp, Homo sapiens; identical to SEQ ID NO: 46880
  chrX:2836217-2836360
  hypo

SEQ ID NO: 67287 - DNA, 128 bp, Homo sapiens; identical to SEQ ID NO: 46881
  chrX:2931204-2931332
  hypo

SEQ ID NO: 67288 - DNA, 20 bp, Homo sapiens
  chrX:3478216-3478236
  hypo
agtaacgcagttccccctcc

SEQ ID NO: 67289 - DNA, 41 bp, Homo sapiens
  chrX:3746571-3746612
  hypo
ctcaccaagcaggagcgggcccctccctcacgcggagccgc

SEQ ID NO: 67290 - DNA, 30 bp, Homo sapiens; identical to SEQ ID NO: 46884
  chrX:5757324-5757354
  hypo

SEQ ID NO: 67291 - DNA, 30 bp, Homo sapiens; identical to SEQ ID NO: 46885
  chrX:11773720-11773750
  hypo

SEQ ID NO: 67292 - DNA, 31 bp, Homo sapiens; identical to SEQ ID NO: 46886
  chrX:19435201-19435232
  hypo

SEQ ID NO: 67293 - DNA, 43 bp, Homo sapiens; identical to SEQ ID NO: 46887
  chrX:20160928-20160971
  hypo

SEQ ID NO: 67294 - DNA, 16 bp, Homo sapiens
  chrX:23714117-23714133
  hypo
cacaactcagctgggc

SEQ ID NO: 67295 - DNA, 54 bp, Homo sapiens; identical to SEQ ID NO: 46889
  chrX:41331697-41331751
  hypo

SEQ ID NO: 67296 - DNA, 22 bp, Homo sapiens
  chrX:44136212-44136234
  hypo
acttacagctgaggccgggcac

SEQ ID NO: 67297 - DNA, 21 bp, Homo sapiens
  chrX:44755607-44755628
  hypo
tcaccgcgcccggccaaaaat

SEQ ID NO: 67298 - DNA, 52 bp, Homo sapiens; identical to SEQ ID NO: 46892
  chrX:44922962-44923014
  hypo

SEQ ID NO: 67299 - DNA, 40 bp, Homo sapiens; identical to SEQ ID NO: 46893
  chrX:58297213-58297253
  hypo

SEQ ID NO: 67300 - DNA, 30 bp, Homo sapiens; identical to SEQ ID NO: 46894
  chrX:58304829-58304859
  hypo

SEQ ID NO: 67301 - DNA, 32 bp, Homo sapiens; identical to SEQ ID NO: 46895
  chrX:78711051-78711083
  hypo

SEQ ID NO: 67302 - DNA, 30 bp, Homo sapiens; identical to SEQ ID NO: 46896
  chrX:97101386-97101416
  hypo

SEQ ID NO: 67303 - DNA, 128 bp, Homo sapiens; identical to SEQ ID NO: 46897
  chrX:97285068-97285196
  hypo

SEQ ID NO: 67304 - DNA, 35 bp, Homo sapiens; identical to SEQ ID NO: 46898
  chrX:122924429-122924464
  hypo

SEQ ID NO: 67305 - DNA, 30 bp, Homo sapiens; identical to SEQ ID NO: 46899
  chrY:14621298-14621328
  hypo

SEQ ID NO: 67306 - DNA, 35 bp, Homo sapiens; identical to SEQ ID NO: 46900
  chrY:22918547-22918582
  hypo

SEQ ID NO: 67307 - DNA, 30 bp, Homo sapiens; identical to SEQ ID NO: 46901
  chrY:23111758-23111788
  hypo

SEQ ID NO: 67308 - DNA, 45 bp, Homo sapiens; identical to SEQ ID NO: 46902
  AC225595.1_16282-19523:1184-1229
  hypo

SEQ ID NO: 67309 - DNA, 30 bp, Homo sapiens; identical to SEQ ID NO: 46903
  AC239873.3_5604-11530:5296-5326
  hypo

SEQ ID NO: 67310 - DNA, 30 bp, Homo sapiens; identical to SEQ ID NO: 16832
  AEKP01139090.1_11256-14570:719-749
  hypo

SEQ ID NO: 67311 - DNA, 41 bp, Homo sapiens; identical to SEQ ID NO: 46905
  AEKP01149800.1_88-7643:5268-5309
  hypo

SEQ ID NO: 67312 - DNA, 86 bp, Homo sapiens; identical to SEQ ID NO: 16833
  AEKP01153556.1_1-5252:404-490
  hypo

SEQ ID NO: 67313 - DNA, 30 bp, Homo sapiens; identical to SEQ ID NO: 46907
  AEKP01166227.1_44013-111583:24167-24197
  hypo

SEQ ID NO: 67314 - DNA, 58 bp, Homo sapiens; identical to SEQ ID NO: 46908
  AEKP01188815.1_1-4777:2612-2670
  hypo

SEQ ID NO: 67315 - DNA, 151 bp, Homo sapiens; identical to SEQ ID NO: 46909
  AEKP01196136.1_22995-25251:459-610
  hypo

SEQ ID NO: 67316 - DNA, 30 bp, Homo sapiens; identical to SEQ ID NO: 46910
  AEKP01229474.1_1-1021:874-904
  hypo

SEQ ID NO: 67317 - DNA, 22 bp, Homo sapiens
  CR936360.14_69981-85448:11336-11358
  hypo
ctagtttgagccagccggccgc

SEQ ID NO: 67318 - DNA, 30 bp, Homo sapiens; identical to SEQ ID NO: 46912
  FP565324.3_2001-29640:15187-15217
  hypo

SEQ ID NO: 67319 - DNA, 47 bp, Homo sapiens; identical to SEQ ID NO: 46913
  FP565324.3_2001-29640:19686-19733
  hypo

SEQ ID NO: 67320 - DNA, 18 bp, Homo sapiens
  JH636052.4:2022610-2022628
  hypo
aacaataaaacaggccgg

SEQ ID NO: 67321 - DNA, 61 bp, Homo sapiens; identical to SEQ ID NO: 46915
  NW_001838014.1_249000-295694:3702-3763
  hypo

SEQ ID NO: 67322 - DNA, 42 bp, Homo sapiens; identical to SEQ ID NO: 46916
  NW_001838014.1_249000-295694:4094-4136
  hypo

SEQ ID NO: 67323 - DNA, 60 bp, Homo sapiens; identical to SEQ ID NO: 46917
  NW_001838014.1_249000-295694:7207-7267
  hypo

SEQ ID NO: 67324 - DNA, 311 bp, Homo sapiens; identical to SEQ ID NO: 46918
  NW_001838014.1_249000-295694:13512-13823
  hypo

SEQ ID NO: 67325 - DNA, 84 bp, Homo sapiens; identical to SEQ ID NO: 46919
  NW_001838056.1_145425-224902:42711-42795
  hypo

SEQ ID NO: 67326 - DNA, 30 bp, Homo sapiens; identical to SEQ ID NO: 46920
  NW_001839407.1_42766-49957:1184-1214
  hypo

SEQ ID NO: 67327 - DNA, 23 bp, Homo sapiens
  NW_001839609.1_1-3470:1139-1162
  hypo
caaagcgaggcactgcgagcctg

SEQ ID NO: 67328 - DNA, 90 bp, Homo sapiens; identical to SEQ ID NO: 46922
  NW_001839760.1_243903-260476:6752-6842
  hypo

SEQ ID NO: 67329 - DNA, 22 bp, Homo sapiens
  NW_001840754.1_117-3691:2515-2537
  hypo
gggctaccgcagggagggtgcc

SEQ ID NO: 67330 - DNA, 30 bp, Homo sapiens; identical to SEQ ID NO: 46924
  NW_001840841.1_1-4205:1669-1699
  hypo

SEQ ID NO: 67331 - DNA, 43 bp, Homo sapiens; identical to SEQ ID NO: 46925
  NW_001841011.1_96346-168555:37241-37284
  hypo

SEQ ID NO: 67332 - DNA, 140 bp, Homo sapiens; identical to SEQ ID NO: 46926
  NW_001841051.1_40144-46142:4777-4917
  hypo

SEQ ID NO: 67333 - DNA, 46 bp, Homo sapiens; identical to SEQ ID NO: 46927
  NW_001841110.1_111-11841:9069-9115
  hypo

SEQ ID NO: 67334 - DNA, 55 bp, Homo sapiens; identical to SEQ ID NO: 46928
  NW_001841145.1_177495-186900:5222-5277
  hypo

SEQ ID NO: 67335 - DNA, 69 bp, Homo sapiens; identical to SEQ ID NO: 46929
  NW_001842432.1_1-179261:101291-101360
  hypo

SEQ ID NO: 67336 - DNA, 38 bp, Homo sapiens
  AC006359.3_31144-32210:157-195
  hyper
ctttctgcccccacccgccgctgcggctttttgcccca

SEQ ID NO: 67337 - DNA, 18 bp, Homo sapiens
  AC010098.8_29020-31687:1483-1501
  hyper
gcggctttttgcccccgc

SEQ ID NO: 67338 - DNA, 41 bp, Homo sapiens
  AC010098.8_29020-31687:525-566
  hyper
agcggctttttgcacccccgccgccgcggctttttgtcccc

SEQ ID NO: 67339 - DNA, 179 bp, Homo sapiens
  AC018688.9_35552-170204:78812-78991
  hypo
ttggccttggctagccggttccccgcccccgctggtgggctgcctcgccctgggtggggtgtgccccaccatgtgccaggactgggtccggtgcagagtgcccttcttcctgggaagggtgtggctgaaaaggcggcctccttgcccgtcatgcaacacacgttcgtggggaacctggt

SEQ ID NO: 67340 - DNA, 94 bp, Homo sapiens
  AC018688.9_35552-170204:82698-82792
  hypo
ccaccccaccctccacgcgtcggctgatgaaaccatttctctacaatttattaaaaagattatctgggcctggcactgtagctcatgcctgtca

SEQ ID NO: 67341 - DNA, 120 bp, Homo sapiens
  AC127380.4_153-32188:9589-9709
  hyper
gcaaaaagccgctgcgggcaaataaccgcggcacggggcgggggcggggggcgcaaaaagccgcatcggcggggcgcaaaaagccgcggtagcgggggaacaaaaagccgcggcagcggg

SEQ ID NO: 67342 - DNA, 30 bp, Homo sapiens
  AC137488.2_1-70728:40075-40105
  hypo
tgttaatgatccctccgcaggttcacctac

SEQ ID NO: 67343 - DNA, 40 bp, Homo sapiens
  AC145029.2_135730-137748:1618-1658
  hyper
cgcggtgggcagaaagccgtgggggcggggtgcaaaaagc

SEQ ID NO: 67344 - DNA, 198 bp, Homo sapiens
  AC188622.2_1-37519:11868-12066
  hypo
gtgtcttgagttttgcgtatgactctgcttcaacttgcctggtggtttcatgctattctgattcctctacaatgtaatgctttgtgagacgatggcagacacaaggcagatcctcagaatacactcccgatgatattagcttcttgtgcaatcagccaacacacagaacatgaagcttgcccccgatgtttgccacag

SEQ ID NO: 67345 - DNA, 30 bp, Homo sapiens
  AC207871.4_32367-39588:2999-3029
  hypo
tagcttcgtggtcgccgggggctgggggtg

SEQ ID NO: 67346 - DNA, 45 bp, Homo sapiens
  AC211344.3_7702-13588:3836-3881
  hyper
ggagctcttgatgtgcgggaaatgcagacccggcactggaatttc

SEQ ID NO: 67347 - DNA, 598 bp, Homo sapiens
  AC211950.2_11234-25326:13291-13889
  hyper
cgtgcttgggggaggcggcagtttcctctgatcttctcccagataagaggcacagatgtcgtcaacaggagaaacaacggggaatacaaactaagagacataaaccagataagaaactggagaatgcgggcgtcgatcccgctacctctcgcatgctaagcgagcgctctaccgcctgagctaattcctcactgaggaggcccgccaccccacccattttcctggttatcaggagcctgccggtactttgggccgccaaatccctggcaggacaagattgagggcggagcttctcagatactgccttgggcaaacttctacgagcctgagagtgtgaagaatacggatttccaaaataggtcatgagggagacctctctcctcacttcccaatttcgccttcttcatctctcggaattagagagcacgttccagttggagaagcaccacctggaactgcctggcttgcgggcacagctattccagcccgctctagagttgtgatcctcacctgctccctgcaggcaaggccacccggaagtagcggggcagcttctcccagccccagaacttcacgccatacgcgcctcatcttcaat

SEQ ID NO: 67348 - DNA, 18 bp, Homo sapiens
  AC211950.2_11234-25326:180-198
  hyper
aagcggcttttttttaat

SEQ ID NO: 67349 - DNA, 95 bp, Homo sapiens
  AC211950.2_11234-25326:25-120
  hyper
tcagaaaagtttcttcggtgattggaataacgttcgcctttaaacttctcaagagatttagggtgggttttagtaagcggggccggttagctcag

SEQ ID NO: 67350 - DNA, 152 bp, Homo sapiens
  AC211950.2_11234-25326:8748-8900
  hyper
gcttctgtgggtgctcgtttgacacgcgctcccggctccgcgcagtggctgtttctggatgagtctggagactccgcctgcagtcctgtgctggctccaccttggcagggatggagctcaggaatgttgagtggtcccgaaaaaccaggtgg

SEQ ID NO: 67351 - DNA, 173 bp, Homo sapiens
  AC225595.1_16282-19523:1056-1229
  hypo
gaaatcatcaaactacgaagattgaagcgttgcaggacatggtgactgacatgatgtctccccggcttcatcggtcatgtgtgatgagcccaactgataacgcaatagcagcccagctgtcggtctgtgcagaaggatagtctcggaagacatctgcccggccagatccaagc

SEQ ID NO: 67352 - DNA, 74 bp, Homo sapiens
  AC231386.2_19255-24791:4032-4106
  hyper
gaccgggggcgaaggcgacaggggtctgtggaagagacctgtcggcggagagcggtccacgttttcctggagaa

SEQ ID NO: 67353 - DNA, 30 bp, Homo sapiens; identical to SEQ ID NO: 46903
  AC239873.3_5604-11530:5296-5326
  hypo

SEQ ID NO: 67354 - DNA, 259 bp, Homo sapiens
  AC241442.1_28021-33880:323-582
  hyper
gtgggggtggggaaccgtgccttccgcgcacgcgcgccgctgggcctgagcgtgcagtcggtcgggtgggcgagggcgccgccctggtggcggaagcgcctcctccagggctcccccgaacggcggcgccgggaccccgctctccttgggctctttgcctcagaccccacgtggcgatgacccggcctcggtgtgcgcgtcggtgcggaggccggcccttcgagctgggtcccgagatcgctgacgtctggcctccact

SEQ ID NO: 67355 - DNA, 420 bp, Homo sapiens
  AC241851.2_88-34049:15133-15553
  hyper
gcccccaccgcccgggctttttgcgccgcggctttttgctgctatttgtccctgccaccgcggcgttttgcccccgcagccgcggctccttgccccctacgcggcttcctgcctccgccaccgtggctttttatcaccccagccgctttttgaaccccccgccgcgggtttttgccgccgcggcttcttgcccccctcgccgcggctttttacccccacagcggcggctttctgcccctgcctctgagggtttttgcggctttatgtccccgctgtcgtggctttttgccgccgcggcttttggccccctccgccgcggctttttgcggcttttggcacccaacgccgcggctttttggggcttttggtccccgccaccggggcttttttcccccaccgccgcaggtttttcccgcccct

SEQ ID NO: 67356 - DNA, 30 bp, Homo sapiens
  AEKP01008621.1_1-2685:1692-1722
  hypo
tgtgctagaggctggcggtggcagcaggga

SEQ ID NO: 67357 - DNA, 30 bp, Homo sapiens
  AEKP01044741.1_1-4554:2853-2883
  hypo
gtaaaggtcccaggtcgcagggccagtctt

SEQ ID NO: 67358 - DNA, 30 bp, Homo sapiens
  AEKP01132292.1_2033-9536:6910-6940
  hypo
ccattactgatccagcgagtcaacctatga

SEQ ID NO: 67359 - DNA, 30 bp, Homo sapiens; identical to SEQ ID NO: 16832
  AEKP01139090.1_11256-14570:719-749
  hypo

SEQ ID NO: 67360 - DNA, 30 bp, Homo sapiens
  AEKP01146324.1_36063-42453:2576-2606
  hypo
tggcacagagagaggcggagattcacccaa

SEQ ID NO: 67361 - DNA, 21 bp, Homo sapiens
  AEKP01149800.1_88-7643:5248-5269
  hypo
gtgtgagggtgtgagcgggtg

SEQ ID NO: 67362 - DNA, 30 bp, Homo sapiens
  AEKP01149800.1_88-7643:5586-5616
  hypo
tttctagtaaagtttcgtttccagagacag

SEQ ID NO: 67363 - DNA, 158 bp, Homo sapiens
  AEKP01153556.1_1-5252:377-535
  hypo
aatcaccatcagcaccgtcatcaccgtcatcaccattatctccaccactgttgctgtgaacgcatactgcactattatcacctgaggtacagtgacaacgttgtgtgatgctaaaatgtgagcttttctatctgccgatgattcggcctttgtccctc

SEQ ID NO: 67364 - DNA, 42 bp, Homo sapiens
  AEKP01153556.1_1-5252:995-1037
  hypo
cacccgcctcacctccgcatgaaaccccgaccataaccccga

SEQ ID NO: 67365 - DNA, 30 bp, Homo sapiens
  AEKP01160869.1_25046-30418:2610-2640
  hypo
gtctctctacttccccgtgcccccatcccg

SEQ ID NO: 67366 - DNA, 49 bp, Homo sapiens
  AEKP01166227.1_44013-111583:24167-24216
  hypo
acctagactgttgaccgaggacctgaaagagaagcgtctccagagagat

SEQ ID NO: 67367 - DNA, 123 bp, Homo sapiens; identical to SEQ ID NO: 38671
  AEKP01168736.1_1-4752:1196-1319
  hyper

SEQ ID NO: 67368 - DNA, 280 bp, Homo sapiens
  AEKP01168736.1_1-4752:1533-1813
  hyper
ggcggaggtggaggtcggacagcacaagtgagagtgagggggtctgcaggtagagctggcattggaggggtgggaacgtggacggcggctgagcggggggcgcgtgcaggtcggagccggcaggtgaggagccagggtctaagctagggcccggggtccaaaggaaaggctttcagatctgagctccgcggctctggcggcggtggagctgggagcccgcggtggccggctggggacgggggcaggagcagaggggtcgcgccgcggccactggaacccg

SEQ ID NO: 67369 - DNA, 940 bp, Homo sapiens
  AEKP01168736.1_1-4752:1873-2813
  hyper
gcgctgaccggggcgctcagctttgtgctcctggcggccgccatcggcacggacttctggtatatcattgacaccgagcggctggagaggactggcccgggggcgcaggacctgctggggtccatcaatcgcagccagcccgagcctctgagctcccactccggcctctggcggacctgccggggtaagggtgcaccccgtggctgggagctgtggctgcgaacgccccctgcgcggtgccctgctcccttgggacctgttgcttggcgcgcactcctcccccaagtccctaaaatacaatgtctagggactcggggggaaggtgagcagaaggccgggactgcgaaaacccttccgagaggcacccggctgcgatcccaactgctctagctctccccgcgccctccccgggtggggcacttagggtgagcatgggggcaaagccgcagacgagggtgctgcacagaactccggggtcctgcacccatggattcctccgtcctatccagtgcagagcccgtgcacaccgctgatgaaccccttcaggctggagaacgtgacagtcagcgaatcgagccggcaacttctcagtgagtccggggagggtgaggatggagggagcgccccggtcctagccgtgagttctggagcctttcccaaaacagccgggcttcggggcctgcggagagggcggctggggtggcctctgacagcccagcctgagaatggagtgggcttaagaccggggggcagggtctctcctgatccacctgtaacgttttgtggtttagggttcattcagctcacgttgactaatggctttctttgcaccgttttgatggatggttaagacacaggccatcccctcaaggggctcacagtggtgctgggacaaatgtggagacgcgcagttagagtccagcagcgtgaggaagggaag

SEQ ID NO: 67370 - DNA, 30 bp, Homo sapiens
  AEKP01171299.1_4392-9704:2569-2599
  hypo
acttccctggagtgccgtgtggccgttgta

SEQ ID NO: 67371 - DNA, 273 bp, Homo sapiens
  AEKP01171767.1_199-12179:10825-11098
  hyper
tttccatggaccccacgcaagctccctgcccggtgtctcgggggtgtgggggttgggggagccgccgggggcggggtccccgcctgcccaggccggacccatgtcagcggacgtcactgcgggaagcgcggccggcgggggcgacccggggtctgcgcggctctcacccggtggcgcgccgcagccgcaggcaatttatctccgtctccccgctcttaaaacacttttatcaaaattggcggtcacaccgcgctgaaccgtggtggcctcaat

SEQ ID NO: 67372 - DNA, 30 bp, Homo sapiens
  AEKP01184864.1_3582-5885:670-700
  hypo
tgtccttaagcaacccgtggctatttgtct

SEQ ID NO: 67373 - DNA, 58 bp, Homo sapiens; identical to SEQ ID NO: 46908
  AEKP01188815.1_1-4777:2612-2670
  hypo

SEQ ID NO: 67374 - DNA, 30 bp, Homo sapiens
  AEKP01193750.1_12147-15056:206-236
  hypo
acaaggtgtccagctcgggattaatttcta

SEQ ID NO: 67375 - DNA, 213 bp, Homo sapiens
  AEKP01196136.1_22995-25251:442-655
  hypo
tgacgacagagttcacgtgctggaagagtcaacggcgtttttaaagaggcagggcaacgcgcactacagtgagggatcttacaggcctgtttttgagggaaaatggtaagtgagctacagcgagcacacgtgtgtagatcccagttacaggtccgtcaagatggctagagaatacacacactgcccagcccatacacacgtgcaaaggcacac

SEQ ID NO: 67376 - DNA, 61 bp, Homo sapiens
  AEKP01196137.1_1-1039:721-782
  hypo
ggctgtgcagctgagcggggcagcaggacccgggacatgcactgcacgggaggaggagcag

SEQ ID NO: 67377 - DNA, 196 bp, Homo sapiens
  AEKP01197830.1_1-1408:29-225
  hyper
tcggggtggcggtcccggggctgccgggctgcgggtcggccacattcctgcctttgccgggcggggggggcgcctggagggaaccccggcccgacaccccgcggctttgggctcccacggggccgcgcgcctcttcccagccgggccccccatcccggggcagagggcccagagccttcctcgaccttgggagaaa

SEQ ID NO: 67378 - DNA, 78 bp, Homo sapiens
  AEKP01197830.1_1-1408:476-554
  hyper
tcagaaaagctggagcggggccgcagcccggccctgccccccggcatggggacttcctccccccggtgaaggcggccg

SEQ ID NO: 67379 - DNA, 39 bp, Homo sapiens
  AEKP01210344.1_1299-2924:730-769
  hypo
gacatgaaaggcacacgggtgacaggacggacaccccag

SEQ ID NO: 67380 - DNA, 30 bp, Homo sapiens
  AEKP01213519.1_104-1403:796-826
  hypo
tgtcccagggctcaccgccattcatgaaga

SEQ ID NO: 67381 - DNA, 23 bp, Homo sapiens
  AEKP01218892.1_1-1226:1010-1033
  hypo
gaggctgcaggggcacgggcggg

SEQ ID NO: 67382 - DNA, 26 bp, Homo sapiens
  AEKP01225640.1_1-1497:736-762
  hypo
gccctgggacccttccggggttgggc

SEQ ID NO: 67383 - DNA, 197 bp, Homo sapiens; identical to SEQ ID NO: 39017
  chr1:100436557-100436754
  hypo

SEQ ID NO: 67384 - DNA, 86 bp, Homo sapiens; identical to SEQ ID NO: 4943
  chr1:100437183-100437269
  hypo

SEQ ID NO: 67385 - DNA, 242 bp, Homo sapiens
  chr1:10057380-10057622
  hyper
tggccctaggtaaggcggaggggaggcggcggcggcgcgaggctcgccgtgggtctcgggatcaggcgaaggcggccgggccgggcctgtaggtacgtcctctgtccgtgcctccgccctgctgcgcccaccgtcgcccagtcgcccccgagtccgctggtccttggcgcctccgtccatcgggcgcgggaccccagtccttcagtcccccagtccgtcctttcccgcgcccacccgccccc

SEQ ID NO: 67386 - DNA, 34 bp, Homo sapiens; identical to SEQ ID NO: 39019
  chr1:100814764-100814798
  hypo

SEQ ID NO: 67387 - DNA, 30 bp, Homo sapiens; identical to SEQ ID NO: 39020
  chr1:100928393-100928423
  hypo

SEQ ID NO: 67388 - DNA, 155 bp, Homo sapiens
  chr1:10094917-10095072
  hypo
tcaggactgcccattcggcgttactttgtttttttcgaatacagcagaaatgtaatcttaagtgaagagaatattacacagtttctttcattcggtaggaaatctccttagaatcgctttattttatgtgggtttttttttgtttgtttgttttt

SEQ ID NO: 67389 - DNA, 361 bp, Homo sapiens; identical to SEQ ID NO: 1776
  chr1:101004456-101004817
  hyper

SEQ ID NO: 67390 - DNA, 92 bp, Homo sapiens; identical to SEQ ID NO: 26494
  chr1:101004842-101004934
  hyper

SEQ ID NO: 67391 - DNA, 880 bp, Homo sapiens
  chr1:101004935-101005815
  hyper
ctacctgctcatcacccgggcgcccgccacctaccaggcgctgtaccagaggcgccacacggcgggcatgctggcgctgtcctgggcgctcgccctgggcctcgtgctgctgctcccgccctgggcaccgcggcccggcgccgcgccaccgcgagtccactacccggcgctgctggccgccgcggcgctgctggcgcagacagctctgctgctgcactgctacctgggcatcgtgcgccgcgtgcgtgtcagcgtcaagcgggtcagcgtgctcaacttccacctgctgcaccagttgcccggctgcgccgccgccgccgccgccttcccgggcgcccagcacgcgccgggccccggtggcgccgcgcacccggcgcaggcccagcccctgccgcccgcgctgcacccgcggcgggcacagcggcgtctcagcggcctgtcggtgctgctgctctgctgcgtcttcctgctggccacgcagccactggtgtgggtgagcctggccagcggcttctcgctgccggtgccctggggagtgcaggcggccagctggctcctgtgctgcgccctgtccgcgctcaatccgctgctctacacgtggaggaacgaggagttccgccgctccgtgcgctcagtcctgccgggcgtcggcgacgcggcggccgctgccgttgccgccacagccgtgcccgcagtgtcccaggcgcaactgggcacccgcgccgcgggccagcactggtaacctagccggggcccgagggaagcggagatccccggcttccgacgtccttgggcaccgtcgcctccttccctcctagggcatcccctgcctgaacgaagacttccgccgcgaagcccgatagatcgggggaaaatgggg

SEQ ID NO: 67392 - DNA, 86 bp, Homo sapiens
  chr1:10103747-10103833
  hypo
agtgctgggattacaggcgtgatccaacgcgctgggccgggatgcttcttataaatagatggtgtaatcaccgttggccaggtggc

SEQ ID NO: 67393 - DNA, 55 bp, Homo sapiens
  chr1:10166572-10166627
  hypo
tccacccctaccacccgcctcacccagtgccacgagcagacgcccctcctccctg

SEQ ID NO: 67394 - DNA, 363 bp, Homo sapiens
  chr1:101701718-101702081
  hyper
gcccaacaccaaaaccggcgctggttcatttctctgtgcactctgggaaagccactgcccctcagaccgcagttgcgagtagcacgaggatctggggtggcggggggagtacaggaacctcccggttcattctccctcccgggctgcttgtctcctccgtacctctcgcagccccttcccagcctctcctccccagagcgccgccgacactcgccgggccgcggctcaggttttctgctgctcgcgcgaaagtggctcggggagctcctggccacaagctcagcacaccgatcctcctagggctgcggggggtgtgggaccagggcggtgcgctacgagactccgggccgtcctctgcctcct

SEQ ID NO: 67395 - DNA, 233 bp, Homo sapiens
  chr1:101702369-101702602
  hyper
ccagctgacagagggcgtggggggttaaggcattaacccctcccagcctcttcctgaagaaaccacccagccttggcgcggcgctgggtgacttcgcgtagcaggcagggaactggccgcggcgagcgggactggccattggagtgctccgctgcggagggaggggaccccgactcgagtaagtttgcgagagcactacgcagtcagtcgggggcagcagcaagatgcgaagc

SEQ ID NO: 67396 - DNA, 193 bp, Homo sapiens; identical to SEQ ID NO: 26497
  chr1:101702603-101702796
  hyper

SEQ ID NO: 67397 - DNA, 79 bp, Homo sapiens
  chr1:101703188-101703267
  hyper
tctgctgaccagtgccgtcttagaaagtttctttgtaactttctagtcctaggagaggagtcaacgtgttgggggactg

SEQ ID NO: 67398 - DNA, 76 bp, Homo sapiens; identical to SEQ ID NO: 26499
  chr1:101703566-101703642
  hyper

SEQ ID NO: 67399 - DNA, 83 bp, Homo sapiens
  chr1:101721485-101721568
  hypo
agttggtcaggaagccgcgcagcagccatggcttttaagaataccgggcactttgggaggccgaggtggacggatcacaaggt

SEQ ID NO: 67400 - DNA, 394 bp, Homo sapiens; identical to SEQ ID NO: 26500
  chr1:101775094-101775488
  hyper

SEQ ID NO: 67401 - DNA, 30 bp, Homo sapiens
  chr1:101918826-101918856
  hypo
ccccaggaacctccacgtgttcagctccca

SEQ ID NO: 67402 - DNA, 30 bp, Homo sapiens
  chr1:10206714-10206744
  hypo
aaagggcctccctgtcgccaccctctcctc

SEQ ID NO: 67403 - DNA, 23 bp, Homo sapiens
  chr1:10232969-10232992
  hypo
ttgtgttacaactgccgacagga

SEQ ID NO: 67404 - DNA, 50 bp, Homo sapiens
  chr1:1025254-1025304
  hypo
tgaacagggcctgcccgtggcacgctgacacaggccggcatcctcgtggc

SEQ ID NO: 67405 - DNA, 122 bp, Homo sapiens
  chr1:103572643-103572765
  hyper
agccagatgccttttcgggaaagggcgggggaaagagggagggagaaggcggaggggaggagtgaagtcgctctccctccgtgggtactgacagggttgcagacttccgagcaggtctggcc

SEQ ID NO: 67406 - DNA, 278 bp, Homo sapiens
  chr1:103573422-103573700
  hyper
ctccctttattgtcccgcctacattcatctctttctccagtttccaattccaacctggtagcagctacaatctggattgtatttaagggaattgcttttttttttttttcttgaagagcggggaggaagggtaaagtggggggaggggcgcagaagcagtaggaccgacggcaatctcccacctccccaaatccattttttcttacctcctctgacctctctagcttggaagaggaaggtcaatgcgagggttgttacggtgaaatcccagagccacc

SEQ ID NO: 67407 - DNA, 467 bp, Homo sapiens; identical to SEQ ID NO: 26503
  chr1:103573701-103574168
  hyper

SEQ ID NO: 67408 - DNA, 30 bp, Homo sapiens; identical to SEQ ID NO: 38694
  chr1:1045970-1046000
  hypo

SEQ ID NO: 67409 - DNA, 30 bp, Homo sapiens
  chr1:10493353-10493383
  hypo
cccaaccctccaaatcgagaggggtgggtg

SEQ ID NO: 67410 - DNA, 297 bp, Homo sapiens
  chr1:1049888-1050185
  hypo
tatctcaggggttcccgggatgctgcctgtgcaccccagggctgaggtgactgcgtgtggaaacacctgcctgactggcttttaggaggagtactgggggcgggatgtgtgtcaggaaaacaacgtttctgtataattcataaacatgtatgttaaaaacaacgtggccatgacggatcctggctgaatgcaaacggggaacataaacctgagtaatcaggcgcatcactgaacatcccaggcggccgcccctaccctggggctcaaaaccggctccctctgcgagggtttcccagg

SEQ ID NO: 67411 - DNA, 92 bp, Homo sapiens
  chr1:10534389-10534481
  hypo
atttccaagtttcttcgcattcatccattggcaagtccctaaatgtgcccatggcactgtggggatgggcagagattaactcaataagaata

SEQ ID NO: 67412 - DNA, 33 bp, Homo sapiens
  chr1:1053775-1053808
  hypo
gagcagagcccctgccggcgtgggccaacctga

SEQ ID NO: 67413 - DNA, 30 bp, Homo sapiens
  chr1:1056382-1056412
  hypo
gacctcagtgaggctcggttttgggggcct

SEQ ID NO: 67414 - DNA, 30 bp, Homo sapiens
  chr1:1058888-1058918
  hypo
gcacacctgcgcacacgccacacacacctg

SEQ ID NO: 67415 - DNA, 35 bp, Homo sapiens
  chr1:10601654-10601689
  hypo
tccatctgttgtgaacggaccgtcttccttccctg

SEQ ID NO: 67416 - DNA, 37 bp, Homo sapiens
  chr1:1066357-1066394
  hypo
tcgccgcagggtccccggctcccgaggctgctgtggg

SEQ ID NO: 67417 - DNA, 169 bp, Homo sapiens
  chr1:1067634-1067803
  hypo
ctcctgcctgagacccgccgccatcgccgccgcgagccctgcgttgggcattggggccaggcacctgccaggagggcctcttccgaggtggggtgtcacctgggatgtgtccgctggcaaatgggagaaacaccagggcggctgccggggaggtcgatgtcagggagcc

SEQ ID NO: 67418 - DNA, 35 bp, Homo sapiens
  chr1:1068726-1068761
  hypo
tcctgccaaggatgacgctccggctgggtgggcac

SEQ ID NO: 67419 - DNA, 23 bp, Homo sapiens
  chr1:107161642-107161665
  hypo
tgagaccccgtctaaatatatat

SEQ ID NO: 67420 - DNA, 18 bp, Homo sapiens
  chr1:107598664-107598682
  hypo
gtgagttaggccgggcgc

SEQ ID NO: 67421 - DNA, 109 bp, Homo sapiens
  chr1:107600250-107600359
  hyper
tggtgctgtccacctcgccttttcacccggccactcactggaaacaggcgctcctctacctgaacgagccggtgcaagtggagcaagacacggacgtttcaggagagat

SEQ ID NO: 67422 - DNA, 1154 bp, Homo sapiens; identical to SEQ ID NO: 26504
  chr1:107682621-107683775
  hyper

SEQ ID NO: 67423 - DNA, 719 bp, Homo sapiens; identical to SEQ ID NO: 26505
  chr1:107683776-107684495
  hyper

SEQ ID NO: 67424 - DNA, 30 bp, Homo sapiens
  chr1:10783213-10783243
  hypo
gacgtgggaaggccccgcctgccagtgtgg

SEQ ID NO: 67425 - DNA, 462 bp, Homo sapiens
  chr1:1080476-1080938
  hypo
caccccacagccccccgctcctcccctccacacccaaccacagtccctcctggctgacaccgtggcccctcctggcctgtgctccccgggaacctcagtcagtgtcacttgaactccagcaccggacctggccccgtccatccagcctctgccccgagagccccgcccgtatctccagaggacacgccctgccaggggacaggcgggagcagctgagggccgcccggggaaggaaggcaaggagggcatgtaatcgcctgaccacatggccgacccccttgtgacctcatgacccccaccaccttcatggccgaccccacctgacctcatggccgacctgacctgaccgcacggctgacccaaccccatctcatgactgaccccacctgactttatggctcaccccagtgaccccatggccaaccccacctgacctcatggccgacccgatctgacctcatg

SEQ ID NO: 67426 - DNA, 30 bp, Homo sapiens
  chr1:10819797-10819827
  hypo
catggggaggaagagcgcaggcaggtgagc

SEQ ID NO: 67427 - DNA, 57 bp, Homo sapiens
  chr1:1083618-1083675
  hypo
gtgggggtggagagccgaggtgccggtgcgtccctgggttgccgcacgtatatccct

SEQ ID NO: 67428 - DNA, 169 bp, Homo sapiens
  chr1:10838656-10838825
  hypo
tcccaactcccctctcgcggtctttcttcctgaatctgattcctaaaatgtcttccagtggacacgaggaggagagctcccatccaaactgttcccaggcaaacgtgtccttgctcttgatccgtgtggaattccaagtccccctggcagagagcggcttctgggactc

SEQ ID NO: 67429 - DNA, 190 bp, Homo sapiens
  chr1:108432636-108432826
  hypo
tgagaaacttatttacggcttatactccagattttagctctgctcactatttcacaatcttaattttataaaaataaaattttattctttcttagtatcaatgcttaggttttgcactaaaatcaccgtatcagcaagaagtagtaaattgtgagtcagatttgtgtacatatatcggagtccacagtgc

SEQ ID NO: 67430 - DNA, 482 bp, Homo sapiens
  chr1:108506595-108507077
  hyper
ctgcaggaaggaaagcggaatctctagtgaaacttctcatttcctgtcgctgctgagagaggctggactcgctccttctcacatggcttaggaagagctgtaaacgggagcttgccggctggccaccagctcaggggccctgggggcggcctccgggttctgctccctgttcttccctttgaccaatgtcactcctggacagataacgggaccaaacgcccttcacttcctcgagtcctcatgtatgtcatggttcctcttttaggaaaacatgagtacaagacgcaaagcaaaagaagagactaaaggcaaattaccccatcacctcgtttcgtccctccccttcgttattatagaagagcttgatcaaattccctttgtcgcgccacacacacgcagagtaggtgaagggcaccctaagacaacttatttctttcccgcctcacagaaagcctttacgaaatcctcacaccatctccgga

SEQ ID NO: 67431 - DNA, 228 bp, Homo sapiens; identical to SEQ ID NO: 77
  chr1:108507148-108507376
  hyper

SEQ ID NO: 67432 - DNA, 113 bp, Homo sapiens; identical to SEQ ID NO: 78
  chr1:108507494-108507607
  hyper

SEQ ID NO: 67433 - DNA, 550 bp, Homo sapiens; identical to SEQ ID NO: 79
  chr1:108507657-108508207
  hyper

SEQ ID NO: 67434 - DNA, 340 bp, Homo sapiens; identical to SEQ ID NO: 80
  chr1:108508208-108508548
  hyper

SEQ ID NO: 67435 - DNA, 38 bp, Homo sapiens; identical to SEQ ID NO: 81
  chr1:108508549-108508587
  hyper

SEQ ID NO: 67436 - DNA, 287 bp, Homo sapiens
  chr1:10854374-10854661
  hyper
ttactaactttgccccgcgactaccagggccttttccccctcgccaccccctgagtgtaccgggtgtcggcgggacaactacgcacaatgagggccgcacccccacactccactcggtcagaaacgcacactccgccccgtggcccagtgatccaggtttgggggagctccatactcaggagaggcgctactgccgcttttccggtgggcacgcacccgcacccgcaccgtagccagcgtggctggaaggaggtcctcgccgcgcccagagccggctttccaagctg

SEQ ID NO: 67437 - DNA, 30 bp, Homo sapiens
  chr1:10856927-10856957
  hyper
gagtcgcacggcctgcggaggagcatctga

SEQ ID NO: 67438 - DNA, 30 bp, Homo sapiens; identical to SEQ ID NO: 39021
  chr1:109076927-109076957
  hypo

SEQ ID NO: 67439 - DNA, 643 bp, Homo sapiens
  chr1:109203578-109204221
  hyper
gctcactgaaaccaacgcttctgtctttgtacgggccgtcgcttccatcatcctgcggtaagcagcatgcccaaccgaaaaaacaaagctcgtcgcggagccgccagcgtcctcaactcagcgccgccctgacgcccgcgcacgcacggcctcgctgcgtgacgctaccgccgcggctacgccggcgcccgcacccgcgcctcggcctccccgcggggctcgccaacctcgtgcgctctcacggtcggccttgggccccgggagcctcatggtgcgccgagctccgtccctctaggctctcagttccaaggcgtcggttttgcgtctcgtaacggccgctgtggcgcatgcccagaagccattttcaaggtcctcttccgaaccttggcgaggacccctgcgcctgccgcgccgttgaccccgctagcgtgcggctgcgacgcggcacggtacggcagctgttggcgaaggcccccaactccgagcgcgtccgcagaccgcgagccggaaggcggcttgggcggctgttgagttcgtggcgctcccgaggcgtggcaaaggcctaaaaacggtcctggccagcggaaggcggcaagaggagcagcaaggctccacgcgaggcggccggcggctggagtcccag

SEQ ID NO: 67440 - DNA, 30 bp, Homo sapiens; identical to SEQ ID NO: 39022
  chr1:109370476-109370506
  hypo

SEQ ID NO: 67441 - DNA, 274 bp, Homo sapiens
  chr1:10948439-10948713
  hyper
ctcaagtgcctcattcgcgccctacccaggtccccgcccaggatcacaggatttgtgaccctggccttggccttgtccctaaaaccgtcacccgggtctcccaggcgagaggggcgggaggctccagacgcccagagcccacagcttcccgcccggggcggctgagcggtcccggggagagccctggagagagacagagaaggggaggcgtggagcggggcccccacagcagaagaggggcaggagggaggcgagagggggccggagtctggcc

SEQ ID NO: 67442 - DNA, 314 bp, Homo sapiens
  chr1:10948746-10949060
  hyper
cgcggcccgggggtcccagacggggcgcccctccccacccggcccgccctgccccaccccccggcgcgggaggcccctgctccgcagtcggcggcgcccgggggagggggcgctgtgggggctcccggccgcccgccgcctgatgcgtatcgatcgcagcccggggtcgacgcgggggcaccagctgccggcgggcggggcgaccgcacattagcgcggccgggaccactccccggaacgcgggccgggcagcccattagacgcccccgggcggccgggcgaccactgcacgggcggggcgaggctggctccaa

SEQ ID NO: 67443 - DNA, 42 bp, Homo sapiens
  chr1:1094962-1095004
  hypo
ggggcgacgggggcacgcccagtgccccgccactctccatgt

SEQ ID NO: 67444 - DNA, 30 bp, Homo sapiens
  chr1:1095467-1095497
  hypo
acaggcgtgagccaccgcacccggatggtg

SEQ ID NO: 67445 - DNA, 98 bp, Homo sapiens
  chr1:109585374-109585472
  hypo
tattccacaaatatacgtgatgttcaaccgagcttaattaagcatccaggaagtataaccataaggaagaatacaattacacaaacctgtaagaacat

SEQ ID NO: 67446 - DNA, 37 bp, Homo sapiens
  chr1:109585772-109585809
  hypo
aagaacatcatcctcacagaggcgaaagtccagagtg

SEQ ID NO: 67447 - DNA, 18 bp, Homo sapiens
  chr1:10959337-10959355
  hypo
taccctgtagggggccgg

SEQ ID NO: 67448 - DNA, 28 bp, Homo sapiens
  chr1:109593505-109593533
  hypo
tcaagggccaggcaccgcggctcacgcc

SEQ ID NO: 67449 - DNA, 36 bp, Homo sapiens; identical to SEQ ID NO: 39026
  chr1:109631646-109631682
  hypo

SEQ ID NO: 67450 - DNA, 30 bp, Homo sapiens
  chr1:109642384-109642414
  hypo
gacaaattaaagtcacgatcacagaaaaac

SEQ ID NO: 67451 - DNA, 103 bp, Homo sapiens; identical to SEQ ID NO: 39027
  chr1:109644233-109644336
  hypo

SEQ ID NO: 67452 - DNA, 35 bp, Homo sapiens
  chr1:109646883-109646918
  hypo
attacagaagttagccaccgcgcccctccatagtt

SEQ ID NO: 67453 - DNA, 71 bp, Homo sapiens; identical to SEQ ID NO: 26513
  chr1:109656220-109656291
  hyper

SEQ ID NO: 67454 - DNA, 576 bp, Homo sapiens
  chr1:109656494-109657070
  hyper
cgccgcgcgcaccagcggcggcggctgccatggcgacccgcaggtgagctgcagaggcgcgcgtggtccctgccccacccgcgcggagccagagaggaggcggttgtcaaggcgacgtgggtaggaggagaggacagagggaggaggaaggatgggcggtgttggcgtagccgcagggaggtgactgaagcgagcctggcctcttgcatcctccgcctgtgtacctccctcccctttttttccgccttctgccagcagaagcagcagccgcagcacctgagccgctactgccgctcactcaggacaacgctatggctgagcctgggcacagccaccatctctccgccagagtcaggggaagaactgagaggcgcataccccggctgtggcggctgctgctctgggctgggaccgccttccaggtgacccagggaacgggaccggagcttcatgcctgcaaagaggtactgccgcccccctacccgatcccgctttggtcacaaaagtcttggatccaggcggagaccttggggacccaggcgcagagagtttcagacgccacggagtttagatttc

SEQ ID NO: 67455 - DNA, 30 bp, Homo sapiens
  chr1:109679322-109679352
  hypo
ataccctgaaaataacgaactcctgtgtct

SEQ ID NO: 67456 - DNA, 30 bp, Homo sapiens; identical to SEQ ID NO: 39028
  chr1:109701309-109701339
  hypo

SEQ ID NO: 67457 - DNA, 110 bp, Homo sapiens
  chr1:109772113-109772223
  hypo
aagttggaagcagagcggtttgagaacctccgagagattgggaaccttctgcacccttctgtacccatcagtaacgatgaggtaggtggctgtgccgcagcaggaggctg

SEQ ID NO: 67458 - DNA, 30 bp, Homo sapiens
  chr1:109797867-109797897
  hypo
ctcttctttctttcccgcccctgcccatgc

SEQ ID NO: 67459 - DNA, 61 bp, Homo sapiens
  chr1:109941488-109941549
  hypo
cgctgttccctttaccgcagaagctgcacacacaacttctacaacacgtagcacaggtaaa

SEQ ID NO: 67460 - DNA, 78 bp, Homo sapiens
  chr1:110009016-110009094
  hyper
cggtcccggaggcttcggcgaggaggacccggagtcccccccgccccgcggcggaactaaccacggaggcctctggtc

SEQ ID NO: 67461 - DNA, 235 bp, Homo sapiens; identical to SEQ ID NO: 26515
  chr1:110009583-110009818
  hyper

SEQ ID NO: 67462 - DNA, 30 bp, Homo sapiens
  chr1:110010091-110010121
  hyper
gaggggggagaaggacgacggggacgaggt

SEQ ID NO: 67463 - DNA, 80 bp, Homo sapiens
  chr1:110086023-110086103
  hypo
gcctggccatcctctcggtgtcagccatcaatgtggagcgctactattacgtagtccaccccatgcgctacgaggtgcgc

SEQ ID NO: 67464 - DNA, 30 bp, Homo sapiens
  chr1:110186147-110186177
  hyper
tccccagaaatcgggcggaggtttaggcct

SEQ ID NO: 67465 - DNA, 449 bp, Homo sapiens
  chr1:1102215-1102664
  hypo
gagggccgagcggggcgggcagagggcccgtgtcagccccactccgacctagtcctcggccgtctggccaggacacttcggccccccaggtgcccaccccaggacccaaagctggtggctgctggactcggcagggctggcgggtggggctcacccgggcccctgccctccggcgatgctgtcctcagtgccccaggaggacgaggccccccagctactgagcttcccagcgagtcccatgcaaccctcagccgggcggcccccggacccagctcgggcagccgtggccatcttactgggcagcattggatggagtcaggtctctaatactgcctggtaatgatgacggcggagccctgcacgcagcgaccggccgaccccgtcccggcccccagggcctcccgccgagccccacactcccctcccacacagcccgctcaccggacccc

SEQ ID NO: 67466 - DNA, 697 bp, Homo sapiens
  chr1:110282542-110283239
  hyper
gcggttcagcgactgcgcagctcccacccattcccaacccccgcccgctaacgttccccggcccggggctgccgagtccctgcgtcctgccggggcggtggttaagcggcccctaggcccggctccggcgtggtctcctccgcccctccccacagggcccgcgatcccagaggctgggcaggggtcgacatccgtggctcggcagctcgaaaaggctcccgcgtagagctgctcctgctggagatcgcggacccagagacccgccctctccgcgtcagtctctttgaccgagcggctctaccgttgagacggcactcaccccacgaatatcccagtacccgagaaccatagacgactcgcacgacatggtgacgggcttccgagccttcgaggactagggaaactgtgagcgggaggggctttatacccgacataagggggcggggcccacgcgcgggcgccctgactccgcctccgccccgttctccgtcccttgcctccgcggctccacagggccgtgcgcaggcgcgactaatgccggcgttggggttcagggcctggcgaccccgaggcgggacccgggcaggagtgctgcaggagagcaaaggacccgaggttgaggctcctcccttccccgcgggtgggagccagacttcattcattaatggtgccagtgaagacgcgaaaagcaccacta

SEQ ID NO: 67467 - DNA, 55 bp, Homo sapiens
  chr1:110305550-110305605
  hypo
gtggtgtgtgtgtcccgggtgggggtggtgttagtctgtgcgggtcaagggtatg

SEQ ID NO: 67468 - DNA, 91 bp, Homo sapiens
  chr1:11036267-11036358
  hypo
gctccatgggaacaccgtgggctgaacacaggcaagccagacggccctgcgggagaggagggaagggggtggggacatgcaccgcccagct

SEQ ID NO: 67469 - DNA, 475 bp, Homo sapiens
  chr1:110610423-110610898
  hyper
cgccgtgggcaggaccccggtgaggcctcggtgcccttcttgggggttctcagcgttggcccagaagcctcagcccgggtctaagaacttgggactctcctcgactttggcgatcggccgggtcatccggctcagggcctcagcggcagcgggcaaaactctagtaggagtctcttgccgagggcgtgtttcgacgtcagagccaaactcgggacagactagccaagcgcggacggcgcgagagtggctggcagcgccagcacgcagcctgggttcagagcaaggctgggcgctctcagcaaagggcggcctggggctgcgcgggcggcggactgcaggcgggagaagagcgaggtgcgccaggctctggggcgcgcaactgcccagcctcgtgaaagatcgcgccgcagatggggcgcagctgcgcgctcactcgtgtggactggaaacgctccgagccggttattttaaaaac

SEQ ID NO: 67470 - DNA, 232 bp, Homo sapiens; identical to SEQ ID NO: 83
  chr1:110611045-110611277
  hyper

SEQ ID NO: 67471 - DNA, 80 bp, Homo sapiens; identical to SEQ ID NO: 84
  chr1:110611434-110611514
  hyper

SEQ ID NO: 67472 - DNA, 141 bp, Homo sapiens; identical to SEQ ID NO: 85
  chr1:110611653-110611794
  hyper

SEQ ID NO: 67473 - DNA, 398 bp, Homo sapiens
  chr1:110612294-110612692
  hyper
cagggaggccagcttagtatgagaaataagaatacagttattccgtcttgaggacagccctggcattgcacgaccagtcgcggccagactgtgccagtctgccgcacaggcagcacccttcctgtgaaggctaggcccggggaggagagacgggccaagaccaggccgcagtccccagccgaccccgatttgaccactctaggttgaggcccagcctcagggccctcaaagggcgccagacacaaaagccgcgcttcttcgtcaggtctcagtgtggctccacagccctcggccgggtctgggcttcagggtaggtggcagttccagtccaacttcggcagagcatgctctctccttcccaggtccaactgctttcgggccccgactggactccgggc

SEQ ID NO: 67474 - DNA, 21 bp, Homo sapiens
  chr1:110613458-110613479
  hyper
ggagcccgggaaccccctccc

SEQ ID NO: 67475 - DNA, 876 bp, Homo sapiens
  chr1:110626790-110627666
  hyper
ccctcgcgtggccgggcgcagatccccgtgcacgggtcctccgcacacccttgccagcccgcagggattgttcgccgcgttggtgactccttcccaaaatgggaataaaagatcgaaatagctagtaagcatgcaaagtttattgtcaacctcaagtctctataaaaccagatcaaagggaacaggcgtttggtttcttcccagatcgctggggggcctcggggctcaggaagccccaggagtccagcccgctgccgctcactgcgctcttctctccagccgggtccaagggctcgagcatcgcaacctgcggcctgagttggccccgggcgcacgcgagggaaatggatgcagtgcccgtgaacttggggcctgaataattgataacaacccgctgggtgcccgtcgcgcggccaggcctgcggggagcggagccggaggcagcaagcaaaggaaacgcacgagccgggagcgcgggcgcgcggggccacgaaagaccgaccgactgtccgacgggcggtgggacaagaggacggatgctgtgggggggccccggaacccgccgccacaactcgcggcccacgcgggtcgcagccgccagccgtagggagctgccgagcagcgacgttccgcattccatcgggttcccgcgccctactgggcttgtgcggcgcagtgcctgcgtgtgctttcgttttctcaaggccattctgataaaacatacgtgctggttccctttcttttctcagaatgattcttcaaggcgaatgactcgaaatggagatttcttctaacaccgcgtgatcaccgacaacttttgcaggacgggatgaaactcctctgggtttccagtcagatgtgcgagtgggctctctt

SEQ ID NO: 67476 - DNA, 249 bp, Homo sapiens; identical to SEQ ID NO: 26525
  chr1:110672833-110673082
  hyper

SEQ ID NO: 67477 - DNA, 269 bp, Homo sapiens; identical to SEQ ID NO: 26526
  chr1:110673083-110673352
  hyper

SEQ ID NO: 67478 - DNA, 613 bp, Homo sapiens; identical to SEQ ID NO: 26527
  chr1:110692884-110693497
  hyper

SEQ ID NO: 67479 - DNA, 560 bp, Homo sapiens
  chr1:110693736-110694296
  hyper
cgtacgcacgggttggacaccgggcttcagcttctggtgctcagaagggcccaagaactccggaggaaattgggcttagctgcggaggcaagcgcccgcggagaaccggagggggcctgtccggcccatccgcggcttgaaactgcgcgcccagggcgcagttccactgggagcctcttacgcagctggagaccccagccccagccgctcggcctcaggcctgtgaccttgacagtaacattggcaagcgaagcagaactgtcacgcccgagatgaatatttaattctcagtcctggggctggtcctcgctggattcggagctagcagagagcccttcctccctcgtgggaagcgcatctggggaacggaatggctgagacaggggacgtgcgtgtggtgcccatctggagggggcgccgtcctggcgggtcgagaggcctctgctgcatttatgcctgtgtgcgccgtgctctgaagcgatgctggatgctcgcagtactatgggtgggccgctccccaggggcgcggctgccttggaaagaagcgtgatgtttccttt

SEQ ID NO: 67480 - DNA, 159 bp, Homo sapiens
  chr1:110726609-110726768
  hypo
ctctagcatggagatcgccaacacttccgcaactccaagatagacagtttttcacatttgaacatctctgaaagcacgctgtttccgacgatcagtgaggcaattatacaagcctgttttttctgtttttgttggttttttttgacggagtctcgctct

SEQ ID NO: 67481 - DNA, 104 bp, Homo sapiens
  chr1:11073857-11073961
  hypo
cggtgctgctctccacggttacagcccagtttccaggggcgtgtgggcttcgctacaggaatccagtgtctcagtgtatgagaggtgtccggctggtagaagga

SEQ ID NO: 67482 - DNA, 241 bp, Homo sapiens
  chr1:110754116-110754357
  hyper
ttcttatgatcagctcggtgtgtgtctcctcctaccgcgggcgcaagtcggggaacaagcctccgtccaaaacatgtctgaaggaggagatggccaagggcgaggcgtcggagaagatcatcatcaacgtgggcggcacgcgacatgagacctaccgcagcaccctgcgcaccctaccgggaacccgcctcgcctggctggccgaccccgacggcgggggccggcccgagaccgatggcgg

SEQ ID NO: 67483 - DNA, 765 bp, Homo sapiens
  chr1:110883470-110884235
  hypo
cgcaccatagactaccgaaaaggtgatagttgggcatatatccagtatgaaagcctggatgcagcgcatgctgcctggacccatatgcggggcttcccacttggtggcccagatcgacgccttagagtagactttgccgacaccgaacatcgttaccagcagcagtatctgcagcctctgcccttgactcattatgagctggtgacagatgcttttggacatcgggcaccagaccctttgaggggtgctcgggataggacaccacccttactatacagagatcgtgatagggacctttatcctgactctgattgggtgccacccccacccccagtccgagaacgcagcactcggactgcagctacttctgtgcctgcttacgagccactggatagcctagatcgcaggcgggatggttggtccttggaccgggacagaggtgatcgagatctgcccagcagcagagaccagcctaggaagcgaaggctgcctgaggagagtggaggacgtcatctggataggtctcctgagagtgaccgcccacgaaaacgtcactgcgctccttctcctgaccgcagtccagaattgagcagtagccgggatcgttacaacagcgacaatgatcgatcttcccgtcttctcttggaaaggccctctccaatcagagacagacgaggtagtttggagaagagccagggtgacaagcgagaccgtaaaaactctgcatcagctgaacgagataggaagcaccggacaactgctccc

SEQ ID NO: 67484 - DNA, 29 bp, Homo sapiens
  chr1:11089945-11089974
  hypo
gctgggattacaggcgtgagccacacctg

SEQ ID NO: 67485 - DNA, 19 bp, Homo sapiens
  chr1:11091314-11091333
  hypo
tcatgcctgtaatcccggc

SEQ ID NO: 67486 - DNA, 42 bp, Homo sapiens
  chr1:110949152-110949194
  hypo
attaagttctagggccgggcgcggttgctcacgcctgtaatc

SEQ ID NO: 67487 - DNA, 62 bp, Homo sapiens
  chr1:11095139-11095201
  hypo
gacgcactgccccaccgcctcggtgcacgtctatgccacctaggttacgtatttcatcactc

SEQ ID NO: 67488 - DNA, 165 bp, Homo sapiens
  chr1:111039979-111040144
  hypo
gtgctttcctgagtccgcgcttttcctgggagtcccagacgcagaccagtcagggtgagagtggactgggaatccaagaatcttcagaaattattcttcggcttgaaagtctgatgaatgaactgattacggctggtgcagaaagtgccccgtggacactctatc

SEQ ID NO: 67489 - DNA, 30 bp, Homo sapiens
  chr1:11104788-11104818
  hypo
gtaggcagagaggagcgcaccccgccgcct

SEQ ID NO: 67490 - DNA, 674 bp, Homo sapiens
  chr1:111097796-111098470
  hyper
aggaatcagcattcccgttgtagagatcggtggaccgatgctctcagaggcttccacaagcgtttgtattgtttggggcggtcggaactcagcgctgcggaagccggtgtatctgagtctctccacgtggctctacttttctgcagccctgtagaaataaacctgggtcctcgctccctggcctggggaaggaggtctgcaggggtctgtgggggccctggaggcgccttcccagctgcacaggctcagtcggaccagcagaggtcactgcgtgggaaagagtggggcgccaacccgcgcagagcccagccggcgaccgcccccgcgtccccgcggagctccctgccttctgccgcagtcctccgagggctgggcttctggggcaggtcatggctattgcaaccaaagggaggcccgggtgccagtgggcggccgccgcggtgtggagggcgccagggcggtacggcgcagcgggccgcactcttgggacgccccgcctgctctgcggagcctgcctgggatgccctttcctggtcacggactccgccggcagccggggcgggacggaccagaggctaccaactgggggcttctgctgcctgggacacggggatccacattgccgtccgaatcccatcgccaaagcctgtatgtgcagccgagtgggagagtgg

SEQ ID NO: 67491 - DNA, 947 bp, Homo sapiens
  chr1:111149588-111150535
  hyper
ccaccagctcctctccgtgccctccgccccgcgccacgcaaaccccagagggtcccgagcccattctgtgcactcttcttgagcagggtgcaagttccccttgatctccccggtctgggacctgccgagcagacggcagtggtcggcaagggcttgccgccgcggactcagcccaagcctgctgcgctgcaggctgcgccgccgggtgccccgcagcccctctgggcgccgcagccgggcagggaaggcagcacgcgccgcgcaacgccccgacacggatttacccttccggatgggcaccggggcctccatgttcctaggttacggccagcgccggcagaaccccggcagcgggcggcggcggggtgcgggcggccagccgggagccggctctgcagtcccgcgggcggcgcgtacggagctcccggccgccgcccgcagccgcaccgcgccacgcagcgccgcacctggctcgacggcgaactcgaattaaaggggccggcgggggccggggccggggccggggcgacaagctgccctccgccgccaccgagctcgtcacctcgttgggcccccgggcctcagcccccgccccgcgaggaaaacattctttggcagagcccgacttactaaccagaacctccaggagagctcagctgggtgctgccgggccggggagatgggggagggcagaagttgaggggcactggtgagaggctcctgccaacgtaatgaagtaggcaaggaggagataatcaatagcagctaccccaggcccacagcgggatccagccccgggagagacgtgttgctattattgtggtgcctccagacaggatctgcagacccctttcttgccctttctcccgccagcgcgaccccttctccagatcggcttcccacctccctgttacccagcaaagatttggcttcgcagggaaatgcag

SEQ ID NO: 67492 - DNA, 30 bp, Homo sapiens
  chr1:11115120-11115150
  hypo
cggctcctggaagttcgtgctctggggacc

SEQ ID NO: 67493 - DNA, 30 bp, Homo sapiens
  chr1:11118714-11118744
  hypo
ctactgaaccctccccgaccaggtgttttc

SEQ ID NO: 67494 - DNA, 38 bp, Homo sapiens
  chr1:111204435-111204473
  hypo
catcataatgtcagccgggcgcggtggctcacgcctat

SEQ ID NO: 67495 - DNA, 278 bp, Homo sapiens
  chr1:111216695-111216973
  hyper
tgaggatgaccagcacggacacgatggcgatgccccgggccggcccggagctctcggggtactcgaagagcagccacacctggcgctggaagtcgcggcggggcaagggccgctcctcctcccgcaggaagccctcgtcctcgcggaacttctccatggcctcctcgcccagctggtagaagcggatctcctcggagaaaatgtcgatgggcacgttgaccggccggcggatgcggcccccggactgatagtagtagaggatggcgtcgaagctgggc

SEQ ID NO: 67496 - DNA, 381 bp, Homo sapiens; identical to SEQ ID NO: 89
  chr1:111217194-111217575
  hyper

SEQ ID NO: 67497 - DNA, 136 bp, Homo sapiens; identical to SEQ ID NO: 90
  chr1:111217576-111217712
  hyper

SEQ ID NO: 67498 - DNA, 179 bp, Homo sapiens; identical to SEQ ID NO: 91
  chr1:111217713-111217892
  hyper

SEQ ID NO: 67499 - DNA, 145 bp, Homo sapiens; identical to SEQ ID NO: 26537
  chr1:111217923-111218068
  hyper

SEQ ID NO: 67500 - DNA, 42 bp, Homo sapiens
  chr1:11124188-11124230
  hypo
gctgtcagagacctccgctttgagctgcgctgccatagagct

SEQ ID NO: 67501 - DNA, 201 bp, Homo sapiens
  chr1:11131698-11131899
  hypo
cagagtaaaaggcagcgtcatcccgtgggcctctgctggctccttccccatctcctgctcttctctacccgctctgctcatgcaggcccacttgctgctgctcagcatgcccagtgaactagccccagggcctctgggctcgctgtgctgtggctccagaactcttctctaggtcactgcaggtctcgtcaatgtcgcatt

SEQ ID NO: 67502 - DNA, 43 bp, Homo sapiens
  chr1:11139758-11139801
  hypo
gcttcttaccttgagcaggggcatctctcgggcctgctggatt

SEQ ID NO: 67503 - DNA, 30 bp, Homo sapiens
  chr1:11141247-11141277
  hypo
taatgggtgtcatcccgggcgtagctgagc

SEQ ID NO: 67504 - DNA, 715 bp, Homo sapiens
  chr1:111505931-111506646
  hyper
tgagtcacataagagcgtcggccatcttggttttcatctcccgtggagatctactcggtccgcctattaaacttgagacgctggggtcccgcggagccgctgtgtcaggctctaaagaggttttacatttcccagaggaaagcgctctatgggctttaagcgccgcggagacaagcgcttcccgcctgggtggcgcactctgcgggctccaactcctctcaactacacagcgtccggaaacgacggccgactccacatccctaagacggacagaggggcagccgtggggaggattcgaaaccggtacttaccaacgcgaggcgttgcctgaattttcctctgcgggtttcaggaagaccctccgtaggttatttgacattttagtggggagaaaggggacacctcatccagaaaagtgggaagcgtggggccgagtttcccaatggggcgagaaccagagcgagggaatgttgggctggagttgcccacagcaactgtgaggggttcgaccttaacggagggcgacagcgggctctcgagagggtgtatccccaggcttcgggacgaggtcgcgcaccgcgcagaaaccggaaggctcctggcggtggactgcgccctcacagccctacgctgagagagaatcggcgtgagtctccgccctcagagcctacgacaactctccagactccgccggagcaggcgcagggggcgtggc

SEQ ID NO: 67505 - DNA, 41 bp, Homo sapiens; identical to SEQ ID NO: 26539
  chr1:111813546-111813587
  hyper

SEQ ID NO: 67506 - DNA, 110 bp, Homo sapiens
  chr1:11193073-11193183
  hypo
gcacacaggaggacacgagccagccagggtgctgggtctcacaggtggcctgcttctgatcaccttgtaccagctgcggtcgtgctctgtggcggcgctgtagtactgca

SEQ ID NO: 67507 - DNA, 199 bp, Homo sapiens; identical to SEQ ID NO: 39035
  chr1:112084890-112085089
  hypo

SEQ ID NO: 67508 - DNA, 16 bp, Homo sapiens
  chr1:112192214-112192230
  hypo
acgaccagaatattag

SEQ ID NO: 67509 - DNA, 496 bp, Homo sapiens
  chr1:112282866-112283362
  hyper
cgctctcgcctttggcgaagcgctctaaggccgggacgctcctttgttattcaaaaggagccgggcgagcgccagccaggccctggaggatggagttgcggccaataggctcgataggccgatgggctccgcagaccggtggggggtgctcctcccagcccagccctggacgccgggctccgcgcccgccagcgctgctccctcccagcgcggagacgccgcgcccggccgggacagccggggacggtggcggagagcacggagagtaattaagcaattagcgacgtgttgttaaaaggtaattaacggggaaaagtttgccccaggcaggattagaggtctctgagtgggacaactgtaagaacaccagagaaggcacgaacggtgccggcgccgccatcggtccgtccgtggcagccaaaagtgccagatatgctaactattgaaagatgcgcgggtggcgcacgcctgtaatcccagcactttgagaggccga

SEQ ID NO: 67510 - DNA, 279 bp, Homo sapiens
  chr1:112531573-112531852
  hyper
ttcgatccctctccccggggccgcgacggcccttggcgtcacgtagagacctttcccagagctcgcggggtggaagtggcgtcgggcaggaccagatggactggcccccagcctctggtagacacaccgccggctcgccgagctggagaactttgcgaagcgccccaaaccgctccgggtttccactttcagccatttctctccttgtcccctcaccaagagcggggacggagcaagccttcgccacctgtctctggcacccgccgagggaagacaggc

SEQ ID NO: 67511 - DNA, 679 bp, Homo sapiens
  chr1:112533107-112533786
  hyper
ggtggcagggagggccggcgtgtgcgcgcgtggggtatgtgtgcacctagctgtgtgtctatttctcgctgactgtccacagggcagcagcacctgcttgagaccaagcccggcgacctggcaaggtggggccccctaccgcgcaatctttgcggctggcccccggctctcagctccgagtgcagaggctgaagaggtacccgggggacacactgcctctaaccccacctatgagccgctctcctctcggaggacgaaggcaccatcagaaggtcgagattcgccctcctctcccgccacgtctacccactacctagaccgggagtctggacttgggagcgtgaactctcacccgagccggtccccttacaactggagcccgcccagcccctcagtccctccctgaagcccatgggtccccactgctccgtgcctcgtcgacccaggatggggagtgggaaggtcagcatgtgcccacagggccaggtgtccggcccagattcccaccctcagggcggcggcgcgcaaagggcgcagtccccgccgctgggcggacccgcggctccggctttcccggtgtctccagcctcggtgcccggaatcctggatctcggcctggcgctccggaagcgaggcagctccgtgccccagcagggacggggaacgcttggcttgagag

SEQ ID NO: 67512 - DNA, 152 bp, Homo sapiens; identical to SEQ ID NO: 39037
  chr1:112784462-112784614
  hypo

SEQ ID NO: 67513 - DNA, 102 bp, Homo sapiens
  chr1:113051583-113051685
  hyper
tccgcacactaggcccgcagctcccttcagcgccgcagaccccctgacaccgcacccggtcctcaggcagcgcgccccagaccccgggttcggcacgccgtc

SEQ ID NO: 67514 - DNA, 57 bp, Homo sapiens
  chr1:113052056-113052113
  hyper
cgtcctggtggtaagtgtggctctcaggctgggcgggtgaggcgcttggtaggagag

SEQ ID NO: 67515 - DNA, 671 bp, Homo sapiens
  chr1:113392209-113392880
  hyper
cccaccccctggagacgtggtctcccctcccgcgagggtccctccgaccccacccgggcaactagggcaccgcgggctgttacccaactaaccattaagcgcggagccgagcgcgtgcgtggcacggagaggcggggcgggtctggtctgcgctctcggcaccatgcggcccccaagacgtagagcttccctgcctcggtttgaagggaccgctgggctgcctgattacgcgcccccggccgagcctgcgcactggggacgcagtcggccctcgcgtcctctgctgcccgaaacaagcgcgtggaaagcttggtcggggcttctcacagccgcgcgcacagactggttctccccccgcgtctcccgggagcgtcgccgccacctgcacgcgtccggcacacaaacgtcggtctcaccccttagtttctggaagagaaaaaggaaaagccaccgagaggcctgaccctgaggggtcggggggagatgcgggcgcgtagtagagggaagcgactgaggagcggggactgggcagcatttgaatggatgcgggtgccgctggcacccgggaagacgcctgggagccggcgctggggagccgggcatgggctgggatgtgtttggattccaatctgggcctgacaccagttcagtgacctcgggaagttccccaa

SEQ ID NO: 67516 - DNA, 135 bp, Homo sapiens; identical to SEQ ID NO: 26545
  chr1:113497971-113498106
  hyper

SEQ ID NO: 67517 - DNA, 81 bp, Homo sapiens
  chr1:113498107-113498188
  hyper
ccttggctgtggggaatgcggctctccgcaccactctcgcaagtcaccaggtggggcaaggatcggcgggccaagaaggtt

SEQ ID NO: 67518 - DNA, 30 bp, Homo sapiens
  chr1:113617180-113617210
  hypo
actaactgagcagcacgtttattaactgac

SEQ ID NO: 67519 - DNA, 86 bp, Homo sapiens; identical to SEQ ID NO: 39038
  chr1:113751201-113751287
  hypo

SEQ ID NO: 67520 - DNA, 30 bp, Homo sapiens
  chr1:11376239-11376269
  hypo
acagcttctatttcacggagccatctcaga

SEQ ID NO: 67521 - DNA, 30 bp, Homo sapiens
  chr1:11380230-11380260
  hyper
actccactcccactccggcggcctgttcca

SEQ ID NO: 67522 - DNA, 42 bp, Homo sapiens
  chr1:11417975-11418017
  hypo
taatttgcatcgctgcggaaagcagggcgcatgcaggcggag

SEQ ID NO: 67523 - DNA, 59 bp, Homo sapiens
  chr1:114355897-114355956
  hypo
gtatttatttagagacgggcggggcggggctcggtgtctcaggccggtaatcccagagc

SEQ ID NO: 67524 - DNA, 120 bp, Homo sapiens
  chr1:114448980-114449100
  hypo
aaacttgcctcatcttaagaatccacctaatgtgctgggtggttctccagctctctccccaccccacccttaagtctccaagagattaagatcaggagtaagtttgggaattgctgacta

SEQ ID NO: 67525 - DNA, 378 bp, Homo sapiens
  chr1:1145504-1145882
  hypo
acaagtgcagtgagacgtcttagccctcgggagtgtttctcttcagcccctgacaccatggaggcgaacaggcacctccgcctcccgagggacacagatgtcgcttagacgcccggggtgtcttccctgcgggaagcctgcagggctgctcccgccttgttcccgagctgtggcctcgggcgtgactggcgctcgggagcaggctctgtgctgctcgaaggataccccactcccagacaccagcttgagaagattcccgcacggccggggacggccccagggccttgggagcgtctgtggacacctgtggtgtgggccgaggagctgggagctcatctgaacacgccagcactcgcgcatccacgctgctggcggatg

SEQ ID NO: 67526 - DNA, 240 bp, Homo sapiens
  chr1:1146646-1146886
  hypo
ctctccagtcagaggcgggcacggcccaagcctccatgccacaggtgtgcagcccacagtgccggtcggagactcccgtctgccaaggtttttattgtggtcccgcggggcaggaggtatgcatggcatacgtaagcagagagccggaggcagccatcggcacctagaacggtgcagagttggcccaggagcgtggcggggcaggcggcctgcacctgccctgctcgcccagcagaccct

SEQ ID NO: 67527 - DNA, 383 bp, Homo sapiens; identical to SEQ ID NO: 26547
  chr1:114695312-114695695
  hyper

SEQ ID NO: 67528 - DNA, 41 bp, Homo sapiens; identical to SEQ ID NO: 1801
  chr1:114695696-114695737
  hyper

SEQ ID NO: 67529 - DNA, 384 bp, Homo sapiens
  chr1:114695799-114696183
  hyper
cgcacggacccggggacctcgacactcgctaggaggcaagccctattcctcagccgggcgcccctcgtctcccgctctctccatggacccctctcctggcaaatcgcccgcagagcgagcttggagatgcgagggaaactgaagccccaagggtgccccgtcctgggagcctggctgtctgcggggtcccccgcattccgcagtagtaatacaggagggccgggggcttctaccccaacctccgctccccttcgggtctctcctggctgtgcaagcgatgggccagagggctggacgaggctggctcccaatccagaatcccgagctggggagttctctctaggttctggggctcctgggaccggggctttggggaagggagat

SEQ ID NO: 67530 - DNA, 52 bp, Homo sapiens
  chr1:114696412-114696464
  hyper
tgccgagcagcagctcgaacccgcgccccggccgcactggggcggggcacga

SEQ ID NO: 67531 - DNA, 676 bp, Homo sapiens
  chr1:114696540-114697216
  hyper
cgcccctcacgtggcatcccgcggcagctggcgagtctggcgcctcgcggccgccccctctacactcagggactggcctgagtccggggggtgggggtttcgaggcgggaagccgggctgtcccgaatctcggagggtgcaaggccaggaaagagtccgggttcccactccgcattcactgcctggtgtgaccttgggcgtctctgagcctcaattttcctctccgtaaaggaggtgtaatgattttaagtacttcacggactccctggggatagaaagatcgtgtttgtgaaaacactgggtaaactgccacatgccacacgaatgacagagaaatagataaccccgtaacagaaagagcgacggtcaggcagggtctgggaggaccttggccgaggttcctgacgggagcagttagactggcccccgagtcccagcttcggaggtagaagaccccaagacaggcgggcgatgcgaactgcaagactttccgagctccgcaatcctgcggtccgcggtacccgcatgttgctatggcgacgggaggcagcggccgtctctctccatggcaacgggagggaaaagtttctggcaaacaggaatggggggtcatttcaagagggcgcagggcgctcagttccgccgacccacctccttgcttcggtgaaacagcacc

SEQ ID NO: 67532 - DNA, 257 bp, Homo sapiens
  chr1:114697661-114697918
  hyper
cggagggaggagattcggagccttagctcctggcggtctccactgcgcgccatctgtgccaaccggcccttggacttgcgatcccctagcagctggtgcctggggcaccaagggctaaggcaaggcctgtgaggaccctggcccagccaggcggcttttccaccgtgaggcgccccctggctctgtccacggtgctgaagacccagttggtgctaccatcgcgtgggcataagtttaggggacgagggagaggcaat

SEQ ID NO: 67533 - DNA, 96 bp, Homo sapiens
  chr1:115055222-115055318
  hypo
tcaagccgtgctcctcgcaattacctgggaccgtagatgcacgccaccatgacttagctgatcttttttttccctttgcctcgaagaggctggggt

SEQ ID NO: 67534 - DNA, 1123 bp, Homo sapiens
  chr1:11538873-11539996
  hyper
tgcaggggcggggaccgacccccaggggtcgctgcgccttgcgcttcccccgcccgcgggcgccagggccgggctgaaccaccgcgcggatcggcagggggagcggcggcgaagacagcgccagacagcgggtcccagagaccgcagcgcgcggcgtggcgcagggtctcgccggccactgattcaaggcgcggcggcgcggagcccgagaggcgccagggattgggcggcagcgcggctccggagcctggctcggacacccccgcgacccgtggtaggagcccggacccaaacaaaggcgggcggcgaataaaaggcggcggcggagcggagtgctcgggttgcgagctgaggactgggattcgcgcgcagcttcccgcggtctgcttgccctggagcggagggggagccccagcctcctgcggctccgagaagcttccccctgcgacttccgcgaggagacgagtctgcgcagcgtggtggccgccgccccccgaccctctgcgcactctctcccgcgccggcggctcagcctagccccgttcggccggccgaggtgagtgcacggccgcggggcgccatccgggcttggtctcggggctgggggatgcattgctaggaggagggggaagtcctccgcgccgtccgcaccccgacctgcttggcgccgcgcgcgaagttctctcgctctccagccagcccgggatgcgggcctcggagccccccgggaaagacggtcaggggtggacagaacccaagcttgccctctacgaccgggccccagctccgcaccatctccccgcgggactgcagcattcttggtcggccaaggggagttggatgttggatgtccaggaacggcaaggcttccgacctctggcccctgcttgtcccctctgagggatatctgggtccataaaagttgagcgtcagtctgaagccgcccttggatcgggctctcgcccatgctagagcggagggaggggacagagtaaggctaatgaccccctccacccactccctacctagcgtactcgtgctctcggagggacatttccccgattaacctggctgcaggtccggccggggagggcgcgtgggggcttggggcgggccgggccag

SEQ ID NO: 67535 - DNA, 140 bp, Homo sapiens; identical to SEQ ID NO: 26052
  chr1:11540039-11540179
  hyper

SEQ ID NO: 67536 - DNA, 17 bp, Homo sapiens
  chr1:11540380-11540397
  hyper
cgcgcacactcacaccc

SEQ ID NO: 67537 - DNA, 94 bp, Homo sapiens
  chr1:115631944-115632038
  hyper
gccccctgccctgaccggccctcccggctcctggtctcacccagaagagcaggttgaagccaagcagcaggtacttgatgcaccgcaggccccc

SEQ ID NO: 67538 - DNA, 533 bp, Homo sapiens
  chr1:115632104-115632637
  hyper
ggggagcggcaggctccggcggggagggggcggagcggggaggaccggggcggggcctccggggggcggggcggggcccggcggggaggggcgcgtggaccccaagcggcgtggctggcgacgggtgggggcgccagcgggtggagatcgagcagcccgagggagcacgttcgctcttctcccggacccagggaccaccttccttccctccagtgggcgcaccgccgccggctatcggagcacctgcagggcgggagcgcccaccggggactggggacccatttaatcagcgccctgtgcggagaccggtttgaggcccgggcgatgcttgagggataagcacttggtctcgtggctatggaaatctaggaaggtgacctcgggtagaagagctaagtggggtcggaggttgccccgaagctggcaggaccagtcgcggggcacctgactgagtgtccagggctgcggctccgcggcgcggagcaagcacacaagcagcttctaggggaccctccctccggcccctcccccct

SEQ ID NO: 67539 - DNA, 30 bp, Homo sapiens
  chr1:115828832-115828862
  hypo
tttgagtcaatgccccggcacccgctgtca

SEQ ID NO: 67540 - DNA, 170 bp, Homo sapiens
  chr1:115880037-115880207
  hyper
actcaaggcgctccccgccctaaccttccacgcccgcttctcccacacctggcagcagacagctggagatgaagcgtgtgacccaagtggcagggctgaaccttggcgacctctacctgaggttgtccaacgcggctccgtggagggccccggtacgccggacggacccc

SEQ ID NO: 67541 - DNA, 587 bp, Homo sapiens
  chr1:115880208-115880795
  hyper
gcgttggctcgcagacttcctgcgttaacccccggggccctcagtcacgactcccagcccttccgagacgcgctgagggaactgccccaggtctagcgcgccccgttccgctcctccccctacctgggggccgcgcagcactttccctactcggcgctcacctcagccagcgcgctctgcgctccccccgcggtgctggccgccactcctcccgccctggcgcgccagctgccggcgcatccctctccgcgcccattcgctctccctcacttgcgcgttatccacttctagccctcgagctagaccctggcatggccgtgggcttctgcaggcgccagggctgctccctggactgcaggccatcctgggactagggactccacgaccagaactaacgctgttccctcggtccgactcgtcctcccgcgagggtcccgcgcccccacacccactcgggacatttctcagggctgctcttcggcctgcgggagcctcgggggtaaccagagagctcgccagaccggtatccttgcaaactctcccgcgaagcccagccacccctgcccgcgcccgcgctgcgcccctct

SEQ ID NO: 67542 - DNA, 171 bp, Homo sapiens
  chr1:115880872-115881043
  hyper
cgagctgctctcacacaggcttcttgaattcttagcccctcctcccgtactcctgagtcacacgctccaaatcctggcccccatccctcccctccccaccaccagccccgcacctgctgtggctgggctgtggtgcccggctggagggggtcctggggactacagacggat

SEQ ID NO: 67543 - DNA, 30 bp, Homo sapiens
  chr1:11591786-11591816
  hypo
ctgggtgccatgctgcgtacttgcccgggg

SEQ ID NO: 67544 - DNA, 99 bp, Homo sapiens
  chr1:11596484-11596583
  hypo
cttcttctgcatcatcgccccatttgccaagttcggcaagattgtggcactcaacacgggcgtgtccatcctctacacgctgaccgtcagcaccgccct

SEQ ID NO: 67545 - DNA, 30 bp, Homo sapiens; identical to SEQ ID NO: 26053
  chr1:11611023-11611053
  hyper

SEQ ID NO: 67546 - DNA, 142 bp, Homo sapiens
  chr1:116213911-116214053
  hypo
gggtgtgacttgacacggtgtgaaagtggaggggcgcgagcactcaggtgggtgaacagcctgcggcctcctttccctggctgcaaagccgccactcaactctgctccagcccaggtttcggggagccgggatccacttggg

SEQ ID NO: 67547 - DNA, 196 bp, Homo sapiens
  chr1:116214288-116214484
  hypo
cccaggcaggggaggcgcagtgcaggttggactgtgtaaggaaatggcagcatggcgaggtttgtgccgcggcctacaagcagggctgcatgctccccaggcagactgtggcagagccaagcccctcacttgtagggaagcgtgtctcctaggtgccccagtaggggaggtctgccagcatcgctgtgctgtgggg

SEQ ID NO: 67548 - DNA, 45 bp, Homo sapiens; identical to SEQ ID NO: 39042
  chr1:116214942-116214987
  hypo

SEQ ID NO: 67549 - DNA, 30 bp, Homo sapiens
  chr1:116247777-116247807
  hypo
caactgagggtggggcgctggctggagcca

SEQ ID NO: 67550 - DNA, 166 bp, Homo sapiens
  chr1:116371021-116371187
  hyper
caccgtgtccacaggcgcccactggtgtggcgtcctgagagtgcgtgcgtgagcgagcgagcggcttatcctagactgaagacccagggaaacagatctgtgtggaggatgtttctgttttcagcagaacagacgcagcccccgagtcagtgccgtcagaagacac

SEQ ID NO: 67551 - DNA, 407 bp, Homo sapiens
  chr1:116371188-116371595
  hyper
tcagtcaattcagtggaaaacacttccagtgtgaggcgttcgccggcgccccttagacgcggccgggtctgaggcgcctgccgagcgaggtggcgcggcccgggagctgtggtcgaagcccctgggcctggcgtgtaggctgcgcgggcggcggcgggctgggggcggggctctccgccctccgcgcgggtccgcctggcccctcccccgcccaccccgcgcccgtcccgcctcccccaccttctcccagaggaggtgacagacgggcctgtaatttggttccattcgctcgactggagcaacacctgcccccctcccctgggacgcgagggtctcatcccaaaccagacaagaagccaaagacaaatcccagcccacatgcagatccgacgcggaaaggagcgcgg

SEQ ID NO: 67552 - DNA, 1644 bp, Homo sapiens
  chr1:116380300-116381944
  hyper
agaagtggctcatctcgggtgtctccacgaggttctcctggcctggaaaatcccccctgcgagcccccgggctcgccagacaaccccacctgcctgcgtcggaaaccttccctcgtcgccctgctgaccagagagaacaggtagcgagcttcttccccggccgtctctcgaggcggccgtctcgctgggccaccgcagcctccgccacccgagcgacggcgcccgtccggatccgtagcgtttcgcggacgccgggacaggcggccccccgcggcgcaccccgccctacacgtccaggacgtggttgagataggagatgtagcagatggccaggcgcaggatctcgatcttggagagcttcttgtccgggggcagcgtgggcagcaatttgcggagctcggcgaaggccaagttgaaggcttccacgcggatgcgctcgcgggtggcgtgggccgagcggtacttggccgtggcgcgccggcggcggcgcttctcctcgcggctcagctgctgcgggtgcgggtagagcgcggctcggctgccgcccttgccgtcgccctcggcctcctccaccggctccaggtccgacacgctgccgagcaccttggtgtccgtgccgcccagggactccggatccgagtgcgccgagctgggatggtccgaatctgctgcttggtccggactcagcatcattttggaggctgaggaggggtcggaaaattaatcagtaaaaggaatcagggtattttgctggaaggatggctgccgaggcctaccacgccggtcctcccagcggacgcgcggcccgggccccctccccacagcaggccggcgcgcgacgcgggagggcgccgataggatctggcccgagggcgcgagccctgcgcctcgccctggcgcgggagccggcggggacgcggttgacccaggccgcatactagactggacacctcgacttgcagacggccacagcgggcctgtggccctgggcctggggaacaaccgcaggcctgtggggtcgcgactgggtttttgtgcctcttccggccaaatgccaaccgcgctattcctcctccctcccttcgtccccttcccggacaaacgagcgatttcgaacaacgaatacatctgggttttcacgggggcggggagacgcggggtgcacttctcgccccgagggcctccggcgaagcaacccggcagccgcggcgcccgagggcctggcgctggtctggggctgcgccgggggcgcctggctctggggtgcggccggtcaggaatccccatcctggagcgcaggcggagagccagtggctgggggcgggaaggcttcttggacccctcgcgcttctccgaaatcgtaaagaaatgactaaacaaacgtgggggagcctttaaaaagaaaattgactccgatgccctcgcaggctcccggagcaccatctgtcacgcagacagccacacacataggggacctagggacacggcgacgtgggatcagacaatgcgcccggcagtctggcgaccaccttgcgggaaaatgccggcagccgggccgctgagggaggagaggatgcagagggaagggaagagaagggaagggcccggggcggggcaggcggggactagcgggtgcagcgcgtg

SEQ ID NO: 67553 - DNA, 111 bp, Homo sapiens; identical to SEQ ID NO: 26566
  chr1:116382387-116382498
  hyper

SEQ ID NO: 67554 - DNA, 30 bp, Homo sapiens
  chr1:11645732-11645762
  hypo
gggaagcttctgcatcggagaagggcacac

SEQ ID NO: 67555 - DNA, 61 bp, Homo sapiens; identical to SEQ ID NO: 39043
  chr1:116574202-116574263
  hypo

SEQ ID NO: 67556 - DNA, 771 bp, Homo sapiens
  chr1:116710521-116711292
  hyper
gaatgccccgaagggcgtaggctcggggtctcccagccaggacacacaaggcaggctggggagccagggtcagccagggcacgccgctgagatgtctttcctgctccttctccccgggaagcaagggaagcaaaaggccagaggggtgctgggatcgctgtccgcagcaccagccttctcctgggacgtgttcagaaagagggaggctacagtgggcggggagagaagaaggaagagaaggtgggcagaaagggggcaagatgaagcggcaaggaggaaggaaaggagaagctaaggagggaggatggggaggcggcgacaatggccgcgctaccggtcgcccactgtgctgcggtgggtcggggcccactgcccctcgctggggcacctggggagggggcgctggggcacctggagagggcgcgcaggagcagcgggccgagccttctgcggggatggggtgggaagagaagaaatgaagacacagaggagtagaacaaagaggcgggagcaccccgccaggggaccgggaagggtcgaggaaaactgctgccgcgccccactgggttttaacaacgcccgggatgggggaagggctcccacttgcgccccaagcgcatgcggagaaggttcggcagcgcctcctgccggccgcccggagggtccgcggtggcgccagccccgatcgcagccgcgcaggcccgagggcccctacccgcacggtgaattgtcttccacgcactagtattttctcctcgctttcaactgaat

SEQ ID NO: 67557 - DNA, 634 bp, Homo sapiens
  chr1:1168350-1168984
  hypo
ccgcgactacctgcgcgcctggcacagcgaggacgtgtctctgggcgcctggctggcgccggtggacgtccagcgggagcacgacccgcgcttcgacaccgaataccggtcccgcggctgcagcaaccagtacctggtgacgcacaagcagagcctggaggacatgctggagaagcacgcgacgctggcgcgcgagggccgcctgtgcaagcgcgaggtgcagctgcgcctgtcctacgtgtacgactggtccgcgccgccctcgcagtgctgccagagaagggagggcatcccctgagccgccgcggcccggccctccgggacacctgcttcacccggcggcgccttggggcaggtgccgagcgggcgcactacgcccgggccccaaggcccccgtcccgcagccacgcttgtggtcgctgcgtcccggtctgcgtttgggagacccctgggggttgccggggcagcgcgccgtgtccaggtggaggtgcccgttcctggacctcagcgagcctgagccgggcccggccgcacgctgacccccgtgctgtccccgaccggctcacggggctgggctccgatcttccgtgtctcttatcagtggcgtttctcacgtctgcgtctcagatctaac

SEQ ID NO: 67558 - DNA, 30 bp, Homo sapiens
  chr1:116946453-116946483
  hypo
tatttgaactgtgttcgtgtgcatataaat

SEQ ID NO: 67559 - DNA, 30 bp, Homo sapiens
  chr1:11721254-11721284
  hypo
cactcattactgggccggctggtacggccc

SEQ ID NO: 67560 - DNA, 30 bp, Homo sapiens
  chr1:1172140-1172170
  hypo
tctgaggtgagctggcgtctccctctccca

SEQ ID NO: 67561 - DNA, 30 bp, Homo sapiens
  chr1:117239297-117239327
  hypo
ggatgcatggaaaatcgaaggcttgcctga

SEQ ID NO: 67562 - DNA, 190 bp, Homo sapiens
  chr1:1173900-1174090
  hypo
tggccaagcccagcccgtgagcgacggccccaggacgcggcgccgagctctgcccccagctccagctcccagcggcgtcggagcacagcagatcccagggcagcgctctgcaggcaggaaagagcttccccttgggacagcgcgctgagcagcccccagctgagggtgggagccccgtccctggacccct

SEQ ID NO: 67563 - DNA, 30 bp, Homo sapiens
  chr1:11740384-11740414
  hypo
tctgtggttctgggacgtgcctcacctgga

SEQ ID NO: 67564 - DNA, 51 bp, Homo sapiens
  chr1:1174339-1174390
  hypo
acagatgtgcagacacgtgggcacacacgcaccagtcgcagggacacacaa

SEQ ID NO: 67565 - DNA, 359 bp, Homo sapiens
  chr1:117452844-117453203
  hyper
ggccgctgctgctggcgctcctgtcgttgggtgagtgtgcgcggggctcagcggggcacacggggactggcgaggccctggagggctcggcggggcgcggctgcagcgcgcggcctggggcgccgagggtgcccgggctgctcccgggaaacccggccggggtgcgcgggttgttcggcccggcggggagcggccgcggggccgcccggagcctggcgcgaatccgctcgggccccgcgcgcggggtgcaagtggccgctccgccaggccgagcctcgcccccaacatgtgccggggggagtggcccggggccgtctttcccccaggtctccctacctgttggccgccgggagcccggc

SEQ ID NO: 67566 - DNA, 278 bp, Homo sapiens
  chr1:11751289-11751567
  hyper
cctgacagacgcggccgcagctgagcgcgcagcctcgctccattgttggggtccaccgaggaccgcccgccgcggccctttgtcgcccgccctgcgcggggccgctccagaggcgccacaactgccggagcccctcccgtcccacgcgccctgggccgcgccgaggcggctcttacgcaccgggaggagtgggcctgcctcgcccggtgcccgcacggctgctgggctgcgcccgcctttgtctgcctcctttgtctgccccgcgccctcgcggcggc

SEQ ID NO: 67567 - DNA, 210 bp, Homo sapiens
  chr1:11752448-11752658
  hyper
cggggtcgctgagtgcgcccggaaccagcaccgccggtggccccgcgccgtcccatctgtgcccaggaaggtactcagcctggctcccccgacggcgctggtctttcgcctgtggtctcccgctctgtccctcctgctccccaccgccggcttttggcttttctccgtccgctcgtcaagggtctcagccgccttcggggccggggtatg

SEQ ID NO: 67568 - DNA, 34 bp, Homo sapiens
  chr1:117665071-117665105
  hyper
atggagggcttacttcggccgggccagggagcgc

SEQ ID NO: 67569 - DNA, 30 bp, Homo sapiens
  chr1:1177998-1178028
  hypo
ccacaaacacagaagcgtactgtccagcct

SEQ ID NO: 67570 - DNA, 30 bp, Homo sapiens
  chr1:11780195-11780225
  hypo
attgaattatcacaacgaccttttcaagta

SEQ ID NO: 67571 - DNA, 30 bp, Homo sapiens
  chr1:1178721-1178751
  hypo
gtccctaacaggacccgcacccggggccgg

SEQ ID NO: 67572 - DNA, 30 bp, Homo sapiens
  chr1:1179038-1179068
  hypo
ctcccgggaccctcacgctcactgtgggca

SEQ ID NO: 67573 - DNA, 76 bp, Homo sapiens; identical to SEQ ID NO: 38854
  chr1:11792825-11792901
  hypo

SEQ ID NO: 67574 - DNA, 30 bp, Homo sapiens
  chr1:118173786-118173816
  hypo
atgagaagctggagtcgctgcctttctttc

SEQ ID NO: 67575 - DNA, 36 bp, Homo sapiens
  chr1:11822246-11822282
  hyper
tccgacgtcccctcccgcccgcgacctgccgacctg

SEQ ID NO: 67576 - DNA, 110 bp, Homo sapiens
  chr1:118277822-118277932
  hyper
gaggggccaatgtgacgagcagcattcctctttcactttcattttgtgctgtttactttataaaagttagtgtctacagaggctaggagtttgtccgtgctatttttatt

SEQ ID NO: 67577 - DNA, 30 bp, Homo sapiens
  chr1:11839862-11839892
  hypo
ttcctcagctggagccgctgggcaacagcc

SEQ ID NO: 67578 - DNA, 33 bp, Homo sapiens
  chr1:11848300-11848333
  hypo
aggaagtacctgcagcgccggtgcctcgaggca

SEQ ID NO: 67579 - DNA, 30 bp, Homo sapiens
  chr1:118522258-118522288
  hypo
gtttgaataaaactgcgctgagaagtacta

SEQ ID NO: 67580 - DNA, 83 bp, Homo sapiens; identical to SEQ ID NO: 38855
  chr1:11854720-11854803
  hypo

SEQ ID NO: 67581 - DNA, 30 bp, Homo sapiens
  chr1:11861082-11861112
  hypo
ggggatgggatcctgcggatcctcagcgtg

SEQ ID NO: 67582 - DNA, 286 bp, Homo sapiens
  chr1:118727824-118728110
  hyper
ctgcctaagcgtccccgctaccacagtaaccgaagccacgcccagttcctgaaccacgtcggctcccctcccccaacaccgttcggaatccttgggtcaaccgcctccgtctccacagcaacggagtttcagagcgcgcggcagcttgggggcggggttcccagtcccccggtcaaattttaggacttttcagcaggaaagctgcacaactggaggagggcaggacgaggctggcctcgcaggtcgggctacgttcttctacggtctgaggcgttgtctagaaact

SEQ ID NO: 67583 - DNA, 186 bp, Homo sapiens
  chr1:1190209-1190395
  hypo
caggagctccaagaacgcaggagcagcccgcggtcggcagcaagtttgcatttctaagtgaccacatctaataaaatgaaaaacgggtttactaaaacaggtccaaagacaacacggaagataagctacaaatccagcacacaaggcccacccacaccagccccagcggcccgtggccaggacagg

SEQ ID NO: 67584 - DNA, 317 bp, Homo sapiens
  chr1:11919143-11919460
  hyper
gtgggaggtggagaccgggcagagccgaccttgtatagaaatgggccgggtcgggccggggggcaggaacgcgctggagacacagacaagtccccgtctcccgcttcttcctttcctgcaaatgtccaggtgtcctaggttggcgctttcttcctgcctccccaccccaccgttgctggaaaaggcagggaggaccccggctttccgaggaccgacgtgagcgcggggagcacggggtgactcacagcgaaaacagccccggccaagaccccgccacccgcggcgcctctcccctccccgcgcgagttccctggccc

SEQ ID NO: 67585 - DNA, 85 bp, Homo sapiens; identical to SEQ ID NO: 38856
  chr1:11936694-11936779
  hypo

SEQ ID NO: 67586 - DNA, 30 bp, Homo sapiens
  chr1:11938065-11938095
  hypo
tgaagaccaaggggacgagatctcagtgtc

SEQ ID NO: 67587 - DNA, 30 bp, Homo sapiens
  chr1:11938661-11938691
  hypo
tgtccaaccccatggcgcccttgccctcca

SEQ ID NO: 67588 - DNA, 30 bp, Homo sapiens
  chr1:11939935-11939965
  hypo
ggaaggctggccagacggaagtggcacccc

SEQ ID NO: 67589 - DNA, 60 bp, Homo sapiens
  chr1:119521978-119522038
  hyper
cgtcacgatcccacaggatgactttcctttttaacagactagctacgatatatactgacc

SEQ ID NO: 67590 - DNA, 138 bp, Homo sapiens; identical to SEQ ID NO: 26571
  chr1:119522297-119522435
  hyper

SEQ ID NO: 67591 - DNA, 289 bp, Homo sapiens; identical to SEQ ID NO: 26572
  chr1:119522565-119522854
  hyper

SEQ ID NO: 67592 - DNA, 15 bp, Homo sapiens
  chr1:119522925-119522940
  hyper
cggttcatccagttg

SEQ ID NO: 67593 - DNA, 165 bp, Homo sapiens
  chr1:119526767-119526932
  hyper
tagcagttgagctgacgggtgcgtgcgagaatgcgagacctgccacgtgtacacgtgtacgcggagtgtcgatctgcctgcgtgtccttggatgtgcctgtctaggtgcccacccgcgcgcgccaccacatccccaggcctctggaacgcagctgctgtgtggcc

SEQ ID NO: 67594 - DNA, 416 bp, Homo sapiens; identical to SEQ ID NO: 26575
  chr1:119527236-119527652
  hyper

SEQ ID NO: 67595 - DNA, 310 bp, Homo sapiens
  chr1:119527868-119528178
  hyper
tcacccgggaagagacgctgccctgggcacaatagggtcgcctgcattactcctccatacacacatctttaaatgtgtccctgtgtgtgttcgttagggtgctgtattacagaaaaagaaaggcctaaaaacacccccagccctggtcgcgcctttcgctaccgcctgagtctggagccgacagctccacctcttctgctccctggaccgccgcgtctccacgccacggcgccctttttactaaaagatcttttctcatcctatcagcaaatcgttaagaaaggcttagccattgcgggggctccaactt

SEQ ID NO: 67596 - DNA, 726 bp, Homo sapiens
  chr1:119528611-119529337
  hyper
acataaggccctagacgggctccgtgcgatctggggcctcccaagagaaaacttccccgggacaggacgtctgccacgcgcagctaaacaacttctgttttttccgccgtggggaaaataaaagaaccttacaaattctaaggcgtcataacccctgcaagaacttctaactgtatgaaggcccacgcgagattttgacaatagataaatgagctgaggaaatagggtctggccagcgaagggaaacacacagtagccctgggtgcctttctggaatgcccacgcaggggtccgcgtggacaagcacttgcattcaaatacaggaaaaggcttggacggtcgaaataaatctccttttaattttcttttcatcgactaataaaaataattccccagcactaaactcaaataccgtaacgggccacaaaaacacggagaattcataaaactctatctctgcaggtcacccgctaatcgcattattattagcctcgggagcatggaaattgaactgtcactgcctaaagagaaaatgtaagcgacagctgtccctcctctgagttggacagctttgtggctgagatccccaagctcctgagccccagaccgtctctatcccagtgcaggccgctgccccctccccgggcttgtcagcgtgtgaagcggggtctactccccagctctggctgttcagcaggagcaccttccagcatggttttagaagtc

SEQ ID NO: 67597 - DNA, 189 bp, Homo sapiens
  chr1:119529378-119529567
  hyper
cgttgtatgtgcgcgcgcgcacactcaagattcttccgacaacagctgttcccccgggctgtttttgcacagttgaaatcttggcacttaacacaaaacgttaaagttggcttctcccctcctagggttctgttaaaatacagacatgacatcccccctgctttttacatgttccgtgcacataatata

SEQ ID NO: 67598 - DNA, 135 bp, Homo sapiens
  chr1:119529777-119529912
  hyper
caactggtcattccccgaagactgaggtattggattggagaacgccgcgccagtcctcccgagttctcagaagcgagtcctagatctcggctcccgccgttgccttcggcccgcgcccctcccaatcccagggac

SEQ ID NO: 67599 - DNA, 144 bp, Homo sapiens; identical to SEQ ID NO: 1805
  chr1:119530005-119530149
  hyper

SEQ ID NO: 67600 - DNA, 307 bp, Homo sapiens; identical to SEQ ID NO: 1806
  chr1:119530201-119530508
  hyper

SEQ ID NO: 67601 - DNA, 47 bp, Homo sapiens; identical to SEQ ID NO: 1807
  chr1:119530553-119530600
  hyper

SEQ ID NO: 67602 - DNA, 685 bp, Homo sapiens
  chr1:119530601-119531286
  hyper
gatccgacctgcgcccctacgctggcccagctgctaggaactagcgccccgagcgccgcccgctcgctgcatgagcgcccgagtcctgcttcccacccaccggggcaggcgctcacagactgtgtccactgaacttcatcttgtttttgttattattattattctctctcctctctctctctctctctctctcccctccctctctttttctctcctccccctctctctctcttcctctctgccttcccgtcctccctgtgatccaaacttctgggaaacttttttttccgctaaattcctcccttcccgaggaacagggggcaggcggtgcgctcctgtccgaggggtgagggagagggagggggaggaagaaaaagactgagggggaaaaaagccagcccccaaccaatagcgaggagggaacaagagaaactccgagagcgcgaaccaatgagaggaagggagagactgaggcccgggccaaagcgcagcgccagtcgtcccctggatgctcctgggccgactttaacccctggcttcccggtttccccatgggttactccaagagggaggtaggacagttgaaagttgaggtctgatctgcgcctttacaaactcctgcaaatcccaaatccatacgtttttcttccagatctgctggtctcatagacgctgcaagtccaga

SEQ ID NO: 67603 - DNA, 396 bp, Homo sapiens
  chr1:119531601-119531997
  hyper
agagcaaggggcgggcggcggagcgcggggtttagggcgagctcctcaggcgtattccagctgggccccctcacgccgcaaatactctctttccctacggcccgaacgctgggctgcgcttcgcctgttccgggctcttgttgcagagaacctatggagaggtgacaggcaagaacagctaggaactttaacagaagagaaggagctttttcaaaattccctgcaaatcccgttacctcaagaccatggctttcccggccagctgatctcccccctggccgccccctgccttttgcgatctctaaggactgcattcaacatggatttctaaggaattaaaaaatccaacgctcctggccattcttaattcccacacctcttcccaagttacgccac

SEQ ID NO: 67604 - DNA, 71 bp, Homo sapiens
  chr1:119535278-119535349
  hyper
ggccgcacctccagtcgctcctttaagtcgcagagagctgcgggacccgcataagtcgttaactattcaag

SEQ ID NO: 67605 - DNA, 148 bp, Homo sapiens; identical to SEQ ID NO: 26587
  chr1:119535573-119535721
  hyper

SEQ ID NO: 67606 - DNA, 249 bp, Homo sapiens
  chr1:119536142-119536391
  hyper
gcactctcaggagttcgggattgcttagcagcaccataaaacccaatccaaagtcggcgagttttgaggccccaacgtgcaccccgaaaaaaatacgggtacatcagcaactaccatatactttttataggaagctaagtacaagcgtcatgcacgtatcatgtgtgactacacaaagccatatgtttatccggcagcacacataagcatgcatacacttcgtacacccacacgcgttgtatccatgta

SEQ ID NO: 67607 - DNA, 30 bp, Homo sapiens; identical to SEQ ID NO: 26588
  chr1:119536719-119536749
  hyper

SEQ ID NO: 67608 - DNA, 3 bp, Homo sapiens
  chr1:119542991-119542994
  hyper
acc

SEQ ID NO: 67609 - DNA, 146 bp, Homo sapiens
  chr1:119543069-119543215
  hyper
cgaagagcgggtagatgccggccaagcaaagtgctcgaaagtgtagctgggacgcccacgccggaagcctggagaggcaagttgcgagttcgcagggcttgggagttttttgcggcggaagaagctgaatctaggggctgagtccc

SEQ ID NO: 67610 - DNA, 1280 bp, Homo sapiens
  chr1:119543273-119544553
  hyper
cgagattgagagctctttctgcggaacctgcctccggagtcagatgagcaaggggaccgccacgtcctcaccgagctcccagcggcctttggggcgggtccggggacaagccggaggactaggcttctcccagagcgcggctgtctttcccggaaagacccaagtgcgcgatgtcagcccgcctgcacttcatctgagttgtccttatgtggccatttctgtttcaaatttcagatttttctactaaaaaaggatgggttaaaacagctgagagcgcgcctgctctttcccgccctgggttctacatctctctagccgcccaccagactgcatctccaatctgggagctatcctcaccttgggagggtggggcaacaatgttattctcgtttcccgataaggaaaccaacgtccctacaacttgacgttaaatggtcccaggttcctgagcctcaaatctaggactattacctaggtcacctaaaaatttttgttctttccactcccccgagggtgattctgttagcctcgcaggcccttctcccacccgtcatttgaagtcatcgaccccggggcagccccaacagttctgtgcgggcctgcgcgcaccgccctcaccttgcgcgccaggcatctcacctcagccgggcaggtgcagaggtgacaggcgcggcagccgcggttcgtccggccgaggggcaggaggaggctggccgccgccttctgctgcccgcaggctgagggggcaggggagggggaacagggctgggaaactgccgtcagcgggtcccggccccgcctcccgaacgcaacgtccaggaaacctcagaactttctattgtctgagaagcttcactgaacaaattgtccctaaaactttagagctgcgaagagcggatcagggcaggttctagtgtggccctgtgccccggagcctgcctgccataaagtgtgaccggaagcccccccccccccgcccactgtcagaaccactgaggagagaagagcgcggcgccttagtgccgccctgcgtcgtggtcgggaagccgagcaagcggtgtggacgccccaggagcagggggatccaggcctaaactcatgggttccgaatgggcaagggagcagaatcaagcatcggtgggcgcttatagaaagcgcgtctgtcttggaacacccttaccagggtacccaaccccagcgccaggtttcctggccttgcaaggagaggttgaatttgtcaggattccccactctagaaggtggctcgtggtggtgaagct

SEQ ID NO: 67611 - DNA, 112 bp, Homo sapiens
  chr1:119545108-119545220
  hyper
atagtgtaaggaattcgacttctcaagctcagcattttcaattccttaatttgtccctgggtgaccgttagcaattgtggctgtagatcacatggggcggaccaggtagaat

SEQ ID NO: 67612 - DNA, 340 bp, Homo sapiens
  chr1:119548577-119548917
  hyper
aagcacattcctggacggcgactttgaatccaggccaagaaaagagaggtacaccaatattgggattctgtattttgggggtctaattggtgagtacagaacaaaggagtggagaggaaggcaaaataacctaagtaatagaaaatccagccatagactgcagtggaaattaatggcacgagaagccttgggggcaaaggtaaggggtcgcagttgaatgccacccgaactcatccagatgccgctgcgttcaagctctcccagcacccgcggccgaagtaaataacaattctcttaatgctaaggcagcaaggagagggcactgcgaactgcagacttt

SEQ ID NO: 67613 - DNA, 606 bp, Homo sapiens; identical to SEQ ID NO: 1811
  chr1:119549129-119549735
  hyper

SEQ ID NO: 67614 - DNA, 807 bp, Homo sapiens
  chr1:119549914-119550721
  hyper
cgtctaccccaacccgggtattaccctcttttccgtcttctagaaggggaaaaccatgctgttttgaattcaacatatttagattctgaaaatcgacggcccttcccttctttcctaggaaggcctgccccgtaggcacaaccttcggagaaacgggcggcgcgtgagttccctggagccgcctcctgggcatccaggctcctgtcgcacggctggtgcggcgcccactgggcgtggggactgggcccaaggctcccgggaccgggtcgtggttaacgccgaggccaagcccttcgaagaactctgagttctctgcctgacgttttgtccctcaggaagtgtcccttcccgacttttgagggtgtcttgttctttgacggggtggccctgtgggggaggaaggagaagtgttcctccactgctgttctgtggagcgggacctggctttgttcggcctccctgctctcgggagcctgtactccggctcgcacgcctgactgctggccctggccgctgctcgggccccgcgcaggcacacgggacaaggcgaagccccgacgcccagagggcgcttgggcccagcacacccgcgcacagcccaggaaacgggaaaggccactgtctgcttccctttcgcagattctatccgctggcacgcgaaggtcacacgggctctcaatgctaatttggaatgggaagcaccacgaagggttgaggtagcctggtggccctgactgcgcagggtgcggacagtgagcccgtatccagcttcgctgccacgcgcctagcagcccggcggccccggcc

SEQ ID NO: 67615 - DNA, 320 bp, Homo sapiens
  chr1:119551013-119551333
  hyper
cggggtagtgggcgggagacaagggtctcagaacagaggggctggcccggcgcggcgggccaggaactcccgggcgtgtgtgtgcagtggtgcggggtgggggtggaggtgaggtctcctttagttcctgggatctgggaatcccggcttctcgatctcatccggcgcggagatcttaagggtcggtggaccagttagtgtgtacggcctcacccctccgcctccagctttcgaggctctccgcttcagagctccaaaggaaaacttctgcgacttcaagaacgtcctgcgcattcacatggggtcgcttcctggctggt

SEQ ID NO: 67616 - DNA, 358 bp, Homo sapiens
  chr1:11958880-11959238
  hyper
gccgggacccgagggcgctccaggttggctccgcgggtcgcatcacctgccaagtgctcgggagccgcagcacgggcaccaggggggtccaggatggaggggccacggaggtctccaagggaactgcccgggctgagattggccagggagggggccaggaactagtggagctacggagccgccagtggatctgaggacccacctggatccgaggtcggcccctgtccccggtgctgaaatgcgggcgcccgcggggttcacggccaggactcagccctggagtccctgagaccgctagccccgtagcaatcccctatgtaggatttgtttcaagggctcagaccggcacagagccccc

SEQ ID NO: 67617 - DNA, 153 bp, Homo sapiens
  chr1:119683985-119684138
  hypo
tttgttgaaccctaccgtaatgtgctgggcactgaaggtacagagaaagacatatcttgtcttcaagttgtgtacagtctaatagagtagcggataaataaatgatgtacacttaataggtgttaaagaagcaagcaccgcaagttttaagga

SEQ ID NO: 67618 - DNA, 304 bp, Homo sapiens
  chr1:119869950-119870254
  hyper
tccctgccaggtgtccgaggcccgaccgcgccccgcccccaccgcgcccccctccccgcaccccgcccctcctgctcccggctttcatgtggatcaaggctggaggatgacaagctcctgactgatagatacatggagacttcgctggtgatttattggctttctgcacctgacgagaaccactaggcctatctgaggagggaaatatatgggctttcctgactccaagtggcagccccggggcgagcatgtgatgtcaagctgggcagaggaaagcggagctgtgcaccggcctgtgtactgt

SEQ ID NO: 67619 - DNA, 110 bp, Homo sapiens
  chr1:120190340-120190450
  hyper
tgggcttggtttctccgagggtctctgatgcccccttcggtggtcggcgggacggtcctattccctcttgcatcgctgtctcctccctcaagtctcagcctcctcctccc

SEQ ID NO: 67620 - DNA, 281 bp, Homo sapiens
  chr1:120190519-120190800
  hyper
cggggccctgcgccccaggggagcggacaacggtccactttacgaggcacaacttcgcccagccgttccgccaccgcactcgaacacacaccccatccccgcagcggtcgggtctggtcccgatcagccccatccccgggaggcggttgagcccagccacagccacgctcctacctgcgaggcggctggcgcggcgaggagctagggcaccgagcgccccggcccgagccccgcaccgcagcgcgtctgcccttgtgcggcggcggcggctgcagcggccg

SEQ ID NO: 67621 - DNA, 147 bp, Homo sapiens
  chr1:120191165-120191312
  hyper
gctgcactccgagctcgcggcaccggttgcgggcagccggtgggacgctgccgctgagctgtcccatggttcgggagggctctgcggtgggagaggccttttctttaaaaactgggaagtttgtggtgggttcgctttttaaaaatt

SEQ ID NO: 67622 - DNA, 63 bp, Homo sapiens
  chr1:120254521-120254584
  hyper
gagatgactggggagcgggagctggagaatactgcccagttactctagcgcgccaggccgaac

SEQ ID NO: 67623 - DNA, 145 bp, Homo sapiens
  chr1:120321244-120321389
  hypo
ctttgttcaagtgcacgtagctggttaagtggtggtgccagggactccggactcctactctcgtgaaaactcttgtgcctgaaaattattgtaaaatatctggaattattattattatttatttttattttttgagacggagtct

SEQ ID NO: 67624 - DNA, 15 bp, Homo sapiens
  chr1:12041510-12041525
  hypo
cgctgctgcactcca

SEQ ID NO: 67625 - DNA, 76 bp, Homo sapiens; identical to SEQ ID NO: 38857
  chr1:12078805-12078881
  hypo

SEQ ID NO: 67626 - DNA, 432 bp, Homo sapiens; identical to SEQ ID NO: 26058
  chr1:12123122-12123554
  hyper

SEQ ID NO: 67627 - DNA, 163 bp, Homo sapiens
  chr1:12123787-12123950
  hyper
cgcaagggaggacactcctcaccccgttccctgcccagctggagtgagggggcgcgggtgacaagcaggaacaccggaatatgctagcacccacaggtgggaggctggctgaagggctagtggtggggggcgcctccttctcaccccgcgatggctgggactg

SEQ ID NO: 67628 - DNA, 94 bp, Homo sapiens
  chr1:12175071-12175165
  hypo
tttttattattaaaaatttcaaacatattcagatgtagagtgagtcagagatggctgcgtactatcacccagctttaaacggttatggagtcat

SEQ ID NO: 67629 - DNA, 23 bp, Homo sapiens
  chr1:1218784-1218807
  hypo
atggggcttctgggccgggcacg

SEQ ID NO: 67630 - DNA, 30 bp, Homo sapiens
  chr1:12201701-12201731
  hypo
gggactcccaggacacgggacttgcagtag

SEQ ID NO: 67631 - DNA, 20 bp, Homo sapiens
  chr1:12204539-12204559
  hypo
actcaaagccactgtcggcc

SEQ ID NO: 67632 - DNA, 30 bp, Homo sapiens
  chr1:1222237-1222267
  hypo
cagagccgccctctccgccactgtcccccg

SEQ ID NO: 67633 - DNA, 30 bp, Homo sapiens
  chr1:12227408-12227438
  hyper
tccgggcccggcacacgtgcgctcggggca

SEQ ID NO: 67634 - DNA, 81 bp, Homo sapiens
  chr1:12227644-12227725
  hyper
ctgccccactgcccacgccgggcaccctcttcaaaagacttccttttcctctgggcgacggttttccgatttcttagaaat

SEQ ID NO: 67635 - DNA, 44 bp, Homo sapiens
  chr1:1223161-1223205
  hypo
gcaccacagcttcagcgtccggccagggacggaggccaccatca

SEQ ID NO: 67636 - DNA, 83 bp, Homo sapiens
  chr1:1223512-1223595
  hypo
tagagggcctgggaacggggcagtccccgtggaggcccgcactccatcccccgtgtccccgctccattccctgtgtctctgct

SEQ ID NO: 67637 - DNA, 639 bp, Homo sapiens
  chr1:12251319-12251958
  hypo
ctcttcacagccccacggggcaggcggtgggagaactgtgcccacgtgagggttgaggaggtggtgcgtgggagagtggtgcgcatgctcgtgctgcgaggagcaggactgcggggaggagcgaaactgctgggaagagcgggactgcggggaagagcgggacttcggggaggagcggcactgcggggaggagcaggactgcagggaggagcgggactgtggggaggagcgggacttcggggaggagcgggactgcgggggacgagcgcgactgcgggggacgagcaggactgcggagagtagcgggactgcggagagtagcgggactgcggagagtagcaggactgccggtcctgcccctggactctggccggtgttgtgtgtgccccatgctgaggcggtccgccagcctcctggagatccgctgtctgagagtgctgggctgtctgggagggcagcgtgggtgtggcggaggcaggcgtgaccgtttgccgccctctcgctgctctagaccaggtggaaactcaagcctgcactcgggaacagaaccgcatctgcacctgcaggcccggctggtactgcgcgctgagcaagcaggaggggtgccggctgtgcgcgccgctgcgcaagtgccgcccg

SEQ ID NO: 67638 - DNA, 30 bp, Homo sapiens
  chr1:1226147-1226177
  hypo
agacaagggcagggccggaactgacccagc

SEQ ID NO: 67639 - DNA, 56 bp, Homo sapiens
  chr1:12304691-12304747
  hypo
ttataaaagtatcaacgtgaaagggatttctcaggtttaaacgtgtttctcctctt

SEQ ID NO: 67640 - DNA, 64 bp, Homo sapiens
  chr1:1234696-1234760
  hypo
agcccgcccagggcccgtgctcacttacctgcagcagcgtctggagggccggagcaggaggggg

SEQ ID NO: 67641 - DNA, 103 bp, Homo sapiens; identical to SEQ ID NO: 38707
  chr1:1235178-1235281
  hypo

SEQ ID NO: 67642 - DNA, 177 bp, Homo sapiens; identical to SEQ ID NO: 38708
  chr1:1235901-1236078
  hypo

SEQ ID NO: 67643 - DNA, 252 bp, Homo sapiens
  chr1:1238230-1238482
  hypo
cttcaggtgagccagcgcagctcggttccaggccaggcacagcccacaggtggcagggaggccgcgctcaccatgtggtagttcaccacctcctgtaggctgtcagcgaacctctgcagacattcctggaggagcagatgggaacccgtgctgagatggcaaatccgggcccaggtcacccagccacgccctctgagcccctgggcggtgcagacaccggcctgcttctggcctggacgccctcaaggggct

SEQ ID NO: 67644 - DNA, 188 bp, Homo sapiens
  chr1:1239479-1239667
  hypo
cctcaatctccaccacgtccgtctccacctcgtcaatggtcgccctaaagcaagaacggggctggctggggtcacctgcagcctcagccccctcggggcttcacctccccccgcacctccctgaggggctccaccatgggaaggggctttcaggaaacaggctgggagacagacgcctgcctgctacg

SEQ ID NO: 67645 - DNA, 345 bp, Homo sapiens
  chr1:1245007-1245352
  hypo
agggggcgggcaggccggccccaccctcctgacggtcaccctggtccctgaagctgcctggatatggtcgccatgcaggaagccgcccagcacctcctcggcacacacgacttcagcgccttccagtccgctggcagcccggtgccgagccccgtgcgaacgctgcgccgggtctccgtttccccaggccaagccagccccttggtcacccccgaggagagcaggtgaggaagggcccctgggctgtggccctgccctcaagtcacgtgctgattttagctccagcacctcccccagttttaaggcaaggtgaggcgggaggcaggcagccgggagtcctcagga

SEQ ID NO: 67646 - DNA, 30 bp, Homo sapiens
  chr1:1247668-1247698
  hypo
acgcggcaggtgaagcgcagctggtgctca

SEQ ID NO: 67647 - DNA, 35 bp, Homo sapiens
  chr1:1253245-1253280
  hypo
tttttttttttgagccggagtctcgcgtctcgctc

SEQ ID NO: 67648 - DNA, 35 bp, Homo sapiens
  chr1:1253520-1253555
  hypo
attacaggcgtgagccaccgcgcctggccaaggca

SEQ ID NO: 67649 - DNA, 30 bp, Homo sapiens
  chr1:12551925-12551955
  hypo
agggcttaacatggccgacaagctccagct

SEQ ID NO: 67650 - DNA, 100 bp, Homo sapiens
  chr1:1257399-1257499
  hypo
gcctgttcctgcccccgctgggtgtgagctctctgagagcagggtctcagctgtctcctccctctgcatctcctaccccaagccacgccaggctcacaga

SEQ ID NO: 67651 - DNA, 30 bp, Homo sapiens
  chr1:1264857-1264887
  hypo
gtgccatgcttgtgccgtttgcgtgtccca

SEQ ID NO: 67652 - DNA, 57 bp, Homo sapiens
  chr1:12655969-12656026
  hyper
gacgccgtgatgtcacgggcgccgctgacctgtggctgaacccggagctgtaaatga

SEQ ID NO: 67653 - DNA, 30 bp, Homo sapiens
  chr1:1266025-1266055
  hypo
gtacagctggccatgcggttcctacagctt

SEQ ID NO: 67654 - DNA, 1138 bp, Homo sapiens
  chr1:1267047-1268185
  hypo
ggccatgaaaatggccgtggaggagatcaacaacaagtcggatctgctgcccgggctgcgcctgggctacgacctctttgatacgtgctcggagcctgtggtggccatgaagcccagcctcatgttcctggccaaggcaggcagccgcgacatcgccgcctactgcaactacacgcagtaccagccccgtgtgctggctgtcatcgggccccactcgtcagagctcgccatggtcaccggcaagttcttcagcttcttcctcatgccccaggtgggcgccccccaccatcacccacccccacccagccctgcccgtgggagcccctgtgtcaggagatgcctcttggcccttgcaggtcagctacggtgctagcatggagctgctgagcgcccgggagaccttcccctccttcttccgcaccgtgcccagcgaccgtgtgcagctgacggccgccgcggagctgctgcaggagttcggctggaactgggtggccgccctgggcagcgacgacgagtacggccggcagggcctgagcatcttctcggccctggccgcggcacgcggcatctgcatcgcgcacgagggcctggtgccgctgccccgtgccgatgactcgcggctggggaaggtgcaggacgtcctgcaccaggtgaaccagagcagcgtgcaggtggtgctgctgttcgcctccgtgcacgccgcccacgccctcttcaactacagcatcagcagcaggctctcgcccaaggtgtgggtggccagcgaggcctggctgacctctgacctggtcatggggctgcccggcatggcccagatgggcacggtgcttggcttcctccagaggggtgcccagctgcacgagttcccccagtacgtgaagacgcacctggccctggccaccgacccggccttctgctctgccctgggcgagagggagcagggtctggaggaggacgtggtgggccagcgctgcccgcagtgtgactgcatcacgctgcagaacgtgagcgcagggctaaatcaccaccagacgttctctgtctacgcagctgtgtatagcgtggcccaggccctgcacaacactcttcagtgcaacgcctcaggctgccccgcgcaggaccccgtgaagccctggca

SEQ ID NO: 67655 - DNA, 30 bp, Homo sapiens
  chr1:1273471-1273501
  hypo
aggccagggggcagccgggtggggcagcgg

SEQ ID NO: 67656 - DNA, 17 bp, Homo sapiens
  chr1:12805063-12805080
  hypo
aacgcatgcctcctctg

SEQ ID NO: 67657 - DNA, 30 bp, Homo sapiens
  chr1:1280896-1280926
  hypo
ctccgctgaaactcacggcagctgccaggg

SEQ ID NO: 67658 - DNA, 82 bp, Homo sapiens
  chr1:1308761-1308843
  hypo
tcaccccgtgcattccgggtgctccctaaaccccagtcctgtccccctgtacttctgccatccgggtcggcctccccaggga

SEQ ID NO: 67659 - DNA, 253 bp, Homo sapiens
  chr1:1309067-1309320
  hypo
gagagacctcacacccggcaaatggagctccagacccgcaggaaaggctgagtcctctgagaatttattactacggatcacagcagcaacgggcgggaagggcggcgccagactcatttgccccgcaggtagatcttgggggtctgccagccttcgggggcttcctttagccccgccttcagccagatgcgcctcaggtctttctcgaacttgatctgcaagacgcagagagagggaccgccaagtaattcgt

SEQ ID NO: 67660 - DNA, 93 bp, Homo sapiens
  chr1:1341737-1341830
  hypo
aaaaaaaaaccggggtacgttagatgctaggttcatgaggctgagacgggagtggtgaggcgcagtaatgaggcggcacgtggacagagtgga

SEQ ID NO: 67661 - DNA, 30 bp, Homo sapiens
  chr1:1344048-1344078
  hypo
actccagatttaactcgcttcaaatgtctt

SEQ ID NO: 67662 - DNA, 215 bp, Homo sapiens
  chr1:1355522-1355737
  hyper
cgcagcgccgccccgcgccccgcagcggcagccacgagcagggcgccgtccaggcccgcgccgccggccgccagcagctccagcaccgccagccgcccgcccgcggccgcccagtgcgccgccgtccagccgcgcgcgtcctccgcctccgctgccgcgggtcccgggcccggagcctccagcaggcgcgcggccagcagcgtgtggcccagggc

SEQ ID NO: 67663 - DNA, 30 bp, Homo sapiens
  chr1:1356905-1356935
  hypo
acctcccccaggaagcgcagccttggatgt

SEQ ID NO: 67664 - DNA, 46 bp, Homo sapiens; identical to SEQ ID NO: 38715
  chr1:1363856-1363902
  hypo

SEQ ID NO: 67665 - DNA, 132 bp, Homo sapiens
  chr1:1371107-1371239
  hyper
gcgccccgtccctcgcgcgcgatgctcccctggacggcgctcggcctggccctgagcttgcggctggcgctggcgcggagcggcgcggagcgcggtgagtgcggcgggcggccgggccggggctggggcttc

SEQ ID NO: 67666 - DNA, 340 bp, Homo sapiens
  chr1:13839429-13839769
  hyper
ctcccccagcctagccggctcggctcacctttgggcagtttggatgcgttctcctggatccaggagaagaggtgggcgaagtcacagtcgcacagccaggggttcccgtccagacgcagggagcgcagcgcgggcagcgcggccagggcggccacgctgaggctgcgcaggttgttgtcgttgagctccagcacctgcagcgactccagggtctcgaaggcgtcctcgtgcacgcccaccaggttgttgttagccaggctaagcttcaccagcctcccggccgagcggaaggcgccggcgcccagctgggtcaagttgttgtagctgaggtcgaggaaca

SEQ ID NO: 67667 - DNA, 177 bp, Homo sapiens; identical to SEQ ID NO: 26061
  chr1:13840521-13840698
  hyper

SEQ ID NO: 67668 - DNA, 77 bp, Homo sapiens
  chr1:13854197-13854274
  hypo
aaatgatagttttagaagactatttaatgatataaaaagtcatacaattaagtgaaaatcaacggtttacaaaacct

SEQ ID NO: 67669 - DNA, 21 bp, Homo sapiens
  chr1:13882124-13882145
  hypo
aagagtcgcttctttctttgg

SEQ ID NO: 67670 - DNA, 193 bp, Homo sapiens
  chr1:13910055-13910248
  hyper
taatttttaaaaccccgtttgttgcatgtggtccctttccctcctgttgttgagcagaataaaagcccattttgccagggcccgcagtcctggcggcccccgcagctgcggccctgtaactttaaacctggcctgagatcatcgttttggcgccggccaaacagagcccgagggcgggcctagcgcgcccgga

SEQ ID NO: 67671 - DNA, 388 bp, Homo sapiens
  chr1:13910310-13910698
  hyper
cgctcggaaagttctcaactgcaaagtttgctgtccggctgcctagggtctgggaagctcgggcaccctccctctccggggctcctgctcccacccctccggcccccccaccgtcgcgctcctccaggctgggcctgtggccgcggtgctttttaattttcccccagctcagaatcttgctgctcggcccccaggagagcaacaactcaacgggaacgatgtggaaggtgtcagctctgctcttcgttttgggaagcgcgtcgctctgggtcctggcagaaggaggtaagacccagcgcaagtggcttcctgccgtcgctgatggggacgagcgagcagagacttgctggaatgcccgggcctggtattcgaggttgtccaggggagc

SEQ ID NO: 67672 - DNA, 58 bp, Homo sapiens
  chr1:13910699-13910757
  hyper
cgggggagctgagggtgtgtgcgtgtcaggcggctgagcgccggaggaggagaggcag

SEQ ID NO: 67673 - DNA, 134 bp, Homo sapiens
  chr1:13910793-13910927
  hyper
cgcgggtgtgccgggaggagccccggaatccacaggctgcgaggtgggcagcacagggggcctccctccgagtcggcagcaccagagagatcgggtggaaggttcacagtaggcagccccgcttgctggcagca

SEQ ID NO: 67674 - DNA, 160 bp, Homo sapiens
  chr1:13936570-13936730
  hypo
aacaaaaaataaaaaaataaagctgaataacgttctgttgcatgtatagaccatactgtgtatccattcttctgtctgcagacgcttgggttgctaccacttttggctgttgtgaataatgctgctatgaacatgtgtgtacaaccgtctcttcaagatc

SEQ ID NO: 67675 - DNA, 730 bp, Homo sapiens
  chr1:14026466-14027196
  hyper
cctagccctagggtgcggtcggacttgccgcgacgccagccgccggggttccttcccgaggcgccgccatgggatccgcggtgacctacgaggggcggctgggtggtggccattgggcgacggcgcagggtcaagggccgggctctgggatcgtggggagaccgggggtcccggagccccccagccccgcaggccactgcctcgccgcccgacgtcacttccgactggagtcaagatggcggcggcgcggccgcgggcgccggggccggcgaaacagcggcggcggcggcggccctcggtgctctgaggcgctggcgcggcgggcgcgggtaaggagtggcgcgggtgggcggcctctgggctcgcgccgggacgctggtccctccccccgaggagcgcggcggcgacggcggcggcgacacgctggggacccggcgccgcagggatggccgggtcggcggacgcgccccctcagaggtcccgggcgtgccgggggccccgggacgaggcgcgggcctccgggtcggtggccccgcgggtgggtggcggcgccgggctcctccttgtcggccgtggggtccctgcggcgaagttcgggattcggtttgtcgccgtgaagagccgcgcgccccgcgggggacgcgtgcgggctgcagagactggccgggtgcgggcggcggtggggccacctggggccccacgtggggccgggcgccgtcccaattgtcaa

SEQ ID NO: 67676 - DNA, 116 bp, Homo sapiens
  chr1:14079260-14079376
  hypo
gacgggatgcctgggcgtttaccaggtgtgcgatcttggacagctcatgtcacctttctgagatgaagtttccctagccttaaaaatgaatatcatcatatcgatgatgcttgtgc

SEQ ID NO: 67677 - DNA, 54 bp, Homo sapiens
  chr1:14125568-14125622
  hypo
aaacacagaggtctccgccacttacttcgtcactaagtccggcatgttcaccat

SEQ ID NO: 67678 - DNA, 194 bp, Homo sapiens; identical to SEQ ID NO: 38860
  chr1:14139406-14139600
  hypo

SEQ ID NO: 67679 - DNA, 928 bp, Homo sapiens
  chr1:14218911-14219839
  hyper
ccctaaatgctggcccgagatgatgcagcctctctggagttagcatcttcatgattagcaggtggaatagcaaaataaacccagcactggcagaaatagctgttggaatcatgcaaaaagtacccctctcctccttttccagagaagcggccccttttggtttggagcaggggacagatccttcatacacagtagggttgggtcggctaagatgaagtactcagatctctgtatcaccggagcgccctaggggatgtgtggcattttctccttttctcttcttggtctctggattttatcgcaggcagtcgggtctcccgtgcctggcacttccttggctgtgggcaggaagaggttacagcagccctggagcctgctgggctgagttagcacttccctccgcatccagaatatctcccaggaactgccccctttgcatcgccgcaccggggtggcggcgcgggctgggggccgctgcagcaggtctcagtccctccctgctgccacgcgaggagtggggagcggcagggcctaggcgtcccgagtggaggatgagccggagacgcctgcgggtccggagctgcaccgcgcccgtgcggcccgcgccgcccgcctcccgcgctctccctttggcagcagccggacgcctggcgcgtgcaggacctggggccgcggcgctcgcgcggggacgcgggagcccagggtcggcgctgcaggcagcggggcggcgccagcaaggccagctccccggggaccctggggcagcctcgcgccctgcctgcctccctggactgagacgccgcggggcctgggcagcgctctgccggcagctggtgctggaacacagccggggctgagctgctcccggggaccctgccccttccaggtgaccccaggagaagcagccccgggccggggggcaagttcc

SEQ ID NO: 67680 - DNA, 112 bp, Homo sapiens
  chr1:1471673-1471785
  hypo
gtgccctttcctccacggctgccaccgcgcctgccaggcccactgcccctggtgtttcttctgctcctctatccctgggaggtgctgtcggaggccacgggggctctaccca

SEQ ID NO: 67681 - DNA, 60 bp, Homo sapiens; identical to SEQ ID NO: 14211
  chr1:14730412-14730472
  hypo

SEQ ID NO: 67682 - DNA, 346 bp, Homo sapiens
  chr1:1475298-1475644
  hyper
cgtaggccttggtagggggagcgcagcgggtatggggatcgcaggctggggaggggagcgcaggccggggtggggggagcgcaggcccgggaggggaccgcgggccggggagggggaagcgcaggccggggtggggggagcgtaggccggagagaggagcgtagggagtgtggggatcgcaggttggggaggggagcggaggccggggtgggggagcgcaggccggggaggggagcgcaggccggggaggggagcgcaggccggggaggggagcgcaggccgcacgggcggtaaacaaggcgcgggaggtgggccaggcggcgcgcgcgggcggggagcagggggc

SEQ ID NO: 67683 - DNA, 85 bp, Homo sapiens
  chr1:1476254-1476339
  hyper
cggtcctggaggggcgccgaggcccttcccgccccactgctccgccctacgtcctggactcccaggtcgccgggtgcgggactgc

SEQ ID NO: 67684 - DNA, 51 bp, Homo sapiens; identical to SEQ ID NO: 26600
  chr1:147775362-147775413
  hyper

SEQ ID NO: 67685 - DNA, 100 bp, Homo sapiens
  chr1:147775523-147775623
  hyper
aggctttggagcctgcacaattgttctacaaaaggcagtagctccgccgaacgttggatcgtcccttggtctggtgataccagaacgagagttgactgtg

SEQ ID NO: 67686 - DNA, 30 bp, Homo sapiens; identical to SEQ ID NO: 38716
  chr1:1483034-1483064
  hypo

SEQ ID NO: 67687 - DNA, 694 bp, Homo sapiens
  chr1:14924504-14925198
  hyper
cctcatctctgtccccgccaatattcagcccggctaagaagcttaggagctggctaaggctgctcctccacctggatgcacacacagggctagggctgtggagaggcgggagcaccagcggcccacgccgaggaagataggcgctccctcctggggtgggcagcgcaggtctggcctgcgggtggggggtggagagtgagaggcacgcggggcaccagctcagctcccctctggggatttcgtactcgcagtttaaggaaccggtggagcacgaactccactcctgagctggcgcaagcgtctcccttccatggagatccaccccggctcccctctgaggccccctttccaagcaccctctcttccgagcacccagcacctccccaaccttagcacggctcggggcaccagttctccagggcgggggctgccccaccgctcaagggaggggacagagggccggcctcggtccaggcgacccctgcccctcgccaggggcgccaccttggccccctcccgactgccgtccgccgcctccgcccccccggggggtgtgtctccgaagtacgggggcgcgggaggccaagggtgcccccagcctccgaccgagaccccctcccgagccggcggcgaatggtaggctccatttaaagagtgcctggtggcgcgcggtgtccttcttggagcagctctc

SEQ ID NO: 67688 - DNA, 1005 bp, Homo sapiens
  chr1:14925199-14926204
  hyper
gcgcccgcccgccggggtctcggcgatcgctgctcctcctcctccttctcctcctcttttttctcctccgcctcctccccccgccgcctcgccaccgccgcggctagggctggaggcgccgctgtcattcctgtgccggaggaaccggcgctgccggtgcctgggggtcggggcgcgggcgaagccgggccgcggaggacacaacaggtagagccgggggtgcccggccgcgcgccccccgcgcatcatgcagctctttgtcacctctctcgcccccaggccaaaatcctgagcatgatggaagacaataagcagctcgcgctccgcatcgatggggcggtccagtcggccagccaggaggtgaccaacctgcgagccgaactcacggccaccaaccggagactggcggaactgagcggcggcggcggccccggcccgggcccgggagccgcggccagcgcctcggcggcgggggactcggcggcgacgaacatggagaacccccagcttggagcgcaaggtaggatcgccccggcgcccagggcggaggaaggcgagcagagcacgcccggcctcggaggtggccggggacccggggtcccccacacccggggcgaaatcgctttgcattctggcttgtaaccctttccgcccggcggtggccaccgctgctctccggctgggagttgcaggctgctgtcattcacgaaaacccgagcgcagtgtgcacggggtcacacggtcacaccggccccggccagcctgagcgaggcgcagccggcgggtcccttccggcatcagaaagtgccctttccgtggcaccagccccctagctccgtgcaaacttttcatgccggggccttttccccaccccccgcaggggtgaatggcacagttccccccacttccttaggctccttcccagagagagctccgggctctgccgccgtggttgggatagaggattgcactgctgtgcacttttctccgcggatgccaaatccc

SEQ ID NO: 67689 - DNA, 251 bp, Homo sapiens
  chr1:150185824-150186075
  hyper
taagaatctgacccacgagtttcagtccaagtaacctggacctgcccagaggaagcaaagcggaagtaggatccaaaacgctttcagcaggccgcctgcgcccccgcgcatgcgcaggtctctgactttgaccgttttggcgggtgcgcgccagccctagtttatctagaggggaagggcggtgcgggaccacgtgactggggttgcggcatttctggcccaatccgagacggtttcgtagagcgccctgt

SEQ ID NO: 67690 - DNA, 40 bp, Homo sapiens
  chr1:1502515-1502555
  hypo
gcaggacaggccatgcggctccacgcgcacctccgaagat

SEQ ID NO: 67691 - DNA, 30 bp, Homo sapiens
  chr1:150504403-150504433
  hypo
acacccttgctctgtcgcccaggctggagt

SEQ ID NO: 67692 - DNA, 30 bp, Homo sapiens
  chr1:150529962-150529992
  hypo
cactcaggtgtctggcgccccattttcctc

SEQ ID NO: 67693 - DNA, 138 bp, Homo sapiens
  chr1:150565309-150565447
  hypo
gattacaggcatgagccaccgcacctggcctggtttaccctttcattgacagtggagcctgtgcccactgcattaaagttgaagctctgtcactggcgatttggcagattcccctagagctgtcgccaattccagcca

SEQ ID NO: 67694 - DNA, 149 bp, Homo sapiens
  chr1:150602992-150603141
  hypo
aacatttggtaaatacggttaatactagttaacctatccagaattacagtttaacatttcctgggcgtctgtctgtatgtggatggtactgtgttagttggggggggtacgtgtatagtaaggcagtctctgcccttagaaagcttaca

SEQ ID NO: 67695 - DNA, 30 bp, Homo sapiens
  chr1:150693359-150693389
  hypo
ccttcaacggtcacccgctggggcgcgaca

SEQ ID NO: 67696 - DNA, 104 bp, Homo sapiens
  chr1:150850631-150850735
  hypo
tttcctggtaataggaagcattgagctattcgaggtaggcactgtccaaaatgctttatatgtatttactcatttaatcctcacaacaacgatgaggtaggttc

SEQ ID NO: 67697 - DNA, 50 bp, Homo sapiens
  chr1:150940902-150940952
  hypo
aatgttccaaggtggcgttgggaggtgcccgcagccgagttttctccttt

SEQ ID NO: 67698 - DNA, 58 bp, Homo sapiens
  chr1:150947697-150947755
  hyper
ccacttccagccccacggggcgcgggcggaggagggtgcagcccggggatcctgccca

SEQ ID NO: 67699 - DNA, 61 bp, Homo sapiens
  chr1:151032676-151032737
  hyper
ggcccccagtcagcacgggggtgctggaagagatcgggaataatagcgcagaccaatgagc

SEQ ID NO: 67700 - DNA, 34 bp, Homo sapiens
  chr1:151080126-151080160
  hypo
aatagctgggtgaggcggctcacggctgtaatcc

SEQ ID NO: 67701 - DNA, 37 bp, Homo sapiens
  chr1:151104646-151104683
  hypo
tctctgggggagccccgaggggcgagttaaggcagct

SEQ ID NO: 67702 - DNA, 145 bp, Homo sapiens
  chr1:151106046-151106191
  hypo
acctaggcccagaggcgccggcagttcccaggcctgacatcatcgtccctcccgctgctactcagcctcactcctacagcctccaccatcctcaggattcacctctcctgactcctcagcatacagcccacgcactacccctcac

SEQ ID NO: 67703 - DNA, 114 bp, Homo sapiens
  chr1:151118621-151118735
  hyper
caaataatcccttttcgcgcttcccagtccagcgggatgcgactcgacgaaagcccaattgaacgaggtgcccagactctgctctcaccagtacagttacggggctcggccact

SEQ ID NO: 67704 - DNA, 120 bp, Homo sapiens
  chr1:151169648-151169768
  hypo
attctatggatgttcgggtcctaggttactttatgaggacccacaagacatctggaaagaggataaccaggtcattctgggggttacaaaacctgttttttttgtttgtttgttttgttt

SEQ ID NO: 67705 - DNA, 138 bp, Homo sapiens
  chr1:151170068-151170206
  hypo
aatggagttatttcatgggccatgagtttgagaggatctatctgaccgactcttaccccgaatgttttaccattcctctttatttattcattccacagataattatggagcccctactatgtacgaagtcactggagg

SEQ ID NO: 67706 - DNA, 94 bp, Homo sapiens
  chr1:151252667-151252761
  hypo
tacttcaaaggagctcggaaactctccgggtgcgccggggagtcctggttccggtgtcctgggactcctgggcagggtaacgaaaccactttta

SEQ ID NO: 67707 - DNA, 84 bp, Homo sapiens; identical to SEQ ID NO: 39049
  chr1:151300852-151300936
  hypo

SEQ ID NO: 67708 - DNA, 30 bp, Homo sapiens; identical to SEQ ID NO: 39050
  chr1:151345799-151345829
  hypo

SEQ ID NO: 67709 - DNA, 81 bp, Homo sapiens
  chr1:151347981-151348062
  hypo
tgctactagaggtgacgggcgccatgccgggccctacacactaacaattagctcaggttccgcccatggcacagctggaga

SEQ ID NO: 67710 - DNA, 60 bp, Homo sapiens
  chr1:151445917-151445977
  hyper
ggtgggtgggtataccgggaggggacagctggagccgcgaaggcgcgggggcccgcggcg

SEQ ID NO: 67711 - DNA, 71 bp, Homo sapiens
  chr1:151481576-151481647
  hypo
ttgaagaacagatgacgaaggcggtgactcagaggctcccacttatccttgtaattcgtgttcatggtgct

SEQ ID NO: 67712 - DNA, 44 bp, Homo sapiens
  chr1:15149251-15149295
  hypo
cccactcacctccatcgctggctctgtggcgagtgctcctttcc

SEQ ID NO: 67713 - DNA, 69 bp, Homo sapiens
  chr1:151513143-151513212
  hyper
ctcctgcctgggactcggcgccggcgagcccgtgcttgggccgcgggtctcaggcgtcttttgggcagc

SEQ ID NO: 67714 - DNA, 54 bp, Homo sapiens
  chr1:151678593-151678647
  hypo
gctttcatcctgacacgtgggcaagagctgggctcagcgcggggtgacagggag

SEQ ID NO: 67715 - DNA, 316 bp, Homo sapiens
  chr1:151689335-151689651
  hyper
gtcagtctcaggggtcgaatacaaattctctaccctggagagggacgcacaatccaggcacgagccacgccctctttctatctccatcctccctgactcccttcccgcccccagaagagcagctggtcctgttgataataacccttcccccatcttactccccagtcaggagttgggcaaagcactaagatggagaatttatagaggaaccctaaagtggggtccattgttccgggggctggagctgtccccggtgctggaagactcagcagatggggggtggcggggaaagaggggagcccggcatctggggagc

SEQ ID NO: 67716 - DNA, 544 bp, Homo sapiens
  chr1:151693862-151694406
  hyper
caccccccaagcccccgccccggagctcacccctcagttccctcagcccctagcccctgcttcgctgaaggggccgggcttgggggcagggcggggccgggggcggggcctcgccggctcgcggccggtcgccttgacgaccgcagcaagatggagacgctgccaggcttgctgcagcggcccgaccccggggcgcttagcgcagcgcagctggagcagctgcgaaaattcaaggtgggtgcgcccgcgcccccatccagcgtccaccaaagtgtagctgccccaggactggggccccagactgggaagagagccgccgagagaaggggagcgggagcctgttccctgataaagtggggagggcgcaggggagacccccggcggacctctaggcgtctgatcccagcacagagcgcgacgggcatctgagagtgcaggaagaactaactcagggactcggccagagaaatgggccgaaattactgccagacacatccgaccttagtaaaggcccctcatcctgaacaagcggcagaatgatatt

SEQ ID NO: 67717 - DNA, 77 bp, Homo sapiens
  chr1:151801573-151801650
  hyper
ccccggcctggcagtcggccccaccccctcccatctccctgcctctgtccagcatttctcctcgccttttttcacaa

SEQ ID NO: 67718 - DNA, 61 bp, Homo sapiens
  chr1:152009237-152009298
  hyper
cccagttccctcccacgaggctgatttttcctgctgtttcctgccacgtccacacataagt

SEQ ID NO: 67719 - DNA, 272 bp, Homo sapiens
  chr1:152080369-152080641
  hyper
cgcggaattttctgtcgcgctcctggcggcgcagctgctgttcttccctttccggacggagctgctcttcctctaggatttttctgtagcgttcttggcggcgcagctgctcttgctccgtttcttggcgcagctgttcctcctcacggaattttctctccagttcctggcggcgcagctgctgttcctcctggaggaattttctctctcgttcctgacggcggagctgctgttcctcttcgcggaattttctgtcacgctcttggcggcgc

SEQ ID NO: 67720 - DNA, 105 bp, Homo sapiens
  chr1:152083260-152083365
  hyper
agaaaccgttgttcccgctgctggcgctcctcggccctcagctgcctctcccgctgctcccgcaatgggggcctggccgacagcctctgacggcccctctcgctc

SEQ ID NO: 67721 - DNA, 119 bp, Homo sapiens; identical to SEQ ID NO: 26608
  chr1:152083590-152083709
  hyper

SEQ ID NO: 67722 - DNA, 739 bp, Homo sapiens
  chr1:152083710-152084449
  hyper
cgcttcagccgctgctcgcgcctttcctgctgctcgcgccttagttgctgctggcgcctctcctcctgctcctcgctcttcagcagctgctggcgcctctcttcctccggctcctcgcgcttcagccgctgctcgcgcctctcctcctgctcgagtctctccacctcctcgcgcttcagtcgctgctcgagcctctcttcctgctcgcgcttcagccgctgctggcgcctctcctcctcgcgcttcagcagctgatcgcgcctctcctcctgctcgcgcttcagccgctgctctcgcctctcctgctcgagcctcttctcctcctcgcgcttcagcagctgctcgcgcctctcctcctgctcgcgtcttagttgttgctcgctcctcaaccgctgctggagcctctcttcctcctcctggcgcttcagccgctgctcgcgcctctcctcttgctcccgccttagttgctgctcgcgcctctcctgctgctcgcgcctctcctcctcctcgagcttcagccaacgttcgcgcctctcctcctcctggtcgcgcttcagctgctgcttgcgcctctcctgctcgtgcctctccgtctcctcctcgcgcttcagccaatcgcgcctctcctcctgctcgcgcttcagccgctgctcgcgcctctcctgctcgtgcttctgctcgtgcctctcctcctcctgctcgcgcctcagctgctgctcgcgcctcagctgctgctcgc

SEQ ID NO: 67723 - DNA, 859 bp, Homo sapiens
  chr1:152084689-152085548
  hyper
gcctctcctcctgctgctcgcgcctctcctgctgctcgcgcctctcctcctgctgctcgcgcctctcctcctcctgcttgcgccttagttgctgctcgcgcctcagcctttgctgctgctgctcttcctcctggcgctccctcctcagctcttgccgctccagcttccgtagctgctcttcttcctcctggagctctctttgccgctgcggctcctcttcctgcaacttctcttcttccttccggagcactgtctcgcgcttcctccactctttctcttcttcctcctggaacactctgtcttgccgctctcgcctttgctgctgtttctcctcgcggcccttcctcctcagctccagcagctcccgccttcgcagttgctcttcgtctggaaactcctcagtttcgtgacctttgcaactctgcagctgctcttcctctgcacggcgctcttcccgttcttgccattcttgcctttgccgccacagctcctcgtcgcggcgctgcctgtcgcgctgttcaagtcgctcttgtttctcactttgctcctctccctcagctagctccctctcctgttcctgcctcttctgcctgcgtcgttgcccaggttcttcttccagttgtctgtcccggggctcgaatctcctttggtcttcttcttgcctgcgatcttgtaacaggctctcctttccgtcacaccgggctcgcttctcctcatccagtcccgtggcctggccgagagcatagtaacaagcttgagccactttgaaaataaataggaggaattcgttgaaatcgacacgcccattactgtcaagatccagaagttccaggatcagatctaccgtcttagggtcatg

SEQ ID NO: 67724 - DNA, 30 bp, Homo sapiens
  chr1:152192377-152192407
  hypo
gactcatatgggccacggcttgaagacctc

SEQ ID NO: 67725 - DNA, 66 bp, Homo sapiens
  chr1:152276060-152276126
  hypo
tcctctccttgaccccgggtgtccacgaatggtgtcctgaccctcttgggacgctgagtgcctgga

SEQ ID NO: 67726 - DNA, 30 bp, Homo sapiens
  chr1:152282667-152282697
  hypo
gaaggttcatggtgacgtgaccctgagtgc

SEQ ID NO: 67727 - DNA, 51 bp, Homo sapiens; identical to SEQ ID NO: 39054
  chr1:152286249-152286300
  hypo

SEQ ID NO: 67728 - DNA, 168 bp, Homo sapiens; identical to SEQ ID NO: 26611
  chr1:152487789-152487957
  hyper

SEQ ID NO: 67729 - DNA, 252 bp, Homo sapiens
  chr1:152487999-152488251
  hyper
cggcgactcaggctgctgcggctccagctccaccagttgctgctgcttcccaaggagacgccgccgacagcggagtagtggttgctgctgctgcgggggcggcagccagaggtcccagcgctccaacaaccggagctcaggatgctgctccggctgctgagaggcccgcaacccccagcgctgcgctagagaaacccgcccagcccagagcgggcccgccccgctgcggctcccacgcggggctgggcctcg

SEQ ID NO: 67730 - DNA, 85 bp, Homo sapiens
  chr1:15251189-15251274
  hyper
cagcgcgcggagccccgagccccgggcgggtgcagcgggaggcgtgcgggacgcagagtgagttcctcggcgtggggaccggggc

SEQ ID NO: 67731 - DNA, 81 bp, Homo sapiens; identical to SEQ ID NO: 26071
  chr1:15251499-15251580
  hyper

SEQ ID NO: 67732 - DNA, 16 bp, Homo sapiens
  chr1:152696808-152696824
  hypo
ggagtcttgctctgtc

SEQ ID NO: 67733 - DNA, 127 bp, Homo sapiens
  chr1:15314099-15314226
  hypo
gacaggaatgagcttcgcgtatgttggggacccagaagccattgtagctggaaagtgaaggatggagagggagcaggagatgaggggaggggcactttcatgcggggctctgcggtcctgggtaagg

SEQ ID NO: 67734 - DNA, 30 bp, Homo sapiens
  chr1:153395112-153395142
  hyper
gtgctgtgagctgtccgtggtgctgaattc

SEQ ID NO: 67735 - DNA, 79 bp, Homo sapiens; identical to SEQ ID NO: 26613
  chr1:153438376-153438455
  hyper

SEQ ID NO: 67736 - DNA, 375 bp, Homo sapiens
  chr1:1535001-1535376
  hyper
cgcggcaggaggccccgaggagcacgcgctcgcacgggaagcgcgtgtaggcgccgcgccacgagcagttgagcgcgaaggcgcgcacgcggcgcgcggcggccggggccaggcgccactgcaggaggacgctgcggttgcgcaggacgctggcgcgcagggagcggccggccggggcgtgcagcacgcagcccggagcctggcagcggaagccgcgcgcggggctgcggaagcacaggcgcccgccgcccgcctcggggccctcgggcagcaccttgtaggggcaccagggcgcgtcgggggtcggctcccagcccggcggcgtcggggcggccgcggcgcagggcggcggcgcgcaggcggccagcagcagca

SEQ ID NO: 67737 - DNA, 109 bp, Homo sapiens; identical to SEQ ID NO: 14268
  chr1:153539476-153539585
  hypo

SEQ ID NO: 67738 - DNA, 219 bp, Homo sapiens; identical to SEQ ID NO: 39057
  chr1:153540023-153540242
  hypo

SEQ ID NO: 67739 - DNA, 193 bp, Homo sapiens
  chr1:1535748-1535941
  hyper
caccttggacccctgcggcttttccgagccgaaactcacgggctgtggccggcttcgtttcgcgtcgtgcagctccgcgaccgcccgtggccacaccagtcggggacttcgtgctttacgatgggggcgcagcggtctggcacgcgcaggaccccgggccttgcaccccaacgctggccgccctggacccgcg

SEQ ID NO: 67740 - DNA, 150 bp, Homo sapiens; identical to SEQ ID NO: 39058
  chr1:153608334-153608484
  hypo

SEQ ID NO: 67741 - DNA, 40 bp, Homo sapiens
  chr1:153620461-153620501
  hypo
gggcaacaagagtgaaactccatctcgaaaaaaaaaaggt

SEQ ID NO: 67742 - DNA, 89 bp, Homo sapiens
  chr1:153644958-153645047
  hypo
gagactctcccatttcggcctccctagtagttgggactactcaaaggcacaggccacaccactccgagctaattttatttttttttttg

SEQ ID NO: 67743 - DNA, 87 bp, Homo sapiens
  chr1:153650936-153651023
  hyper
ctccaaagaggtaggcgtggggcggccgagaccggggaagatggtccacggggaagcgcgcgggctgggcggcggggaggaaggagt

SEQ ID NO: 67744 - DNA, 989 bp, Homo sapiens
  chr1:153651443-153652432
  hyper
gagccccggggtgagcgtccccgtcccgctcctgctccttcccatagggacgcgcctgatgcctgggaccggccgctgagcccaaggggaccgaggaggccatggtaggagcgctcgcctgctgcggtgcccgctgaggccatgccggggccccggcgccccgctggctcccgcctgcgcctgctcctgctcctgctgctgccgccgctgctgctgctgctccggggcagccacgcgggcaacctgacggtagccgtggtactgccgctggccaatacctcgtacccctggtcgtgggcgcgcgtgggacccgccgtggagctggccctggcccaggtgaaggcgcgccccgacttgctgccgggctggacggtccgcacggtgctgggcagcagcgaaaacgcgctgggcgtctgctccgacaccgcagcgcccctggccgcggtggacctcaagtgggagcacaaccccgctgtgttcctgggccccggctgcgtgtacgccgccgccccagtggggcgcttcaccgcgcactggcgggtcccgctgctgaccgccggcgccccggcgctgggcttcggtgtcaaggacgagtatgcgctgaccacccgcgcggggcccagctacgccaagctgggggacttcgtggcggcgctgcaccgacggctgggctgggagcgccaagcgctcatgctctacgcctaccggccgggtgacgaagagcactgcttcttcctcgtggaggggctgttcatgcgggtccgcgaccgcctcaatattacggtggaccacctggagttcgccgaggacgacctcagccactacaccaggctgctgcggaccatgccgcgcaaaggccgaggtgagacgctggcacaccccgtcccgccgcttagccgcagggcctcccctctgacctgccggaggcatcgggactttctctctcatctgggggcactcttctttctcctcgccgttcttcattctac

SEQ ID NO: 67745 - DNA, 65 bp, Homo sapiens
  chr1:153662197-153662262
  hypo
gacagacgctgcacccggtgtgacggtgtggccggccgcacagttgcagccgtcaagtcctgcac

SEQ ID NO: 67746 - DNA, 102 bp, Homo sapiens; identical to SEQ ID NO: 39060
  chr1:153937070-153937172
  hypo

SEQ ID NO: 67747 - DNA, 80 bp, Homo sapiens
  chr1:154098530-154098610
  hypo
accgcgcccggccaagaaatgtttttaatgaaacctgaaaccccaaatgatatatacacaatgaccgcaaatgcagatat

SEQ ID NO: 67748 - DNA, 22 bp, Homo sapiens
  chr1:154107501-154107523
  hypo
ccacgcccggcctctgtgtacc

SEQ ID NO: 67749 - DNA, 23 bp, Homo sapiens
  chr1:154156755-154156778
  hypo
gccggcctcggcctcccaaagtg

SEQ ID NO: 67750 - DNA, 176 bp, Homo sapiens
  chr1:154238843-154239019
  hypo
ttgaagctggaaaaccgaccaaaattcccttgcattggtatagctagaaaggctacagatatcacctcatctcaggaataagggccaggtagctagctgagctaatcctcctgtctgtttcctcctcccccaggtgtttcagtcacctccagtaacacgggcgtgccagatatctc

SEQ ID NO: 67751 - DNA, 30 bp, Homo sapiens
  chr1:154292635-154292665
  hypo
tgtgtgatcttgggccgggcacggtggctc

SEQ ID NO: 67752 - DNA, 43 bp, Homo sapiens
  chr1:154298110-154298153
  hyper
ccccgccccagcccccggcatgggcagtacggggccgccgggg

SEQ ID NO: 67753 - DNA, 221 bp, Homo sapiens; identical to SEQ ID NO: 26616
  chr1:154298253-154298474
  hyper

SEQ ID NO: 67754 - DNA, 30 bp, Homo sapiens
  chr1:154302983-154303013
  hypo
gcaaggacaacctaccgttgggactgaggg

SEQ ID NO: 67755 - DNA, 30 bp, Homo sapiens; identical to SEQ ID NO: 39064
  chr1:154305492-154305522
  hypo

SEQ ID NO: 67756 - DNA, 129 bp, Homo sapiens
  chr1:154324138-154324267
  hypo
tgttttttaactctgcgcttttccgcatgcctcacatcttcctggcttctcaagtgagtatcaaggaagctaaagtcttatattaaagggagctttcctccagggaagggagggcggatgaggatgggg

SEQ ID NO: 67757 - DNA, 138 bp, Homo sapiens
  chr1:154325447-154325585
  hyper
ccctttcctcctggtcgcttgcttccatatgtgaacccttacttgcttcccaatccagcccggagcccgtggtctggtactcgtcgctttgccccggaacattccagccttgggtcagcccagcgtctcccagggtga

SEQ ID NO: 67758 - DNA, 36 bp, Homo sapiens
  chr1:154474549-154474585
  hyper
tgctccgtgcgcccccggccggccgtcgcccacgcc

SEQ ID NO: 67759 - DNA, 35 bp, Homo sapiens
  chr1:154474743-154474778
  hyper
gggcgccgggggcttccccctgctctttcctcctg

SEQ ID NO: 67760 - DNA, 81 bp, Homo sapiens; identical to SEQ ID NO: 95
  chr1:154474987-154475068
  hyper

SEQ ID NO: 67761 - DNA, 173 bp, Homo sapiens; identical to SEQ ID NO: 96
  chr1:154475371-154475544
  hyper

SEQ ID NO: 67762 - DNA, 54 bp, Homo sapiens; identical to SEQ ID NO: 39065
  chr1:154499777-154499831
  hypo

SEQ ID NO: 67763 - DNA, 78 bp, Homo sapiens
  chr1:154516767-154516845
  hypo
taacataacaggtgacgtctacggaggcagatttgtaatgcagtgcaggcagtggggccgttgcgttttgcaccccac

SEQ ID NO: 67764 - DNA, 32 bp, Homo sapiens
  chr1:154533446-154533478
  hypo
aaaaatttaaaagatcggccgggcgcggtgac

SEQ ID NO: 67765 - DNA, 37 bp, Homo sapiens
  chr1:154536500-154536537
  hypo
ggattacaggtgtgagccatcacgcctggccccaagg

SEQ ID NO: 67766 - DNA, 227 bp, Homo sapiens
  chr1:154540058-154540285
  hyper
ctcttgccccttctccgaccatgctgcaggtcctgccccaactttaggacttcagaactcctccaccgtgccgtggaggaacagcccttcttccacctcacgcacaccctaccacggcagaaccaatcgaagactatcccagccggggaccccccttttttttcctgggacccagcgtttccgcctccggggcgcagactcctccccctcaccgtcccaattgtatt

SEQ ID NO: 67767 - DNA, 189 bp, Homo sapiens
  chr1:154682354-154682543
  hypo
gggttgtggcccccacgctggtgctcaccaactgcctgaccgtgggatggtcactttgttcccttggatcttggtttcctcatctatattgataatcagaactaccaattgcaaaacctttatagtttacaaagcattttcacagatatcatcttattcgatcacctgagcctccgatggtaggaatta

SEQ ID NO: 67768 - DNA, 30 bp, Homo sapiens
  chr1:154685747-154685777
  hypo
gcccacaagacataccggtagattgcaaat

SEQ ID NO: 67769 - DNA, 47 bp, Homo sapiens; identical to SEQ ID NO: 26621
  chr1:154733207-154733254
  hyper

SEQ ID NO: 67770 - DNA, 85 bp, Homo sapiens
  chr1:15479692-15479777
  hyper
agggggagagggaggcggtggcctccccaggaaggaggagaggtgagtatcccgccaggtaaaggcggggcggctggcggagctg

SEQ ID NO: 67771 - DNA, 116 bp, Homo sapiens
  chr1:15480110-15480226
  hyper
gcccgggggtggtgccgagggccgggagggagggtcggccggtgggcggtgcttctccgggctggaggccgctcctggccggcaccgccctccgcctcccgcggtccctccctccc

SEQ ID NO: 67772 - DNA, 179 bp, Homo sapiens
  chr1:154808666-154808845
  hypo
tgagtgttgagcagccggaagagcagccagaaggtacctcgtacaagtgaggagatggtaggactcccacagtacccctgggtccctcttgctgttgtaataggaggagccagaggaacaccccacctgatactcgactggccttaatttgggctcctgccccccgtctattttgccct

SEQ ID NO: 67773 - DNA, 125 bp, Homo sapiens
  chr1:15480940-15481065
  hyper
acgggggtaaagaatcgggcatgagcaaagtggattgaaactcgagtccttccctgagcgcgtcggtttcttcatctgtgaaactgacatgacaacgtcccagggtgcggcggggcattcatgcc

SEQ ID NO: 67774 - DNA, 30 bp, Homo sapiens; identical to SEQ ID NO: 39069
  chr1:154851806-154851836
  hypo

SEQ ID NO: 67775 - DNA, 21 bp, Homo sapiens
  chr1:154954412-154954433
  hypo
tcaccgcgcccggcctttttt

SEQ ID NO: 67776 - DNA, 30 bp, Homo sapiens
  chr1:155019681-155019711
  hypo
actggaggtgaaggtcgggggagactccat

SEQ ID NO: 67777 - DNA, 309 bp, Homo sapiens
  chr1:155043397-155043706
  hyper
tgtgggggtctcacccggctcccagcggccccaggccagcctccttttcgcagaaccaggcgggcgcgctcgctcccgcggctggggctggcgcgcggacgcgccgctgataacgcatgtgcgaaagagacgcggggcccagtcagctttctccgcactcagacgcacgccctaactgtcgggcgctcccacttgacacggacacacgcccctgccggccgcccagccccttgcaggtgcaagggcggatgcctcagcgaccacgggagccgggctggggaggttggtggggggcggggggagtcttaa

SEQ ID NO: 67778 - DNA, 45 bp, Homo sapiens
  chr1:155054426-155054471
  hyper
cgcagggaggaggggcggaggtgtcgggcgcgctgattctccccc

SEQ ID NO: 67779 - DNA, 199 bp, Homo sapiens
  chr1:155055105-155055304
  hyper
tttctgcaagagaggcgagaggctataggggatgaagtggagcaagaagagagaacagtacgaaggggcagggcacaacccggtccccaggtcccagcccacccccacccttccgcaggaggcgcggccctagaggcggggttagctgcggagcttcgcgtgggcccagcggcacctctctctccgcactgctagggag

SEQ ID NO: 67780 - DNA, 30 bp, Homo sapiens
  chr1:155064834-155064864
  hypo
tcctccagtctcctccggtgtggcctgggg

SEQ ID NO: 67781 - DNA, 31 bp, Homo sapiens
  chr1:155113365-155113396
  hypo
tctatagtgcctaggcgggacagaactcctt

SEQ ID NO: 67782 - DNA, 66 bp, Homo sapiens
  chr1:155146189-155146255
  hyper
aagaaatggctcccccgtcaaatacctttccatattccccaaccccccgaccggctttcgagaacc

SEQ ID NO: 67783 - DNA, 29 bp, Homo sapiens
  chr1:155147233-155147262
  hyper
cggagaagggggtgccgctgaccgggttg

SEQ ID NO: 67784 - DNA, 30 bp, Homo sapiens
  chr1:155154997-155155027
  hypo
aagacctccttcacccgtatcttaaaattc

SEQ ID NO: 67785 - DNA, 98 bp, Homo sapiens; identical to SEQ ID NO: 14271
  chr1:155160925-155161023
  hypo

SEQ ID NO: 67786 - DNA, 30 bp, Homo sapiens
  chr1:155176630-155176660
  hypo
ctcaaaaagacaaaacgaaaacaaaaaaaa

SEQ ID NO: 67787 - DNA, 30 bp, Homo sapiens
  chr1:1552463-1552493
  hypo
ccatgctggcctccccgcctcagggcttca

SEQ ID NO: 67788 - DNA, 36 bp, Homo sapiens
  chr1:155311784-155311820
  hypo
gtgcagacaggatagcggttccggtggatcttgtaa

SEQ ID NO: 67789 - DNA, 21 bp, Homo sapiens
  chr1:155563460-155563481
  hypo
aataaaattgccattcgggcc

SEQ ID NO: 67790 - DNA, 23 bp, Homo sapiens
  chr1:155578174-155578197
  hypo
ctaccctcacattctcgaatttc

SEQ ID NO: 67791 - DNA, 120 bp, Homo sapiens
  chr1:155578917-155579037
  hypo
cttgccttgtttctaaatacacacaagaatgttaatcatagcacctaatagcccaaaaattggaaacaatcccaaaagctattatcagcagtatatatatatatatatatatatatattt

SEQ ID NO: 67792 - DNA, 30 bp, Homo sapiens
  chr1:155659966-155659996
  hypo
aagagtaggtaatgtcggtgatagatataa

SEQ ID NO: 67793 - DNA, 59 bp, Homo sapiens; identical to SEQ ID NO: 39074
  chr1:155668700-155668759
  hypo

SEQ ID NO: 67794 - DNA, 30 bp, Homo sapiens
  chr1:155675909-155675939
  hypo
cctcctaagtagctacgactacagtcctgc

SEQ ID NO: 67795 - DNA, 181 bp, Homo sapiens
  chr1:15573580-15573761
  hyper
gaaatggggcaggctcgtggggcctggagcattcagcaggcggtaacccagtgggcgttccctgcacggtgccacgccccctctgccgcgcaggccacgccctcatctattaggctggaccccgcggcgcctggcggcgttgccatggcaacgcgcgtacacaggccggccgggcgggcgg

SEQ ID NO: 67796 - DNA, 30 bp, Homo sapiens
  chr1:15573999-15574029
  hyper
cctggatccaggctccggtccccaggagca

SEQ ID NO: 67797 - DNA, 34 bp, Homo sapiens; identical to SEQ ID NO: 39075
  chr1:155826302-155826336
  hypo

SEQ ID NO: 67798 - DNA, 58 bp, Homo sapiens
  chr1:155830324-155830382
  hyper
cctgtttccctgggccgccttttcaaaaagggggactgaccagcgttgatgctggcgg

SEQ ID NO: 67799 - DNA, 30 bp, Homo sapiens
  chr1:155888002-155888032
  hypo
ttagcaatggtaatacgtgttttgttttgt

SEQ ID NO: 67800 - DNA, 23 bp, Homo sapiens
  chr1:155892702-155892725
  hypo
aaagacagtcctggccgggcgcg

SEQ ID NO: 67801 - DNA, 23 bp, Homo sapiens
  chr1:155892965-155892988
  hypo
agcctgggcgacagaaaaaaaaa

SEQ ID NO: 67802 - DNA, 42 bp, Homo sapiens
  chr1:155893814-155893856
  hypo
ttgcttttttttggccgggcgtggtggttcacgcctgtaatc

SEQ ID NO: 67803 - DNA, 29 bp, Homo sapiens
  chr1:155905289-155905318
  hypo
ggtaggattacaggcgtgagccaccgcgc

SEQ ID NO: 67804 - DNA, 30 bp, Homo sapiens
  chr1:155911541-155911571
  hypo
ctgggccaatgcctccggaggcagtgtgct

SEQ ID NO: 67805 - DNA, 30 bp, Homo sapiens; identical to SEQ ID NO: 39078
  chr1:155911924-155911954
  hypo

SEQ ID NO: 67806 - DNA, 220 bp, Homo sapiens
  chr1:155912424-155912644
  hypo
tactgtctcctgaggcgggagccccggcaggctctggcaggcaccttcagggatctgcggttgaggctgtggccccagggcggaggctgggtgcaacaggtggccctaaagcaggtaggcaggcggtgggtcgcaagcaacccccgggagagccgcccttctaccctgctcaccaacctggacagagggacacccgggtgaagggcgcaagctgaacaca

SEQ ID NO: 67807 - DNA, 143 bp, Homo sapiens
  chr1:155954169-155954312
  hypo
gtcccccacactcaccgtttcctgaggtcaatggcagaggactgggatacattccctgccaacacaaaaggagatgagaagtgtctagctaaagccagacaaaggcgcccagggcttcctcccccacccgcttcacctagatc

SEQ ID NO: 67808 - DNA, 30 bp, Homo sapiens
  chr1:15599088-15599118
  hyper
gcagctgcagggtggcgcttatccacattg

SEQ ID NO: 67809 - DNA, 20 bp, Homo sapiens
  chr1:156010528-156010548
  hypo
caccgcgcccagccagtcca

SEQ ID NO: 67810 - DNA, 204 bp, Homo sapiens
  chr1:156030654-156030858
  hypo
caggcgtgagccaccgcgcctggcctcaagtgggtttctgaggggctatttcttgctcattagttgggggaccggccctcaccacagattccagaagcccagcaatgcacactcagccctcagtgggctgtctctgaaggtcctgtccctttttcgcttcccccccgctggagctgcttctcccgcttgcgggagcccaggctg

SEQ ID NO: 67811 - DNA, 105 bp, Homo sapiens; identical to SEQ ID NO: 39082
  chr1:156031479-156031584
  hypo

SEQ ID NO: 67812 - DNA, 52 bp, Homo sapiens
  chr1:156212895-156212947
  hypo
gttggctgaccacatcggctttcaggaggcctatcggcgcttctacggcccg

SEQ ID NO: 67813 - DNA, 542 bp, Homo sapiens
  chr1:156215329-156215871
  hyper
agtagcaggagaggccggtgcacaggaaggagttgagtgcggcggcaggcacaaagaactggtgcaggtggccgtgcagccaggaggccggcatggagtaggcggcataggggaaggcgcagcctgcggtgaggtgggggcgtgcagctgaggcctgaggggcgcgcccctatgtcccgcgtcccacccctcgccccgctccgggacgcccagaccccgcgctcccgcgcctgtccggctcacccagactgtagaggctgagcgcgccgtagtcgaggaagtagcagatgtggcgcatgcggggcgacatggagctgaaggtgtgcgcgcagcacgacgcgaaggggtagaggcaggcgggcagcaggaagaccagcagcggccagtggtacggctccgcacggaagccggggccgcccgccagcgccaggagccgccacaggaagtacctgcggcgggcgcgtgctcaggccgccgcggacccccgcgactgccgctgcagcccgtgggcctggacggtccctgcccgcctgggtaccccc

SEQ ID NO: 67814 - DNA, 30 bp, Homo sapiens
  chr1:156216765-156216795
  hypo
cactgaggggcttggcggcctcagcccagc

SEQ ID NO: 67815 - DNA, 30 bp, Homo sapiens
  chr1:156232727-156232757
  hypo
ggcttgacaagagctcggtcctgtgtgact

SEQ ID NO: 67816 - DNA, 39 bp, Homo sapiens
  chr1:156233282-156233321
  hypo
ttctcctggatgctgcgctcattccgacaggagcgtcca

SEQ ID NO: 67817 - DNA, 206 bp, Homo sapiens; identical to SEQ ID NO: 39083
  chr1:156253833-156254039
  hypo

SEQ ID NO: 67818 - DNA, 33 bp, Homo sapiens
  chr1:156268868-156268901
  hypo
ctgccatctcctcctcggcgcccaactcttcct

SEQ ID NO: 67819 - DNA, 91 bp, Homo sapiens
  chr1:156271355-156271446
  hypo
agctttttttttttttcttttgcatacactcaaaccaatctgcacacacacacccattttgagcccatcaaagccccggacccagccacaa

SEQ ID NO: 67820 - DNA, 179 bp, Homo sapiens
  chr1:1563080-1563259
  hypo
ctgagtgctgggtgccgggcggacgccatcaacagcacccagagcacagcactgcacgtggccgtgcagaggggcttcctggaggtggtgcgggccctgtgtgagcgcggctgtgacgtcaacctgcccgtgagtgctgctccctggcctgggtgccccctgcccgtgagtgcttgtcc

SEQ ID NO: 67821 - DNA, 116 bp, Homo sapiens
  chr1:156339144-156339260
  hyper
ctacaaccacaaaaccgacgctgccctctggcaccggagcaaccacagtaacgcggacaatgaattttactttcgctacccaagtgagtgcggggtgagggcgcgcgggaagcaaa

SEQ ID NO: 67822 - DNA, 760 bp, Homo sapiens
  chr1:156357837-156358597
  hyper
ccgcggggccagcggcgttgagggaaggttctccggaagcagccgctgttctggcttggcgcaagtgcgtgtggacgacagcaggatttcctgcccagggacatctggataagaggcccaaggtccccaggagcccccaggtgcttctgccctgtgtggccagagccccctcggccaggagttagaagctgctcctctgacctctggaggacccggcactccgaaccccgcgcagcctgggaaaggcctgagattccccgctattgggattcacatcacgacgcggcggccccaactcggggaggaattagacacggcgtgagtgtcccaagtgcggggcggtggccgtcccggggcagacgagcgcggctgccgcgtccccccacctcaccccgatattccgctcccaccgtcgggaactcccccaccgccgcctccggccctgcgcgccccttctcctttgtctggcccgcccactcccagccggtccgccgcgccgccccgcgcgccccggcccgtgcgcccgccgccgccgcccaggaacaatgcgggccaatgtctccgggcgggcgagccggctatgcaaatgcccaacggcctgtgagaatccccttcgccgccgcctgggcttccacggcctgaaaagggctggcggccgggcctgggtgggggaggcggccactgcatagggatgagctgttgtcccggagcgcccgggacagagcgccattgtctgtgctgcagtcgtctgatagccagt

SEQ ID NO: 67823 - DNA, 103 bp, Homo sapiens; identical to SEQ ID NO: 38718
  chr1:1563663-1563766
  hypo

SEQ ID NO: 67824 - DNA, 1120 bp, Homo sapiens
  chr1:156390096-156391216
  hyper
gaggccggctttccccgggcccctctgcgcagtgtatggggttatttttactttcggttatctagctttatgaagactccacaccactcatacagctagataaccaaagataacaaccaaccccgcctcctggctgctgtcgccgcctcttccacgcagcctcccggccgccgccgccgccagcacctccgcagcttcccggtcgcccgtcagcgggagtaggagggaagggacacgagtggagttgagggggagggtgaagagagaaatgaagtccgagacaaaacaacaacaaaaacctcagacacggagatacagacacgacagagaccgaaaaaggcgtggaaaggacgcgatgacccgtggcgtcgaagtcggggagttgaccccgatccagacccaaaaagtttctggtgccccatttcccgctctcccattcgggccaggagcaggagttccgctggtcccaggtggaagggacgcgcgggcttttcgtgccacccgggaagaccgcagcgacccaggcagaggcctccccagcctcgccgggtctccactgcccttctctggaagatcgagggcgcatccgacagccagagccctgccttcggcggagcccgagcctggcgcgggatggaaatggggagccgcggtgccggcccggccacgtcgccaactcagaaaggcgttggaagcgaagcggagcccttgtgggggaaagagccggattcaagaggccgactaaaaggggaaatgggcagccaaaccccggaggtaaaaaccccagagatgtcctaataggaagcagggaaatcccggcgacccaaagagagaggaaaggctgtggggggcgggtgggggcgacccagagactcccaagcgagtctctcaaggagagaaggaaacagcagagaccccacccgggaagagatccgggagagtacccatgagaggggcggaggggaggaaagcagagggcgacagggcaggtgaccagagtcccaggccctgcagagccccggataaacggctttgttcaaagaggaccagagatcacccagggttgtgaaaatggccgggggttcgaggcgagcggtgctctaggggtgggaaaggggtg

SEQ ID NO: 67825 - DNA, 346 bp, Homo sapiens
  chr1:156391242-156391588
  hyper
cgaagagggtgggggctcggccggcccctcgtggcggacgcgcgggcacgccggattccgaggcgctcgcccacctcgtgctccacgctggccaggccacttacatcgagcccagggtgcccatccgtgctctcccgcgcggtcctcccggccagttcccgcccctggagcgccagggccctgagttccagatgccggggctcagcgggcgccgggcagaggaggctgccctgctcttagcctccgccgagcctaggcgagcagggtggagcgggtctcacctcctagctccctcctctgcctctgccgcggctctggccccggcgcgctccggctccggactttt

SEQ ID NO: 67826 - DNA, 48 bp, Homo sapiens; identical to SEQ ID NO: 1821
  chr1:156405367-156405415
  hyper

SEQ ID NO: 67827 - DNA, 437 bp, Homo sapiens; identical to SEQ ID NO: 1822
  chr1:156405634-156406071
  hyper

SEQ ID NO: 67828 - DNA, 509 bp, Homo sapiens
  chr1:156406104-156406613
  hyper
cgaacccgaccccgggaaatcctcctagccgccgcctcccagcgccgggtctccccgagcgtgtgctctcggctgcgaggccctgcatgcgcagtgtctgggttcgcggcgtcaagcggagcctcggtccagcctgggcagccgagagcgcggggactgctgaacgcggtccgctccccgccagccgttcgggaccccagcctgggggaaagccgacagcgtccctctccgcgcaaactccacgcggcagcctggactgggatgtggggccagggggctgaataattaacaaccaggagaagccggggagagcgggaagcctggcaagccagggaaagggaagatgagacagagagacatagagagacagggacagagggagacagagagggggctaagagcgacgcgggcgagagaggaagaaaggctggggagaaggaaaaatgagataaataaaggaaaaaagagaagcgaagggcggtgggagaggcagccgggcctctctggga

SEQ ID NO: 67829 - DNA, 146 bp, Homo sapiens
  chr1:156432169-156432315
  hypo
tggcccctcacactccgcgttcgcctctgcagcacctgggctaggtacagagaagcagccacaccctgttcggaggaagccaagccggatctgctttcctccacagccgctccatctgccccagggcacggctgtgccaggtatga

SEQ ID NO: 67830 - DNA, 47 bp, Homo sapiens; identical to SEQ ID NO: 14276
  chr1:156433495-156433542
  hypo

SEQ ID NO: 67831 - DNA, 30 bp, Homo sapiens
  chr1:156434427-156434457
  hypo
acccattcatctggccgcccaggagcccct

SEQ ID NO: 67832 - DNA, 37 bp, Homo sapiens
  chr1:156441193-156441230
  hypo
tacaggtgtgagccaccgcgcccggccagaatcaact

SEQ ID NO: 67833 - DNA, 333 bp, Homo sapiens
  chr1:156468600-156468933
  hyper
gtcccccaatcaccccgtataaagaggtcctcagccactcccacaatagtcctaccccacccccatctcctgcccaacacactgggaaaccacaggaaggaaattcattcccaggcagggccgtgggagctgggacagccagactaagtcctggggcgggtgtgaccccgtggccacaagcgggtggacatctgtgaacactgacatgtgccttttcaatgctctcctcagctactgagaccttcctgttggggttgggagaggagtgggaggtggacagctcccaaacgccaaaacacccaatctcaggctgacctgcgctcccctcctatc

SEQ ID NO: 67834 - DNA, 51 bp, Homo sapiens; identical to SEQ ID NO: 26633
  chr1:156474407-156474458
  hyper

SEQ ID NO: 67835 - DNA, 30 bp, Homo sapiens; identical to SEQ ID NO: 38862
  chr1:15651124-15651154
  hypo

SEQ ID NO: 67836 - DNA, 167 bp, Homo sapiens
  chr1:156594060-156594227
  hyper
ctccctctcccaggccgcgccgcccttcctccccctccgctcccatccgctggccctccccaggatccccgccaccccctaggtgtggtgtttccgtaccaacccagccggggccggtaccagttcaattactacgaggcgaagcaggcgtgcgaggagcaggacgg

SEQ ID NO: 67837 - DNA, 624 bp, Homo sapiens
  chr1:156594429-156595053
  hyper
gctgctcgagggctccgtgcgctaccctgtgctcaccgcacgcgccccgtgcggcggccgaggccggcccgggatccgcagctacggaccccgcgaccggatgcgcgaccgctacgacgccttctgcttcacctccgcgctggcgggtgaggcgcgggacgaaggcagggtcttggggaggggtctgaaaaatgtgggggacgaggagtggacctcagcttgagatcagggcagggtctccgggtccctccaaggcaccgcccccccatcagcccgcccgcccgcccaggctccagctcacctctccaaaccctccctgcacttttgcctcgatcccccaactcctcttacccaagctcgatccagcacctctgcggtcccgcaccccaactccgcctcctgggtgtcagccgcccctctccgcccaccctgccctcggtcggtgacccgctgtggtccccaggccaagtgttcttcgtgcccgggcggctgacgctgtctgaagcccacgcggcgtgccggcgacgcggcgccgtggtggccaaggttgggcacctctacgccgcctggaagttttcggggctagaccagtgcgacggcggctggctggctgacggcagtgtg

SEQ ID NO: 67838 - DNA, 104 bp, Homo sapiens; identical to SEQ ID NO: 5748
  chr1:156595080-156595184
  hyper

SEQ ID NO: 67839 - DNA, 44 bp, Homo sapiens; identical to SEQ ID NO: 26637
  chr1:156595221-156595265
  hyper

SEQ ID NO: 67840 - DNA, 169 bp, Homo sapiens; identical to SEQ ID NO: 5749
  chr1:156611775-156611944
  hyper

SEQ ID NO: 67841 - DNA, 126 bp, Homo sapiens; identical to SEQ ID NO: 26639
  chr1:156611993-156612119
  hyper

SEQ ID NO: 67842 - DNA, 544 bp, Homo sapiens; identical to SEQ ID NO: 26640
  chr1:156626475-156627019
  hyper

SEQ ID NO: 67843 - DNA, 15 bp, Homo sapiens
  chr1:156627083-156627098
  hyper
cggagagtggaggtt

SEQ ID NO: 67844 - DNA, 30 bp, Homo sapiens
  chr1:156636236-156636266
  hypo
aaaaaaaaaaagaaacgcaaacctggtcag

SEQ ID NO: 67845 - DNA, 4 bp, Homo sapiens
  chr1:156646593-156646597
  hyper
cctg

SEQ ID NO: 67846 - DNA, 222 bp, Homo sapiens
  chr1:156646634-156646856
  hyper
cgtagagcctctagctcgcgctccagctctgccacctggctactcagccaggcccgggcgcatttctctgcctcgacggcgcgccggttgcgggctacctcctccgtcgtccgctcccgggccagccgcagctgctggcatcggcctgccacgccctccagctcttcagccaggttgtcgcgcgccacctcggccgcgtgcttctcccgccagcgttggtca

SEQ ID NO: 67847 - DNA, 90 bp, Homo sapiens
  chr1:156676449-156676539
  hyper
gagatggcagggagacggagaaacagaaacggaggtcaggcggggagcctcggggacaggcctgggacccgaggccggaaaccgcagagg

SEQ ID NO: 67848 - DNA, 34 bp, Homo sapiens; identical to SEQ ID NO: 39087
  chr1:156690386-156690420
  hypo

SEQ ID NO: 67849 - DNA, 34 bp, Homo sapiens
  chr1:1566945-1566979
  hyper
cgcaacctggcaccctccgcggcccttgcctacc

SEQ ID NO: 67850 - DNA, 121 bp, Homo sapiens
  chr1:1567229-1567350
  hyper
ctaccctttcctaagcgggagccctggcgctgcccttcccgggctgcctggggccctcttcgctcccccctccgaggaccccgcccagcaggccatgcccaggcctctgcccctggcccac

SEQ ID NO: 67851 - DNA, 132 bp, Homo sapiens; identical to SEQ ID NO: 25993
  chr1:1567781-1567913
  hyper

SEQ ID NO: 67852 - DNA, 30 bp, Homo sapiens
  chr1:156783716-156783746
  hyper
gcagccgcgcgtgggcgctgtcctcgccca

SEQ ID NO: 67853 - DNA, 199 bp, Homo sapiens; identical to SEQ ID NO: 26642
  chr1:156814754-156814953
  hyper

SEQ ID NO: 67854 - DNA, 210 bp, Homo sapiens; identical to SEQ ID NO: 1825
  chr1:156815030-156815240
  hyper

SEQ ID NO: 67855 - DNA, 480 bp, Homo sapiens; identical to SEQ ID NO: 26644
  chr1:156815273-156815753
  hyper

SEQ ID NO: 67856 - DNA, 505 bp, Homo sapiens
  chr1:156818562-156819067
  hyper
acctgggccctaccacggagtacaacttgcgggtcctggcttcctgggtcttcatagcctcgctgagctccgccctcacctgcctgtggtcccgaagaaattggcctcgtccggtcccgcccccgctccggccccgcccccggcactcacgactccttgtagtacacgatgaagctgagcaggtcgcgggcctccagtggctcatagcgctcccagcgtagcaggatgcggtctgcctccgtcacgttggacacgaagcgcagggtgcgagtctggcctgggtggggcgaggggcctgctcgcaaccgcgcctgccagctgcttgagcgcccaccctgaccccgcggcatcccattcccagtgagacctctgaggagaacttctcagagtgtccccctcgagctttctccctcccccgggtgtgcgtgtctagtgtgtggccgcgtgtccaccggcactggggttggggtctcacaggcggcgcggtctccgttggtgcgggggt

SEQ ID NO: 67857 - DNA, 56 bp, Homo sapiens
  chr1:156823879-156823935
  hypo
ggttggggaagaggtcgcgcaggctctccagtccgtagacacggaagagcagcagg

SEQ ID NO: 67858 - DNA, 124 bp, Homo sapiens
  chr1:156829116-156829240
  hyper
ccgctgcggctgcagcggctcccgccaaccctttgtccccaccacaggcttcttccaagtggggctgcaccgccggaggggcagccagcgcgcccgggcttctggggagcgctgtgtctagatt

SEQ ID NO: 67859 - DNA, 100 bp, Homo sapiens
  chr1:156829475-156829575
  hyper
tgagctcaggctgctcggtcggtctgtgtgtccctgtctcggggacttggggggccatccgtgctggggccttggcggagagaaccgtgagcctctagga

SEQ ID NO: 67860 - DNA, 83 bp, Homo sapiens; identical to SEQ ID NO: 26648
  chr1:156830265-156830348
  hyper

SEQ ID NO: 67861 - DNA, 246 bp, Homo sapiens
  chr1:156830950-156831196
  hyper
cgggcggtgggggggcgcggggacaggcaggcattgcagtgccccgagggcgcggactcgctgcttgtttgctggtcaggcaggacgagcacggcggaaggctggcaccacgcagccttcggcgctgcccgggcgttcctccgcagccgccgctgccctagcaagctttatggtcagtgcctggatgtcccctagtgttcagggcagctgggccgccggcttcagggagatcgaagggggaaatct

SEQ ID NO: 67862 - DNA, 180 bp, Homo sapiens
  chr1:156838167-156838347
  hypo
tgcctggggtgacatcgcctgggctccaggtcattgaggagggtgggggaaggagcagccccgcagtagagttctggggccactcccagctctaacaccccttggccctcgggcgtcctgggtggccaggtgtgcccacgctgaaggtccaggtgcccaatgcctcggtggatgtggggg

SEQ ID NO: 67863 - DNA, 389 bp, Homo sapiens
  chr1:156843312-156843701
  hypo
cctgccctttgatttcgggttctactcgctttgcccgtggacttgtcgggtgtgtgccaggctccctccagctgcgccctgacctcctgctgttgctctttctggcccacagtcccggccagtgtgcagctgcacacggcggtggagatgcaccactggtgcatccccttctctgtggatgggcagccggcaccgtctctgcgctggctcttcaatggctccgtgctcaatgagaccagcttcatcttcactgagttcctggagccggcagccaatgagaccgtgcggcacgggtgtctgcgcctcaaccagcccacccacgtcaacaacggcaactacacgctgctggctgccaaccccttcggccaggcctccgcctccatcatggc

SEQ ID NO: 67864 - DNA, 91 bp, Homo sapiens
  chr1:156849311-156849402
  hypo
gggctctgtctccttcgctatcccagatggaaacagcaccttcggtttttgcctcttagacctgagagccaccactgtttgtttatttatt

SEQ ID NO: 67865 - DNA, 270 bp, Homo sapiens
  chr1:156849702-156849972
  hypo
tatttttaatgatggggctggggtaggctgtgccttgacgggctgtcccaggcgcccctggaattgatgcagtgtccgcccgtggcaggtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggtcagccccggcccatggtcacc

SEQ ID NO: 67866 - DNA, 425 bp, Homo sapiens; identical to SEQ ID NO: 99
  chr1:156863061-156863486
  hyper

SEQ ID NO: 67867 - DNA, 84 bp, Homo sapiens; identical to SEQ ID NO: 26651
  chr1:156863640-156863724
  hyper

SEQ ID NO: 67868 - DNA, 96 bp, Homo sapiens
  chr1:156866303-156866399
  hypo
actggcgacagcctgcgggaggggttgcgattgatgtgtgaatcaggatccctgcaggtgagtgggccctggggcgtagcccgctcactgctggtg

SEQ ID NO: 67869 - DNA, 195 bp, Homo sapiens
  chr1:156890228-156890423
  hyper
acccatcagctcctgcgatctctggccggcctcgccctgcctgctccgccgggcctggcccgcccctcgggttctggctccgccacccgccctcgtgggctctcccctcgccttgctctgccctgcggcgccccctgtcggccccgcgtgctctctgcggttgcccctttccctcgggcccgcccgcctcgcgcg

SEQ ID NO: 67870 - DNA, 146 bp, Homo sapiens
  chr1:156890673-156890819
  hyper
accaaaaagggagagcgcgcggccaaagagaagccagcgaccgttctgcctcccgtgggggaggaggagcccaaaagccctggtacgctggcgccggggtttggggatcgggcttccaggctgcgtcttcccgggttcccactagc

SEQ ID NO: 67871 - DNA, 261 bp, Homo sapiens
  chr1:156893504-156893765
  hyper
cagaagaggggaccccgttgtctaccgtgcacgcacgcccgttagtcccctttctccgagctcttgctttccccgtttcctatcaagtgttttcagcgtccgtacttccaagcgtttgcaagttgaatggctgcaaaaatatccgtctgaggagggcccctccgcccgcgcgggagagcttggggatgcgggggtgggcgtggccccttctctcacgcccctgcctgcccccgcagaggagtaccagtgctccggggtcct

SEQ ID NO: 67872 - DNA, 188 bp, Homo sapiens
  chr1:156893791-156893979
  hyper
cgcggtggggctacacggacttccccaaagttgtcaaccggccccgcccccacccgcccttcgtcccctccgcctctttgtcggaaaaggccaccttaggtgagtgacagtggagctccccggtgcctgccagggccgcctagtccatcctcagcctcccttcccacgccgggccaaatggagggacg

SEQ ID NO: 67873 - DNA, 280 bp, Homo sapiens
  chr1:156894012-156894292
  hyper
cgacgaggccggtggggaggtgggggagtctcccgtcttcctttccaacccagcagaggcgcgagtggccggagaggcagagtccgcaggccggcgcctcccctctggcggtgtcctccaatcccacccgggcacccgtgggccggcccggcgtggggccctggaggtggctgttcccctccctcctcacctctgccttccagacgatccgcggctgtcggggtcctgcagcctcaatagcctggagagcaaatacgtgttcttccggcccaccatccag

SEQ ID NO: 67874 - DNA, 30 bp, Homo sapiens
  chr1:156897401-156897431
  hyper
gggtttcaaccacatcggtgacgagggcgc

SEQ ID NO: 67875 - DNA, 40 bp, Homo sapiens
  chr1:156897769-156897809
  hyper
aaagggacacaggagcgctcgcgatcggtgaggagctacc

SEQ ID NO: 67876 - DNA, 30 bp, Homo sapiens
  chr1:156915778-156915808
  hypo
aatgagggtctggcacgaggcccactgcct

SEQ ID NO: 67877 - DNA, 30 bp, Homo sapiens; identical to SEQ ID NO: 39092
  chr1:157086435-157086465
  hypo

SEQ ID NO: 67878 - DNA, 31 bp, Homo sapiens
  chr1:15714388-15714419
  hypo
aagaaaaagactctcccgcagtgatccctta

SEQ ID NO: 67879 - DNA, 37 bp, Homo sapiens
  chr1:157247210-157247247
  hypo
gtaggaggttttggccggctcaggaagggatgggggt

SEQ ID NO: 67880 - DNA, 96 bp, Homo sapiens
  chr1:157247367-157247463
  hypo
ttgaaacgggagtcaggtggaggtggattattaggaggcttccatgtagagccgcggcccagtggcctgcagggcctctgacggcagaggcaagca

SEQ ID NO: 67881 - DNA, 48 bp, Homo sapiens
  chr1:157346340-157346388
  hypo
tcaatacttggaaggcgctggtcagcgcagaagcgaggctggtgggca

SEQ ID NO: 67882 - DNA, 162 bp, Homo sapiens; identical to SEQ ID NO: 39094
  chr1:157458773-157458935
  hypo

SEQ ID NO: 67883 - DNA, 227 bp, Homo sapiens
  chr1:157490582-157490809
  hypo
ctctaaagtcagtggcgctcttgcgcccagcccgccaacccgcgctctcagccccaacgccatcacttcagaagcacttcaggaaatatagcagtttagagagctgccagctgtgttacttcgccctgaggagtgcctttctgatcaagcactgtgagggttatcagagggtccgcggaggaaacattttgtccgcatctgtggcccgggcacgggaaacttacctg

SEQ ID NO: 67884 - DNA, 191 bp, Homo sapiens; identical to SEQ ID NO: 39096
  chr1:157527405-157527596
  hypo

SEQ ID NO: 67885 - DNA, 87 bp, Homo sapiens; identical to SEQ ID NO: 39097
  chr1:157543012-157543099
  hypo

SEQ ID NO: 67886 - DNA, 30 bp, Homo sapiens
  chr1:157543676-157543706
  hypo
tttttcttagtatttcgtaggtagttttat

SEQ ID NO: 67887 - DNA, 38 bp, Homo sapiens
  chr1:157608817-157608855
  hypo
aacctaccggccaggcgcggtggctcacacttgtaatt

SEQ ID NO: 67888 - DNA, 36 bp, Homo sapiens; identical to SEQ ID NO: 39098
  chr1:157791984-157792020
  hypo

SEQ ID NO: 67889 - DNA, 412 bp, Homo sapiens
  chr1:157895130-157895542
  hypo
actgtgagaggtgagcggcatggtctgaatctgctagccggcggctccctgctggggtcagtttccttctgtagcagcgaggatgctccaaggtgacgacaagaaacagggcgtgaggagggtaagaggccctatgggcactgtagtcttgtgatgggggaggtggtggcagcggcagcggtggcagagagctagaggagggtgagaaggtggacgcggggccatgtatcccgagctcttcaccagagcccagcacagctctgccggaagcacccctgcagggttagaccagcaggtgcgaggtgcgacgtgggaaagagtccagggccggcggggtgctatgaggcgaggacttcctgagccgaggaccgggtgggttgtgagttgcgaccagcctcgctgacggacccta

SEQ ID NO: 67890 - DNA, 22 bp, Homo sapiens
  chr1:157905741-157905763
  hypo
aattaagctataggccgggtgc

SEQ ID NO: 67891 - DNA, 138 bp, Homo sapiens
  chr1:157963288-157963426
  hyper
ggaaatgagtttgtgcgcgtgagtgtgcgcgcgcgcgtgtgtgtgtgcaggggcgggcgcgggcgggcggggggcgggctcccgggctcccgggctcccctcctccccagcccgctcctctggctcgctcgccaactc

SEQ ID NO: 67892 - DNA, 73 bp, Homo sapiens
  chr1:157963443-157963516
  hyper
cgggcgcacggcgggcggacagcatgctgagcctcctcgtctggatcctcactctctccgatactttctccca

SEQ ID NO: 67893 - DNA, 154 bp, Homo sapiens; identical to SEQ ID NO: 26658
  chr1:157963737-157963891
  hyper

SEQ ID NO: 67894 - DNA, 30 bp, Homo sapiens
  chr1:158064583-158064613
  hypo
ctcaacacctatagccggggccctgcctct

SEQ ID NO: 67895 - DNA, 55 bp, Homo sapiens
  chr1:158064823-158064878
  hypo
tacgccacagccactcgattctcctacacctcccagcactcggactacggccagc

SEQ ID NO: 67896 - DNA, 530 bp, Homo sapiens
  chr1:158083182-158083712
  hyper
ccttttgagattctccggacctgcgcgccgcccgctcggcagggggctcggcaggcgcgggcggcgggtgggggcgggaggctctgcccgctcggtggctgccgcggcctcctccgcgctgctctccacgcctggcttattatgcacgaggcaggcaatttgccttcctccccggggacccatctcggagacaagaaggtagtttgttctctgtaatggcttctgctggagtgcggcggggcccaggcgcgagcgggggcacgggcggggagttggcagcgaaggatgcgcccggcgccccccggcggccgcccggagcccgaggtcggcgcgggaggagcgctgactccgcgggccgagccctcccctgccctcctctgctcctccgtaactcctgagctgtggcctgcctttctgctgcctccacgtccctactcttcctttctgccaccccgtttgcttcttaaaggttgtcctttgtttctgccatttcccctgtctttcagcttcatattcgttgggtgccccca

SEQ ID NO: 67897 - DNA, 30 bp, Homo sapiens
  chr1:158120029-158120059
  hypo
atttcatactagctccgactagtcttaaat

SEQ ID NO: 67898 - DNA, 40 bp, Homo sapiens
  chr1:158129286-158129326
  hypo
gattacaggtgtgagccacctcacccggcagacccaacta

SEQ ID NO: 67899 - DNA, 93 bp, Homo sapiens
  chr1:158150556-158150649
  hyper
ataatggttgtaaagcgtcccacacgttgacccaaagtctcctttgaaacaggaaattgagacacgccggttgtgaaacctactgaagtgagc

SEQ ID NO: 67900 - DNA, 147 bp, Homo sapiens; identical to SEQ ID NO: 1829
  chr1:158150650-158150797
  hyper

SEQ ID NO: 67901 - DNA, 358 bp, Homo sapiens
  chr1:158150798-158151156
  hyper
gaaagggacgtgagctgagcggcgggggagaagagtgcgcaggtcagagggcggcgcgcagcggcgctccgcgaggtccccacgccgggcgatatggggtgcctgctgtttctgctgctctgggcgctcctccaggcttggggaagcgctgaaggtgggtggaacgagggcgcttgagtgcactcgcgggagggcggagagagggagctgggtagggacggggagggcaacgcctgatggggactggtgagacccgggacgcactggcgcgatctaggtagaaaactcgctgctccctggctccggggagaggcagcgcggcacagagttcgctggcatcagccgcctcctgaagctc

SEQ ID NO: 67902 - DNA, 30 bp, Homo sapiens
  chr1:158165497-158165527
  hypo
cctcagccttcctgtcggcatcagggggca

SEQ ID NO: 67903 - DNA, 141 bp, Homo sapiens; identical to SEQ ID NO: 14282
  chr1:158169208-158169349
  hypo

SEQ ID NO: 67904 - DNA, 30 bp, Homo sapiens
  chr1:158232713-158232743
  hypo
aataacctgaaatgacgactacctttgtct

SEQ ID NO: 67905 - DNA, 60 bp, Homo sapiens; identical to SEQ ID NO: 39101
  chr1:158237112-158237172
  hypo

SEQ ID NO: 67906 - DNA, 20 bp, Homo sapiens
  chr1:158366698-158366718
  hypo
tattttggccaggggcggtg

SEQ ID NO: 67907 - DNA, 30 bp, Homo sapiens; identical to SEQ ID NO: 39103
  chr1:158578092-158578122
  hypo

SEQ ID NO: 67908 - DNA, 16 bp, Homo sapiens
  chr1:158591676-158591692
  hypo
ggagtcttgctctgtc

SEQ ID NO: 67909 - DNA, 15 bp, Homo sapiens
  chr1:158591932-158591947
  hypo
cgtgagccactgcac

SEQ ID NO: 67910 - DNA, 42 bp, Homo sapiens
  chr1:158639312-158639354
  hypo
gtggcagccttttcacgtagggcatcccgccgggctaacagc

SEQ ID NO: 67911 - DNA, 178 bp, Homo sapiens; identical to SEQ ID NO: 39107
  chr1:158669704-158669882
  hypo

SEQ ID NO: 67912 - DNA, 300 bp, Homo sapiens
  chr1:158672332-158672632
  hypo
attacaggcatgagccaccgtgcctggccgtgacctccacattttcttcagactttcttacttagaaacctcactttgacccaaacgtacatcctcacctattataggctgttaaattgtgtcccctgaaaatttgtaggttgagtttctaacccccagttcctcggaatgtggttgtacttggacatacagtatttaaagaggtaacaaagttcaaatgaggaaattagggtggcccttaattcaatagggccagtgtccttacaagaagaggaaaccggccgggcgcggtgtctcacg

SEQ ID NO: 67913 - DNA, 183 bp, Homo sapiens
  chr1:158686993-158687176
  hypo
gaacagttttttaatcgcattgttcatgtccttgtttctcaggctataaatgatgggattgaagaatggagcaagtacagtaaacatcagtgcaatggctgtgtccaaaactggtggataagtgtcgctgaaacgcaagtacatgagtgatacactgccaaagaatatcgggaagaccatgag

SEQ ID NO: 67914 - DNA, 135 bp, Homo sapiens
  chr1:158687415-158687550
  hypo
aaatcatcacaatctcgggaagcaggataaggaaaccgaagaggcaggaacctgcagagagttgagcacagagccggggggtcatgatcatttgatagcgaagagggttgcagatggcaacgtatctgtcaatgg

SEQ ID NO: 67915 - DNA, 30 bp, Homo sapiens
  chr1:158710956-158710986
  hypo
gcataaatcaaaacacgtacggtgggttta

SEQ ID NO: 67916 - DNA, 32 bp, Homo sapiens
  chr1:158712034-158712066
  hypo
aagtagggcaagggccgggcgcggtggctcac

SEQ ID NO: 67917 - DNA, 30 bp, Homo sapiens
  chr1:158712492-158712522
  hypo
gagaaagccttctgacggctctcaccagag

SEQ ID NO: 67918 - DNA, 107 bp, Homo sapiens; identical to SEQ ID NO: 39109
  chr1:158723718-158723825
  hypo

SEQ ID NO: 67919 - DNA, 17 bp, Homo sapiens
  chr1:158730575-158730592
  hypo
ctgggtgcagtggctcg

SEQ ID NO: 67920 - DNA, 30 bp, Homo sapiens
  chr1:158746532-158746562
  hypo
atgatttccttgttacgaagactgtagata

SEQ ID NO: 67921 - DNA, 32 bp, Homo sapiens
  chr1:158760470-158760502
  hypo
ggcgtgagccactgcgccgggcctttgatagg

SEQ ID NO: 67922 - DNA, 42 bp, Homo sapiens; identical to SEQ ID NO: 39112
  chr1:158815297-158815339
  hypo

SEQ ID NO: 67923 - DNA, 39 bp, Homo sapiens
  chr1:158840962-158841001
  hypo
actggattttttaatgccactatccggcagtgattaaat

SEQ ID NO: 67924 - DNA, 60 bp, Homo sapiens
  chr1:159088824-159088884
  hypo
ctcacaccagaactccgaataaagaagcaatggctccttgggatccgctcctcttttact

SEQ ID NO: 67925 - DNA, 114 bp, Homo sapiens
  chr1:15911093-15911207
  hyper
cggggccagcaggggcgcctgtctcggtgctttccatgcccgacagccagcaagcagtccctccacgtgtacccggcccccgtccttccggccttacctcgccccaggccggtt

SEQ ID NO: 67926 - DNA, 15 bp, Homo sapiens
  chr1:159141385-159141400
  hyper
ccgcgactgcagcag

SEQ ID NO: 67927 - DNA, 112 bp, Homo sapiens
  chr1:159141432-159141544
  hyper
cgggctccgaagcggctcgggggcgccctttcggtcaacatcgtagtccaccccctccccatccccagcccccggggattcaggctcgccagcgcccagccagggagccggc

SEQ ID NO: 67928 - DNA, 162 bp, Homo sapiens
  chr1:159141599-159141761
  hyper
cgcctgctgctgggcgcccggcggggccaacctctcccaggacggtgagtgagggagggggcggcgcctggggaggtggggagtgacccgaggcgggggctgggatcgggagtctcgcggaaggagcctgttggctttgtttggaaccggggttaaagtcac

SEQ ID NO: 67929 - DNA, 64 bp, Homo sapiens; identical to SEQ ID NO: 26665
  chr1:159158305-159158369
  hyper

SEQ ID NO: 67930 - DNA, 40 bp, Homo sapiens; identical to SEQ ID NO: 1832
  chr1:159158471-159158511
  hyper

SEQ ID NO: 67931 - DNA, 79 bp, Homo sapiens
  chr1:159187230-159187309
  hypo
taatgcctacatgttcgagacttagctctggtgtttcctgacctgagcccatcctctctgtccccgcaagctgggttgg

SEQ ID NO: 67932 - DNA, 33 bp, Homo sapiens
  chr1:159202103-159202136
  hypo
tgagccaccgcgcccagccgacatggtcttgtg

SEQ ID NO: 67933 - DNA, 30 bp, Homo sapiens; identical to SEQ ID NO: 38863
  chr1:15928989-15929019
  hypo

SEQ ID NO: 67934 - DNA, 442 bp, Homo sapiens
  chr1:15929958-15930400
  hyper
gaacattcgccagaacgaaagcggcagccaggagaagccctcgcaggtgctgtagggatccaagcgcttgagctgagtccgaaactcgcacagcaacctcgggaggataaactccagcaaccagaatcgggttggcgtcgcctagcaaccaggagccaaatgcgcggacgccaggcattggcctgcacgtgtcacgtgagccagcgccgctgcccagtgggagattacgccgcaggcacgtgatgcggcgcaaccgccctttggcagagcttttcgcgaaggcagttgtggctctgagcgcataggcgaggcattcctggggtttgcgccgtatccttttacaaagtcctggctttggctggtgcgaccaaagaaaggaaaccggcgcttgagacttgtctgggctggctatggtgaagcagtgaaacggtgcagaattgtg

SEQ ID NO: 67935 - DNA, 24 bp, Homo sapiens
  chr1:159448019-159448043
  hypo
tttttttttttgagacggagtctg

SEQ ID NO: 67936 - DNA, 51 bp, Homo sapiens
  chr1:159642793-159642844
  hypo
tggtcacagccccagcgggttcctcccccaagctcacggtatcagatgaac

SEQ ID NO: 67937 - DNA, 41 bp, Homo sapiens; identical to SEQ ID NO: 39114
  chr1:159650169-159650210
  hypo

SEQ ID NO: 67938 - DNA, 26 bp, Homo sapiens
  chr1:159679196-159679222
  hypo
agactccgtctcggaaaaaaaaaaaa

SEQ ID NO: 67939 - DNA, 96 bp, Homo sapiens
  chr1:159683839-159683935
  hypo
ggctttgagaggcttcgttaacggtgctttgagggatacataggaagtatccgactctttgggaaacacaaaagccttcctcgacatgtctgtgag

SEQ ID NO: 67940 - DNA, 267 bp, Homo sapiens
  chr1:159750379-159750646
  hyper
ccccagggcatccagcgtgaaggaggtagaactaggccggcccgcgaggaggcaggggcaggcgccagtgacgcaatgactgcaacatgccgccagggtgcagcagagcccgaccccgggttgttccatccgcagcaaacaattcctaactcgctccaggtcttccttcttagctgagtgggttgaaccccgtggaagtaaccccccgcccattatgatgatccagccaatcaccgcgtgatctgctcggacggggcgggatcgcgg

SEQ ID NO: 67941 - DNA, 95 bp, Homo sapiens
  chr1:159750677-159750772
  hyper
cgcgttccagccccgccccaggttctgggccaatccccgcggctgggcagagcgacccgagggcggcgccctgcagaccacgtggcccgggaggc

SEQ ID NO: 67942 - DNA, 114 bp, Homo sapiens; identical to SEQ ID NO: 26669
  chr1:159751133-159751247
  hyper

SEQ ID NO: 67943 - DNA, 79 bp, Homo sapiens
  chr1:159869607-159869686
  hypo
ccgctgtaatggcaacggggagagggttggggcatccctttctccccaactcctccgctcagcgcgctccacatttcca

SEQ ID NO: 67944 - DNA, 23 bp, Homo sapiens
  chr1:159876328-159876351
  hypo
agaacatttaggagccgggcatg

SEQ ID NO: 67945 - DNA, 169 bp, Homo sapiens; identical to SEQ ID NO: 14290
  chr1:159883486-159883655
  hypo

SEQ ID NO: 67946 - DNA, 45 bp, Homo sapiens
  chr1:159915746-159915791
  hyper
acgggcgaccctctccgctccccgaacgggcgcgccacagaggcg

SEQ ID NO: 67947 - DNA, 19 bp, Homo sapiens
  chr1:159930262-159930281
  hypo
ttttttcctttgagacgga

SEQ ID NO: 67948 - DNA, 91 bp, Homo sapiens
  chr1:159931588-159931679
  hypo
agacggactgcaggccgctcactgggggcgtatagacctgctgagtttataagttatgcactcaagaagtttacctttggccgggcgtggc

SEQ ID NO: 67949 - DNA, 72 bp, Homo sapiens
  chr1:159932029-159932101
  hypo
tattgccaatgatttcgttttaagagtggagatgaggctacaaagatggactgcaggcggctcactgggggt

SEQ ID NO: 67950 - DNA, 71 bp, Homo sapiens; identical to SEQ ID NO: 39120
  chr1:160025702-160025773
  hypo

SEQ ID NO: 67951 - DNA, 257 bp, Homo sapiens
  chr1:160039671-160039928
  hyper
ggcaggggaacaagacggtggtaccgctgaggccaggcagggtagggactgaggatctgggaccccgatgtctctggagagttagggggacaggacccggccggggcggcagaactccttcatcagggccagggtcttaccttgggtccgaggtggagtggccccttggatgggccgcggggcagcgggacagatggacggacggggcgggcaggagttaggagcagagctgtgcgacgggccgggccaggactctt

SEQ ID NO: 67952 - DNA, 171 bp, Homo sapiens
  chr1:160040333-160040504
  hyper
ggaagaaaagggaggcggtcctgtcagcgatgggttacgagagctggagccggggggcgggactgggaccgagttaacgaagtggaaatgaattcaggaccggcccagtggccctgcaggcagcgccgaaggcggcgcctggaagtgagattggggcggagtaggcctggg

SEQ ID NO: 67953 - DNA, 76 bp, Homo sapiens
  chr1:160135228-160135304
  hypo
ttgttatctcctccacgttctttgtttaaactattggtctgccgggcgcggtggctcacacctgtaatcccagcac

SEQ ID NO: 67954 - DNA, 173 bp, Homo sapiens
  chr1:160370097-160370270
  hyper
cattcccctgcccaccgttcgggacccgagtgtcagccccaccgcggattcccaggatcggggagggccgctgggcatctgaaggcgcagggctgggggagcggcgactccgggaagagcggggccgcagacaatggacgcggcggtaggaggggcggcggctgtgggaacag

SEQ ID NO: 67955 - DNA, 30 bp, Homo sapiens; identical to SEQ ID NO: 26673
  chr1:160370599-160370629
  hyper

SEQ ID NO: 67956 - DNA, 36 bp, Homo sapiens; identical to SEQ ID NO: 39121
  chr1:160451199-160451235
  hypo

SEQ ID NO: 67957 - DNA, 30 bp, Homo sapiens
  chr1:16049826-16049856
  hypo
aggctctgagatccccggaaatctggaaaa

SEQ ID NO: 67958 - DNA, 30 bp, Homo sapiens
  chr1:160503724-160503754
  hypo
ccagttgtcccagaacgaattgttgaaatg

SEQ ID NO: 67959 - DNA, 30 bp, Homo sapiens
  chr1:160508436-160508466
  hypo
gcctcccaatacaggcgtgagccactgtgc

SEQ ID NO: 67960 - DNA, 97 bp, Homo sapiens
  chr1:160523172-160523269
  hypo
cttctcttgaacaaacggaacaaaaacactgaagacagaatgagaacaagcagaaagaacatagccagcacgctcagcaacccggtgtggtgagtac

SEQ ID NO: 67961 - DNA, 17 bp, Homo sapiens
  chr1:160524877-160524894
  hypo
tttttttttttgagacg

SEQ ID NO: 67962 - DNA, 73 bp, Homo sapiens
  chr1:16059027-16059100
  hypo
agctttgagtgggggcggggctgcaaggcctgcagaaggaaagctctggctgctcacccgggggcctggctct

SEQ ID NO: 67963 - DNA, 126 bp, Homo sapiens
  chr1:16059358-16059484
  hypo
ctcctgcctcagccccgggggtgagtgcctgctgctcttaaaacaaacccagaagagtcctcactgtccttgccgtctcttgctgcgcacaagcctgccaggctgggagcccgaggccctcaagcc

SEQ ID NO: 67964 - DNA, 30 bp, Homo sapiens
  chr1:160654992-160655022
  hypo
tcagagtgagacctgcgctagaggaggcag

SEQ ID NO: 67965 - DNA, 94 bp, Homo sapiens
  chr1:160693863-160693957
  hypo
ggtcaacttctcacccgtggtaacccgagccctggtattatacacataggtcctgtcctcctgaaaacgggtcaggactggccaggcgcagtgg

SEQ ID NO: 67966 - DNA, 30 bp, Homo sapiens
  chr1:160698365-160698395
  hypo
agcattttggccaggcgcagtggctcacac

SEQ ID NO: 67967 - DNA, 25 bp, Homo sapiens
  chr1:160752829-160752854
  hypo
gaaaacaaccctgaacgcaggtgac

SEQ ID NO: 67968 - DNA, 197 bp, Homo sapiens
  chr1:160787406-160787603
  hypo
tttttgcacaatcttcgcaacaatcctacagagtagatattctcgtttttcccctttatatggataaagaaactgaggctcagaaaagataagggacttatccaaggtcacaccataaaagctggtttcgaaccctgagctctatcttctgctcttccgtagaaggaagcagaaaaaaggtacggtctacccaggat

SEQ ID NO: 67969 - DNA, 30 bp, Homo sapiens; identical to SEQ ID NO: 39124
  chr1:160820959-160820989
  hypo

SEQ ID NO: 67970 - DNA, 30 bp, Homo sapiens; identical to SEQ ID NO: 14294
  chr1:160853373-160853403
  hypo

SEQ ID NO: 67971 - DNA, 101 bp, Homo sapiens
  chr1:160880601-160880702
  hypo
gggagagagtgaaggcgcacctacaaggggcttatcaggaccacttatcctctcaaatttctactcttgagtgcgagttaaagaaacaacttaaagaatga

SEQ ID NO: 67972 - DNA, 120 bp, Homo sapiens
  chr1:160883883-160884003
  hypo
caggtgtggagaggcaacccgccccatcatgagccactgtgcccagcctgaattaaattttttaaagtttaattgagcaatgaacagttcccgaaactggcagcctcccaagccagagta

SEQ ID NO: 67973 - DNA, 151 bp, Homo sapiens
  chr1:160953002-160953153
  hypo
ctcaaaaaaataaaaaagaacggcctcgaatctactcgcagggacctcaggtatggaagtttcttctgtcttttgggaatccagccaggtcaggcctgagtcccagatcccaaagacacccacaaccctggggtaccggggacagtctcaa

SEQ ID NO: 67974 - DNA, 27 bp, Homo sapiens
  chr1:160992336-160992363
  hypo
cttaatagtcttggccgggtgcgtggc

SEQ ID NO: 67975 - DNA, 57 bp, Homo sapiens; identical to SEQ ID NO: 14297
  chr1:161007705-161007762
  hypo

SEQ ID NO: 67976 - DNA, 193 bp, Homo sapiens
  chr1:161044630-161044823
  hypo
cctccacccccatgacgtcacccagagccgcaggctgttcccacggtgcccctccctccaccaggcaggtctaggcagaggtcctttctccctgctgcccagcctgacctgggcaccccccacacacacccggggaagatccacacgtgtgccatcccacatgcttccacaggcatcacgtcatccaacactg

SEQ ID NO: 67977 - DNA, 181 bp, Homo sapiens; identical to SEQ ID NO: 39131
  chr1:161056643-161056824
  hypo

SEQ ID NO: 67978 - DNA, 30 bp, Homo sapiens
  chr1:161059519-161059549
  hypo
tccaggctttacctgcgagtatgtggaagg

SEQ ID NO: 67979 - DNA, 30 bp, Homo sapiens
  chr1:161062448-161062478
  hypo
ccatgacaggctgcacgcctcagccaaacc

SEQ ID NO: 67980 - DNA, 646 bp, Homo sapiens
  chr1:161067928-161068574
  hyper
caaatcagttcacagcggagatcacaggggtttattctaaggacccgactgtcctccgactttctgaggttaacaatcttgcaggatttttattgacctgatacagctcccgtagccttggtggcaccaccatacggttcccgatagccacccaggtgtcctgtctccacggtaactgctgctttgcgaccttcggtttgcagcggtcgcgctgcagccgctgcagtggttgctgggcgaccacggagagaaagccgggacttgaggtgggaaccccggctggcgtccggtagggggaggttcccggggaagcccgcggaaggcgaggtgcctggcctgccatgtaggggctcgttccaagccgcagaccccaccgccctccctctccccggggcccatggcggtggccgtgcccccgggtcgggccgcaggctcaggctgggcctggaggccagtggcgcgggacgcgcttttggctagagctttccattcatgcaccgaactgcggggacggttctatctcgtaggtggtctcctagcaggaggagcgagagagcccagcagcgatacggtggttttcgacccagctaggggccaggccgtacgattgggagcccggggcagccccccgcgcagtcaccacgac

SEQ ID NO: 67981 - DNA, 78 bp, Homo sapiens
  chr1:161121163-161121241
  hypo
cccctaaaggcagaacgagacaaggatgtctgctggtaacactgtcttttttttattttgagacggagtcttgctctg

SEQ ID NO: 67982 - DNA, 224 bp, Homo sapiens
  chr1:161228649-161228873
  hyper
agctgtaacccctgccgcagagcccggcaactttcagctgtcgcccgcggagccccgagggccactcgcctcacctgtgcgtgcagcgcctcgcgcgccctgtccggctgcggagatgagcgaggtgagcggtgcggcccccggcgctgtcggcagggctgcggcggggagggtgctgcggctcgggatcccagggaggcgagggagagcgaggcagaccggag

SEQ ID NO: 67983 - DNA, 124 bp, Homo sapiens
  chr1:161275455-161275579
  hyper
ggggtgggggggtggcgatcacttgtccgagttcaggcccatcatgttcttgagggcgtttttgaggctggttctgctgggggacttgacagcaggccggagctccgggctctgctcatccttt

SEQ ID NO: 67984 - DNA, 484 bp, Homo sapiens; identical to SEQ ID NO: 26677
  chr1:161275639-161276123
  hyper

SEQ ID NO: 67985 - DNA, 41 bp, Homo sapiens
  chr1:161358973-161359014
  hypo
atgtaaagcaggccacgcacggtggtggctcacgccttaat

SEQ ID NO: 67986 - DNA, 360 bp, Homo sapiens
  chr1:161367762-161368122
  hypo
ttaaaggcgtgaaacaccgcgcctggccaaaaaatgttttattttaaattcaaaatgctgtaatggaggctgggtgcagtggctttttttactcagcatacttgagattcatgttgttgtatatgtgagcagttccgtcctttttttggctgagtaacattccattgtatggatcggtctttcacttgttgattgacatttggatagtctacagtttggggctattacaaatagagctgctatgaatgtttgtgtacaggcgtttgtatgggcatatgctctatttactcttggtaaatacctaggagtggaatggctgagtcatattgtagtagtttaacgcttttaaaaacccccaaa

SEQ ID NO: 67987 - DNA, 140 bp, Homo sapiens
  chr1:161409851-161409991
  hyper
acaccctccaaacaccgcaagcctccttccccggcgcacaggcacgcagccacaggccaagctgcgacgcgagctccgcgcgcgggatctccgcaaaaggtccgcccgatgcgttgggcgggaatcgagcccgggtcaac

SEQ ID NO: 67988 - DNA, 169 bp, Homo sapiens; identical to SEQ ID NO: 39134
  chr1:161442404-161442573
  hypo

SEQ ID NO: 67989 - DNA, 252 bp, Homo sapiens
  chr1:161450235-161450487
  hypo
attgggccagtctttcgtggatgctccaatgggacggaggcccatggcaggttgtgaccagtgaagggtggctggtggcgagctctgctgtgacagcttccattggcatttgccatcagtgcataggtggttcagtggtagaattcttgcctgccacgcaggaggcccaggtttgattcctggcccatgcagcacgccctcccattttggtgctgcagcagcaccaaggcgtagctgcgttcgcctctgccg

SEQ ID NO: 67990 - DNA, 29 bp, Homo sapiens
  chr1:161471750-161471779
  hypo
ccaccgcacctggccggttctcttgaatc

SEQ ID NO: 67991 - DNA, 215 bp, Homo sapiens
  chr1:161481646-161481861
  hypo
gctcaccagggctgccggctggacctgagccagcgagaaggggcttgtgcgagttcagctgggagccagggagggagcagcgatggggggatggccagggctcaaatcgcttggtcaactctgagtctaatttctgggcctaaagaggacctcgctggagatgagaagagaaacaccagtcccagatacagaggagagggcggtgttcaaatttc

SEQ ID NO: 67992 - DNA, 99 bp, Homo sapiens
  chr1:161493379-161493478
  hypo
acatgagggacatcccgaccgtactctgcgtcctcctttcccaggtgttgcgttctctcttgggctgagtggcgaggtctctcccgagtcccagggcca

SEQ ID NO: 67993 - DNA, 184 bp, Homo sapiens
  chr1:161494827-161495011
  hyper
gcaagatgaaggagacggccgaggcgtacctgggccagcccgtgaagcacgcagtgatcaccgtgcccgcctatttcaatgactcgcagcgccaggccaccaaggacgcgggggccatcgcggggctcaacgtgttgcggatcatcaatgagcccacggcagctgccatcgcctatgggctgga

SEQ ID NO: 67994 - DNA, 283 bp, Homo sapiens
  chr1:161509756-161510039
  hyper
ccattttggattccccgaagacccttcgttcctgcattctcttctgctctccttttctcaacctcttctgctggaagctgagtcctgctccagatctaggcaagtgctagcgcagaaaaaagacctgcctcgctcagggctatgagccgcgccctgaagcacggaaagctaattgtgtcactggtttcaaatcaacctcaatttttttggagacgtgagtgctgagcattttttcttcagtgaagtgacttggcagccaaaatcgccaacgcccgtctctgtg

SEQ ID NO: 67995 - DNA, 163 bp, Homo sapiens
  chr1:161510099-161510262
  hyper
ggacggaagtcgcattttgtgaaccctgggtttttgaaactttgactgaaaaaactgcgtgcgatgctatccgctgggagcgctggggccttggcgctcaaaaccagccgcggtgctaaccgcagggagctctggtagcagacctccgcgttgtgtggttccc

SEQ ID NO: 67996 - DNA, 17 bp, Homo sapiens
  chr1:161529750-161529767
  hypo
aaagcctcactctgtcg

SEQ ID NO: 67997 - DNA, 34 bp, Homo sapiens
  chr1:161577201-161577235
  hypo
gggctgctgtgcaggcggccgtgttgatggggga

SEQ ID NO: 67998 - DNA, 30 bp, Homo sapiens; identical to SEQ ID NO: 39137
  chr1:161577640-161577670
  hypo

SEQ ID NO: 67999 - DNA, 128 bp, Homo sapiens; identical to SEQ ID NO: 26682
  chr1:161581762-161581890
  hyper

SEQ ID NO: 68000 - DNA, 413 bp, Homo sapiens
  chr1:161582234-161582647
  hyper
cggaggaaaatcccccggcggtgctcaactgcggctttctctctcggctgtgagccggctccgccctccggcttccagagcaagtggcttctgcgttcaccgccccccgccgtttgtggggcggggccgattcataagaatcggttctcaccaatggagggcttagcatgtttaacctcaggatcataaacaaaagacactgctagaacggtcgggaaagtcatacgctttgcttatcttatatatagatttctaaaattccaaaccggggacgcgttggtggtgtagtggtgagcacagctgcctttcaagcagttaacgcgggttcgattcccgggtaacgaaacgtttttgtctttccttctacgaaaaacttttctgagccggagcctccagcgcgctgtgtattcgtt

SEQ ID NO: 68001 - DNA, 81 bp, Homo sapiens
  chr1:161591283-161591364
  hyper
ctaggcaagtgctagcgcggaaaaaagacctgcctcgctcagggctgtgagccgcgccctgaagcacggaaagctaattgt

SEQ ID NO: 68002 - DNA, 140 bp, Homo sapiens
  chr1:161591628-161591768
  hyper
gctctcaaaaccagccgcggtgctaaccgccgggatccctggcagctgacctccgcgttgtgtggttcccaatgtcctcttctgccttagtgctgtacgggtaattttgaggtatttggtttttccgactagggttgtag

SEQ ID NO: 68003 - DNA, 231 bp, Homo sapiens
  chr1:161695622-161695853
  hyper
tgcaagtgccctatgcgccagtgttcgagggtgagccgctagtcctgcgctgccgcggctggtacgacaaggtggtctacaagcttcactactaccacgacggccaggccgtgcgctacttccactccagcgccaactacactgtgttacaggcgcgtgccagcgacagcgggcgctaccagtgctcgggcaccatgcgcatcccggtggagagcgcgcccatgttctccg

SEQ ID NO: 68004 - DNA, 277 bp, Homo sapiens
  chr1:161697067-161697344
  hyper
cccagctccatgggccgcagccttggctcctggtaataggccgctttccttcagaaagcccccggtgtccagatcggtcccgttggtcacctccgtccggaacaccacctccaccgggctgcagttcccggcgagcggcgccccgactgcggggccacccgcctgcgctccgccgacgcccttggaacaatcggctggagccctgaaacccgacgtggaccttctgctccgagaaatgcagctgctcaaaggccttctgagccgggtggtcctggaa

SEQ ID NO: 68005 - DNA, 45 bp, Homo sapiens; identical to SEQ ID NO: 39138
  chr1:161879452-161879497
  hypo

SEQ ID NO: 68006 - DNA, 54 bp, Homo sapiens
  chr1:161913485-161913539
  hypo
agttctgccaggtctcgaacaaaaaatcaccttttcacacgcacacaaaaagcc

SEQ ID NO: 68007 - DNA, 30 bp, Homo sapiens
  chr1:162389828-162389858
  hypo
gatcacgctattcaacgtacagacacaggt

SEQ ID NO: 68008 - DNA, 161 bp, Homo sapiens
  chr1:1625727-1625888
  hypo
atctcataaataaataaataaataaatattacttttacgttttgttaaacttccacttgtttttgtttccgttgcatgaaccttcgtaaagcttcaggaggctgatggcagcctccttccccaggcttccccgtggcgcccgcagccgggttgggccagag

SEQ ID NO: 68009 - DNA, 500 bp, Homo sapiens
  chr1:162792053-162792553
  hyper
ttgtcgccagtgcctcgatttttgcatttaaaatgaggcgaaagaacaaatggaataattatagaaaattttagcctctagcaaaacactgtgaagcagctccagcctgtggtggaagatgtgcgaaagggatgggggaacgctgtggaccggtgtggagtctaggacgacaggtggtgggctctgtccccacgcgcctcgcggccagcagaggccccctcactgcggccgccgggcgggactggcgcgggcggcgctgggctgggcccgggaggctggcatccctgggtgctccggtgcggtactagggggcgacggctgagccgtgggtggagccgctgggtcagtctcggatagaaataaactgggaaactgctgtggtctctgttgcttgcgtgctcggttttcgtgcttatcacgctgatgatgaggaaggtggttttggttacggagtgagcaggtgaacgcctccccgtggaccccaccggactgggtgggga

SEQ ID NO: 68010 - DNA, 30 bp, Homo sapiens; identical to SEQ ID NO: 39140
  chr1:163363352-163363382
  hypo

SEQ ID NO: 68011 - DNA, 196 bp, Homo sapiens
  chr1:16375246-16375442
  hyper
gggtgacttgattggcggtgctaagaggcttcagtgtaacattatacagacttgggtttgaaatccacgtatgaccctggcccgttggcctctctgagcccggcttcctcctctacaaaatggagatcgcaaccgtccccacccgatagcgagagggcgcacacccgcattccaggctggacgggtctctgggcag

SEQ ID NO: 68012 - DNA, 172 bp, Homo sapiens
  chr1:164290500-164290672
  hyper
atgcaaaaaaaactgcgccgtgttcccctctgttgtgtgcgccgcgtccggggagcctgggccgtgcctccctggcgtatgcaggtcgccggcgcagccgccagctccgggggccgcgcttccagccacccgcagccggcggggcccgccgggcagcacgggaatcgcggag

SEQ ID NO: 68013 - DNA, 34 bp, Homo sapiens
  chr1:16455953-16455987
  hypo
cgatggcagtgtagccggccgccatgaagtgctc

SEQ ID NO: 68014 - DNA, 40 bp, Homo sapiens
  chr1:164637945-164637985
  hypo
tggcactgccaggaccggctcctcgcgccaatgtggcagc

SEQ ID NO: 68015 - DNA, 30 bp, Homo sapiens
  chr1:164642633-164642663
  hypo
gccaccacgtctctccgctttcatcagccc

SEQ ID NO: 68016 - DNA, 30 bp, Homo sapiens
  chr1:164667343-164667373
  hypo
tatctcccagggcaccgattgttaagaggg

SEQ ID NO: 68017 - DNA, 30 bp, Homo sapiens
  chr1:164708418-164708448
  hypo
taaggattcccctggcgcaaaccaatcata

SEQ ID NO: 68018 - DNA, 359 bp, Homo sapiens
  chr1:16475073-16475432
  hypo
ggccctgcagcagctcggggcacttcttgtagtagacacggacggagagcagcgccacacaggcaccgatatcctggaaggccaggtagaagcctttgcgggtgagcggccccacggagcgctcctccacgttcagcttcacgtggcgtgcctcgaagtcgctgctgacggtgatctcatcgggcgcaatggtgtcaatcttggtgaacaggcgcttctggaagttggtgccgtagtccaggtccgactcggcatagtagaggttgaaagtctccttgcaggagctggcgccaccagggaagctgttgcagtcacgtacagtaaacttgagctcaatgaagatacgctcagcctctcct

SEQ ID NO: 68019 - DNA, 68 bp, Homo sapiens
  chr1:16482476-16482544
  hyper
acccgcacgcctgcacgccggcctcggtgtccgctcccgcccgccggcctgcgcgcaacttctgcccc

SEQ ID NO: 68020 - DNA, 30 bp, Homo sapiens
  chr1:16483726-16483756
  hypo
cctactcttgggaagcgggtccagacatct

SEQ ID NO: 68021 - DNA, 67 bp, Homo sapiens; identical to SEQ ID NO: 26690
  chr1:165086960-165087027
  hyper

SEQ ID NO: 68022 - DNA, 220 bp, Homo sapiens
  chr1:165204374-165204594
  hyper
gagagacagttagagcgtatagggggcgatgcagtcgatggtatctgtagcacagtacccagaagacccgggagctaggaccaaaccaggagtcagctcagtccaaaggaaatcagggttcaggtagcgacggtgtccgtgcgtttcttcactagtgcatgtgcgaggagggctggaggcatgagcgaaagagggaaggcaatctcggtctccaaaaaat

SEQ ID NO: 68023 - DNA, 541 bp, Homo sapiens
  chr1:165204825-165205366
  hyper
cccgggcccgcctgacgtcacctgggaacgcgcggcggcgcggggcggcgcggacccgggacgacctcgccgcgacctggcctcgcctccgcccgcgcggggctttgctccgcgggaattaaaggaaggagaaatgttagtacacttttaattggaaaccgagttcttctttcagagcggcttgtttactcaggattgggcattagaactcaggggaggctctaattgaagtgacggctttggagattatggggaacatatggccctaccgccgggctctttatctgcattttctcataaaactgccgtccgtgtgtgtttctgcgcctggcctcttgcatttctaaggggcctttgaagacagggccgaatgcgcgcgggggcttcaggcactttgcgctccacggcgggtcccgcagcccggcccgagccggccctggaagcttcgccctggactagactggcaccgacgccgcccccagcctgagcgctgagagggaaaacgagagctagaaaggaaagaaatcggactggtgactgc

SEQ ID NO: 68024 - DNA, 191 bp, Homo sapiens
  chr1:165321596-165321787
  hyper
cctgaactaggatggcggcacaggttgaaggagagggcttcagttcaggccccaactactgtcctaaaagcccctgcatccgagggttctgcagaaaaccaggaaggcgacagtgaaagggcgaacgggctgtgcgcttagctccgaatggcagcagagccatttccgagcccaaactgtccggactccag

SEQ ID NO: 68025 - DNA, 37 bp, Homo sapiens
  chr1:165322183-165322220
  hyper
aagggaagttctgctcgctgggcgtgtctcttgggcc

SEQ ID NO: 68026 - DNA, 30 bp, Homo sapiens
  chr1:165323443-165323473
  hyper
gcgctccccatttcccggctgcactcttct

SEQ ID NO: 68027 - DNA, 1660 bp, Homo sapiens
  chr1:165323697-165325357
  hyper
cgctgcccgcccgggtactgcctgctctggcttccgctctcttccgaggctgggcaagtccaaaagttcccgaaaggggggttcaaagaggggcgctcagtgcacgtgatttcgtttcatctagggtgttgggggtggggagattcctcactggatttggtttctccagcagaactgtctcatcctccacattcatgccgctctagcggttccgagtgaaagaggcaagaggtttaaaggacagaaggaaaactccctcctgctaaaaataaataaataaaataaaataaaataaaatacgggcttcccaaacttgaaaagctccaagggcagagtgggtgggggagccgtaaccagaatctctggcttcagctctgcaagacccgtgtgtggacactcttccggggtccttgactcgctgctcctcctctgtcgctgcaaaggagttgtgaggggggacccacaggacccgacatccagctccagttaattaacgcggagcctagggcccagccgcgcggtctaatccccgcgctgcgttgcctactggcccagaaaagtctctctcggccttgcccatggctgaaattggggctggagttggtgggggagagaagcctcctcgaacttgggcgctccaggcctcgggtctcggatgctattgcctctaggccgcgagaagagggcggcatttatgagacgtcgatcagctccgagattaaaaatccagccctgggtatttttaatcacttgccactcagacgcctacgaacaagctcgcccgcccctcgcggctttggggaattcggtgcccagtgcgtgaggcctggggcggcttgttggatttatttgggtagggacgacccacaagcactgacggacagatagtgatggggctcaatttagtgtatgaagaggggcgctagcttccctatcgcggaccaggtcccagagagcggggctccagagctcagcgccaagcggaaagagagtgcgcccaggacgcacggcctgaacactcacccagcagcgaggagaaggaggccgaggtgtcgatcgcgctttggaagttctcctccatctttaggccgtccagcatgttcgggccgggccgggaggacctgtagaggagaagaaacgatgcgtctgacgtccgtgcccgctgggactcggcgccagcagccaccgcactcctgggaaagaactgagggagtgtccagggcgaccagaatcagccaggaggatagggtccagccaagagaatgtagggtgggaggagagatcagtcacagcgaactgctctggctgatctgatttcacttgaagtcaacacgttatgtacttaggcctccgccccccaactgcgtttctccttctcctgcccccctcacccccacctacatcccttgccccaggttttccatcccgaatccgactccgccccaacctatacgaaggtgggccctcgggacgtctctgcaggaacgcagctactggggtatattgggtatataaagagtgggtaccctccctcgagcgaccgggtccaggcacgcgggacgatggggtttgcaatcccgcgtcccagccgccccgttgcggccctcacctgccccaggtcgagaaggggcactgtaagggacccggagggcgtcccgcc

SEQ ID NO: 68028 - DNA, 811 bp, Homo sapiens
  chr1:165325394-165326205
  hyper
cgcgcaggagccggtgtgcggggcgcgcggggaggtcctcccgccagtcggccagtgccgggaatgtctgcagaagcaaaagagtcgcctcggggaggagccccggctggcccggctcactcttggatgcatttcaagtcaactttcagaaacacgcccgcccgagccacagcctaggcacgggcagccttacttacctggtaggcgagctctctcccagtgactggagcagagagaagttgcggagcgctgctggaagcttctgcccgggaaggcgtcgcccccgagactgcagccggaggagccgccctcggcttcggagcgccggggagggagccggagcgaacgccggccgctggctctgctcctcggcgcgcccaggctgggccgggacgtggtcgcgagctgccggccttcccgggacgtcctaccagcccgcgtcgctcctcagcgggaggagagggccagttgcttctccaaggctaggagggaaggcagaggcccagggtcctgggtgcgagtcggccctgcttcgccggggcggatcctgcagcttctgacaggggccgcggcgctgcgtgcgcggcggcggagagggggtggggtgcgctgggcggggggctggcagcgcgtcccgtggcggggccgtggtgctccctttcccagcctggctgcgcggccaccacacggccgctgccctctgagcccctccgcctctgggagctctcggacacgctaagtttcctcccctccacgtgtaactgttacctcggggcgctctggcccggtcgccccccagtgcccctcaccc

SEQ ID NO: 68029 - DNA, 195 bp, Homo sapiens
  chr1:165326296-165326491
  hyper
cgctgcaatccttacccgggccccgggaagcgctgagaagctgtttagcgccagtagatgtgggcccagcagctcctagctcctcaaacccctcatcacccgagggctcatgccagtttccaacttcctttaaggtcgaaccatattcactcatggggcgtacagaggccatgggactcacggcctaagaatcat

SEQ ID NO: 68030 - DNA, 30 bp, Homo sapiens
  chr1:16532867-16532897
  hyper
aggaccagttcacctcggaggccctggcct

SEQ ID NO: 68031 - DNA, 438 bp, Homo sapiens
  chr1:16533298-16533736
  hyper
ctagagccaaccttccgcgcggacagtcgcgccagcaaccccctttgtgtgtccccctccctctatggcccggttcccgctaagtccccggaccgcgtactccccggcccgcccccgccccgccgggtccccgcgcgcgcccacctcctgcagcttgcagtcccgcaggctcagcgtggccaggacgccgctgccgcgtacgtcggggatatcctgccacagcgagaaggtggagcctcgcgccgagcgctgcgcccggaaggagctgctgggggagaggttggcccgcggcggccccggcccctcctctgcgccctcggcctcgtcccccgggccctcctcctcgcgctgctgccgccgcagttcgcgggcgctggccacgtcgctgtattcctgatagaggacggctgggggaaagacgggcgggggagagcgtgg

SEQ ID NO: 68032 - DNA, 257 bp, Homo sapiens
  chr1:16534506-16534763
  hypo
agagaagagtgcagccgggtcatcagctccgatgccgagaagcgcctccgctcaggaccttcgaggctcactcgggtggacccagacaactccaccctgggctcctctgtgctcagggcctgctcttgcactacctggccaggctctaggaagacagcgtgggcctcggggcagccggggacctcttcacgctggtacacccgcatcttgcgccctagggttgggggcaaggagtgagagcacgggctggggtctcc

SEQ ID NO: 68033 - DNA, 209 bp, Homo sapiens; identical to SEQ ID NO: 26700
  chr1:165345473-165345682
  hyper

SEQ ID NO: 68034 - DNA, 67 bp, Homo sapiens; identical to SEQ ID NO: 38867
  chr1:16535138-16535205
  hypo

SEQ ID NO: 68035 - DNA, 317 bp, Homo sapiens
  chr1:165414227-165414544
  hyper
aacaagagtggtcatcgcttcctagcagcccggggagcacaggctgggccagccctctgggattagtcaggaatctgcctctagatcggagagtccacatagtgcgtttgagacggctgtggcggcagcagctggtgcctgtcagtaatcacgcataatgctgccgccgccgccgccgccgccgtcaccgctactcttgccaccgccgtcgctgctgcttgagatcctgttgctagtttgattaactcagggttgggctgctgcgtgcgactcttccagctcccggcgcgtccccagaggtccctaccgggtggcac

SEQ ID NO: 68036 - DNA, 13 bp, Homo sapiens
  chr1:165414545-165414558
  hyper
atctattatctag

SEQ ID NO: 68037 - DNA, 76 bp, Homo sapiens
  chr1:16542965-16543041
  hyper
tgctgactgaaacagcgtctcccggttgtctgccaccgcctgcttggccaggtagcgctcgcgcagttatcttggt

SEQ ID NO: 68038 - DNA, 73 bp, Homo sapiens
  chr1:16553382-16553455
  hyper
gctgcggaaggcgcacgaatcctacggccggctgggcacctactgctgcagagggttgcgcaggcgcaggcgt

SEQ ID NO: 68039 - DNA, 263 bp, Homo sapiens
  chr1:16553469-16553732
  hyper
cgagccctcagagtcggggttgggccgggcctggggtcaagggcagggttacggccccctagggagactccgcccctggcggaccccgccccacccctccacatgagacggcgcgcgcaggctcagttcctcggcgtagcacagcggctcccaggcgcgctcagctcggcgaagggtgcggcgctatgccggggtactctcctgggctgctctcccaggaggagagggaaggacccctaagcccctcccctcacgatctcggc

SEQ ID NO: 68040 - DNA, 30 bp, Homo sapiens
  chr1:165550859-165550889
  hypo
gagtcccggaggccccggggccctgggatg

SEQ ID NO: 68041 - DNA, 30 bp, Homo sapiens
  chr1:165624524-165624554
  hypo
tgatagaatggcttgcgaatgttgaaagca

SEQ ID NO: 68042 - DNA, 23 bp, Homo sapiens
  chr1:165664216-165664239
  hypo
aaaaaggacgatgagctataaag

SEQ ID NO: 68043 - DNA, 36 bp, Homo sapiens; identical to SEQ ID NO: 39142
  chr1:165809083-165809119
  hypo

SEQ ID NO: 68044 - DNA, 30 bp, Homo sapiens
  chr1:166104124-166104154
  hypo
atttactacctacagcgtaaagtactgctt

SEQ ID NO: 68045 - DNA, 116 bp, Homo sapiens
  chr1:166134166-166134282
  hyper
ccttttagctattgtcgttgccacctgctcagagtctagttctgaaaggaggcgggtgcggagttatgaaaatttggtaaatataaaagtcccggacgcgaccgcccgtagcctgc

SEQ ID NO: 68046 - DNA, 608 bp, Homo sapiens; identical to SEQ ID NO: 26703
  chr1:166134283-166134891
  hyper

SEQ ID NO: 68047 - DNA, 653 bp, Homo sapiens; identical to SEQ ID NO: 26704
  chr1:166134933-166135586
  hyper

SEQ ID NO: 68048 - DNA, 19 bp, Homo sapiens
  chr1:166312814-166312833
  hypo
agcacgctgtcacctctca

SEQ ID NO: 68049 - DNA, 230 bp, Homo sapiens
  chr1:166360872-166361102
  hypo
aaccatctataaagtcgttatgcttatgaattcccatacaattataaaactagaacaaatttatacattaaatctaaatgaagctaaaatacaatgaaattcaaatgtgcgttaatgtaatgtgatggatgatgctggtttgtgaaattaaattgagcctctaaatgtgaataaggtactgagtactaaggggaagattattctgagtggccatgcgatgactcatgtct

SEQ ID NO: 68050 - DNA, 18 bp, Homo sapiens
  chr1:166479382-166479400
  hypo
aggcgtgagccaccgcgc

SEQ ID NO: 68051 - DNA, 94 bp, Homo sapiens
  chr1:166853653-166853747
  hyper
tagaggaagaagagacggccctgagcgcagcatcacctcggccggttggagtctgcccggctgccgccagggggtgatgcgccctcacctttcc

SEQ ID NO: 68052 - DNA, 175 bp, Homo sapiens
  chr1:166916746-166916921
  hyper
gaacgcaagcctgcacgcctgaatagcggcagctggctttggagaaaaatgggacaactgtctcctgcccggctttcaagagctgccattctttctttccaggggctgagccaatttctcggtgccacccactctcgcgcctgcccccagcccccgtttcctcccccgctcgggc

SEQ ID NO: 68053 - DNA, 14 bp, Homo sapiens
  chr1:166916936-166916950
  hyper
cgactacaatgcag

SEQ ID NO: 68054 - DNA, 36 bp, Homo sapiens
  chr1:16693059-16693095
  hypo
gattacaggcgtgagccaccgcgcctggccagtaat

SEQ ID NO: 68055 - DNA, 196 bp, Homo sapiens; identical to SEQ ID NO: 26708
  chr1:166945272-166945468
  hyper

SEQ ID NO: 68056 - DNA, 30 bp, Homo sapiens
  chr1:166958831-166958861
  hypo
gaagaggaaggcccccgtttgtggccctgg

SEQ ID NO: 68057 - DNA, 25 bp, Homo sapiens
  chr1:1671766-1671791
  hypo
tctttttttttgagacgggagtctc

SEQ ID NO: 68058 - DNA, 30 bp, Homo sapiens
  chr1:167274768-167274798
  hypo
ctcatatcatgtaaccgtttattcctggta

SEQ ID NO: 68059 - DNA, 30 bp, Homo sapiens
  chr1:167340601-167340631
  hypo
accagttttaattaccgtaaaattttctct

SEQ ID NO: 68060 - DNA, 48 bp, Homo sapiens
  chr1:16736310-16736358
  hypo
agctgaggtgggcaccggggtcagggtcctgggcgacttctgggctgt

SEQ ID NO: 68061 - DNA, 30 bp, Homo sapiens
  chr1:167393583-167393613
  hypo
ctgcgtgcatgggcacgtgtgcattgctca

SEQ ID NO: 68062 - DNA, 77 bp, Homo sapiens
  chr1:167505794-167505871
  hypo
ataattaactcacttcgaaatcccttgcttcctcatggaacgtttgtggcagagttgctcagcgtgcccacaagaca

SEQ ID NO: 68063 - DNA, 30 bp, Homo sapiens
  chr1:167525159-167525189
  hypo
tttaagctttggtcacgtctttttggagca

SEQ ID NO: 68064 - DNA, 769 bp, Homo sapiens
  chr1:167599108-167599877
  hyper
acaaaagaaggaaatcgaaaagagaggaaacaaaaagaattaaaggaccactctaattcttgaagggacaggaaaaagaaagaaggcgcattaagggagggagacgttgagaaggactgagaccgtggcaaagcccagggtcctgagaaacttcgcgagacagaggggcccggtggctgcccatccccatgtttgggcacatggagtcgtggctcccgctcttgagtcctgccctgggagggacagtatctgtttagatttgcgtctaaatttaaaccctgatcgtcggcctccctccccgctccccaccctcccctcccctccccttcctccctccctccctcctcctccttcctcgttctctcgcgcagggcccccgcggccggggcagtcccgcagccgagcgcagccgggcgcgcgccaccgcccactcgccctgtgcccgccgcagcccgaaactggccacggccgggagcggaggggacagcggggatcgtgagctccggcccgggcgagcgggtgcgtctgccgcagagtcggcacctgaaggacatggaggtaaaggaccccggagggagacgcggggctgagcggtgagcggtgtatcgggcgccccttccccgggcggctgcccctgccctgagcatggagcacgcggctcatcgctgctgccaactagaagggcaaatgcctgctgttccgacgcctccttgaccaactccgaaggatcgtccctggtcccacctaggacacccgggttgggaggctg

SEQ ID NO: 68065 - DNA, 30 bp, Homo sapiens
  chr1:167608107-167608137
  hypo
caatttaccaatggtcgtacttaaagtcag

SEQ ID NO: 68066 - DNA, 38 bp, Homo sapiens; identical to SEQ ID NO: 39144
  chr1:167789113-167789151
  hypo

SEQ ID NO: 68067 - DNA, 98 bp, Homo sapiens
  chr1:167823344-167823442
  hypo
gagatttaggcgtgagccaccgcgcccggccatagttagacaatctttagccgagtccagtgagtcccaggcaatgttaagttcgcttacaatctgga

SEQ ID NO: 68068 - DNA, 16 bp, Homo sapiens
  chr1:168004664-168004680
  hypo
acggagtgagactctg

SEQ ID NO: 68069 - DNA, 30 bp, Homo sapiens; identical to SEQ ID NO: 39146
  chr1:168058977-168059007
  hypo

SEQ ID NO: 68070 - DNA, 34 bp, Homo sapiens
  chr1:168116121-168116155
  hypo
cctattagaactacacgtagaagccgggtgcggt

SEQ ID NO: 68071 - DNA, 77 bp, Homo sapiens
  chr1:168150740-168150817
  hypo
cacccggcctcctctccatataactttctgtgacaaattgccgattggtgcaaaagtaattgcggtttttaattgca

SEQ ID NO: 68072 - DNA, 43 bp, Homo sapiens
  chr1:168151281-168151324
  hypo
acagagtaagactccgtcccccaccctccgccaaaaaaaaaaa

SEQ ID NO: 68073 - DNA, 277 bp, Homo sapiens
  chr1:16861465-16861742
  hyper
gcgtctccggggtggcgacgggaaagaaggtgggcttattgggtgcagctccacgggggctggcatctctgccgggctgtgtacacctgagcgagaagctcagtcgctctctaaagctgctcccgcggatgacggacacggagacaaataggaacggtgtgtcgtgagaggtggtccacaagcacttgccctccttcgcccggctttaaccccgctgcggagactgttctgcttctggcccttggagcaggccggctgacagcgtagtgaaggaaga

SEQ ID NO: 68074 - DNA, 349 bp, Homo sapiens; identical to SEQ ID NO: 26710
  chr1:169396286-169396635
  hyper

SEQ ID NO: 68075 - DNA, 53 bp, Homo sapiens; identical to SEQ ID NO: 102
  chr1:169396636-169396689
  hyper

SEQ ID NO: 68076 - DNA, 193 bp, Homo sapiens; identical to SEQ ID NO: 103
  chr1:169396730-169396923
  hyper

SEQ ID NO: 68077 - DNA, 26 bp, Homo sapiens
  chr1:169457163-169457189
  hypo
agagcgagactcgcgagtactcgtct

SEQ ID NO: 68078 - DNA, 30 bp, Homo sapiens; identical to SEQ ID NO: 26080
  chr1:17033955-17033985
  hyper

SEQ ID NO: 68079 - DNA, 35 bp, Homo sapiens
  chr1:17034330-17034365
  hyper
ccgccctgccggctccgccccgtctcccctccgca

SEQ ID NO: 68080 - DNA, 39 bp, Homo sapiens
  chr1:170629373-170629412
  hyper
cctcgaaactccctgcggtgatgtcggggctagaggaat

SEQ ID NO: 68081 - DNA, 266 bp, Homo sapiens
  chr1:170630336-170630602
  hyper
acagcaacgttaaaacgcaactgtgtaaatgaggatagagagtgcgaaaggagggagaggcgaggagctgctctatttctagggaggttttggggagactgatcagctccaaggacagaccgctgggaagggaaaaacggcccacatcgaactggatgccggatggaaacctctctgcgctattagactgcgtccagtacagcagatggcacgagcacgtgcggcgctcagcttaggctctcggaggcagctgagttggaaatccc

SEQ ID NO: 68082 - DNA, 1037 bp, Homo sapiens
  chr1:170630603-170631640
  hyper
acggaaagcacccacaagctcccactctgcgctggcccacccgcgtgcacgcccaccccccacgcgcgtccctggctcagaagcgcacagatgtttactgcttagagccggtaccgctggggagatcgagcgacttgcgcggcgcacagtgcggcgctggcagggctctgggctcccggtcgggggttcgagcggccaagggatgggggtgggggcggggagagtggggggagggcgaaagaccgccgagaggaggggggagtgggtggactaatgatgaaaaagtctcctccatcccagttccttaattaaatgcatggaaagaaccgaggcgagcacatctggtttcaatctacagccctttgatggcatcaaatgttcttttcccagatcagggctggaagttctgggctaactatggccgtttggagcccagaaaccatttacacacactcgtacccttctttctctccagtcgagcctcttgactataggacgaaaaaaaaaaaaagtctagcaatcaagggagtgcgggagtacggatgcgtgtgtgtgtgtgtgagtgcgcgtttaaagaacataaaacgccacaaataagcacttaatattttactgagtcgtcatacagtaactcatttctaatgagactgttaaagctgttaccaaattccaacaggtcatgaaaaaactgctcagcacctctctgtcttctgtcaggttagggctccgcagacggacgacagaggattatccgtagacttagatgggggttcctccgcccctctctgtcctcctgccaccacagccaggctggacgcagaaccgcacggaagcctccccaactcctgcctctgggagtgctcctgcctgcttcaaggaatctgggcagcgggaccctctgggtttagcgtcctcgcctggggaagcaactttggccttaccgtagaagttacaaaattggcgggggtagggagaaagattataatatatatttggagtcctttcttccagtttaataaacacgtacttttctcatt

SEQ ID NO: 68083 - DNA, 33 bp, Homo sapiens; identical to SEQ ID NO: 26717
  chr1:170633073-170633106
  hyper

SEQ ID NO: 68084 - DNA, 256 bp, Homo sapiens
  chr1:170633381-170633637
  hyper
ttctggagcggcaaccggcgctgggcggccgcttggacagcccgggcaacctcgacaccctgcaggcgaaaaagaacttctccgtcagtcacctgctagacctggaggaagccggggacatggtggcggcacaggcggatgagaacgtgggcgaggctggccggagcctgctggagtcgccgggactcaccagcggcagcgacaccccgcagcaggacagtgagtgaggggcgcatgcccacgggggtgtgtgccc

SEQ ID NO: 68085 - DNA, 391 bp, Homo sapiens
  chr1:170633892-170634283
  hyper
ggctaggcaccggctcggttcatcccgcacgcggggcggcggggctgggctgggaaaaggtcttagcggggtgcaaactcagagagccagcgctgtttgggaaagcagcaggttaaagatgctgagtcgggttggaagggcttctctcgggcagcgtatgacggcttgagggagggcaccaggcacagggagcaggacttggcgctgctcaggctgcactctccacgcgggcaccgtaaggccgggcgcgaccgggaggccccgagagaacgcccggccccagacgctggagctgctctctgccccctgctgttgcctctaccgcaaatgggtttgagactggcagagtcaaaagcccggctggcttgggaaaactcgggccaagcaaagg

SEQ ID NO: 68086 - DNA, 168 bp, Homo sapiens
  chr1:170637642-170637810
  hyper
ctggctcccgggccgcggcgggatgcaaatacaaaacagcgacgcgggaaatcgatttgtcacaaagggagaggtgtaaacgcagcgcaaaggaattgcttgcccaatctaccagccacactctctcgggaccttgccccgccaacttctcttcgccagagaaacgcc

SEQ ID NO: 68087 - DNA, 504 bp, Homo sapiens
  chr1:170640121-170640625
  hyper
agaagctctaattcccgagaactttggggcttatttttaccatcattgagtctgcccaggctcagctctcttacaaaggtataaatctgaaattcatgtattaatttgaatccccaagatccgagttatgagaaagggcaagggcaggctctactcctattttgtttactttcaccgagttactgtgaagtgattggaaactttcttaacgggcagagagagaatacacggaaactcggatgcagtaataaagttgacataggagtcggaacagggggctctttttggatctcacctttactggggcttgaggttgtggaatgggtggaagagtaattaactgaatgaagaattttaacgttgaaaacagagcccacagtatttttggttatagtggtgtggtctctgcctcggcaaagaaacaaacacccccaccccatcttcgcagttctcctctctgctgtagcgacgccaggcgctgctttccgccgggtaaattagcgg

SEQ ID NO: 68088 - DNA, 43 bp, Homo sapiens
  chr1:170640664-170640707
  hyper
cgaaagggggcgcgctcctcccaggctgcgctggtacctatcc

SEQ ID NO: 68089 - DNA, 120 bp, Homo sapiens
  chr1:171452989-171453109
  hypo
accgcgcccggccatacgtgtcagtcttatgaccttggttaatgtaatttcatctgattgctgaagttgttctccattgctcaagacagatgatttggctgggcgtggtggctcatgccg

SEQ ID NO: 68090 - DNA, 56 bp, Homo sapiens
  chr1:171555005-171555061
  hypo
ttttttgtgtgtttgcgtatacataatgaggtgtcttggggcgaggggcctgtcta

SEQ ID NO: 68091 - DNA, 37 bp, Homo sapiens
  chr1:171625525-171625562
  hypo
acactgacccttggccgggcgcggtgactcatgcctg

SEQ ID NO: 68092 - DNA, 30 bp, Homo sapiens
  chr1:171707361-171707391
  hypo
gcgtcccaagtgcggcgattgcaggcatga

SEQ ID NO: 68093 - DNA, 111 bp, Homo sapiens
  chr1:171731284-171731395
  hypo
cgacttcagcagcttcgggcctgtctctgaggtggtcattgtcaaggagactcagtggtccaggggttttggtttcatcaccatcaccaacccagacgccatgagagccat

SEQ ID NO: 68094 - DNA, 1087 bp, Homo sapiens; identical to SEQ ID NO: 26724
  chr1:171810200-171811287
  hyper

SEQ ID NO: 68095 - DNA, 323 bp, Homo sapiens
  chr1:171811320-171811643
  hyper
cgccgaaagcttcccagtgcccctctcctgttttcccagctcaacacccccctccttttcctgtcgccctccgtgaggctccctgtgaggctgtggggctttatcccccgagccccctcccttaggtggagatgctttccttctcgccagggttctcgttcctctcagctgtctactgttgcctgcctctagctggggaggcggggtgcgaggagaaagacgtcgtttgttgtggtgaagctttatccagagacgcttccccaccattctcctcccggagagtcgaagaataaaaggtggtgtgtttgcgtgtgcacctattc

SEQ ID NO: 68096 - DNA, 30 bp, Homo sapiens
  chr1:17215966-17215996
  hyper
gggcgaaggcaattccgctgttctggctcc

SEQ ID NO: 68097 - DNA, 30 bp, Homo sapiens
  chr1:172815503-172815533
  hypo
gggatccccaaggcccggccatggccgggg

SEQ ID NO: 68098 - DNA, 17 bp, Homo sapiens
  chr1:172902655-172902672
  hypo
atagcagacttgggccg

SEQ ID NO: 68099 - DNA, 16 bp, Homo sapiens
  chr1:172943420-172943436
  hypo
ccgtctcaaaaaacta

SEQ ID NO: 68100 - DNA, 30 bp, Homo sapiens; identical to SEQ ID NO: 39153
  chr1:173090762-173090792
  hypo

SEQ ID NO: 68101 - DNA, 61 bp, Homo sapiens; identical to SEQ ID NO: 39154
  chr1:173477004-173477065
  hypo

SEQ ID NO: 68102 - DNA, 411 bp, Homo sapiens; identical to SEQ ID NO: 26726
  chr1:173638647-173639058
  hyper

SEQ ID NO: 68103 - DNA, 146 bp, Homo sapiens
  chr1:173794930-173795076
  hypo
ccttatgtgtagaagcgaaattcactctcattatattcattatacggcagttttttttccctgagtttttagaaagaccacaaaaaggtaaccacgtaatatatagaatactctgcttttggttgatgccttaaaaaaatccttct

SEQ ID NO: 68104 - DNA, 82 bp, Homo sapiens
  chr1:173897008-173897090
  hypo
tgttgcccaggctgtcgtgttttcctgtttctcaaataaatcttttattatttttttttttgagatggagtctcgctctgtc

SEQ ID NO: 68105 - DNA, 21 bp, Homo sapiens
  chr1:173897630-173897651
  hypo
aagctccgtctcgaggaaaaa

SEQ ID NO: 68106 - DNA, 84 bp, Homo sapiens
  chr1:173993036-173993120
  hypo
gcagtatgatttttacgttgtttatttttatctcgtcaatatttcaattaaaaatacgttaaaggacagatagatgcagtggct

SEQ ID NO: 68107 - DNA, 30 bp, Homo sapiens
  chr1:17416193-17416223
  hypo
ggagcctccttaccccgtcctccatccctg

SEQ ID NO: 68108 - DNA, 30 bp, Homo sapiens; identical to SEQ ID NO: 39158
  chr1:174421982-174422012
  hypo

SEQ ID NO: 68109 - DNA, 30 bp, Homo sapiens
  chr1:17444308-17444338
  hypo
gcgcccactccctagcggtgcccagttcag

SEQ ID NO: 68110 - DNA, 44 bp, Homo sapiens
  chr1:17445869-17445913
  hyper
ccccgccgcagtgcccgcgctcgctggtccggggcggccgggag

SEQ ID NO: 68111 - DNA, 38 bp, Homo sapiens
  chr1:174956311-174956349
  hypo
tttttttttttgagacggagtcttgctctgtcgccagg

SEQ ID NO: 68112 - DNA, 18 bp, Homo sapiens
  chr1:17498377-17498395
  hypo
gcccggcctctttttttt

SEQ ID NO: 68113 - DNA, 47 bp, Homo sapiens
  chr1:175048461-175048508
  hypo
ctcccagatctaagccgccactgcagcggccacgggaccttctccct

SEQ ID NO: 68114 - DNA, 89 bp, Homo sapiens
  chr1:175346485-175346574
  hypo
tgaacagttagccatcgattttatataactgctaattaccaaattagcctgcggctctaggcagggatgggctgcgcttagaatcagtt

SEQ ID NO: 68115 - DNA, 504 bp, Homo sapiens
  chr1:175354872-175355376
  hypo
ttgtcattttacaaacgggaaacctgaggcccatagtggggaaggatttatatcaagcacagatctggttgccagtagaggtaggatgagaagctagttttcctctcctagtgagggagcgctgcttttcctgtatgctggaaacctcttgcttccttctcgcggtgtctatgacaaggccaatgctctgacacaccttgcctcattcctaatactcctcttgctgtgatgacaccaccggttggctccacccctctttccctccttgtgcgtctctcccccaccgcagccttacctgttgtgaactgagtggtggcagaatcgctctcgttggtccctcggacggcactgactgacacctcgtatcgggagccaggccgcagggcctgcactgagtattggctcaggggaggctgcagccggaaggtggtcctcccaccttccccgcccaccaggccatatttcaaaagaatgaaatcgactttggctcgagggggaatccac

SEQ ID NO: 68116 - DNA, 347 bp, Homo sapiens
  chr1:175365589-175365936
  hypo
agaactaagaaaagacgctactatcatgaatgcccatgatctcatgtaggagaaaagaaaaatgaagcaggacggggaaatggtacgtacgggtggccaccttggcagtgatgggaaggctgaggatgttgctaatgacagcgtagacgctgatgttgtaggtgagacctggctccagctccgtgatggtgacaccactccaatctccaggcacccgctgctggagctggaggccccccagggccgtcggctggtaagagatcacatattccgtcactgccatcggcccgtcccattccagctcaatggacctgtcgctgataccagccactcgcaagtcctctgga

SEQ ID NO: 68117 - DNA, 78 bp, Homo sapiens; identical to SEQ ID NO: 14308
  chr1:175372494-175372572
  hypo

SEQ ID NO: 68118 - DNA, 246 bp, Homo sapiens
  chr1:175375200-175375446
  hypo
cttttttcctttgaccgtgtgaagagatgccggggttttgctgggagtgcgttttcgctggaagtgcattggtccttcttgttcactctccctctctgctcagccctctccttcccctcctgagaccacgctgcgagctcccggactctacctgtggcagcactttcttggcagcagttggcgttgcactggtctcgcagcaccgacacctccctctccagcatctcgatccggctcagcagctcc

SEQ ID NO: 68119 - DNA, 18 bp, Homo sapiens
  chr1:175388664-175388682
  hypo
aattcctctgtggcacga

SEQ ID NO: 68120 - DNA, 30 bp, Homo sapiens
  chr1:175415084-175415114
  hypo
attatgggaaacacacggttcctgtgtgtc

SEQ ID NO: 68121 - DNA, 30 bp, Homo sapiens
  chr1:175421411-175421441
  hypo
cagcagtgaacaaagcgccctgctcgaaag

SEQ ID NO: 68122 - DNA, 30 bp, Homo sapiens
  chr1:175463981-175464011
  hypo
aggaaggatggcacacggttcttagtgtct

SEQ ID NO: 68123 - DNA, 152 bp, Homo sapiens
  chr1:175472199-175472351
  hypo
gaaaataggatgccccgccgcagtggcgcatgagtggacacaggtccatatgaacagccagtacacgttgctgaggatgactgggagaccagaggacccatggctgagggaagagaagcctccctaagatgagaaggcgcagctgaatgggc

SEQ ID NO: 68124 - DNA, 35 bp, Homo sapiens
  chr1:175861012-175861047
  hypo
aaactggaccatgagcgtcccgatgttgcttcata

SEQ ID NO: 68125 - DNA, 20 bp, Homo sapiens
  chr1:176318951-176318971
  hypo
cagcacgctgtcacctctca

SEQ ID NO: 68126 - DNA, 104 bp, Homo sapiens
  chr1:176694805-176694909
  hypo
cacatcttccacacccggttacacacacacgcacgcgcgcgcacacacacactcacgggtttagtcattttaatcataacagatttattttagtgctgaaatat

SEQ ID NO: 68127 - DNA, 40 bp, Homo sapiens
  chr1:1767616-1767656
  hypo
caatgtggagagtcccggctcctcacgcccaacaacgctg

SEQ ID NO: 68128 - DNA, 39 bp, Homo sapiens
  chr1:17679581-17679620
  hypo
gaaagctttgatgggcgggagaagcgggttggtctgggt

SEQ ID NO: 68129 - DNA, 140 bp, Homo sapiens
  chr1:17689938-17690078
  hypo
agagaagggtggggccgctcagattgcgctgcaggctgcccgctgctgcctgtgacctgaaccctcacttccctgcaggtgaacatgctggtgctagggaagcacctgggcatccccaagcccttcgggcccgtcatcaa

SEQ ID NO: 68130 - DNA, 142 bp, Homo sapiens; identical to SEQ ID NO: 26727
  chr1:177133445-177133587
  hyper

SEQ ID NO: 68131 - DNA, 474 bp, Homo sapiens
  chr1:177133689-177134163
  hyper
cgtgatgcttttgagcttgcactccagctccttggatggatccacgtcgccggcggccgtggccagcaccgccgccggcccccagcagcaggcgagcagggcgcagagcccggctaaagccatcttgagccccggccgccttcctcctagcgctgcgatggtgggggaggaagcgagcggggagggagcgagggagcgagcgcgggaggcgggggaggttagggaggggatggagagccgggagagccctggaccccggaatgagatgccgcttgcagagtcctgggtttaagctctgatgtctggagagccccggattctttgtttcccggagctgcttatctggagaagggaaagcgggggaggggggagaggagaaaaagggaaggaaggacgtcgaaaggaaagaggaagggagctgaggattctagggaatcaggtcagcccccagctggctgccggtgctcctgcctc

SEQ ID NO: 68132 - DNA, 40 bp, Homo sapiens; identical to SEQ ID NO: 26729
  chr1:177140105-177140145
  hyper

SEQ ID NO: 68133 - DNA, 28 bp, Homo sapiens
  chr1:177140146-177140174
  hyper
cgccgggctgcagctctgggatgcaatc

SEQ ID NO: 68134 - DNA, 390 bp, Homo sapiens; identical to SEQ ID NO: 26731
  chr1:177140304-177140694
  hyper

SEQ ID NO: 68135 - DNA, 481 bp, Homo sapiens; identical to SEQ ID NO: 26732
  chr1:177150773-177151254
  hyper

SEQ ID NO: 68136 - DNA, 86 bp, Homo sapiens
  chr1:17757487-17757573
  hypo
atgccaataaaataacgccgatgaaagttcccaaccatgccaataaaaatgtatttgttggccaggcgcggtggctcacacctgta

SEQ ID NO: 68137 - DNA, 37 bp, Homo sapiens
  chr1:17787462-17787499
  hypo
tggctcacgccggatcgcctgaggtcgggagttccag

SEQ ID NO: 68138 - DNA, 46 bp, Homo sapiens
  chr1:178006897-178006943
  hyper
gcagcgcggtagtgccggccgctgccctgtccggctctcctgcaac

SEQ ID NO: 68139 - DNA, 108 bp, Homo sapiens
  chr1:178063625-178063733
  hyper
ccatggagctctctccgtcgtccggaggagccgcggaggcgctgtcctggccggagatgttcccggcgctggagtccgactcgccgctgcccccggaggacctggacg

SEQ ID NO: 68140 - DNA, 45 bp, Homo sapiens
  chr1:178531753-178531798
  hypo
caacatgtcgggaaccgtaaacccttgtcgcgggggaaaagctag

SEQ ID NO: 68141 - DNA, 30 bp, Homo sapiens
  chr1:178617443-178617473
  hypo
ctttgtagaatgtcccgcaatgtgggtgtg

SEQ ID NO: 68142 - DNA, 93 bp, Homo sapiens
  chr1:17865877-17865970
  hyper
ctccccgcggagaaccggggaaggagaaccgggaggcgggaagtggggaccccggggtaggtgaaggagcgaggaggtcgccgtgtggccggg

SEQ ID NO: 68143 - DNA, 16 bp, Homo sapiens
  chr1:178665797-178665813
  hypo
gcgacagagccagact

SEQ ID NO: 68144 - DNA, 30 bp, Homo sapiens; identical to SEQ ID NO: 39167
  chr1:178857986-178858016
  hypo

SEQ ID NO: 68145 - DNA, 280 bp, Homo sapiens
  chr1:178994064-178994344
  hypo
gaattctgttcagtacgccttactgattaaatgaactatgtggcctgaagaaaaagtgtcagctcagtctttccccatcacgcatcttattccatggagtaacctgcattatatttcagggtcaggcacactaagtttgcgctttagtatatggtgaataaatggatggacacagtggcggctctgtataagtcagctgaaagcaaacaaagggaaggcagaatctttcattcacacgatttatccgcgcccactgggtgcactacggtcgggcattggc

SEQ ID NO: 68146 - DNA, 30 bp, Homo sapiens
  chr1:179050657-179050687
  hyper
gctggtgttttgctgcggtttcatttccct

SEQ ID NO: 68147 - DNA, 36 bp, Homo sapiens
  chr1:179262288-179262324
  hypo
gggattacaggcgtgagccaccgcacctggcctcaa

SEQ ID NO: 68148 - DNA, 26 bp, Homo sapiens
  chr1:179333328-179333354
  hypo
tcatgcctgtaatcccggcactttgg

SEQ ID NO: 68149 - DNA, 375 bp, Homo sapiens
  chr1:179544716-179545091
  hyper
aatccgtaccttcctcgggccgctcgctctccaacagcgccaccacctcggtgccctcctcgccggagcctcggacctcatccacgtccaccaccgtggcggcgggcgctcggggctcccccggggtccccgcccgtccggagcccgacggctcgggcccagcctcctggcgcccgcggcctccgccgctcctctcggcctttgccctcttgttctccttgtgcggagtcctgccgcctcgcccgcgggactccctggaggagctccgcgccctcctctccatcctcagagctgccgggcggctggagcagcagcgcgggagcgctaggggcacgggagcgcagtccctgtggagtcgctgcgggtccgcgtggc

SEQ ID NO: 68150 - DNA, 212 bp, Homo sapiens
  chr1:179545092-179545304
  hyper
tgcccgggggaccctaaagaccgtcgggtgggggctgagggcgaggggcgggacaccggggccgcgggcggggcgcacccggaaccccgacagctgtgtcttggtggagctgtggactgcgcccgccgactcccacggccggggcggcgctgaagcagagagaggcctgggtgggagagccggccccgggcagggtgcgggcgttgaaaagt

SEQ ID NO: 68151 - DNA, 29 bp, Homo sapiens
  chr1:179704902-179704931
  hypo
gctgggataacaggcgtgagccaccgccc

SEQ ID NO: 68152 - DNA, 407 bp, Homo sapiens
  chr1:179711932-179712339
  hyper
tgactgatctgatcccgccctgccacgaggcccgggtacccctcagcggcggggacatccaggtgtccctggatttccagggcacagtgcgggccggaaataggaacacagaggagcccttcgggaggctctcgaggcagtctctttccagtggatagcgacacaccctggtccctaagattctcatgctctccgaattttccgtcctggacccgatctgtagggcgcaaagtcccctgtactgaggcgttcccagggcgcccgcctcccgcgtttacatttcttaggcaaaaaggcagcggagctaagcaggggtgtttggaaggcgcccgttgcgctgtttgactgcgtggcttcacttggcccgcgtgcatcagcctctctggcgggggattctccccggactc

SEQ ID NO: 68153 - DNA, 144 bp, Homo sapiens; identical to SEQ ID NO: 26737
  chr1:179712410-179712554
  hyper

SEQ ID NO: 68154 - DNA, 24 bp, Homo sapiens
  chr1:179712567-179712591
  hyper
cggggcctcatcgtgcaggggagc

SEQ ID NO: 68155 - DNA, 142 bp, Homo sapiens; identical to SEQ ID NO: 26739
  chr1:179712592-179712734
  hyper

SEQ ID NO: 68156 - DNA, 345 bp, Homo sapiens; identical to SEQ ID NO: 26740
  chr1:179712830-179713175
  hyper

SEQ ID NO: 68157 - DNA, 209 bp, Homo sapiens
  chr1:179743860-179744069
  hypo
tccaggcagaagtcacggccaggacagcctgtttccacccgcagaccctggacgaactcatctccatgctgtccccactgacctcatttttagttctggctgagtgaatctctcaaggctagggagagtttccctgagcccccaggcccgtctgttccactgaaaaacattcccatagtgttaccggtagcaggtcttgactgcaaatt

SEQ ID NO: 68158 - DNA, 188 bp, Homo sapiens
  chr1:179781711-179781899
  hypo
agcctttgggatgaacgggctgggtggaatcgcagccaaattattcgcagccccgttcagcatgcgtgcggtagggatagctaataactgccccgaagggttatcgcgaggatgtagtaagatgcgtgggggtgcttagcatgatgccacacagggaggagccccgcaatcagcggcagctgttcctc

SEQ ID NO: 68159 - DNA, 30 bp, Homo sapiens; identical to SEQ ID NO: 14309
  chr1:179849955-179849985
  hypo

SEQ ID NO: 68160 - DNA, 30 bp, Homo sapiens; identical to SEQ ID NO: 39172
  chr1:180096076-180096106
  hypo

SEQ ID NO: 68161 - DNA, 30 bp, Homo sapiens; identical to SEQ ID NO: 39173
  chr1:180137119-180137149
  hypo

SEQ ID NO: 68162 - DNA, 616 bp, Homo sapiens
  chr1:180198061-180198677
  hyper
tctggaaggaaatgccgtgggggctgggggcaggagagcggctgggtcttggggcagacggggtgggcttcccgcgcctgcagcccggaggcgtcgagcgcctgatggagcgtcagaggagacctcgtcccagcgttgggccttctgttgtatttctgccagaaactcgcgttgaggagaatttgttttaagcgtttctctacctgtccatgcatctcgtaaatacagtaagcatggcaagccctttcgctggttaaccccggcgtccgtgtgctcactgccgccctgcacgcacgaggtcgcggatggttcaaagcacccgcggtggcagccggagaggcagagcgggctctagggacctaagacagggccgagctggacgactggtggcagggcggccggggaggccccgccgcggggaggtttgggccccctaccctgcggaactggaggcaagtgcggactccggctgcaggccgcggtctgcggggacgcgcgcggggggcctgcgtcccgccacctccgcgcacagcccctggtccccttccccagcccgggccggcgccgcccgccgcgtgactcgcgcgttccgggccgagtacgggctgtcccttgg

SEQ ID NO: 68163 - DNA, 44 bp, Homo sapiens
  chr1:180201524-180201568
  hyper
gacaactttgatgttcgacgtcagggagtcgctttgctaaaatg

SEQ ID NO: 68164 - DNA, 158 bp, Homo sapiens; identical to SEQ ID NO: 5816
  chr1:180202237-180202395
  hyper

SEQ ID NO: 68165 - DNA, 646 bp, Homo sapiens; identical to SEQ ID NO: 26743
  chr1:180202648-180203294
  hyper

SEQ ID NO: 68166 - DNA, 254 bp, Homo sapiens; identical to SEQ ID NO: 26744
  chr1:180203354-180203608
  hyper

SEQ ID NO: 68167 - DNA, 588 bp, Homo sapiens; identical to SEQ ID NO: 1847
  chr1:180203633-180204221
  hyper

SEQ ID NO: 68168 - DNA, 398 bp, Homo sapiens; identical to SEQ ID NO: 1848
  chr1:180204222-180204620
  hyper

SEQ ID NO: 68169 - DNA, 474 bp, Homo sapiens; identical to SEQ ID NO: 26747
  chr1:180204897-180205371
  hyper

SEQ ID NO: 68170 - DNA, 60 bp, Homo sapiens; identical to SEQ ID NO: 26748
  chr1:180206312-180206372
  hyper

SEQ ID NO: 68171 - DNA, 264 bp, Homo sapiens
  chr1:180235531-180235795
  hypo
tcggcacaaaatgcacggcctgccagcagggtatccccccaacccaggtggtccgcaaggcccaggactttgtctaccacctgcactgctttgcttgcatcatctgcaaccggcagctggccacgggggacgaattctacctcatggaggacgggcggctggtgtgcaaggaagactacgagacagccaagcagaacggtaagcagcatggccccgcatggtcccctctccaggcctttgtttgggccacgccctctgcctgag

SEQ ID NO: 68172 - DNA, 179 bp, Homo sapiens
  chr1:18033374-18033553
  hypo
gctccccctctgcatcgtgggcccttccaggtgccgggcttgtaggttccagagggtcctggatttgggagacctgggtttgagttctggctctgtcaccggtttgctgggtgatcctctgtgaatccaatcctgtccagatgtgctgcactctcgctgggttccggtactgggatgcg

SEQ ID NO: 68173 - DNA, 239 bp, Homo sapiens
  chr1:180881341-180881580
  hyper
gaatgcccctggttgcgacccccgtcccgcgctggggaaagtgatctgctcgagagcccccaggaccctgagaaccggtccccacccaaggcggcggcgggcaattccggcaccgcggcagacgggatgcgcggagcgcgttccctccgggtttccctcacgcctctggagagcgggaaccaacgaccttgacctcggaggaaacggctctacggagcgatggacggccccacagagag

SEQ ID NO: 68174 - DNA, 428 bp, Homo sapiens; identical to SEQ ID NO: 26750
  chr1:180882004-180882432
  hyper

SEQ ID NO: 68175 - DNA, 30 bp, Homo sapiens
  chr1:180885601-180885631
  hypo
caaggcagggagagccgggactccatcaga

SEQ ID NO: 68176 - DNA, 32 bp, Homo sapiens
  chr1:180891177-180891209
  hypo
ggaggctcaggagcccgcgccagggcggccag

SEQ ID NO: 68177 - DNA, 30 bp, Homo sapiens
  chr1:180896448-180896478
  hypo
agttaccccaaagagcgcatctgcccccag

SEQ ID NO: 68178 - DNA, 30 bp, Homo sapiens; identical to SEQ ID NO: 39175
  chr1:180910386-180910416
  hypo

SEQ ID NO: 68179 - DNA, 99 bp, Homo sapiens; identical to SEQ ID NO: 39176
  chr1:180925089-180925188
  hypo

SEQ ID NO: 68180 - DNA, 30 bp, Homo sapiens
  chr1:180925404-180925434
  hypo
tgccaggctgcctgccgggcctgcctttgt

SEQ ID NO: 68181 - DNA, 22 bp, Homo sapiens
  chr1:181013386-181013408
  hypo
ctgcgcccggcctgatcttttt

SEQ ID NO: 68182 - DNA, 47 bp, Homo sapiens
  chr1:181286584-181286631
  hyper
aggaaggggccatcccgcccgcaaacgagaatcgggtactccagtgg

SEQ ID NO: 68183 - DNA, 149 bp, Homo sapiens
  chr1:181286935-181287084
  hyper
tggtgggcatgtatgcgagttctctttctgattgccagaaatttcttttccactgtgtgagcaagagacagatttttttaaattgtctctcttctcttttatttattttgttctccatttgtggccctcacctccgcctgccttccttc

SEQ ID NO: 68184 - DNA, 897 bp, Homo sapiens
  chr1:181287305-181288202
  hyper
cgcatgcactgcctgcggggctgcgctgcactccccggcggcgccacgggtctggcccccgcgcttctacgtgttggggggatgcatggaccttggagatccgtagttggccctaaccttctcggaatctcctctgcacgcgctgcctgttcctcctctgcacgctctgtccgttcctttgcaacttctgtgggaattgtcctggcgtgggaaacgcccccgcgctctttggcacttagggtgtgagtgttgcgccccttgccgcagcgctcagggcagcatcccgctcgaggatgcagggttctcaccaagcagtgagggggactcacgcgccgccggggagcggagccaggctccgagaagggagcaggctcgagccgctgggttttcgcaagccttggggcctctggccgcccttccatgcctccgggcgcgggcggctcagcaggtccccggcttcgggaagttttgtgcgcggatcgctggtggggagggcgcgcgggccagtggctgagcttgcagcgaagtttccgtgaaggaaactgcatgtgcctttggaggcgactcgggactgctgtagggtggactgggtgtctatggagttgcgggtcagagcgagtagggtgggtcctttcctgggacaggactgggaattggggctcgaagtaggggaggaaagagcacagaggaagccaggctgcatagggtgacttgctttttgatccggcttgagtctccttgtgcgagagtggttgtgcgtcctttcccagggatggaacatccagttttctgtgcttttttgctttgtgcccatgtcttggagagaataatgggagacactaacccaccgacgtctcccttgagatcgcggcttcctccttgcgcagaggactgagg

SEQ ID NO: 68185 - DNA, 179 bp, Homo sapiens
  chr1:181381915-181382094
  hypo
tctaaaccttaccaacgcggcatatcattatttctttaatctgtgtcttctgcagtagactgtaagtttatgagggcaagaatccagtccactttgttaaattctggacacctgggggcccagcctggtccgccgcggatgctcctaatttcaacatcatttatcgagctccactgtgt

SEQ ID NO: 68186 - DNA, 1063 bp, Homo sapiens
  chr1:181451296-181452359
  hyper
ttggaaatgcctggccgtgttcgtggagcctgggaggtgcggaggagcggcgacgcggccatggcgctaggcgcgcaaaggccccgacaccttactagggcggcggcgggcccgtggcaccgctcccggcaccgaacagggcacagcactggggacacctctctgcagggacccaagacgcgcgtgcgtgtgcgccccacgccaggccctcgctctcttgcggagactccgccgcatcgctggctgcacctgcctctctcttctcggcattacttgggggaaaggggactcttcactggacctttgcagaggtggctgctaccctttggccacataaatcaagaaggcaagccagcctcaccttccaggaacctccagccttccggctgcgtccccgcccctcccgcctggccagctcctcccccgcttctcccagcgctcttgcgcgcctcgctgcgcctctgcgcgccgctcgctgtcctctgcctcgcctccccattctccttccgcatcttctccagtgctccgccgagggcgctgcctgcggggaagagggagactgagccgttagtgaggaagttcggtctgtggacaagtgtggtgccaggccgccgcgaggctcggctgcaacctgttcctcgcccgccggtgctcgccgcccgcccgctcgcactcccgccctctcggcggcgcagccgcggatcgctgttgcatgctgatccggggaggcggcggtggcgagcgctccgggcggatgctggcactcaggcttcgctgctctctggatgctgctcaacttctagcccaagcgcaggagctttgaagtcatttgtcccttttcgcttggatcgacttcttattttgagattttgggcattgcggtttacgcaggaacctcaatatcgctctccccacctccctccctctttctccaacctttggatgcgtctctgctggcagatataaagacccaagtcttcgcggtggaatttcttagatggacttgcaggggctggcgttataaagcatgtcatcgtaaccccgtcctcgtctttgtttattt

SEQ ID NO: 68187 - DNA, 295 bp, Homo sapiens; identical to SEQ ID NO: 26754
  chr1:181452691-181452986
  hyper

SEQ ID NO: 68188 - DNA, 60 bp, Homo sapiens; identical to SEQ ID NO: 26755
  chr1:181453050-181453110
  hyper

SEQ ID NO: 68189 - DNA, 736 bp, Homo sapiens
  chr1:181454613-181455349
  hyper
ctcccacagcaaccccggctgggcttctccctctctcctctctgcatcccgctcccctgctccactctcacagagtgatcccaggccatccattgcctgagttgaacgtatctagctagggtggaggtttcgggcgggggaggggtcgggtccctgcagtcacgcctgccggtgcgctgcacaaagcggacagatctcattgtgttgtgtgctgcggctgcaaatattcctctaggcagtctacggatttcccagctgggccctcctttctcactcggcttctacggttctctaaatcttcccatccaccaggtgctgccttgctgtgcccctctcttaggggcgtgtttattcagacaggcgccctcccgtttctttgcggtagacaaagccgcccaaccgccccgcgggtggcaaagtgtgccagcagccatcgttggcacctcggacagcgccgctgaaactcccggcggcccggggctccccagttacccgggttcagcacctcgggtacttctggccgggcccagccttggagctgagaaaccaggcacgtttcctacaccacgtggtcaccttttttcacgttttctcttccgctgcaaagacaccgcctttccaccaggcgttgcgagcgcgcaaggtgcggctgtgagtcttactcctccctttccttgtctttggccaaaaatggaccaaagagagtcaaacgggagactctcgagggagttgattt

SEQ ID NO: 68190 - DNA, 173 bp, Homo sapiens
  chr1:18152682-18152855
  hyper
agatgttctttagcccgcaggtgttcgagcagccggggcccagcatcccacgggccattgtggaatccgtggagtcctgcgagatctccctgcgccccctgctggtctcccacgtgatggcctgcgggggcaacaccctctatcccgggttcacaaagcgcctgttcagggag

SEQ ID NO: 68191 - DNA, 312 bp, Homo sapiens
  chr1:181701511-181701823
  hypo
cttggcaggagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctg

SEQ ID NO: 68192 - DNA, 44 bp, Homo sapiens
  chr1:181727256-181727300
  hypo
gagaggcacaagagccgactgagccccagcgatggttccctccc

SEQ ID NO: 68193 - DNA, 49 bp, Homo sapiens
  chr1:181767758-181767807
  hypo
gtggtgaggaggagacgctcactttcgaagcagccgtggctactagcct

SEQ ID NO: 68194 - DNA, 101 bp, Homo sapiens
  chr1:181922685-181922786
  hypo
gcatgtactatgtatcggacatcatgccaggccgtaggggactaaagaaatgagaaagacatggtccttgcatcagcggagtttttcggggggaccaaaaa

SEQ ID NO: 68195 - DNA, 238 bp, Homo sapiens
  chr1:182026109-182026347
  hyper
gcacgaaggccttcccgcagtctggacacgggtagggtttctcgcctgtgtgggtgcggatgtgcttccggtggtcggaggaccaggtgtaggccttgtcgcagaaggagcactggtagggccgctcgcccgtgtgcaggcgcctgtgctgctggagtgtgccgcggtgggagtaggccttcccgcatagctcgcacgcgtagcgcttggcggcgccgccgcgcgtctccgcggggct

SEQ ID NO: 68196 - DNA, 30 bp, Homo sapiens
  chr1:182270970-182271000
  hypo
acttggcttattcaccgtgatgctgttaac

SEQ ID NO: 68197 - DNA, 178 bp, Homo sapiens
  chr1:182584162-182584340
  hyper
agagcagcaaatatccgcggctcgccgccccgggctctgtggcaccatcagcagcttgcgcaggacacagacgtcggctcacgcgccgcagccctcggccccggaagagccgcggccgcggagcagcgaacgcgtgcctgccagggaaaagcagtcaccaggaacgcggcgttttggt

SEQ ID NO: 68198 - DNA, 141 bp, Homo sapiens
  chr1:182584403-182584544
  hyper
cggcctgcggctccggaaggcgaagctcttccaggaagcagcggcggccccactggccctctcaggctgcggagaaagggcgggaggccgcggggctctccaggactcagtggtttcggagaaactcgacttcccaggctc

SEQ ID NO: 68199 - DNA, 30 bp, Homo sapiens
  chr1:182650639-182650669
  hypo
agacacctagaatcacgcagcaaggagaat

SEQ ID NO: 68200 - DNA, 63 bp, Homo sapiens
  chr1:182758405-182758468
  hyper
ccgaagagacctgaacgccgatgggcagttgggattctccgtacgcctcggaaacagcagccc

SEQ ID NO: 68201 - DNA, 29 bp, Homo sapiens
  chr1:182807578-182807607
  hypo
gccaggcagaatgcccgccttcactgagc

SEQ ID NO: 68202 - DNA, 21 bp, Homo sapiens
  chr1:182815386-182815407
  hypo
tttgagatggagtttcgcttt

SEQ ID NO: 68203 - DNA, 30 bp, Homo sapiens
  chr1:182911546-182911576
  hyper
aggcagggcgcgtgccgggtgcctgcgggc

SEQ ID NO: 68204 - DNA, 40 bp, Homo sapiens
  chr1:182922085-182922125
  hyper
cgctttccccttcaccgggcgaggggaggccaccaccgac

SEQ ID NO: 68205 - DNA, 234 bp, Homo sapiens
  chr1:183058613-183058847
  hypo
taaaacagtttcaagcgtgattgcaaaaagtttctcctcattggaaagggacatttgatatttatctgccaaactctttactactttccaattaaagataaatttaaagaagtttctgaaatgataatgtgctttacggggaaggtgatttaactagaaagaagcttttaaaaaaatgactatttaatctataacactaaatacaccaataatttagatcgacttctgattgaa

SEQ ID NO: 68206 - DNA, 158 bp, Homo sapiens; identical to SEQ ID NO: 39180
  chr1:183129382-183129540
  hypo

SEQ ID NO: 68207 - DNA, 30 bp, Homo sapiens
  chr1:183204607-183204637
  hypo
aatcagaccagctcccgtactctttgccct

SEQ ID NO: 68208 - DNA, 448 bp, Homo sapiens
  chr1:183385871-183386319
  hyper
gaggtttttaacaagcgagcccagttcagcgcaccttttaagtttaaagatgaatatttttagcctaagccacctcgccctgtctttaccgctgtggtgtggttttcactaaacctccctaggagggctcgcgcagtcctcaggctccggataaacacgtgtgcccgcatccagctccggcgcgccctgcatttcagcaccgccgcctctggagagcgccttgctggcgggccaggtcagggcctcccacacgctctctcatccatcccagcccactcgcttttccctactcctcgcttctctcagtttcaagaaaaagcacccccaacttctaacttctcaattcctgcttctaaagtgacctccgcgtccctctttccgtgtctaaacgctcatgccccacgcctttgagtcctacgagcagctgcgaagccgcgtggcttcccac

SEQ ID NO: 68209 - DNA, 229 bp, Homo sapiens; identical to SEQ ID NO: 26760
  chr1:183386598-183386827
  hyper

SEQ ID NO: 68210 - DNA, 677 bp, Homo sapiens; identical to SEQ ID NO: 26761
  chr1:183386946-183387623
  hyper

SEQ ID NO: 68211 - DNA, 6 bp, Homo sapiens
  chr1:183387662-183387668
  hyper
cgcctg

SEQ ID NO: 68212 - DNA, 41 bp, Homo sapiens
  chr1:183462983-183463024
  hypo
ggattacaggcgtgagtcatagcacccggccactttactgg

SEQ ID NO: 68213 - DNA, 331 bp, Homo sapiens; identical to SEQ ID NO: 26763
  chr1:183774098-183774429
  hyper

SEQ ID NO: 68214 - DNA, 32 bp, Homo sapiens
  chr1:18387093-18387125
  hypo
ggctgtttatcggcacgcggcgacgcatcact

SEQ ID NO: 68215 - DNA, 30 bp, Homo sapiens
  chr1:183907120-183907150
  hypo
tagagcatcctgactcgagtggccataata

SEQ ID NO: 68216 - DNA, 1392 bp, Homo sapiens
  chr1:184005438-184006830
  hyper
tcccctggccctccccgcagcagacacagggaccaggtccaagcttctttcctccggggacaaaacttggctgtttatctttcccagggcatcttcgtctctccccgggacgtggaaccccgatgcaccggcagggacagcccggagcgctcgcaggagaccaggcccacggtggtgccatggttgggcacactccgcgggctccgcccaatctccacccctaggtccaggtccccctaggagagctaggagcacatttccagcctggagcaggagcccggcaccggaaagtcagagcagcgcactgcggcgccccagccactgcggagcccctggccaaccgcagttacgttccatctgtcgtatctacatgggaatacggcgacaggcaccctatcccctcacgtcagggctagcagtatgaggtggggaaagaggaaacctcgagagttaaaagcgagggaactgaaagtccccttgaggggtgtcccccatgccccttgtgggacaaagccccaattcgcaggctaccctccagagctccagcggtccggttctccccatcagcaccctctgcgcacactgacccgcgcgtccctccgcagcctgaccgcccgatccgccagccaccggcgcgggcagcgagggggtgtgtgcgccagattttccgcgtgcccccccgcccctccagcggctccctcgccctgcagctgctgctccgggcgctgtccgcgctgggcaggccgcccccgcgtcccgccgcggcggcccggggcccgtgcgcgctcaccagatggccatcctgctcttggggtagtccagccgctccaggcagccgaggaagtgcggcagcgtgtgcgccgcgttgcgggcgaggaccgccacgagcaccgtggggctctgcaggggcgactccgggaaaaccaccggctcctctccgtcgtcctccgagtcccgctcggcgacgaagcgcgctcggcagccttcgcggagcagggctgaggagaggagcagtagcgaccaggcgagggtggcagcagggcgcgcagccatgttccgggccgaggcgggcggcggggaagtcctggcgcgagcgcccggctgggctgcctgagggcggcggcggctgccggggagcaaggggctgcgaggggcggccgggggatgcggcttgccgcggccggccggctcacacactggcctcggcggctgcggttcccaggaccctcccgccgccgctgcaccgcccaggccccagtgcgggtgcgcagcgtacctgcagccgctggcgctcccctgcgcctcgggctcgcagacagtagtggccgaggggctgtgtgccctgagtcctgaggaaagttcctctagtccaggttccgctcgtacagctga

SEQ ID NO: 68217 - DNA, 51 bp, Homo sapiens
  chr1:18433884-18433935
  hyper
catcaggctgagtagcggggagggcgatggtaatcccggggataggagggg

SEQ ID NO: 68218 - DNA, 2 bp, Homo sapiens
  chr1:18434309-18434311
  hyper
gg

SEQ ID NO: 68219 - DNA, 65 bp, Homo sapiens; identical to SEQ ID NO: 26082
  chr1:18434751-18434816
  hyper

SEQ ID NO: 68220 - DNA, 98 bp, Homo sapiens
  chr1:18435431-18435529
  hyper
gcagggaggtatggacgcttccggggctggggagttgtgagcagctcagtgtgtgtgtgtgtgtgtgtgtgtgtgtgtcccgccgtgtggacttgctc

SEQ ID NO: 68221 - DNA, 665 bp, Homo sapiens
  chr1:18436334-18436999
  hyper
ggacattgcagggggcgggggttggaggctggggacctaaggtaagcacccctttccctgggaatgcgcagaacagagagacgcggcagggtgaaggagaggactgatgagaagggcttgttgggaaaccctggctccgtcaggaccccaccctgcgagctctccctggaacccgggagcagggttcttctggctgcccggctgcagagagctgacccggcatcctgacgcctcaaatccctttgcccgcctctgcgggctgcgggaggcgggggttggcgtgcctgagggtgagcgcatctgggccggtgcagccagcgcggcctcggagctccgctgctcaggatgaaggaagagcgcagacgcggatcgcgaatgggaaactttccgcgtctggggcgcagagggagatccgaggcagccgggagccctctcttctccgcagaggagagcacacgagggtggggtccctccttcctccttccaagtctgtgcccagaatggggggcggggtgcgagaagagtccgtgagagacgcaagaggcgggctgtgccggaggagggcgcccttcctggaggtggccgagagaggtgcacctggcagcggctttgcagggccacctgcctccgagggcgcagagaggagcaacccgcgccggccttca

SEQ ID NO: 68222 - DNA, 388 bp, Homo sapiens; identical to SEQ ID NO: 26085
  chr1:18437043-18437431
  hyper

SEQ ID NO: 68223 - DNA, 413 bp, Homo sapiens
  chr1:18437432-18437845
  hyper
ggggtctccgggattgcgcgggcggaggtgggcggccctgcgggttctcgggttctcgggttctctgtctccgcagccgcgtgtcagcaggtggatgggatggaggggctgtctccgctaggccgccgcaaccgcaacgccgagactgcgggggctgtgcgcgcgcgagcgggtgtgacgactttatatatttatcctcccttcacacgcccccttcccactgggcggggcctctggcgcggcagggtttcttctccagccccaactgggggagttaagggccctaatcccttgcaggctgcctcgcccatgcccctccagcgtggccccgcccctagccataaactccacccctcttccaccccataaccgctctgcaaatgggagtttttcattttcgtgttttaagtgca

SEQ ID NO: 68224 - DNA, 30 bp, Homo sapiens
  chr1:184442660-184442690
  hypo
agcagatgattctagcggtctttggggata

SEQ ID NO: 68225 - DNA, 30 bp, Homo sapiens
  chr1:18448183-18448213
  hypo
tctcagccattcctacgtgctcagtggtgt

SEQ ID NO: 68226 - DNA, 25 bp, Homo sapiens
  chr1:184608977-184609002
  hypo
acaaaggggcttggccgggcgcagt

SEQ ID NO: 68227 - DNA, 62 bp, Homo sapiens
  chr1:184633288-184633350
  hyper
gtccgcaggagggatcgacgcctctgtctccccgaagtgagggcgctcgctgcggagctggg

SEQ ID NO: 68228 - DNA, 23 bp, Homo sapiens
  chr1:184721182-184721205
  hypo
ggccaagtcggctttttctaaag

SEQ ID NO: 68229 - DNA, 100 bp, Homo sapiens
  chr1:184725924-184726024
  hypo
cttgctcgcctgctgctcctgagaggcaactgactggtaccagtccactgccccaggcttggggatccttgcttttatctactaacgtggatgctgtgaa

SEQ ID NO: 68230 - DNA, 122 bp, Homo sapiens
  chr1:184764179-184764301
  hypo
tgacagcaggacatccgggtttggagcatcctccaccacccactgacactcatgaatacgggctaccttgatctcctctgcattcacactggccgtggcctgggccgcgctgctttgccctc

SEQ ID NO: 68231 - DNA, 120 bp, Homo sapiens
  chr1:185073818-185073938
  hypo
ttttaaactgtacaccgttctgagtagcctgaggaaatcttgtgccgttccacttgggacatgaattatccccgtgtccagcatatctttgctgtatatgctactcgttcattagtcact

SEQ ID NO: 68232 - DNA, 160 bp, Homo sapiens
  chr1:1856211-1856371
  hypo
acctgtcctccagggcgcctgagtctcgctcaggcccagcttagctgaacccacgtccccacctgtgtcctccctgccctcaccccctctccttagagcaccctttctccatgcaacgcccgtctcgggctctgcctccaggacccgccctgagccaggc

SEQ ID NO: 68233 - DNA, 30 bp, Homo sapiens
  chr1:1857232-1857262
  hypo
aggacacagactctccggcaatcacatagc

SEQ ID NO: 68234 - DNA, 30 bp, Homo sapiens
  chr1:1857706-1857736
  hypo
tgggtcccacctgcacgcagcaggctggag

SEQ ID NO: 68235 - DNA, 67 bp, Homo sapiens
  chr1:1861815-1861882
  hypo
gtccgtgtccctctgcggcaggcgcgggggccactgggtggaggacaagccccggggggggctcaca

SEQ ID NO: 68236 - DNA, 102 bp, Homo sapiens
  chr1:186649596-186649698
  hyper
accaagcccatgtgacgaaatgactgtttctttccgccttttcgtaccccccacaaatttttccctcctctccccttaaaaaaattgcgtaagcccggtggg

SEQ ID NO: 68237 - DNA, 77 bp, Homo sapiens
  chr1:186649956-186650033
  hyper
ctccaggaatctgagcggccctgaggtccgggggcgcagggaatcccctctcccgccgccgccgccgtgtctggtct

SEQ ID NO: 68238 - DNA, 40 bp, Homo sapiens
  chr1:186797074-186797114
  hypo
caggcgtgagccaccgtgcccagcccgaaaaatgtttatt

SEQ ID NO: 68239 - DNA, 122 bp, Homo sapiens
  chr1:18703326-18703448
  hypo
acgcgggttgggagccgcctcctggacggcagcgctgagttcgacgggaaggagctggtgctggagcgggttcccgccgagctcaatggctccatgtatcgctgcaccgcccagaacccact

SEQ ID NO: 68240 - DNA, 30 bp, Homo sapiens
  chr1:187043706-187043736
  hypo
acacctgacattgaacggatgagattgacg

SEQ ID NO: 68241 - DNA, 61 bp, Homo sapiens
  chr1:1874726-1874787
  hypo
gcgagcagactccaccgcagacacgccaacacacgcagctggctcccgggtcaccgcaggc

SEQ ID NO: 68242 - DNA, 22 bp, Homo sapiens
  chr1:187755700-187755722
  hypo
ccgctcccggccatcaataatt

SEQ ID NO: 68243 - DNA, 30 bp, Homo sapiens
  chr1:18801486-18801516
  hypo
gagagaccagattggcggcaggcacgcaca

SEQ ID NO: 68244 - DNA, 30 bp, Homo sapiens; identical to SEQ ID NO: 38873
  chr1:18818951-18818981
  hypo

SEQ ID NO: 68245 - DNA, 30 bp, Homo sapiens
  chr1:1888198-1888228
  hypo
caatgagctccttgtcgagggacagctgcc

SEQ ID NO: 68246 - DNA, 44 bp, Homo sapiens
  chr1:18956211-18956255
  hyper
gtattttgcctccagcgtggggccagagacgctctttcccccgg

SEQ ID NO: 68247 - DNA, 141 bp, Homo sapiens; identical to SEQ ID NO: 26088
  chr1:18956470-18956611
  hyper

SEQ ID NO: 68248 - DNA, 875 bp, Homo sapiens
  chr1:18956738-18957613
  hyper
cggcaggaaggtagagtaagaaccggacaccggggctctgacattacacagaaaaggtcagaattcctcccttcaagtcaccctaggccggttcccggggagcctcactggaggaatttcagagggtgtaagacgagggagaagatgagaaatagggcggactctggccctcggaggccagagaaaaggcgagactccagagaggcgccggacccgaggcagacattcccatacagccgggactccgagagcagccgtgggcgacctgggggccggggactcggcggatccggcccattcatcaaaggaaggcactgggacaaagttggccccctccccttctcccccagcccccaactcgccgggatcggctccctctcttttcacggcggttcaaattctcccccaaaacgaggtcgagccggggattagaaaagagggaaaaaaatattcgttggcgatttcttttcgttattggtcctccgctcccttgcgccctggcccccttccctcctcatgaataaaagaaaagtccgaacctatcagatcgcgctcactgcctcctcctcctcctcctcctcctcctcctcgtacttcggtgaacacttttgcacaacttacccagctgatcactcgcgccccctcgcttttccatttctctttccccaaccccgtcaccccctgtctcctccgtccagccctgaaacccgaggaggctccttcttccgtctgtccccgggtctcctaggggacggggctgtgaaagctggtgtggagggagaagcgagtgtggtccggagaaagaaggcgtggagaagagggagggagcgagagcgagagaataaatatataaataaatacgagaacgaaatcca

SEQ ID NO: 68249 - DNA, 244 bp, Homo sapiens; identical to SEQ ID NO: 26090
  chr1:18957985-18958229
  hyper

SEQ ID NO: 68250 - DNA, 71 bp, Homo sapiens
  chr1:18958358-18958429
  hyper
cgcttctgcgtgggtttcactgcccggcggccttcgtttcgcaggtcgctagctgccggtctttacccgca

SEQ ID NO: 68251 - DNA, 439 bp, Homo sapiens
  chr1:18958829-18959268
  hyper
tagagaacctctaaacggcgagaggggcacggcaatgtccaaacgagaagaaagagctgattttgtaaagcgtccttcctaaacatccagcgcccgcccggggagacccgataggacgggcggcggcgaaccgggtcctggctggagaaaaggctgggagcgcacagcggagagacccgctcctgtgtttttgttctgttttctttttaaactaatggaaggcctcaacctgtcactgagggatcatttggcttctgagggtaggtagcctagggtgtcacagagaagtcattagaaatatgtgcgactttttttttttaaattactcttcctgtgatcgtttgagtccctggcgcgtgaggaaggggagaggaggcagggagggggtgggtgggctggcagcctgcgatccgggaggagctcccttgggcagcgagac

SEQ ID NO: 68252 - DNA, 121 bp, Homo sapiens; identical to SEQ ID NO: 26094
  chr1:18959269-18959390
  hyper

SEQ ID NO: 68253 - DNA, 492 bp, Homo sapiens
  chr1:18959455-18959947
  hyper
cgcagaatactgaggagagccgagtgccggtcgctaaagaggctcttgaatataaagttgggcgctcgagagctcttgagcgctaatggcatatcccgccacggagaccgagtgactccgactttgcgacgcacgatttctgattaaatccgagagtggcttcagacaccgacttttacaaagagaggtggggggaccgggagagcgagggagggggcggtaggaacggcccagcagcggagcctcttctcgcctcctccctttcaattacagtcagctccctccactcccgcggctgtgaaatcgttctaatcttccagatctccgcagccgctgagtccccaaattggggggatcgaggccggattagtgcgctgggtgtccccccaatcttctgtgaggaaattgtgtagactttgcattaaggcaaccaggcgttctcccctccccagcacacaccagtgatgcctgtcttcccggttcccaaagtca

SEQ ID NO: 68254 - DNA, 170 bp, Homo sapiens
  chr1:18960861-18961031
  hyper
ctgcctaaccacatccgccacaagatagtggagatggcccaccatggcatccggccctgtgtcatctcccgacagctgcgtgtctcccacggctgcgtctccaagattctttgccgctaccaggagaccgggtccatccggcctggggccatcggcggcagcaagcccag

SEQ ID NO: 68255 - DNA, 1220 bp, Homo sapiens
  chr1:18962727-18963947
  hyper
gaggtttagtgagttcgattagccgcgtgctcagaatcaagttcgggaagaaagaggaggaggatgaagcggacaagaaggaggacgacggcgaaaagaaggccaaacacagcatcgacggcatcctgggcgacaaaggtagggaacttccctgggctgcgaggccccagcccgggttttcccacgctccggtgtgcgggccagtggttcgctcccgccgccggagcaggcgaccagaactccagcggagaaactctcatgctgcggggcagctgggagccgctcaggctttgccgacagcgccccctcggtgcgcaccccggatgccggctagatgcgaagcccgcgccttctttgcgctatggaggccgggcacggacggcctgtgagtcccgggagagcccggctgcggggctgcgcgcctggtctaccccaatactgcggggagtgcgtcctcccgggctggcgttttggctgctactctcggcgtcgatcaattatttataggaaacttgggcaagggggcgggggacgggagggagggagagaggaaggaggagccggcccgcggctccctaaatgaatttgttaaccagacccccacacgctctctaaacggtcccttgaaaccccgcctgacagttgactgaccgctgcaatcaataaaaattagccagggccgccgcctgactcagccccgcgttgccagggcggactgggggacagagagtgccttcctctgtggcgtgcgccggcagggctgggagtggaggccaagttcccagatgcccagggtcggaggatcgcagtgggggagagacccaggctccacacaccctctccccattcttagcacggcttccgcgggcaggctggagtctgagtcctgcgccatgctttttctcaggatcagctaaggagggcgtttagttttcaagcgcccggaagcccgggaaaggggattgtgcttttgtttcttgacgggaggaagtttcgagagaaggaagggaaagtttttcctcattaccccctccccttcctcattgccctcataattcccctcctaagtctctttgagacttggtaagtgcacgttaaggggcgacagggagagaaacagaaatggaagacccagagtcacaaagactgacagttaaagaaaaggccccaaacacatacgcggagaggcggcaggctgagggaatcggaaagacagtggc

SEQ ID NO: 68256 - DNA, 231 bp, Homo sapiens
  chr1:18964253-18964484
  hyper
agcgaagggaaggggcggccattgacagacagggcccctagtgatgccgcagtcccgcccgggacaaaagggcgagggaagaaagggagccagctgtgccgggcgccccgctgtgcccggcctgccgaggggccacgggtctgcggcgggaggcagccctgcactgccaagcggtccttggctaggccagtcggcccagagccctgggacacctgccgggggacccagtcc

SEQ ID NO: 68257 - DNA, 137 bp, Homo sapiens
  chr1:18965943-18966080
  hyper
tgagtattctcagaccgttgccgataggtgcttgccccagtcaagcttggctcacctggaaagggaagtggacagttccttgcccccatgcacttagactccctcctcttcacccctttctccgaggatcaggggat

SEQ ID NO: 68258 - DNA, 30 bp, Homo sapiens
  chr1:18966326-18966356
  hyper
taagccaaaactgaccggatcagaccaggg

SEQ ID NO: 68259 - DNA, 41 bp, Homo sapiens; identical to SEQ ID NO: 26100
  chr1:18966656-18966697
  hyper

SEQ ID NO: 68260 - DNA, 129 bp, Homo sapiens; identical to SEQ ID NO: 26101
  chr1:18968003-18968132
  hyper

SEQ ID NO: 68261 - DNA, 1483 bp, Homo sapiens
  chr1:18969348-18970831
  hyper
gggggagaggtgaggcggggaaggagtccagtgagagcgcagggggaactaccagcatgggaaggggaggggcctggaggaggaagagacggggtcgagggcaaaggggaggcgggggccaaaggaaagggtgtggggaggggatgcgaagggagggggtcggctgcacttggaacttcaacctcctgggagaggaaaagcgtctgcgggtcgctacagcctcgggaggggtgaagggaagttgtgtgcgccccaagtccagctcaaaagaggccccgagggcattctagggcgccttgggcacgcgtgccaggcccccggtttggcagccgagctgagcgagggtggattgcgaggggcactggggccgccgcggagctctgcgtgtcggctgccagtgaattggccgatttccccagtctgagggtcagcgaacggacctttccatggcttggtcgccctggtcctggaggtgcgctgggcccgagctccggtggagaccaagggaggggtggggagaggcagcggagacagagagccacagaggaggagagagctagaaaattcagagtgagaaagtctgagcgcagcagaagagaatcttgcgcacagtttgaggacgctggaaaatgcggaggcgccgagggaggcgccgagcagcaggaagaaagacaaagagatgcagaatcaccgagagactggccctgggacaggcggatcaggagagccagcgggacctagagacagcccgcgggagagcacgggccgagagggcgagtgctcaaagccgggcagcggctaggggaagataggaggcgggcgagccgcggccgcccttttgatccttcgtggcttcgccttatcagaagcgctttcggtgacatccgcacaaaggcagttcatcatattacagcacgtcccggcggctcgctgcgatcctgccgcttaattagaggcgagcgagctgggccggcagggcgggagggaggccgaccccgaggcgggaggccgggttctgcgctccaacccggggcgctgggcaggggccagcccgcgtgcctggcggtgttgggacgtggagagagggagaggccgggaactgcattcagagcgttgctaaattaacaggccggcccgggcttcactgcccggagagtgaagctcgccgccttccaatttagccgccgccccttctaagttcttgggaagggatggcgctccggccactttcccctcttccaggctgcgaacgctgcggactggagggcgagtaatggggaggcaacccagggcgagctgaaggcttagtgcaactccgggtccaggtcgcacccaccagccccccgcggctgtgttccatcccctcctccgaccgccttgctctccatccgaacccaggtgtgccaggctggagcaatctgagaggggcaaagtgcatcgtggtcgaggttctactgtccatcccacccgcaactcactagcg

SEQ ID NO: 68262 - DNA, 367 bp, Homo sapiens
  chr1:18971716-18972083
  hyper
ctctggagtggcccgcgtcggcgggctgggccttgcttcgccacgggttcgagggagaggcggagggaggagcggctgggctgcggagcctcttgccttcactgcactctttgtctgacaccacgaaaagaccgaagatcaaagaggcccccgagcgggacagaaaaaggggtggggcggcgggcgcgataagtagctcggaaaactccaccctaaacttttctgggtcctttccatgggacccagaccctacagaacctcacccaagtgggcgagtgggcggccggccgtgggttctctacagtcccaagcctccgcgagggcgacaggtggagagggacagctacggctgcgggctccaattcag

SEQ ID NO: 68263 - DNA, 30 bp, Homo sapiens
  chr1:18972559-18972589
  hyper
cattctcctccctcccgctgcctgcaaatg

SEQ ID NO: 68264 - DNA, 163 bp, Homo sapiens
  chr1:18972950-18973113
  hyper
agtgaggataagagccgctcctggcctccccaggcagcaggaaattagggccgggaaagcggtttggaaactggtcagcgggtgcaggcgggcagagggtgggaggcgtcaggagttcgtcctcctccccggggcgccccctccccgccgccctctcggcaca

SEQ ID NO: 68265 - DNA, 73 bp, Homo sapiens; identical to SEQ ID NO: 26105
  chr1:18973661-18973734
  hyper

SEQ ID NO: 68266 - DNA, 30 bp, Homo sapiens
  chr1:18978567-18978597
  hyper
gcagcaagagaatcccgggcagcagcggaa

SEQ ID NO: 68267 - DNA, 38 bp, Homo sapiens
  chr1:19020254-19020292
  hyper
gggcacattcctgggcgctttctcgttcccacgtctgg

SEQ ID NO: 68268 - DNA, 15 bp, Homo sapiens
  chr1:19043052-19043067
  hyper
cctcttttctccctt

SEQ ID NO: 68269 - DNA, 29 bp, Homo sapiens
  chr1:19043114-19043143
  hyper
cgtctccctgatcgcgtcataaccctgag

SEQ ID NO: 68270 - DNA, 391 bp, Homo sapiens; identical to SEQ ID NO: 26108
  chr1:19043352-19043743
  hyper

SEQ ID NO: 68271 - DNA, 151 bp, Homo sapiens; identical to SEQ ID NO: 5351
  chr1:19043756-19043907
  hyper

SEQ ID NO: 68272 - DNA, 561 bp, Homo sapiens
  chr1:190444251-190444812
  hyper
aaaggaaggagtgaccgtcagcaataatactttaacacagagcctaagaagtcattcaacagttctaaaccctacttcgcagtcagacaaggacagtgattagggttttataaagcaggcattctgaggaatcgtcgtttactaacgttaaatatagctcattaaaataaataaatattaacgcaaaaaggtactaagagactccagagatcttaagtctattctctcatacagaagaggtttgctcaagtttggcttaggaaggttggaaatggagcattctggaaggatggaaaccccctggcgcaccccactctatggggctgcaaatgcccacaccaagcacacgttcgctgcaggggctgagtgcagagcctgagctagcaggtcagagtaggggacacctttcctacacgcatgggttattcccacatcaacaccaagcctggggccagctggtcaaccaggcaccttgctctcctccgttccctgagctcaggtggcataggcgttgccgtgagctgcggagaaatctccacgcagagtcgcctgttgataacc

SEQ ID NO: 68273 - DNA, 59 bp, Homo sapiens
  chr1:190445138-190445197
  hyper
ctagtgacctagtgacgggtgaggggcgccaagtggtgcggaccacagtctcaaccccc

SEQ ID NO: 68274 - DNA, 456 bp, Homo sapiens; identical to SEQ ID NO: 26769
  chr1:190445198-190445654
  hyper

SEQ ID NO: 68275 - DNA, 169 bp, Homo sapiens
  chr1:190447121-190447290
  hyper
tttaagagttacctgcgttgggaccattatcattaggattaatagtattccatcagtgcatttcactagtatttcccttgaacattttcacttgcagcaactgagggaggcgtagtaaggaagcccaacacaaccaattcccccactccccaaataaaccactacgacc

SEQ ID NO: 68276 - DNA, 9 bp, Homo sapiens
  chr1:190447291-190447300
  hyper
gtcacatta

SEQ ID NO: 68277 - DNA, 374 bp, Homo sapiens
  chr1:190447388-190447762
  hyper
cgagtcgctaggcgctttcgggggcgctgtgccggtgaggcttaggcaaggggacggggaaccgtggttagatgcagcagcggcggcagcagccctcccaggtcccacttctttggcgttcctgctgcctgtgactcaagacaattgacttccacctgaaccctcagctccgaacgccttgcattagaagctagagctttggaggttctgaggacggtccctggggagcaagtggtaggtttcgaggcgcccgcttcccctctgattcctgcagtaactgagagagagtgtgccagaaatggctttgctgccgaatgcattatcttgccattttcgtgtcccaatactgaacaaacgatcgcctgatcgatcgg

SEQ ID NO: 68278 - DNA, 30 bp, Homo sapiens
  chr1:190448036-190448066
  hyper
ccctccccatgggttcgctctcagagctgg

SEQ ID NO: 68279 - DNA, 30 bp, Homo sapiens
  chr1:1905791-1905821
  hypo
ccagacactgaggcccgccctgcctgcctc

SEQ ID NO: 68280 - DNA, 242 bp, Homo sapiens
  chr1:19075291-19075533
  hypo
cctgctgcttgtaagcgcttcctctgtaactcaggcgtaactgttatacattaaaagaaattaaaagcattttgaaggtttcgtgtactcaattgattgtcattatgcagctgctccaaaagggactctgaggggtgtccaagaagcctttggacctaatttagaggatcagcgtagaaactgtgtttctcttgctccccactgggtcctctagtgccaagcagctgcgaggtttctagtga

SEQ ID NO: 68281 - DNA, 44 bp, Homo sapiens
  chr1:1910323-1910367
  hypo
acaaagcctcttcttcgtgctgagctgggcgtgggaaggcatca

SEQ ID NO: 68282 - DNA, 30 bp, Homo sapiens
  chr1:19119663-19119693
  hypo
ggctgcccaagcctccgcctggccctgcac

SEQ ID NO: 68283 - DNA, 34 bp, Homo sapiens
  chr1:191390212-191390246
  hypo
aaagttagagaatgtcggccgggcacggtggctc

SEQ ID NO: 68284 - DNA, 30 bp, Homo sapiens
  chr1:1914161-1914191
  hypo
gctcggggccgcctgcgggtagggatgggg

SEQ ID NO: 68285 - DNA, 558 bp, Homo sapiens
  chr1:1914559-1915117
  hypo
cacggagagcgatcacggagggggaacgctcccctaacggtggaaagccaactaataggaagggatggtgcaactggaaactcaccccttagaagccatcacagcaggaatgaattctggcaagaaacacggagggatgccagcgctcgtgtgaaaggggacacggagcgggatttcccagcctcaaagcttctgcccacaagctacgcatcagtttccaagggaacggtgtcgctgcactgaagaagccagcggccccacagtggggctggcagccatcacgtgtcccatgagaggacacccgagggactggtcatcacccccaggggcatcgagcacgggcgctgtgcgggacagcccctggcctgcaatcctcagaaccgcaacgtccgcctgtcacagaagaaccgaggctccttctgactgggggaggcgaggggccaccctcgacacaacgccacatgggcttcaggcacggctctgggatgcggggccgaggggcacagggggtcttgctgccattctgcagctcttctgtaagttcggaattgtttcaaa

SEQ ID NO: 68286 - DNA, 30 bp, Homo sapiens
  chr1:19147954-19147984
  hypo
gagaagggctgtggacggagatagggaggc

SEQ ID NO: 68287 - DNA, 30 bp, Homo sapiens; identical to SEQ ID NO: 39183
  chr1:191565747-191565777
  hypo

SEQ ID NO: 68288 - DNA, 155 bp, Homo sapiens
  chr1:191763145-191763300
  hypo
cttactttttaatttttttgtttgtttgttttaactctccaaagtgacaatggaaacttctacttttctaaaaaaaaattaaggatatgctcccaactccgcattttggctcttgctttttgatataagatagatattctcgcattttgcagtac

SEQ ID NO: 68289 - DNA, 30 bp, Homo sapiens
  chr1:19204137-19204167
  hypo
aggagctggctcccccggttgcccaggggc

SEQ ID NO: 68290 - DNA, 124 bp, Homo sapiens
  chr1:19213653-19213777
  hypo
ggtgttggtccaaaccgcaccattttgtcagctccccgctattttgcagacctcgggccaagtgaaacatttcacaggagctcaggccatgagaaccatccggctcagccgcctgaccgcaagg

SEQ ID NO: 68291 - DNA, 38 bp, Homo sapiens
  chr1:192175514-192175552
  hypo
tcctgacctcatgatcagcccgccgcagcctcccaaag

SEQ ID NO: 68292 - DNA, 142 bp, Homo sapiens
  chr1:1935065-1935207
  hyper
gttctgcctggggggcgggggtcaaacccttccagctcagccccagggtcaaacgcatccgcccccacacccacctctggctggcctgggtcccaggttctcgggctccggaggcacagacaccccgggctgctcaggcagg

SEQ ID NO: 68293 - DNA, 58 bp, Homo sapiens
  chr1:1935231-1935289
  hyper
cgcggcgccggcggcgtggtttggggcgggcagctccatggcaacggaagactccatc

SEQ ID NO: 68294 - DNA, 280 bp, Homo sapiens
  chr1:1935290-1935570
  hyper
tggccggagggggagcctcgcccgttctgctccccggctggagcgggtggtttggtccgacccaccaccgaccgcgcgggccggggccggggcaaggaggtcgcgggccccgaggcgcggctgaagggccaggccacaggccgcggggcggggacgtctccggggtcccagacagccaggcctggcccagggccaaggcttggaggtgacagacagacttggggggcctggaggagctcagcaccggcgcgttggcccagaggaccggggcgggtgcatg

SEQ ID NO: 68295 - DNA, 188 bp, Homo sapiens
  chr1:193668360-193668548
  hypo
tgcttctgaaacagtcgtgcacaagcagcttagtgcacctgtgctaaaaaccaatggaaggcattccttttcggagactcaaatataactaaacatctagcttcattctctcaaaatgagtgtaactaattagaatagcaaaaacgttactttttattacaagactgtgttaacgcagttgctttagt

SEQ ID NO: 68296 - DNA, 126 bp, Homo sapiens
  chr1:194532864-194532990
  hypo
tataacattccaaaccgactaagacagattaatacttcaagtacaatacaatcaacatcagcatttaatctgatgaagacattttctgagaggtcttccttagcttcaccacgcataattgtgatt

SEQ ID NO: 68297 - DNA, 37 bp, Homo sapiens
  chr1:194626743-194626780
  hypo
ctaactttagtctggcgcggtggctcactcctgtaat

SEQ ID NO: 68298 - DNA, 84 bp, Homo sapiens
  chr1:194827966-194828050
  hypo
gaattcttactatgtcgggtgccggtggctcacgtctgcaatcccagtgagaggtgacagcatgctggcagtcctcacagccct

SEQ ID NO: 68299 - DNA, 981 bp, Homo sapiens
  chr1:1950396-1951377
  hyper
cccctccccacccaccgccggcgcagccagaagcagccacgcagacgtgcgaccccccacaaaccgcctcgggacgaggttctgccgcgcccgtgggccacagtgtccacgcggggcttgtgccggtgtcgcctcccatgaagacacccggagggtcccgtctgcggcgcgtgagggcagcggtcccggagagccagaccccggccagggagagctgcccgcgagggagggggcgcggctggcggaggggggcgggatggggcggggggcggggggaggagaggggagcggcgggcggggccgggctgcagggagcggcgggctggggcgggctcggggcgggctccgcgctccgtccgccccctcgcgcccgcgccgcgctcgctcagctcccgcccgcctgtgccgcctgtgcggccgccgggagccaagtttgcgcggaccccgtcccgagcccgccgcggccatggacgcgcccgcccggctgctggccccgctcctgctcctctgcgcgcagcagctccgcggcaccaggtgagcgggcggggtccgcgcggcgcggggtcgggggcggtggggggcccgcgtcggcccgagatagcggctgggagagcggccggcgcgagccccgggccccggaccccaagtctgagagccccgcgtcctccctccccggggtcttgccccgcgggcccctcgttggactcgcccggacgctgcccttgggctcgggacgcggcgacccccgcgctggccgcccccgcccggtgctgtccgccgtcctggtgctgaacctgggctgggcgagggcgtcggagcctcccggttcccctgctccgcggcgcgcgtggagggtccccgggtccgcggcactcgcgggtccctgcccggcgggtgccttgaggagaggaaagacctgagaactcggtgcggggaggctgctccctttgcgggggagccgttccccgttcccccagtgag

SEQ ID NO: 68300 - DNA, 30 bp, Homo sapiens
  chr1:1953110-1953140
  hypo
ggctgccggcacctccgtctccctggagaa

SEQ ID NO: 68301 - DNA, 217 bp, Homo sapiens; identical to SEQ ID NO: 39185
  chr1:195732322-195732539
  hypo

SEQ ID NO: 68302 - DNA, 30 bp, Homo sapiens
  chr1:1960572-1960602
  hypo
ctgcacttccacctgcggaggaaccgcggc

SEQ ID NO: 68303 - DNA, 74 bp, Homo sapiens
  chr1:1961524-1961598
  hypo
tgggctcctacaggtcggtgggggtggagacaggggagacgaagaaggagggggcagcccgctcaggaggccag

SEQ ID NO: 68304 - DNA, 64 bp, Homo sapiens; identical to SEQ ID NO: 26773
  chr1:196577371-196577435
  hyper

SEQ ID NO: 68305 - DNA, 680 bp, Homo sapiens
  chr1:196577707-196578387
  hyper
acgctgccaaggaaccgcccccaggctcggcaccgcctctggtccccaggactagggggaggcgggtataaaaagttacttcgccgaaaaagacgcgcggtgcctagaaagaggggagaggggtgggagtgagcgccgcttgatggtgaagcactttccttaaaggcagttgccagatcctcccagagggcagcctcccggctactgttccctcgggcgggcttgcatccggcacagccctgagctggcgggaatcgggggcggtgggtttcggccccagacgcggccaacccggctctccccgcaatctccctgtggagatggagctggaggcccagccaatgagactccccctcattagcatagcacagtgacggcacgggggtgccttggggacaaccaatgggggcgagctaattagcggattgcggggctccagacccttctctgggaggaggggggccagggtgcttggagtgttccactatgccacgagctccctcgctttgattgccttcagtccaggtgggcgggatgaaaaaattgcacgtttctggaaagggaatccccactctcagccccaggaaaatcccatttttttctcacattctgaaagaagggaggtgtttccctgaactcggggaaaaagaagggccaccttaggccgctgaagagaagca

SEQ ID NO: 68306 - DNA, 103 bp, Homo sapiens; identical to SEQ ID NO: 38875
  chr1:19676719-19676822
  hypo

SEQ ID NO: 68307 - DNA, 53 bp, Homo sapiens
  chr1:19683185-19683238
  hypo
cagccacagcatcaccgtggaggtcaacttgtaatgggcggtgcgaccgctgg

SEQ ID NO: 68308 - DNA, 30 bp, Homo sapiens
  chr1:197091622-197091652
  hypo
tacgctgacatatagcgtcaaatggcacat

SEQ ID NO: 68309 - DNA, 30 bp, Homo sapiens
  chr1:19739205-19739235
  hypo
ggaaagaatgagaagcgccaaggcacaagt

SEQ ID NO: 68310 - DNA, 74 bp, Homo sapiens
  chr1:1974645-1974719
  hypo
cattgccatggtgaccgtggttctggtgctgcctcctcagacgcaccagcctcgcgccgcgtctgaaataaccc

SEQ ID NO: 68311 - DNA, 30 bp, Homo sapiens; identical to SEQ ID NO: 39186
  chr1:197771436-197771466
  hypo

SEQ ID NO: 68312 - DNA, 146 bp, Homo sapiens
  chr1:197879400-197879546
  hyper
aaacgcacagattcacggctttccttcctgacactgcaggcataaaagacagtgttaaccaaagaatcatggactctagaggaattggaagatccttaacgaccacatcctcctagcagaaatttgtattctaaagtgtgagcttt

SEQ ID NO: 68313 - DNA, 55 bp, Homo sapiens
  chr1:197879606-197879661
  hyper
atgcatgtcgttaccaaatacctagaacggtattggaccgcaaagaggttaaacc

SEQ ID NO: 68314 - DNA, 1355 bp, Homo sapiens; identical to SEQ ID NO: 26776
  chr1:197879716-197881071
  hyper

SEQ ID NO: 68315 - DNA, 192 bp, Homo sapiens; identical to SEQ ID NO: 26777
  chr1:197881412-197881604
  hyper

SEQ ID NO: 68316 - DNA, 156 bp, Homo sapiens
  chr1:197882052-197882208
  hyper
ggatggaaggggggccgagaagacactgtttctcacacgtgtaggggttaactggaaactggcttcacccacatttttttgttgttgttcagtcctaacccagcgcagccgtttctgcgcctgatctcagcggacgcagtgcgggacttctccctt

SEQ ID NO: 68317 - DNA, 67 bp, Homo sapiens
  chr1:197882427-197882494
  hyper
ttggccgggaagtaccgcccagcgaaaggctggcaagggtgcgcagctggagcgtggcctcgggtac

SEQ ID NO: 68318 - DNA, 279 bp, Homo sapiens
  chr1:197885015-197885294
  hyper
ccctggcttttctcccgtcatctttctagctttggccacagttcccggtcgggctcccccgggcggagggaagcgggtctgcggccgggcggctcttgtgaggtatctaggatgtgccaggacacaggcaccgcagtcctgggaaaggcggcgggaagtagtggggaacgcaggctgacgaaggggacggaaggaacagagagcggccggcgcgtcctcctctctgggtaaagccgcgttggttcctgccgcagcgctgtgcttcggactcctaggggg

SEQ ID NO: 68319 - DNA, 30 bp, Homo sapiens
  chr1:197885683-197885713
  hyper
gggaagagaataagccgccctatggccaag

SEQ ID NO: 68320 - DNA, 21 bp, Homo sapiens
  chr1:197886252-197886273
  hyper
cgcgcgcgtgtgtgtgttttg

SEQ ID NO: 68321 - DNA, 216 bp, Homo sapiens; identical to SEQ ID NO: 26781
  chr1:197886851-197887067
  hyper

SEQ ID NO: 68322 - DNA, 311 bp, Homo sapiens; identical to SEQ ID NO: 110
  chr1:197887146-197887457
  hyper

SEQ ID NO: 68323 - DNA, 416 bp, Homo sapiens; identical to SEQ ID NO: 111
  chr1:197887706-197888122
  hyper

SEQ ID NO: 68324 - DNA, 60 bp, Homo sapiens; identical to SEQ ID NO: 26784
  chr1:197888180-197888240
  hyper

SEQ ID NO: 68325 - DNA, 30 bp, Homo sapiens
  chr1:197888441-197888471
  hyper
ggggactgtatacagcgggctggacagcgg

SEQ ID NO: 68326 - DNA, 975 bp, Homo sapiens
  chr1:197888681-197889656
  hyper
aaaataacctgtgctcgttgaaatttccttttcactcccttatcatttccgttgttttattttgtgtgcgtcgaaaaccacaatttttagcttgtaattatttgaattcggaaacgatcaccaaactgtagtcaatattttcctagtcctttttaagcgaggctccggatggctgggatgtctttaggttagtagtcccgggaggacgcgaacgccggttcaggcagacacggaagaaagcaagcgggccgcaaagagagaaatcacaaatgtttcccctgacttttgcctttgtgcagtggaccctggcccctgccgctctccctgcacaccctgggcttggtctgcctgggggagaaccccgcgtcgtgcggctacaccgcgcgccctcctcagccttgcggtgtgctttctttgcagggcatgcccccgctcagcccggagaagcccgccctgtgcgccggctgcgggggcaagatctcggacaggtactatctgctggctgtggacaaacagtggcatctgagatgcctgaagtgctgtgaatgtaagctggccctcgagtccgagctcacctgctttgccaaggacggtagcatttactgcaaggaggattactacaggtactcccctacacccccacttcctacgcccgagtacacctggaggggccatctgcctgagcccggaatcccctctccgtcccctaccttttgccccattccgggtgctgttatcatttcggagaccaggcaaacccactgcatatgccttcaagctgtaatctccctgaccgacggtgagggtgggtgggagggacattaaaaatctagagctttatcagcgaataccacgcactcccatcacttctcagcttggctggcggaacttggggaaatctggggaagagtaaatggacgtggtctccgtctaccgagacttgattgggtgtttgttttccgcttgctacgaatt

SEQ ID NO: 68327 - DNA, 288 bp, Homo sapiens
  chr1:197890549-197890837
  hyper
acaagactctgaccacgggcgaccatttcggcatgaaggacagcctggtgtactgccgcgcccacttcgagaccctcttgcaaggagagtatccaccgcagctgagctacacggagctggcggccaagagcggcggcctggccctgccttacttcaacggtacgggcaccgtgcagaaagggcggccccggaagcggaagagcccagcgctgggagtggacatcgtcaattacaactcaggtgtgcctcctatcctcacccccggcgcagccccggcctccctgagga

SEQ ID NO: 68328 - DNA, 205 bp, Homo sapiens
  chr1:198097470-198097675
  hypo
gctcaaaactactctcgtattttcagactgaactagtggttatattcatgaacttacaagtccttcagttatctgagtgatcttgtaaaagtagcttacctttctagttctgccttttttccttattcaaaaaataagttatgttgggggagcgtttatttaatatttaatcaggtgaccattatttgttcggcaatatgaagta

SEQ ID NO: 68329 - DNA, 150 bp, Homo sapiens
  chr1:198124631-198124781
  hypo
aggcactgtatatctcggtgagctgttgtatcctcattccttagaacattgcctagcccatttatgaatatttgttgagccacatgaatcaaggcctccttttgagatcgtgaacgttttcatttatttatttatttttttgagacggat

SEQ ID NO: 68330 - DNA, 222 bp, Homo sapiens
  chr1:198181340-198181562
  hypo
taaccgatgagcaaacgaaaggtgtgctgtagccacaggtgcaggagctggatgcccctgtgtcacaggtgttggaccaggagagtcatcgcctgaaagccaaagggcatatggcctgggggcagttttgtgttctgagcacaggctgcctggaattcagctagccgctgttagcaaaacactgcgggtgtgagacctgccttgccacgtacctgggagcag

SEQ ID NO: 68331 - DNA, 116 bp, Homo sapiens
  chr1:1982311-1982427
  hyper
acacgtcgtggacagcgcgggctccttccccgggaccgggtttccctggggtcggccccgcgccgcgagctcctcggcccggtcattgtggtagacgttttcgctggaaagttggg

SEQ ID NO: 68332 - DNA, 157 bp, Homo sapiens
  chr1:1986234-1986391
  hypo
ttgggtgaacttgaacgagtgcccgaccaggtaacgttgccggacctcccacaagagggcactttcttttctcccattttgtcctcattctttccagccaggtaggtcgcgcttttttctctgtgcaaggaagttgatggtggtcattttttttttt

SEQ ID NO: 68333 - DNA, 16 bp, Homo sapiens
  chr1:198918249-198918265
  hypo
ggcctgggcggaggcc

SEQ ID NO: 68334 - DNA, 17 bp, Homo sapiens
  chr1:198918546-198918563
  hypo
tgcgcagaggctactgg

SEQ ID NO: 68335 - DNA, 205 bp, Homo sapiens
  chr1:199249992-199250197
  hypo
gaaccagtaacagcacgaatagattacaattcattattttctagtcatcaggtttcacatttttgtaggttagattctaagtatatgtgtgctctttttaatttgttgtttcgtctagtattctctctaatcctgacttgttggcagacacatttggggaaaaaaaattgttgatcgtattctgtctcagcgagaccatttggag

SEQ ID NO: 68336 - DNA, 30 bp, Homo sapiens
  chr1:199360890-199360920
  hypo
aatggaaatgcataacgcagtctccctccc

SEQ ID NO: 68337 - DNA, 36 bp, Homo sapiens
  chr1:199842536-199842572
  hypo
ccacagggctgggcacggtggctcacgcctatattc

SEQ ID NO: 68338 - DNA, 240 bp, Homo sapiens; identical to SEQ ID NO: 26787
  chr1:199998199-199998439
  hyper

SEQ ID NO: 68339 - DNA, 56 bp, Homo sapiens
  chr1:199998732-199998788
  hyper
cctcaagaaaagtaccgaagaaggctctcccctggcctcagcgagactaccccaac

SEQ ID NO: 68340 - DNA, 176 bp, Homo sapiens
  chr1:200008515-200008691
  hyper
cctcgccaccgccgccgcctgcgcccttgcggagccgaaccagagggccgggacgctgtcttcctcgcctccttttttaaccctgacctcctcctcgcagcttgggggcggctccggagctgcgagaccggacagggctcagaggtcctgcccggcagccccgaggaggcggaggc

SEQ ID NO: 68341 - DNA, 38 bp, Homo sapiens
  chr1:200009412-200009450
  hyper
caccaaaagcccaggcggacacccgcagccagctcgga

SEQ ID NO: 68342 - DNA, 427 bp, Homo sapiens
  chr1:200009750-200010177
  hyper
gctaggaaaagtcaccggtgctcttccatcctcgccccttccagggtgcaggatgtgcgggccggcgggcctgtgatcccggaacgcttcctgccatccccttgcgcgaacttgaaaggactgggaggtgttgagagcagagttcagggctggtgcactctgcggtgctgagtgggcggcgcgcccgggcgctcaggccgggggacctgtagtcgccctaccgcggaggggaaaatacgtagctggagggcgtgcgccgtgcgggttgtgatccgttaccccatcggtcatcctggggtctccccaagcctctaggtagggctgtgagagtcccctagagctgaagccccggaggctgacctgtgggtctggctgctatgggaacccggttggtccaaagaagcctttcttccgggcacctggaatt

SEQ ID NO: 68343 - DNA, 427 bp, Homo sapiens
  chr1:200011257-200011684
  hyper
ccgctgggaggacctcgcctagcatccctttattaatatttcacgaaggcaggctcctgccttctctggagcctcttttctcggaatgttcccaaactctggctaactcactcccctgtgagccatcctagggctctgtggcccgggaagagacgcgtcaactccgcgggtctgcgcgcagtccttagccgcaaagtgctgcaagtgacccccctgacggccctttccgaccgaagagctcgggaaccaaagagaaaaaaaataactttattttcaaaagaacaagtcatcactgcggcgatactgtggcggaggactttggcgatggggtgggggctatttctctttcctttttggtaaacaaatcagaggaaacttctgcccggccgtggctttccatcccccacctgccccaccccctgcaaac

SEQ ID NO: 68344 - DNA, 419 bp, Homo sapiens; identical to SEQ ID NO: 26792
  chr1:200011685-200012104
  hyper

SEQ ID NO: 68345 - DNA, 30 bp, Homo sapiens
  chr1:200183084-200183114
  hypo
atgctgagagttctgcgcttccaggtctcc

SEQ ID NO: 68346 - DNA, 160 bp, Homo sapiens; identical to SEQ ID NO: 39187
  chr1:200505065-200505225
  hypo

SEQ ID NO: 68347 - DNA, 33 bp, Homo sapiens
  chr1:200519383-200519416
  hypo
tttagaggtctttggcatcgagaaaatataatg

SEQ ID NO: 68348 - DNA, 18 bp, Homo sapiens
  chr1:200588770-200588788
  hypo
gtccggcccatgtatgtt

SEQ ID NO: 68349 - DNA, 335 bp, Homo sapiens
  chr1:200860242-200860577
  hyper
cagcgagggggagggcgcctgcggggaggacagggtcgggggagcgcccttccgcaggctcctttcattcttccacttaggggtctccaggaatgaaaactggccccagccaggccagagcgcgcgaatgaaaggcggcactgggaccaagagagaagcttcgtcccgcctgggctgcggaaactggcggcgccaggggtgtcccaccgcgcgggcgtccgaaagcggggcaaaggggacagcctcgcccctcgagcggctgctcccgcagctcgctcacccctgcgggtacgtcgtcactcccgcgtgcggccccgtcccgactcttggatcgg

SEQ ID NO: 68350 - DNA, 77 bp, Homo sapiens
  chr1:200864028-200864105
  hypo
gcagcctgggagggacggcaaggtaggcaggtgagccgagacggacggacggccagcagctccgtcagctggagaga

SEQ ID NO: 68351 - DNA, 33 bp, Homo sapiens
  chr1:200870109-200870142
  hypo
atcacagaggcagcccgtcggctgtgcctggag

SEQ ID NO: 68352 - DNA, 49 bp, Homo sapiens; identical to SEQ ID NO: 39190
  chr1:200941620-200941669
  hypo

SEQ ID NO: 68353 - DNA, 5 bp, Homo sapiens
  chr1:201084226-201084231
  hyper
cgcgc

SEQ ID NO: 68354 - DNA, 184 bp, Homo sapiens
  chr1:201244242-201244426
  hypo
gtcagagggagactccgaccctttgggagcagcctgaagcccagggccttactgaacacagatggggcaggtgcccggtcctttgcttgttattggcgatcctaataagaaggcacctggcagaggctttccgcaggaggccccggccatagaaatggggtaatgcagacgggaggctctgcca

SEQ ID NO: 68355 - DNA, 322 bp, Homo sapiens
  chr1:201252494-201252816
  hyper
ccctgcccccaagagcgctggctccgcagcagcagtgccctgcagctccgcgtctgagcagcagcagcgcgcggcccggtggagtgggtggtgcagggcaggggtggtatatcctgtctgacggagggcgggcctcgccagtgccagagagggacgaaccagggtggaagcgccaggagcagctgcagggagccctcacgcggaccacgcactctatggccgtagggagccgctgagagcgagaagagcacgctcctgcccgcccgctgcaccgcacctcgcctcgcctctctgctctcctaggccccggccgcgcgccacc

SEQ ID NO: 68356 - DNA, 28 bp, Homo sapiens
  chr1:20127443-20127471
  hypo
gcgtgagccaccgcgcagccccaactag

SEQ ID NO: 68357 - DNA, 177 bp, Homo sapiens; identical to SEQ ID NO: 38728
  chr1:2013405-2013582
  hypo

SEQ ID NO: 68358 - DNA, 46 bp, Homo sapiens
  chr1:201368848-201368894
  hyper
cccctgccgggaacccgacttagcccggagacgctcaagagcaaga

SEQ ID NO: 68359 - DNA, 55 bp, Homo sapiens
  chr1:201383691-201383746
  hypo
cgctctgccaggtagcgcaccttctcagcctcgcgctcctcgtgctcctgctccc

SEQ ID NO: 68360 - DNA, 30 bp, Homo sapiens
  chr1:2013995-2014025
  hypo
gatttgtcactcagtcgatttccctggtgt

SEQ ID NO: 68361 - DNA, 51 bp, Homo sapiens
  chr1:201437613-201437664
  hyper
ctagggtgatctgggcgttccagccgggatcttccagggggcagcggaagt

SEQ ID NO: 68362 - DNA, 123 bp, Homo sapiens
  chr1:201437682-201437805
  hyper
cggtcaccagcgtgaagtagatgtggcgcccggtgctctccacgcactccacggccttgatgcgggcgaagctgagctccttgggccggccgcccgtgcccttggcctcgaagagctgcagcc

SEQ ID NO: 68363 - DNA, 73 bp, Homo sapiens; identical to SEQ ID NO: 26796
  chr1:201438552-201438625
  hyper

SEQ ID NO: 68364 - DNA, 206 bp, Homo sapiens
  chr1:201445697-201445903
  hypo
ttctcctgacctgctcgcaccgctttgatgtacagccctttgttccaggactttggggtttcctcggatctctgtttttctaaagggaaacagaaggaaaaaccctaccaaggtttcaagtctctgatgacttgggttttatgggcaccattgcgacagacttcaagtgggcagcaactctgcagccgacccgcccaggcttgctc

SEQ ID NO: 68365 - DNA, 91 bp, Homo sapiens
  chr1:201508375-201508466
  hyper
gcgagaagcggaccccgcacccgcgctgcccttggggatgcgcgactctgcgcggctgcggcgcggacccggagcccgggcgggcaggcgc

SEQ ID NO: 68366 - DNA, 292 bp, Homo sapiens
  chr1:201508694-201508986
  hyper
ctatgggactgactgcgcgtttgattctagagttgactctccgggggggctgcctaacttcagtccctctgagcctcagtttccttgttgtgaaatacccacaatttaaagtgcgttgagatcttatcatgagacaccaggtgctgcgttcttatactcgcacccacacggcaagcacacaccctacccgcacctctgcctttcgttgaagcaagagttaactcctcccatcccagcaggagccagaggaacagctggggcaggtgacctcgcgggccgttccagaaaacgt

SEQ ID NO: 68367 - DNA, 30 bp, Homo sapiens
  chr1:201583245-201583275
  hyper
gtgctgtgcagtgtccgtatctcagtgcgt

SEQ ID NO: 68368 - DNA, 94 bp, Homo sapiens
  chr1:201797447-201797541
  hypo
cactgcgcctcgccacaccctgcatttttaacacctcactggagcgctcatcctctccacctgctccgctattcaggagcggctctgcaccgta

SEQ ID NO: 68369 - DNA, 30 bp, Homo sapiens; identical to SEQ ID NO: 39194
  chr1:201851118-201851148
  hypo

SEQ ID NO: 68370 - DNA, 76 bp, Homo sapiens
  chr1:201915663-201915739
  hyper
agggctagtggaccccggctggtctaatcagcggccaataagacccgacaactgccaggcccggagaggagaagcc

SEQ ID NO: 68371 - DNA, 394 bp, Homo sapiens
  chr1:201977576-201977970
  hypo
ggcccagtgcgggggcgggggggcggggggatcctggacattaactctctcctaggcacctgggagcttcagagaggaagaaggtaaggtaagaagcagattctctgcgcaggactttcttagtcctcaggctatagagttaaagaaagaagtatctgtagaaggtggagtcaccttttgtttgagtaaccgtttcacccaccctggctgagggtggccaggaactccccaagttgtgcattaatggaggggggtcacacagatcctacatttttttgtttttgtttttttttttttgagacgcagtgattacaggtgtgagccaccggatcctacatttcaaatgcataaaaatctagatatgggctgggcgcagtagctcatgcctgtaatc

SEQ ID NO: 68372 - DNA, 85 bp, Homo sapiens
  chr1:201981114-201981199
  hypo
agttctggtcgaagacgcaggttctggactggatcagctaccaagtggagaagaacaagtacgacgcaagcgccattgacttctc

SEQ ID NO: 68373 - DNA, 204 bp, Homo sapiens
  chr1:201982388-201982592
  hypo
gtactgggactgtctcgagggcaagaagagcaagcacggtgagctccgggggcacgtgggtcctccctgcgccgggctgagcggcttcctggggcactgcgggttgttgcaggtatcccttctcccgttttctctggcctccgcatggcctttggtaaggctgtgcacaagctgggggctctatggtatcggtcaccacctaat

SEQ ID NO: 68374 - DNA, 118 bp, Homo sapiens
  chr1:201983113-201983231
  hypo
cagcaacatgacctacgagaagctgagccgggccatgaggtgagctggcggccaggaccctcacgatacagccggacatggggacaggcgctcacactcccaccgccctctttctggc

SEQ ID NO: 68375 - DNA, 98 bp, Homo sapiens; identical to SEQ ID NO: 39199
  chr1:201984047-201984145
  hypo

SEQ ID NO: 68376 - DNA, 164 bp, Homo sapiens
  chr1:201986490-201986654
  hypo
tagacaaaggggatgcgggccagggcgtaggtctagcctcagaagctggggaagctttcacagctacttagtctaaaaatgaccccatttcttggaaattatgcattagactctggtctagtttccctagccacaatatctcggggtccttgcacccttaaaag

SEQ ID NO: 68377 - DNA, 22 bp, Homo sapiens
  chr1:202025754-202025776
  hypo
ttacaggcgtgagccaccacgc

SEQ ID NO: 68378 - DNA, 123 bp, Homo sapiens
  chr1:202042364-202042487
  hypo
ttcagatgggttttacgcagtcattcaacaagcatttattgagtacctactgtgtgccaggcagtgaggacacaaagatgaaagagtcccagccctcaaagagctcgccgtctgagtggacat

SEQ ID NO: 68379 - DNA, 30 bp, Homo sapiens
  chr1:20205294-20205324
  hypo
agtcaagaacctgaacgggccaactgccaa

SEQ ID NO: 68380 - DNA, 15 bp, Homo sapiens
  chr1:202081789-202081804
  hypo
cgtctcaaaaaaaaa

SEQ ID NO: 68381 - DNA, 88 bp, Homo sapiens
  chr1:202101759-202101847
  hypo
gggtgaaggagaggccgagggaggtggagcgggaggaggtggggcttactgtgaaactgggtcaagatggcctcggatttgagcaggc

SEQ ID NO: 68382 - DNA, 248 bp, Homo sapiens
  chr1:202183428-202183676
  hyper
gcaggacccagaaaccgacgcgacgggtggggcgctacccgggccggccctaatccccttccattgttctgggagccgaggccgcctccccacttccggaccctttcagccatggagcgggcggcgcgggcaggggcgggcaggggcacggccaggcgggctggggtgggcaggggcgcgcgcgcgaggctggtccccgcccccggggccgccgcttagctcccgggtacgtgcgtgcagctaggggc

SEQ ID NO: 68383 - DNA, 30 bp, Homo sapiens
  chr1:202208039-202208069
  hypo
ccccaacagctaacacgaagcggtgcgttt

SEQ ID NO: 68384 - DNA, 139 bp, Homo sapiens; identical to SEQ ID NO: 39203
  chr1:202311995-202312134
  hypo

SEQ ID NO: 68385 - DNA, 30 bp, Homo sapiens
  chr1:20247063-20247093
  hypo
tcccgggttgtttcacggatgggtgagaca

SEQ ID NO: 68386 - DNA, 278 bp, Homo sapiens
  chr1:202611761-202612039
  hyper
catctcaaccctggacggctgcggcaaggcgggggcgctcagaaaggcagccagtcctgcaaaccgcccgtgcctccggcacacccccctctgcgccaggggctccccagtgtcgcgcgagcatggtcttccagctcctcctcagcgaggcaggcgctgcagggtcccatgcgccccgcacccacttctctccgcacgcccacttcatgcacctccccgcgcccttcccacggcttctctgcggcgagtcgccttcgcttcaccgcaggtccctggtc

SEQ ID NO: 68387 - DNA, 127 bp, Homo sapiens; identical to SEQ ID NO: 26799
  chr1:202613418-202613545
  hyper

SEQ ID NO: 68388 - DNA, 216 bp, Homo sapiens
  chr1:202678665-202678881
  hyper
cgggctgtcagcacccgccaggctgcgagcctagcccttggggacagagctgaagcagggacggggcgtcctaggtcgtgctgagtcatgagatttggagagaggggaggggcgcctccagccccttcttgggcccctgccccagctcctcgtgcccgttgcttccagatggcccctgcagtctgtctccccaacctctccctgacccagggtctc

SEQ ID NO: 68389 - DNA, 785 bp, Homo sapiens
  chr1:202678923-202679708
  hyper
cgacggcggtgccaggggtccccgaagcttgagactggggcaaaagaaccttccttggagaccgctagggctggcgggggctgggctagacgcgagtgggttcgtcccagggaaaggagagagggacgggggcgcagagccggccggtgcaggggacgcgtggcccgcccctctctgcagcaacccgcgggaggaaatctgcccccagcccagccccagtccctcagaggagccggctcctcgcccctcgggtccgactccccgagacgaaccttccatccggacgcttccaaactcccccaaaggacggggcagactcccggcccccttggcctcaaacttccccaaccctactcacctctcgggacccagaccaccccgtggcccctcgactcagtagcaggaaaggagaaactttggagagggaggtccgtgcccccaccggcgggggtatggacttaccggagagcgacccgaaggaggcgggagagatccggggtctccaatgtgagggggcgtcggacggcaaggacgcgtggctggcgacggtttcgcaggggcgcccgttcccctgggggcgcgaagtccccgctccaccgctgccccaactcggctccgaagtgcctttgccgcaagacttgctgagcttagcagtctgcgccgaggcggcagagggagggggcctgatcgatgggcgcgcgcggcgagcgctgcagtgaggggaggagaccaagcggcgtgggagggcggggaccgaggcggaggaggcccggaggaggcggagg

SEQ ID NO: 68390 - DNA, 16 bp, Homo sapiens
  chr1:202829801-202829817
  hypo
gcgcctggccagtcaa

SEQ ID NO: 68391 - DNA, 76 bp, Homo sapiens
  chr1:202840809-202840885
  hypo
tacctggctttcaaacggcggaatttctttctttctttttaaattttattttgtttcatttttttgagactgagtc

SEQ ID NO: 68392 - DNA, 30 bp, Homo sapiens; identical to SEQ ID NO: 39204
  chr1:202856302-202856332
  hypo

SEQ ID NO: 68393 - DNA, 97 bp, Homo sapiens
  chr1:202856952-202857049
  hypo
atgatagtcaggactcaattccatgtatgtttcaattccaagatccatgttctttccactgactccataatgccactaacttcgtaaaattaattga

SEQ ID NO: 68394 - DNA, 30 bp, Homo sapiens
  chr1:202861824-202861854
  hypo
ctgcgtgcagtggcacgtgcctgtaatccc

SEQ ID NO: 68395 - DNA, 30 bp, Homo sapiens
  chr1:202897655-202897685
  hypo
cctcaaatttattcacgtccattgtccaca

SEQ ID NO: 68396 - DNA, 83 bp, Homo sapiens
  chr1:202898246-202898329
  hypo
gcgcctagccctttgattcttaagggtactaaaaccatagccaagtgggtagcattctaaatttacaacgtgtccccatcttc

SEQ ID NO: 68397 - DNA, 155 bp, Homo sapiens
  chr1:202933730-202933885
  hypo
gtaatgcacctgtcccgccggcaatcattcccagtttcttcgccactcggggttctggtggagatttcttgttgggctgaatgttaaaatgccctgagaggtcaggtgaagagagcagtggaagaataaagtcaatacagcgaacttagaaaaca

SEQ ID NO: 68398 - DNA, 30 bp, Homo sapiens
  chr1:202934371-202934401
  hypo
gtttagaaggaagggcggccctggccctta

SEQ ID NO: 68399 - DNA, 149 bp, Homo sapiens
  chr1:202936921-202937070
  hyper
ggcgtgagccatcgcgcccggccccaagatcttttaagaccgcagctccagcctctcctcccagcgaggtggtccctgccacttcgacccgcttatatccgaactggatgggagttctgcctaaggtagaaccacgctaaattggggga

SEQ ID NO: 68400 - DNA, 79 bp, Homo sapiens; identical to SEQ ID NO: 39207
  chr1:202995301-202995380
  hypo

SEQ ID NO: 68401 - DNA, 394 bp, Homo sapiens
  chr1:202995837-202996231
  hyper
tcgtctatcgcacctcgggaaacagccctttttgactccgtatgtgctacctccggcaggcgtcggtactgcttaccctgccgcccctcgccctcctttgcggtgccctgtgcccttgggggtgaggataggggcgatgcctgatctgcggggagggcgtggagtgcgccctctgctccatcggcttcaggggagggggccgagttggcgagtctcccggtgggaacggagcagactgcgcccccatttcccctccaggagagtcagaaaaagcgcctctcggctccggggccaaccccactcctttggggacgcgattctgatgggctgaggtcttcgctcttcgcgggggtcttaatctttcccgagttgctcatagcacccctgttcctgt

SEQ ID NO: 68402 - DNA, 15 bp, Homo sapiens
  chr1:202996304-202996319
  hyper
cggtggggtggaagg

SEQ ID NO: 68403 - DNA, 262 bp, Homo sapiens
  chr1:203086936-203087198
  hyper
tcagctgaagccttgcgcagtgctccgccaggcgctataatgctgagcccagctatggctcctccttcttctcccttccgcgggaacccagcacctagcgcggcggagcagggaactcaggctgcgggactggggtctggccctgcccagctcctcgcccacgcccaggcttccgttaggccagcagggggaccccgagccccggacaacagccctgagctgggcggctgcttctggctctagatcccgctgctcagccgat

SEQ ID NO: 68404 - DNA, 659 bp, Homo sapiens
  chr1:203096850-203097509
  hyper
gtcactcagctcctgcgccgggggcgacagagccgcaggcgcccgagtcgagtcccagccagctaccatccctctggagcttaccggccggccttggcttccccaggaatccctggagctagcggctgctgaaggcgtcgaggtgtgggggcacttggacagaacagtcaggcagccgggagctctgccagctttggtgaccttgggtaagtctgagtctcggttcacccctggggctccccaatgggggtgcaggagagggttgaaagaagagaccggaatgcccccttggggcaggccatgggcaaggttccccgacagagctggaacgggaccagaggactgctaagatccaggcaccagacgggtctcaagtgggtgggcgcagggcaggtgcgggcacgctggggaatagggagaaacgccccagccttgtcctgggctccgtccccagacccacgtctgccaccccagtcccaggtgcgaaacaggggcgctacctctttaaaagcgtccggggctgagtctctgccgtaccatgtgattgcttgaaaggccgggctgggagcgctgcggcgggagccggaggactatgagctgccgcgcgttgtccagagcccagcccagccctaccgcgcgcggcccggagctctgttccc

SEQ ID NO: 68405 - DNA, 40 bp, Homo sapiens
  chr1:203236950-203236990
  hyper
ttccagcccctgagccgtggcctgccgttctcttccccac

SEQ ID NO: 68406 - DNA, 30 bp, Homo sapiens; identical to SEQ ID NO: 39208
  chr1:203257678-203257708
  hypo

SEQ ID NO: 68407 - DNA, 267 bp, Homo sapiens
  chr1:203298174-203298441
  hypo
ggggcatttcagtgacgcctgacggcgaggtcagggaagagggtaaggaacacacaaagatgggatacagttcaatggggagccagtaagactggggttctggggttcagtcttgagtctgtgcctttagggagacaagtcaattaaacgtgctaggtcccagttaccctgtcttgtaaagtaggctgtatcatacctgtatccttaccgcatagatgtgtcagggaaagaaatgtcatagaagtgaaagcactttatattttctgg

SEQ ID NO: 68408 - DNA, 85 bp, Homo sapiens; identical to SEQ ID NO: 39210
  chr1:203429564-203429649
  hypo

SEQ ID NO: 68409 - DNA, 20 bp, Homo sapiens
  chr1:203764131-203764151
  hypo
gccaccgcaccggccacgtg

SEQ ID NO: 68410 - DNA, 18 bp, Homo sapiens
  chr1:203832761-203832779
  hypo
taacgtttccacttttat

SEQ ID NO: 68411 - DNA, 38 bp, Homo sapiens
  chr1:203911836-203911874
  hypo
gattcaggacagggccgggcgtggtggctcacgcctgt

SEQ ID NO: 68412 - DNA, 68 bp, Homo sapiens
  chr1:204042624-204042692
  hyper
cggacccagggtggccgtgggtccgcagcgactccccggccgacggcggggggcgtgccccctcccag

SEQ ID NO: 68413 - DNA, 30 bp, Homo sapiens
  chr1:204042936-204042966
  hyper
cggctctcttccctgcgagtttccaccctg

SEQ ID NO: 68414 - DNA, 40 bp, Homo sapiens
  chr1:204044387-204044427
  hyper
ccgcggttgtgctttcggactcgtccgacgcggcgccagc

SEQ ID NO: 68415 - DNA, 407 bp, Homo sapiens
  chr1:204120648-204121055
  hyper
cgaggactgggtccccgcatccccctggcagccctggcaggaccccatcctcggccccgcgcccactccgctaccttggtccgaacttgctcgggtttccaatgcggccgcagctcctggatgaggcgcagggccccgggaaggatgtcgtccgggtccacggaaatgccgaagtacgcgacggcggcggccctcggggggcccggcggctcccggcagctggcgctggccgccgccttctcctccatgccccatgagcactgcgggcaaggcgtgtgcctcctcaggtgaaaggacgcgcgcggctgaggggccgaagggggcacagccattcccagcagccccaccccctcggagccgcggcagacgctagccccggcgggggggtccggcgagggagtgggagt

SEQ ID NO: 68416 - DNA, 81 bp, Homo sapiens
  chr1:204159610-204159691
  hyper
ctcagccccgcccagcgcttctgccgtggttccctggtgccgcctcccgcttgccgaagcgcaggccgaaggagttccagt

SEQ ID NO: 68417 - DNA, 30 bp, Homo sapiens
  chr1:20416390-20416420
  hypo
aaggctggggcttcccgttcgggccattgg

SEQ ID NO: 68418 - DNA, 38 bp, Homo sapiens
  chr1:204333521-204333559
  hypo
aggcacacatgaggccgccttcccgcttgctttctatt

SEQ ID NO: 68419 - DNA, 30 bp, Homo sapiens
  chr1:204333856-204333886
  hypo
taggctactggttctcgaagtgtgggcccc

SEQ ID NO: 68420 - DNA, 30 bp, Homo sapiens; identical to SEQ ID NO: 39213
  chr1:204535867-204535897
  hypo

SEQ ID NO: 68421 - DNA, 30 bp, Homo sapiens; identical to SEQ ID NO: 39214
  chr1:204536295-204536325
  hypo

SEQ ID NO: 68422 - DNA, 162 bp, Homo sapiens
  chr1:204586294-204586456
  hypo
ggattattttcctttcgttcctttcccccgtattattgttattatttatttttattttttacaaaacaggagaaaagagtgaatcgggttgggggaggtgacacatttctccacaaaggtacaaaattgcctatagaaagtcagcttcggaatgccgagccc

SEQ ID NO: 68423 - DNA, 153 bp, Homo sapiens
  chr1:204587558-204587711
  hypo
ggctggaggagagcacggcccacaaccacactaaccgtcttagtgtcagcccccaccaggttctgggccacacaggtgtatagccctgcctcttctgctgtcaccctccgcagctccagggtcccctcggggtacacccggtacctcctgcct

SEQ ID NO: 68424 - DNA, 30 bp, Homo sapiens
  chr1:204588003-204588033
  hypo
agcggatggggttgccgtggagacctacct

SEQ ID NO: 68425 - DNA, 112 bp, Homo sapiens; identical to SEQ ID NO: 39216
  chr1:204588271-204588383
  hypo

SEQ ID NO: 68426 - DNA, 30 bp, Homo sapiens
  chr1:204589092-204589122
  hypo
gcaagagtggggccacgagaagcctcatgg

SEQ ID NO: 68427 - DNA, 30 bp, Homo sapiens
  chr1:204643879-204643909
  hypo
ccaggacaaagaacacggacagatctgagc

SEQ ID NO: 68428 - DNA, 130 bp, Homo sapiens; identical to SEQ ID NO: 26808
  chr1:204653466-204653596
  hyper

SEQ ID NO: 68429 - DNA, 426 bp, Homo sapiens
  chr1:204653792-204654218
  hyper
cgcttccccctgaccgagtccccaggctgagccccaggccggcccatcccccaccccaaaggtcccatcccaggctgcggtcggaccccagccagccggcccgggaggagcctagctcctggttccagatacttcagacagacccaaggccaccttgtccctccgcacagactcgcgagctccaaggaggagaaagtccccaggctctggagcgcttccagcctgccagtccgcccgtgtcacgccctccctaacctcactgccacctctcggctcctccacatctccagggccccactctacccagcaacagtttgggggaggttctggcctctccaggcgaaggcccaggcgccctctccctggccgcttctgggcattctccagccctccgtccctctgcccctcggccgcctccctctccca

SEQ ID NO: 68430 - DNA, 194 bp, Homo sapiens
  chr1:204654575-204654769
  hyper
gggaggctcggcgggcgccctccccaacgtggagttatcctgggagcggctccagggcccagccggtgagggcgatggcagaatcccaatccgtccccaccccctctccgcgccctgggcgcgtcgcggccggaggctggcgggcgagagccaggcgctccttgagagcgccgcgcgttcgcaggtgcccggag

SEQ ID NO: 68431 - DNA, 74 bp, Homo sapiens
  chr1:204721208-204721282
  hypo
gggtgctgctgtagccgcccaacccgcagctacagacccacgcctcctgctgtatggagcgggcaggaacccca

SEQ ID NO: 68432 - DNA, 564 bp, Homo sapiens
  chr1:204797757-204798321
  hyper
ggcgcgccggccgcccggggacgcgcacgggctggtctctgccctaatgcggcggctggcggcgagaggcgctgcaggggacgcgggggaagtggcggcgccggcagcggacagctcggacagcgcccagggccggagcccgagcccttggaggtaggcgagcgcgaacaccggagagatgggggtagagagtcatggaaacccacctagcgacacccccttgttcccgccctcgtctgtctccatcccctgacctgccccctccccctccgtccacattcccatcccttcccctctccacactgtcacctgccccgaatccatccgattctgttcgtatgcccaccccgtccccgtccagctcccagccccctgcccaccccaacaccctttctatctcgttggccgcgtcccctcccccttcccgcatcctcaaccctttccctttcctctctgtccccgcctcatccgtgagccctgcctgcccttgtacttctgtttacctcgacaccccactttggatgaccccatgcctcctgtatttcctaccgcacacatcagccc

SEQ ID NO: 68433 - DNA, 25 bp, Homo sapiens
  chr1:20492314-20492339
  hypo
tgtgcgcgcgcgcatgtgtgtttag

SEQ ID NO: 68434 - DNA, 30 bp, Homo sapiens
  chr1:20498645-20498675
  hypo
gaaagactactgtcccgtgcctccaaatgt

SEQ ID NO: 68435 - DNA, 46 bp, Homo sapiens
  chr1:205043046-205043092
  hypo
tattttatattctgccgcaggatagaacccacgcaaggattttctt

SEQ ID NO: 68436 - DNA, 205 bp, Homo sapiens
  chr1:20512345-20512550
  hyper
agagagaaacagaggcggtgacgctaggaagaggaggagagaaggaggccgcgggtccctgtcgcctccaggccaggcaatccactccaggctcgcaatccaccgacctggagttcacggcctccgccctcctggcccagcggcccccacccgaccccacccgaccccacccgacccaggccggttccggtcacgccggaagcac

SEQ ID NO: 68437 - DNA, 248 bp, Homo sapiens
  chr1:20512551-20512799
  hyper
tggccccccaccctgcggcgttgcccgggagaccagggttgtttaccagcaggacagagcccgggcgcaggcggcggatggagcggaacggctaggtgagagcggctgcccgatcccgcggcctgcccttggcctccgccaggcctggaaggggccgggggaggccagtccccgagaccccagcacatcacccgggagggcctccccagacccagcccgggggacgcaaaccccgggagacaggcgag

SEQ ID NO: 68438 - DNA, 145 bp, Homo sapiens; identical to SEQ ID NO: 39218
  chr1:205310661-205310806
  hypo

SEQ ID NO: 68439 - DNA, 24 bp, Homo sapiens
  chr1:205311046-205311070
  hypo
gattacaggcgtgagccaccgcgc

SEQ ID NO: 68440 - DNA, 434 bp, Homo sapiens
  chr1:205312478-205312912
  hyper
ccaatcaccatgatccgcttccccagggcggtgacggccacccccgcccgggctgtgggcagccggggcaaggcggtccactggtcggcctccggggagtagacctcgaagcagtccatggggacgccgttgtcgtcacatcccccgatggcatagacctggcccccggtctccagcagggagcagtagacccggcggctgggcagtggcgccaggcgcttccactggaagtccttgacgttaggcacctccatggcagccttggggagcgcccgggcgccgggagaggtgcgagcgcgggggtccaccggctacttggcgccggctcccacggcccctatcgccacctccatctggctcccgagcgccggacccagccagaccccggccagtgcttcaccgtgccccgagtctcagcggtccggcggcgtcca

SEQ ID NO: 68441 - DNA, 45 bp, Homo sapiens; identical to SEQ ID NO: 26814
  chr1:205312961-205313006
  hyper

SEQ ID NO: 68442 - DNA, 29 bp, Homo sapiens
  chr1:20534652-20534681
  hypo
acagagtgagaccccgcatccaaaagaaa

SEQ ID NO: 68443 - DNA, 482 bp, Homo sapiens
  chr1:205399652-205400134
  hyper
tcctggaatgggatgcgtggttcccatgagacaggagaaagccgcccatcaccgtggagaaccaggaatggcagaccacgcggacgccaacagtttacgcagctccccagctaggtgcaaagtggccaaaggaagagccggtcttccacacgcacacctccgcgcccacactgccccaggagcttcccactcagccgggggacccccaagcagccggcgaggcgcactgcgcacgcgcactcaggccgcggctccagccgccctccctccgcagtggggcgccccgcccccgcgccgctcagttttaaactcgcagcagacggaactcgacttaaaaataactattttgacagttcagatgtaaatatgtgagtgacgcgtggggctgtttttccttcacacttcccctcacccctcgctccctaccccagctcaattcggctgaggctgagatgatgggagagcgccgtctgcaggatgct

SEQ ID NO: 68444 - DNA, 1182 bp, Homo sapiens
  chr1:205424654-205425836
  hyper
ggggtataaaggaaacggaggaggcactccaagcgggtttcactcagcggggacaggaggatcggctacctccggagccaaggctccctctcacactccccccaatcccaccagcggcaaaatcctttaaaaggaacaaaggcaatgggggcggggagggggcttcctctttggtcgacctagggcggcggctgacgcagcccgccgccggtcagctttcaggtgagtgcctgaacccgcatcccgcccatgccttagggacccctcttcgcccagccaagcccggggcggggaggaaagtccccctcagccgcactcgggcccccaacccggccaaggggtcgccaactcgcggcactttctgcctgtttgttttcgctcagtactcacagtttagatgctaagccggctcctcttgcactcacttcctttgtgtctctctctctctttctctctctctccccctcaccaatctctttcttccctccttgtccgattctctgctgtagcttccagtggagaaaaataattattcttcaatgggttagcacggggcgcacgcacacacgcgcgcgcacacacaccccgccgaggtacccaatcaatgcacaaatcttcggggtccctttaacctctgcggatgactccgggagttaattatgaagcctatttcggcgcggcataaatatgcattaaggtaggaaataatcgatacgctgaacttctgggaactggcatttagacggactccgtctcgccgccccccactccctccatggccccacgagccacctccacagcctcgcgccttcccggggtcgcaacgcctatcacaagcttctacccgggtttcagggggcccctgtagtggcgtgggcgccgcgccggtgccgggagaccccctcgtgcgccctctgcggtcggggcagaccctcagccggagcttcttcctcccccacccctgcaggccgggcccaagctgcgacacccccagcacgggctcagcctgtgaacaaactccgagctcagtactcggaggaactggcgagagcgggacggctacctgcccgcacgcccgatttccgggcacagctagaaagaccgggacgcgattcaactcccaatccggtgaatccgcctagcgccttcgggtcctgccgcccccggccagtcccgacccgc

SEQ ID NO: 68445 - DNA, 101 bp, Homo sapiens
  chr1:205425896-205425997
  hyper
atatgcacaccctcgcgcacacagacactcccgcgcgcgctcacgcccgcacacactcagggttataacaaaggaagaggggccagcgctgccttactttt

SEQ ID NO: 68446 - DNA, 30 bp, Homo sapiens; identical to SEQ ID NO: 39220
  chr1:205548923-205548953
  hypo

SEQ ID NO: 68447 - DNA, 413 bp, Homo sapiens; identical to SEQ ID NO: 26111
  chr1:20618140-20618553
  hyper

SEQ ID NO: 68448 - DNA, 327 bp, Homo sapiens; identical to SEQ ID NO: 38729
  chr1:2066352-2066679
  hypo

SEQ ID NO: 68449 - DNA, 150 bp, Homo sapiens; identical to SEQ ID NO: 26112
  chr1:20669698-20669848
  hyper

SEQ ID NO: 68450 - DNA, 69 bp, Homo sapiens
  chr1:20669896-20669965
  hyper
cggaactgcgcccctcccgcggacggcctccggaggacagccccgctccacagccgctcccccttcccc

SEQ ID NO: 68451 - DNA, 105 bp, Homo sapiens
  chr1:20692819-20692924
  hyper
gtcggtccccactcccgacgggcctcgcattcctggtcctccaccttctgccaagaccctgcccacgcttcccgcaccagccttaggtcccgaggtccccaactt

SEQ ID NO: 68452 - DNA, 30 bp, Homo sapiens
  chr1:20693939-20693969
  hyper
gacctccagccagatcggtctcctctgacc

SEQ ID NO: 68453 - DNA, 361 bp, Homo sapiens
  chr1:207200818-207201179
  hypo
ggagggagagtattacgtacagatccagagcgggtggaggtgctgctcatcatgctgtcacagctgccgacacgggtcacgggttctgagccagtccccgctggccacagctccctctcgggcatcacccgaaacaaggtgcagggatggcaaagggggcttctagaggggaagcgaggggaagtgaacaatgtcccaagccgggcctgaaaagagaagaatcaaagccacacatgagccgaggcttcggcaaggctctgcccaggccctgggcggcatggcgggaaggacaccaagcaagcagagagctggaaggggggcatgaacagccactgcccgacacccccggcctgcatggaag

SEQ ID NO: 68454 - DNA, 216 bp, Homo sapiens
  chr1:207224789-207225005
  hypo
acttgtgactagactcgtggctgcattaaacattgactcattggggttccaggggccaaaagactggcctttctgcctccctgggactgtgcttgaaaacgtctatttgccacttcagaaagcacagtatgaggtcagcatctgggcccagggcagctgcctcattcaggtggtggcagtgtaaggaggagtcgtgtaacgcgtgtcatcagattc

SEQ ID NO: 68455 - DNA, 39 bp, Homo sapiens
  chr1:207225631-207225670
  hypo
cttggttcttcaagacgactgcaacggatgatacagcct

SEQ ID NO: 68456 - DNA, 77 bp, Homo sapiens
  chr1:207227177-207227254
  hypo
ttcagggaatatgttcgagattttcccacgtccctcacttttttcttttctttctttctttttcatttttcattttt

SEQ ID NO: 68457 - DNA, 44 bp, Homo sapiens
  chr1:207477842-207477886
  hypo
gatccctccattcggggttcctgacttcccgcaatagctggatt

SEQ ID NO: 68458 - DNA, 87 bp, Homo sapiens
  chr1:207567724-207567811
  hypo
cgcccggcctaaaacagtttcttttgtcttaagttttcatttctacgttcgtctgtcttcattcagtcttgacggtctcaagtaata

SEQ ID NO: 68459 - DNA, 29 bp, Homo sapiens
  chr1:207590078-207590107
  hypo
gaggcaggcggatcacgaggtcaggagtt

SEQ ID NO: 68460 - DNA, 25 bp, Homo sapiens
  chr1:207598909-207598934
  hypo
ccaaactcaccgagtcatgcaggct

SEQ ID NO: 68461 - DNA, 603 bp, Homo sapiens
  chr1:207627530-207628133
  hyper
ccgcccacctcgtgccgggccgtccctcccgcttgtcccaccctcaccggcgccgcgtcagcccccaggccgcctgcaggtgtgcgctcagaactagcacgtgtgccggacactatttaagggcccgcctctcctggctcacagctgcttgctgctccagccttgccctcccagagctgccggacgctcgcgggtctcggaacgcatcccgccgcgggggcttcggccgtggcatgggcgccgcgggcctgctcggggttttcttggctctcgtcgcaccgggggtcctcggtgagctgggagggggagcacggaggtggggacgcgtcccgggcagggaaagtttctgtgccgcgatgcaaagcagggggccaaaagcgagacggtgggggcagtgctcgacgcgtgtccgcctcccgctagctttgagggaccactgcaataaaccgcctggtcctgattgtccccactggcccctccgggagctgggacctccagaattggaggctgcgccacagaggggcgctgtctggtcggcccggtgtggctggcggcgtgcgggtgctcgcggtctcctgccgggctccccgcccccaggattct

SEQ ID NO: 68462 - DNA, 32 bp, Homo sapiens
  chr1:207648482-207648514
  hypo
atcatgaatggtagtcgcgtgattaggtgtca

SEQ ID NO: 68463 - DNA, 30 bp, Homo sapiens; identical to SEQ ID NO: 14325
  chr1:207656486-207656516
  hypo

SEQ ID NO: 68464 - DNA, 15 bp, Homo sapiens
  chr1:207669258-207669273
  hyper
cagggtgtttggagg

SEQ ID NO: 68465 - DNA, 467 bp, Homo sapiens; identical to SEQ ID NO: 26819
  chr1:207669321-207669788
  hyper

SEQ ID NO: 68466 - DNA, 288 bp, Homo sapiens
  chr1:207669828-207670116
  hyper
cgcgcccgggtccgaaggcagcgcgatgggtgggctgagcgcgcgacccggcagggcggcgggtgtaggatccttctgcgcactggagaccctcgctgcttctgggtaagcgtggagttcccaggtgcaggggcttaagtcgtgacgagcgcagtggaaggcgcagatgctgagcgggtgccgcacgaaattccttgcctttgtgtattcacagcctcggctggctatagccaagacgtggcgttgatcctagtgaaagggaacttggggatccgacaaacctgagtt

SEQ ID NO: 68467 - DNA, 30 bp, Homo sapiens
  chr1:207760894-207760924
  hypo
gaagacaactgtagacgtgagtaacccctc

SEQ ID NO: 68468 - DNA, 29 bp, Homo sapiens
  chr1:207786426-207786455
  hypo
gcttctttgtacctgcgtttggtgggtcc

SEQ ID NO: 68469 - DNA, 137 bp, Homo sapiens; identical to SEQ ID NO: 39225
  chr1:207787630-207787767
  hypo

SEQ ID NO: 68470 - DNA, 71 bp, Homo sapiens
  chr1:207818268-207818339
  hyper
aggggtgctagcccacgataaccccctgccagggctctggacacgccctgtctcctcgaaggccaacgggc

SEQ ID NO: 68471 - DNA, 24 bp, Homo sapiens
  chr1:207829567-207829591
  hypo
gcgagattccgtctcaaaatcaat

SEQ ID NO: 68472 - DNA, 30 bp, Homo sapiens; identical to SEQ ID NO: 39226
  chr1:207857205-207857235
  hypo

SEQ ID NO: 68473 - DNA, 171 bp, Homo sapiens
  chr1:207911135-207911306
  hypo
gaggaatctggtggccgtaataaccggggaacagatgagctggaggcctcatcaggaggggtgtcccttggtggaaggacaccattcccggccttaaaaggagaggctccagcacggctggggaagcatgtggataccttgtaataaatccactgtcgtagctcattcttg

SEQ ID NO: 68474 - DNA, 38 bp, Homo sapiens
  chr1:207921798-207921836
  hypo
ctccactccttaaaaccactccacgtgtgcccatctcg

SEQ ID NO: 68475 - DNA, 99 bp, Homo sapiens
  chr1:207991495-207991594
  hypo
tgtccctctgccccacgctccagcagagggggtagagaagagaaaggggaggacggtttgtccgcattcagtggcagtggaggtgcatcttctctctcg

SEQ ID NO: 68476 - DNA, 99 bp, Homo sapiens
  chr1:207991654-207991753
  hypo
ggcggggcggggcgggacgggacgggacggggcgggacggggcggggcagggcggggggatcacgcgcctatagcgcaaagctgcggtatggagaaaag

SEQ ID NO: 68477 - DNA, 30 bp, Homo sapiens; identical to SEQ ID NO: 39229
  chr1:207992298-207992328
  hypo

SEQ ID NO: 68478 - DNA, 15 bp, Homo sapiens
  chr1:208083989-208084004
  hyper
tcctccccagtctcc

SEQ ID NO: 68479 - DNA, 652 bp, Homo sapiens; identical to SEQ ID NO: 26822
  chr1:208084031-208084683
  hyper

SEQ ID NO: 68480 - DNA, 244 bp, Homo sapiens
  chr1:20810594-20810838
  hyper
accccaggtaagtcccgagcgcagctccggtgggcaaggctaggtgcggagatgagcggaaccaggaggggacgccaaaaccggttcccacgacgcgcagcgggtgggggttagggcctggcctgggcgggcgccccctcctgcgcgccctctcccagccgctggccgactgactcggccgccccgcgctccccgctgccgcagaggtcagagcctcccttcgctgcctgccagggacacatgc

SEQ ID NO: 68481 - DNA, 66 bp, Homo sapiens
  chr1:20810864-20810930
  hyper
cgacttagcctcgcctttctcagtccctccatcgtccctcggcgcgacggccggcagccgatcgag

SEQ ID NO: 68482 - DNA, 469 bp, Homo sapiens
  chr1:20811286-20811755
  hyper
caccctagccttccccgcaggaatgggatcctccccacgcaggtccccacgccgtcccctgggggtccctgggaccccctccccacagggttatggagcgagtgcagctgtgactacactgcgcaaaaggcgggggtggggggcgcaaatcaaaaagcaaactttgccgcgcgggtggagacccccagctgctgctagaagccgccacgcccccagggtgacccagccggggatccggcttagggggacgcgttcctgcgacccgcttcagccggacccgcagtgcgggatcccccaattctgcaagaagggattccgtcaggtctgaacgggctccagcgggtgggagacctccgcaacccttgttcaggccgcggcgcgggaaaaagggggtgtcagacaagggggccgcgaactcaccccgcttgctccggccgatctggcccagcttgggcggccgcttgttctg

SEQ ID NO: 68483 - DNA, 54 bp, Homo sapiens
  chr1:208136458-208136512
  hyper
tgtttttcttctcatcggtgcctggctgagctctggaatcgtttcctgctctga

SEQ ID NO: 68484 - DNA, 30 bp, Homo sapiens
  chr1:208281203-208281233
  hypo
cttctccccaggacccgcagtgctgcttca

SEQ ID NO: 68485 - DNA, 35 bp, Homo sapiens
  chr1:208523515-208523550
  hypo
ggtccttgccatttgcgctgcgccttttagattga

SEQ ID NO: 68486 - DNA, 30 bp, Homo sapiens
  chr1:208677386-208677416
  hypo
aacagcactttcagccgaggcaacctggga

SEQ ID NO: 68487 - DNA, 175 bp, Homo sapiens
  chr1:20878485-20878660
  hyper
cagccactgcagcagcggccaggtctctcagctcaggcccagcggtctggcccacgaccttggaagaacctgggagaaagcttcaccaagcgacagtacttttccactgcactgctcggccacctcggctggctttgtgctgtgcagacgaggcaaagtgcgccaggccagcccc

SEQ ID NO: 68488 - DNA, 124 bp, Homo sapiens; identical to SEQ ID NO: 5357
  chr1:20878905-20879029
  hyper

SEQ ID NO: 68489 - DNA, 199 bp, Homo sapiens; identical to SEQ ID NO: 5358
  chr1:20879030-20879229
  hyper

SEQ ID NO: 68490 - DNA, 182 bp, Homo sapiens; identical to SEQ ID NO: 5359
  chr1:20879255-20879437
  hyper

SEQ ID NO: 68491 - DNA, 1175 bp, Homo sapiens
  chr1:20879462-20880637
  hyper
cgcgatgctgccctggagacgtaacaaattcgtgctggtggaggacgaggccaagtgcaaggcgaagagcctgagtccggggctcgcctacacgtcgctgctctccagcttcctgcgctcctgcccggacctgctgcccgactggccgctggagcgcttgggccgtgtgttccgcagccggcgccagaaagtggagctcaacaaggaggacccgacctacaccgtgtggtacctgggcaacgccgtcaccctgcacgccaagggcgacggctgcaccgacgacgccgtgggcaagatctgggctcgctgcgggcctggcgggggcactaagatgaagctgacgctggggccgcacggcatccgcatgcagccgtgcgagcgcagcgccgccgggggttcggggggccgcaggccggcgcacgcctacctgctgccgcgcatcacctactgcacggcggacgggcgccacccgcgcgtcttcgcctgggtctaccgccaccaggcgcgccacaaggccgtggtgctgcgctgccacgctgtgctgctggcgcgggcgcacaaggcgcgcgccctggcccgcctgctccgccagaccgcgctggcggccttcagcgacttcaagcgcctgcagcgccagagcgacgcgcgccacgtgcgccagcagcatctccgcgctgggggcgccgccgcctcggtgccccgcgccccactgcgccgcctgctcaatgccaagtgcgcctaccggccgccgccgagcgagcgcagccgcggggcgccgcgcctcagcagcatccaggaggaggacgaggaggaggaggaggacgacgcggaggagcaagagggaggagtcccccagcgcgagcggccggaggtgctcagcctggcccgggagctgaggacgtgcagcctgcggggcgccccggcgcccccgccgcccgcgcagccccgccgctggaaggccggccccagggagcgggcgggccaggcgcgctgagagccgaaggacaggactcgcagccccaggcccgacccgccagactcacagcctccaaccccggccctgcccgcttcggctgccccggcccccggcccgtgtctcccccgtggtctccgtgttgtccgccccgccgcctcattttggctcagggtgatgcctgatacgcccttggttattg

SEQ ID NO: 68492 - DNA, 18 bp, Homo sapiens
  chr1:208852030-208852048
  hypo
aagggggaagctggccgg

SEQ ID NO: 68493 - DNA, 115 bp, Homo sapiens; identical to SEQ ID NO: 39230
  chr1:208951412-208951527
  hypo

SEQ ID NO: 68494 - DNA, 25 bp, Homo sapiens
  chr1:20897067-20897092
  hypo
ggattacagacgtgagtcacccatc

SEQ ID NO: 68495 - DNA, 93 bp, Homo sapiens
  chr1:20916163-20916256
  hyper
ctaagtgttaatgctcgtctttagatgaaactacggaggtctcgagaggtgacatgacttgcccaaggtcacacggggcgctggtggtgaaac

SEQ ID NO: 68496 - DNA, 88 bp, Homo sapiens
  chr1:209306269-209306357
  hypo
ctctggtgagaacaggctctgtgtgggccccgcagcagcctccgagcccctgccctctcggcacctgagttctcgtccagcatctggg

SEQ ID NO: 68497 - DNA, 30 bp, Homo sapiens
  chr1:209364033-209364063
  hyper
cagggaggctggtctcgccaggaatggcaa

SEQ ID NO: 68498 - DNA, 544 bp, Homo sapiens
  chr1:209381087-209381631
  hyper
ttgtttcagcataggcggaagcctccactccagggcttggggtgggctcgggaggccgcccgccgtcggcctgactcacagcgagctcggcgctccctcttgtggcttctgtgttccccgtcagcctcgggaagctgccggccaccacatacaaatggactccgcgtagttaagctgtcaggtctaatgtatttatttgactctctcctgttaaaatgatttctctacagcactgcggttatttacgactattgtcagtacaaggcgatgagaaggcagcagcagaggaaaacaacaacagctgaaggaaaagttctgtctgggagggctgggtggctgggtggctgggtcccgggctttcccgcggctgcagcggctgtgtgtttactttatctgcagcgggggcttcggagctcatccatccataatgcagagcccattgccctcagcccgcagttcacggccagccccagtgagcgcccttgcggaggagctgtggcccggggaggacacccccagctcttttgagcgctaaacattttca

SEQ ID NO: 68499 - DNA, 185 bp, Homo sapiens; identical to SEQ ID NO: 39232
  chr1:209601396-209601581
  hypo

SEQ ID NO: 68500 - DNA, 237 bp, Homo sapiens
  chr1:209999727-209999964
  hypo
ccaccccagcctctccgaatctaattaggaatagtagatggtcactagaactgacaagaatcgcattctaatggttttattacaacttctatggtgtgacacagtatcagggaaaacccaaatttcccacagtagcactccaatagcagagctattattttgcttctcatttctctcattttggacgctcctgttttaccgtaaatattcaagtgaattctgcggcttatgatttaa

SEQ ID NO: 68501 - DNA, 30 bp, Homo sapiens
  chr1:210070804-210070834
  hypo
atgtttctggaagagcgtacaacttagcgg

SEQ ID NO: 68502 - DNA, 229 bp, Homo sapiens
  chr1:210110982-210111211
  hyper
gctgtttctccacagcggagatctgagacgagtatgtggctgattcgggcaaaacaaaacaaaataaaaccaaacgaaaccaaaacagacttactattaccaaatctgagagtcagtgggtgggaatccttttcaaccaaggagacctgtccatggtcctgaccacatcatttgccactcgcctccttcatggacaccgtttgctccaagtaccggacgggagggcgcc

SEQ ID NO: 68503 - DNA, 139 bp, Homo sapiens; identical to SEQ ID NO: 26824
  chr1:210111283-210111422
  hyper

SEQ ID NO: 68504 - DNA, 127 bp, Homo sapiens; identical to SEQ ID NO: 26825
  chr1:210111796-210111923
  hyper

SEQ ID NO: 68505 - DNA, 133 bp, Homo sapiens
  chr1:210112036-210112169
  hyper
cggcaaaccatccttccgcaatacccaccttcctgccaaactgagagtccagttttttgtcccattcctaacccttccctgtgcccgctcgggctgatgctgggttacactctctgcccgttccccttctgtt

SEQ ID NO: 68506 - DNA, 30 bp, Homo sapiens
  chr1:21024801-21024831
  hypo
cagccctgcccttcccgctgggccccacct

SEQ ID NO: 68507 - DNA, 30 bp, Homo sapiens
  chr1:21026148-21026178
  hypo
ttgctagacaggaggcgcttgctagacagg

SEQ ID NO: 68508 - DNA, 30 bp, Homo sapiens
  chr1:21030592-21030622
  hypo
agcgaacacgcattgcgacaatgccacaga

SEQ ID NO: 68509 - DNA, 58 bp, Homo sapiens
  chr1:210405727-210405785
  hyper
aaagacaagatatctcggaaggttccagagtgaatacattattcggctggagccaagc

SEQ ID NO: 68510 - DNA, 53 bp, Homo sapiens
  chr1:210406136-210406189
  hyper
gctcattaccataaccgtctgcagcgacggcggcgcagcgccccagtcgcggc

SEQ ID NO: 68511 - DNA, 49 bp, Homo sapiens
  chr1:210406479-210406528
  hyper
gcaccagggctgtgccgaggtcaccgagtggactcgcagcggccggagc

SEQ ID NO: 68512 - DNA, 36 bp, Homo sapiens
  chr1:21042027-21042063
  hypo
gcctctctgggagggcggatccggcaggccctgcat

SEQ ID NO: 68513 - DNA, 337 bp, Homo sapiens
  chr1:21042750-21043087
  hypo
aaaatcaatatcttaaagggtaagagcagcacctgcggggctctcacagggtgcatacagggcttctttcgtgcatgggcacaggaagcactgccatacacaggtgatggcccaatgtctgcctgcaatgcagggagctggacacgtacaggtgattctcgtggcgggctatggggcggggcacacagcgacaagagtccaggcagccagccggcagggacagggagtacaaagaagcgaaaacaggatggcacaggaagaacgaagcacagctttccaggcggcaaagacagggagaactgggggagctgggagtggggctcgtactttgccaggt

SEQ ID NO: 68514 - DNA, 219 bp, Homo sapiens
  chr1:21044015-21044234
  hyper
ggtccacgtggtaggcgccgtcgaaggtgaactgcttgggcggctcgtcggcggcgcccgggttctggatgcagcactgggcgcgcgcgcagtccacagtcaccacgggctggcagcgcagctctcgctcccgctggttcatgggacggcagcgcacgacaaccttcaccgcctcggaggccatggcgccgcgcccaggaccaacgggaccagagctga

SEQ ID NO: 68515 - DNA, 69 bp, Homo sapiens
  chr1:210465943-210466012
  hyper
aagaggctccgggctcggccagtgtctgccccgggactgggccctgggactaggcggggcacaggtgtc

SEQ ID NO: 68516 - DNA, 154 bp, Homo sapiens
  chr1:21058263-21058417
  hyper
cccgctgcgctacctcgctcggggcgctgcggggaacggccaggggccccggcagagtccccggacccaggagcgtgctgggctccgctgcaggggacggaggaggctacagtggcagggagggcagatgacgacggagcgggtgacgggcgcc

SEQ ID NO: 68517 - DNA, 235 bp, Homo sapiens
  chr1:211306663-211306898
  hyper
aggccgccgagagcacgtcccgacacctcggacttttcagttgcagggatggaaggtggaggcagccggatcctcccattctgaggcagcggggacctggagttgcccgtctctactgctggctctccctggggagaggcggcgcctctgggagcagcccgggagccccagagccttcgcggaagggtgggcagtgccgatggggcgcgcgctgccgctccggctgcagccagct

SEQ ID NO: 68518 - DNA, 420 bp, Homo sapiens
  chr1:211307119-211307539
  hyper
tgcatctgctggctccgagcggcgagaggttctgcaataaaggcacggataaaacgcccgggtaatcgaaatccgaatgcacctcttaccattggaccgccgaacaatattctccagaaacgtgttttgaggggccactagtcccctcctgcccccagccatggtcatcctcccagcagctcggggtccggcgggcgtcctggcgcggcttcttacgacagcaggaaactggcctcggggcccgcacgcagtcccggctcgaagcgccccatgcgcccggcggggatccgcaggcagggctggcggctccctctggctgctaccctcgcgccctcttcgcgcctccctccctgcggcccgcctcgcagtgcactcgcgccggcctcggctagcggcagccgcctccgggtgggcggaggg

SEQ ID NO: 68519 - DNA, 33 bp, Homo sapiens; identical to SEQ ID NO: 39234
  chr1:211430421-211430454
  hypo

SEQ ID NO: 68520 - DNA, 30 bp, Homo sapiens
  chr1:211504088-211504118
  hypo
tggaggttgctacaccgtccccaccagcat

SEQ ID NO: 68521 - DNA, 30 bp, Homo sapiens
  chr1:211847757-211847787
  hypo
ggatgtttcagttcacgaagcaaattcact

SEQ ID NO: 68522 - DNA, 32 bp, Homo sapiens
  chr1:211871944-211871976
  hyper
gagaggatcctgcgccgcgttcagccctggcc

SEQ ID NO: 68523 - DNA, 349 bp, Homo sapiens
  chr1:2125166-2125515
  hypo
gcagggatcaggtgccgggcgctggggcagggacctggcgggggattccaggtgccctcctgccccgtgaagcagccggtaggaacggcccgggccccacaggtccggcggaaagggtgtccaggaaaaggtcttgggtccgacagtgaagacttcagtgggctccgggccgcacctgggctcctgcaacacagagttgttgggccttgcccagcgatggctcccgccctggaaaccccttcatcgctaagatgggcccagtgggcacacctgtcctgggaaggcgggcagtgaaggcacctcgtgatccaggatcagctccgggctcaccgtgcgcagtagctcggcc

SEQ ID NO: 68524 - DNA, 17 bp, Homo sapiens
  chr1:212614848-212614865
  hypo
gggcatggtggctcacg

SEQ ID NO: 68525 - DNA, 292 bp, Homo sapiens
  chr1:212873974-212874266
  hyper
agagcgaatctgccacgtgggacgtcactagtgacaggtttggggatctggacccgccatgccacggttaaacggcccagatcatttttctttttcaagatttatctgctcgtgccaagctggggaccgggttgaggtagggcaagtccctgtccacctgcctgccagtcaaaagatgcgaagccaagacaattacccgtggtcctagcgaaggaaacactagcggccacaggctgtggtctgcatgctgtgagcaccgggaaagataaccgcgattcgggatgggcgggtg

SEQ ID NO: 68526 - DNA, 96 bp, Homo sapiens
  chr1:212963883-212963979
  hypo
atctacttatattagcggaaaaaatttaaaagctcataataccgcacatttgtgagttatgaatgaccacagtgcaaacagtaaaaataaaggtta

SEQ ID NO: 68527 - DNA, 30 bp, Homo sapiens
  chr1:2129896-2129926
  hypo
tccaactccttccaccgcggaagaacaagt

SEQ ID NO: 68528 - DNA, 1034 bp, Homo sapiens; identical to SEQ ID NO: 26831
  chr1:213123589-213124623
  hyper

SEQ ID NO: 68529 - DNA, 380 bp, Homo sapiens
  chr1:213124668-213125048
  hyper
cgctgatttcaggcaccgccggtaagcagggagcctccgcggagctcccgccgccgctcccccttggtgagtcctgccgcagcgagaggcatggagaaggccgcccccgcggggcgctgatcccctcgccgcgcccgcgcgcacacgccccccgccgccgccgccgctgccgccgccgcgcgcccccagtacctcgctccccgcccaggccccaccatgaccggctccgcggccgacactcaccgctgcccccaccccaaaggcgccaaaggcacccggtcccggagcagccacgcgcggcccgtgagcctcgccaccagcgggggctcagaggaggaggacaaagacggcggggtgctgttccacgtcaacaagagcgg

SEQ ID NO: 68530 - DNA, 180 bp, Homo sapiens; identical to SEQ ID NO: 39236
  chr1:213189664-213189844
  hypo

SEQ ID NO: 68531 - DNA, 101 bp, Homo sapiens; identical to SEQ ID NO: 39237
  chr1:213190144-213190245
  hypo

SEQ ID NO: 68532 - DNA, 44 bp, Homo sapiens; identical to SEQ ID NO: 25996
  chr1:2136044-2136088
  hyper

SEQ ID NO: 68533 - DNA, 183 bp, Homo sapiens
  chr1:2136856-2137039
  hyper
ctgtcccagccacctcgccgcttcaatttcctccaggtccacaggcccagcccggcgcgcgccgctcgttctgcgacctccagggcgagcgcgcttccggggcggccgtgcaagaggcgtgggaagcgcgcggggggttctgagcgtgcagtcgccgcctgcggacggcgaaggggcgggtga

SEQ ID NO: 68534 - DNA, 80 bp, Homo sapiens
  chr1:214019656-214019736
  hypo
aaaaagaaaaaagggtagagctcaaccagtgttaaagttagttctgctgaactccatacccaatgcgctccccactaaca

SEQ ID NO: 68535 - DNA, 342 bp, Homo sapiens
  chr1:214155741-214156083
  hyper
cttctcttttcgctgcgtcaggcaggcacctacttatttctagcccactcctcaccctgaataaaagcttctggtaagatggacaatatggaaaacttcagtcctatcaccaaagcccctgaaaatggagcacccccgaattcacatccttgacgtgaaagaccaaagagagggaagctgggagtaacggccaaacatccttagagtaattgacaaaagaaagggggtgggcagaaagggagatttccatcccttcaaacgtgcacgcccctcccgcggtcccgggagggagtcccccctcccaggtcgagcgcgtccaccggctgtccccacagcaacagg

SEQ ID NO: 68536 - DNA, 121 bp, Homo sapiens
  chr1:214156134-214156255
  hyper
cgaaatcccccggccaccacgacgttccccggctctgcggcgcgccgggagcaggtggttgccctctgcgtccagggcgtgtactgagcccaggctagctgagcgaggctgcagcccctgc

SEQ ID NO: 68537 - DNA, 23 bp, Homo sapiens
  chr1:214156256-214156279
  hyper
atggcccgggaagaggcaagtgc

SEQ ID NO: 68538 - DNA, 556 bp, Homo sapiens
  chr1:214156394-214156950
  hyper
cgctcgctctctctggccggagaggccgcgacacctagcgcggggccgaggctaggaagggcgggccggggagggaggagggcactgggaggaagccgcgggcgaggaagccccgctcctgccgagtgcctggagaggagattcccagccttcctgcccaacccgaaacttttccaacacacgcaggcgtattcctcgcaggattcggcggtcccgagtcgcagtcagggaggaggctcgggaagcacacgtgccctggcacactggaggaggtacacaggcacaccaggagggacagggcctcttgggaggcggctgagggcgtgaaggcagcaggcggccacacatccgaaagggactccctgcgagcgggatcgagcgcttaaaaccctgccacagcttggaagtgtagcggtgcccagaggctttgcgtaactttgcccactgcgcccccgcgtgcaaaggtgtccccttcacactcacaccctcaccccatctcactccccttgagttgcggcccgagactgcctttgtacttaagcgacagcaaaagata

SEQ ID NO: 68539 - DNA, 131 bp, Homo sapiens
  chr1:214158780-214158911
  hyper
cacggagctgggctgcgaaccgatctcgctcgcctagcgtggcgcgcgctcctatttcaagtcgccgctcctgcgccctaatgcgggctgcgaaccgccgcggcagagcgtcgcgagccgggagcctctgc

SEQ ID NO: 68540 - DNA, 181 bp, Homo sapiens
  chr1:214159036-214159217
  hyper
cgccagttcccgggcgtggtgtgtgcaaaacgtgcattcaagcgctatgtgcaattgacacaaacttgtgggctaaagtgcaagccatttttttcgcgtttgaatctttttctctgtccctgactcctttcttccccctactcccccctcctccttctctgctctccgcccttttaaatgt

SEQ ID NO: 68541 - DNA, 135 bp, Homo sapiens
  chr1:214159562-214159697
  hyper
cctctgtgttgcttccgtgatagacgcgtggggggagtgtgtgggggcggcaaaaggggaaagaagaaggctggggatgctcccgcaatctcttttcttatcgccgacacctaacctgaccgacctaattttttt

SEQ ID NO: 68542 - DNA, 88 bp, Homo sapiens; identical to SEQ ID NO: 38731
  chr1:2141596-2141684
  hypo

SEQ ID NO: 68543 - DNA, 319 bp, Homo sapiens
  chr1:214160107-214160426
  hyper
tgctttattaaaagccgtttactgtgcccggtgaaagggacgttctagctgcggctgaggctcgcttgcatttgtaacttgcaaagcccaaggagatctttaagagccacattatctaaagaaattttgctggttatttttcaagcaagaaatgtcaaaccaaagtaaattttctagggctttattttagagcctgcgatttatgcgtttgaaatttcttgcctaataaactttaaagtttgttgcccaggcgtcaaaactgtgtaaatcctgtattgaacagctatctttggtctttctggggcgagtgaattagtga

SEQ ID NO: 68544 - DNA, 30 bp, Homo sapiens
  chr1:214162192-214162222
  hyper
tggggtgtgaggaggcgtttgctccctttc

SEQ ID NO: 68545 - DNA, 393 bp, Homo sapiens
  chr1:214162457-214162850
  hyper
accccagcagaggaccgggaactgggaggaggagagagggaggtgggggggcgctctgttactttcgtctcaaaacgctgtcgaagccgaattgtggaaatccggcttggaggggagcggtgatgggtcccgggaaacgcgcgcggcgcccctcttccgagctcctggacccagggctgggtcaagttgagtagggtaaggcggcaccgggaggctcggggggtcgcgtggcggtgggattgggacaccagcacgaggaggaccggaggatcgcgggccgggtaagagtagggggttcttgggcagcagaaatgggaggcgatgaatctcccagccatcgctggcagactatggtgttgggcagcttcggtctggtctcgtctgggtggtacc

SEQ ID NO: 68546 - DNA, 44 bp, Homo sapiens
  chr1:214193286-214193330
  hypo
ttgcccaaatcactccgaagtctacaatgcgaaatgaagtgact

SEQ ID NO: 68547 - DNA, 286 bp, Homo sapiens
  chr1:214360467-214360753
  hyper
gctgctgtaattctgcgatcccctgacgctggtatttgagaaacacactctggaaacgctgtggttgtttttcacaggaacccagggagctatcaaagtcggagaacgtgcctctgtttgcaggagaggtgggcaggcagcgagatccccgcgcaccgctcgctcgggctgcgggcaggcagcaatcagctaattgcctaatcggagtggggagctggtgcccgctcgccgcggtcgcctcgcgggtcacagacaagagagcggcttgttttctctctgtcacatc

SEQ ID NO: 68548 - DNA, 105 bp, Homo sapiens; identical to SEQ ID NO: 5895
  chr1:214360754-214360859
  hyper

SEQ ID NO: 68549 - DNA, 114 bp, Homo sapiens; identical to SEQ ID NO: 26844
  chr1:214360926-214361040
  hyper

SEQ ID NO: 68550 - DNA, 148 bp, Homo sapiens
  chr1:214387629-214387777
  hyper
tctccttcctcaaagcgagctccagagtagaaactgcaattgtgtatttgaaattctccagtcaccaaatccaagaaaggtgaagaggaactgccccagtggcgtctgcgaggcgtttcctctataaagctgtcgtccctagctctgg

SEQ ID NO: 68551 - DNA, 73 bp, Homo sapiens
  chr1:214638017-214638090
  hypo
ccctgtgctttccaccgacagcgtgcactcgataacattgctgtccagcaggcgaatccgtgtgacaaagcag

SEQ ID NO: 68552 - DNA, 39 bp, Homo sapiens
  chr1:214724448-214724487
  hyper
aagtcatctgcagggcgcccggagcgccaaggcggcctc

SEQ ID NO: 68553 - DNA, 43 bp, Homo sapiens
  chr1:214724743-214724786
  hyper
agcacggggctgtcccgcccgaggaggccggggaggatggctc

SEQ ID NO: 68554 - DNA, 348 bp, Homo sapiens
  chr1:214725213-214725561
  hyper
ctcccgagctggaggcgcgccgtccttggggacgtcacagcgctggaatccgaggaatgccgggctgcaggagctccttctgcaggcccggagaagtcgcacacttttaatggggtagttttggaaaatgttttaaaaggtgggggccgaggacggaggaccggatgaaactccctggagtaagagacgtggaagtggagagagcaaggcgaccgcagccaccccaaccctgggctgctcccgccgttggggagaaagaggcaaggcaaggaagagcccacctagacttccgaggaccgcagagacggggcggcggcaggaacttgctcaccccgacctacattcaga

SEQ ID NO: 68555 - DNA, 164 bp, Homo sapiens
  chr1:21523130-21523294
  hypo
aggataaagtccagtcgtcctcttatgacccgtaggatgcagcgaatggcccctgcctctctctctctccatcccccctctctccatcatcttcagctgcactgggccttcttccagttgcttgcatatgtccaagcctcttcctaattcggcgttacaaatgc

SEQ ID NO: 68556 - DNA, 1813 bp, Homo sapiens
  chr1:215255060-215256873
  hyper
tcatcaggggattcccgctgagaaagtgggaaggaagagagtttagaaacggattgaagttccactacatcacgtgtgttgttagagaattcgcctattacgacgacagcaacgtctgatctcctggctttcttcccctccttggtgggttccgttccgtccccctgtcgctgcgagtttggctgtccctacgccggggtcttggagtttgggcggggtctggtacctgccaaatacggatcctgatggggaggaggtcggggagcgctaagttcaggctggagtctgagttctcccaccctgctgctcccacccaccgcgcttagaaacctatgtttccagcaaaggggtcttgctctgagagaacctaaccgggttttcttccattccctttgcatctctagatgtcttcgccctggctccaggtgcgttccccatccttttcggtcccggacgttctgcagattatagcgcccagctcatgtccagcaccgccggaggtgaagtggggcgagctggtgactccttaacccttcccgaaggtgtagactggaagaagccagggtcttcattacctcccctactccagggctctcaaggcgccaacggggacacttccctgtacaggtctggggggccacgagggcgaggaggacgccctagtgcaggggtccaaggactcgcgtcccagagcttggtcccacacccggtcccacaccccgaacgctggtcgggaaggagataggatgcagcgcagtgtgatgtggatgccagacagcgagagtgaggattttgcggggtggggatgggggttagtggaaggggctgagaggggaggaggcagcaggtgagccaaggggttgtgcccccaggaagagggaagagaggatctttagaagggagcatcttgcaggggcgacgcaggcaagggtagggctaggaggaggtgcggggaagcaagccctggcggtgagacaggagggggaggaggcgaagaggagggagttccgaaaggagggaaacgagccggcaaggggcgacaggagcgagccgggaagggagagcagcggagggctgcagagctgcgggcgcccggaccgtgccacacaccccccgcggggcacggagggcattgcggggggagacacacaaagacatgcgaagaggggctgaacgaggctcgcgcacaaagacgccggggcgcacggcagctggggctgcacccaccgcccccgcgccgcgccgtgccggggccgggccagcgagcagcccggggctgagcgcgtggcggcggcggcggcggcggcggcggcgggcaggcgcgggacccgggtcgcccgcgctctccgggtgacccgggcccggcagcaggcgcgcgcgggggcggcggcgcccaagcccaacttggcctccgcctcgccctctgcccagcccgccggtgtcccctccttcccgcgatttcgtttcttctcacgctcccccccccgccccctcccgcgtccagccccgctctccccaccttgtaaaacaaagccggggaaaatgcctgcccgtgcagctcggagcgcgcagcccgtctctgaataagaagtgagtacaatggcgtgtttgtaaaaaaaagcttcaagtccgtctttttcaaaaaacattttgaatgctgcatgcctcatgcttcccagcgcctcgcgggagagacccggctatagagcaggaggtgagaccccccctccggtacccccacccctctggccgcacgctctcctgccccagccttttctgggaggactgcaaatgccccctctcagcaagcggc

SEQ ID NO: 68557 - DNA, 18 bp, Homo sapiens
  chr1:215256953-215256971
  hyper
cgccgcttctcccccctc

SEQ ID NO: 68558 - DNA, 51 bp, Homo sapiens
  chr1:21568327-21568378
  hypo
aatctccaaaaggagcgagggtctgatcgatctgaccggtcaggaagcctg

SEQ ID NO: 68559 - DNA, 83 bp, Homo sapiens
  chr1:21573351-21573434
  hypo
atgttgcccaggctggtctcaaacgcagggactcaagggatcctcctgcctctgtctcccaaaagtcccgcaattacgggcgt

SEQ ID NO: 68560 - DNA, 294 bp, Homo sapiens
  chr1:21573828-21574122
  hypo
gcaaccagttgatggcgggtgccaaggtctgcaagggaaaaggacagtgtgaccctgtggggctgctcctcctcacagcccagggctctaggacgggcttctacaggaagcaaaggaaagagcttgggcttggcgccatctgacagcgcaccgggcagagagtcaagcggagcctggcgggcttttgtcagagatgctgtaggtagaattctaaggagtccaacaccaaaatttaacctgaaatggaatgaggatgcaatgagaagatgcagcagctgccgctaccattcagca

SEQ ID NO: 68561 - DNA, 17 bp, Homo sapiens
  chr1:215745270-215745287
  hypo
gccgagataaactttta

SEQ ID NO: 68562 - DNA, 141 bp, Homo sapiens
  chr1:21586789-21586930
  hypo
tggccctgagctcctcgatcctggtctcgttcatgcacgcacggtagtatacttgcgcctttctctctgcctcgctcacgctggccgtggagttttctggaacaacagacagtggagtttgcaatgcggccccacttgccc

SEQ ID NO: 68563 - DNA, 30 bp, Homo sapiens
  chr1:21594515-21594545
  hypo
tgatttttttgtatgcgttcatcttacagt

SEQ ID NO: 68564 - DNA, 40 bp, Homo sapiens
  chr1:21611198-21611238
  hypo
gctgcctggggcccacgagacaagccgggagcagaaaggg

SEQ ID NO: 68565 - DNA, 30 bp, Homo sapiens
  chr1:216705663-216705693
  hypo
agcattttgacataacggggatcaagccgc

SEQ ID NO: 68566 - DNA, 32 bp, Homo sapiens
  chr1:216774823-216774855
  hyper
aagaggattccttgtcgcgagttgtcttggtt

SEQ ID NO: 68567 - DNA, 35 bp, Homo sapiens
  chr1:21682446-21682481
  hypo
ttcaatcccggtctgcgctccgcaattgcaggata

SEQ ID NO: 68568 - DNA, 113 bp, Homo sapiens
  chr1:216896454-216896567
  hyper
acacaaacaagcagtcgtgcacacaaaatacccagggcattacctgaatcagtgtgtaaagatatagtctgtccgcccccacccccgcacccccacgacgagtttaaaaagga

SEQ ID NO: 68569 - DNA, 87 bp, Homo sapiens; identical to SEQ ID NO: 5901
  chr1:216896887-216896974
  hyper

SEQ ID NO: 68570 - DNA, 30 bp, Homo sapiens
  chr1:216897216-216897246
  hyper
tgggaaaggattctgcggaaggtagagaat

SEQ ID NO: 68571 - DNA, 49 bp, Homo sapiens
  chr1:2170934-2170983
  hypo
ccatgtgggtgtagccgttggcggcacctttgtacggggacacaccctg

SEQ ID NO: 68572 - DNA, 373 bp, Homo sapiens
  chr1:217262983-217263356
  hyper
ctttaactgggctcccgcgacctcggcaggcgagggggtgctggccggccctccggtggcaagggcacggccccccgctctgcccccgcgggcgcggggccggcctggcacccggggtccgcgtcccgagcggctgtgcactcaccgagccgggctgcgaggggcagaggggcgcccacggctagccggagcgccaaggcgcctcccttttctcttggtagcgtcggtccgcactccctgtgacccaggacgtcatgatgcctgtctgttttctcaatgataacttggcagaagaagagagaggctgccaggttctcctcgggtggttacgtggtatgtgcacgattctgtttgcatgcgtttctctttttaa

SEQ ID NO: 68573 - DNA, 30 bp, Homo sapiens
  chr1:217307206-217307236
  hyper
gagatactgagacatcgcacctccagcacc

SEQ ID NO: 68574 - DNA, 1839 bp, Homo sapiens
  chr1:217307467-217309306
  hyper
gctgcaatgtgagctcgggagggaactggggatgcgagctgggaacagaccgcgctccagcccccatggtttgtgacggggaacttcgggcgcacacaccctggggagtaggtctcctccaaatggcaccgacacagactggcgctggatcttctctccctgctaatctatccgcaaagaccgcctgggcacttttgggggaatgtggccaaaaggggactctaactgcgacatctacagaggaaggagaaactggtggtgcctaagaagttgatctcgatgcgcgcagtgagggcacagggccctgcgcgccagagaagcgaagccagcggtctccacttacttgttcttaattcctccctacccccgctctggcctctcattttcggcctcatggatccaagacccgaggttattttcagtcacaactttctccacaccccgtacccccaaaagtgtacctcagctcaggcgggaaagggcactttgacccgccgtgcgcgagtttccagccagccgctgcgcgcctgagagaaagagcgcctggctgcggctccgagcgcacagctcttccccgcgtgtttggcgcggctacgtttctcttgctccgggctgaggctcgaggaacctcgccagcctgctgtggtcccgtccccttgacgtttgatttctaaaaccgcatagtctgcggctctggcatttagaaaaagaggacaaggtcaaggcctgtggaccgaccgccgcgatccgcttgcacctttgctctcacagcaagcgagtcctggccgcagccgctggaaaaaggtgccgcagcgcccagtttacctggaattcagggacctgaccctgactctatttccggctagtcccagcctctccttcctctcctttccccgctttccgcccagggcggttctgagattttgattaagagagatctgtccccgcaccgcagagggatggtgccaaatggccaggcttcctgggcactgcgtcctcattcccaggtcagagctactgcgaaaggaaaggtctccatctggacgcacctcgtcccctcccccagcgcgcggggcagccctctagggccagctcgggcacgcgcttttccccctcctcaccccctgctccgcccagccccgtacagttttattctttatgaaacacacacgcccaccccgcctcccacgtaaaggccagtcttgactcattttgcgcccagatgcaaactcagctggaagttgagggtagggccaaagaggtgaggggagggtaagagatacagcgaaatagagaatgagaagggagaaatcaaagggggaggagggacaagagaaagcgtgtggagctggaggttgaaggggcagaggcggaggccaaggactgagcaaggggcgcgcgcgcggcggcggcggcggcggtgttggcggcggcggcggcagggcggctgcacctcctcccagccttttcgcccgcgcgcgcgaagcggggtcaggcgcggacccacattcaccgactgcagaactgttttctttgccactaccagagggtgtttcggggctccccacggtcttctccctggctgcttgccgcgtgagagcagaaataaaacaaaacaaatcacgggacacgacggagtcgggccgctgggcgcctccgggatcgctctcactttgcactcggaagcgggcgcggggattcgggctgccgcgtgtagcctataaatagcaaactttttgaccgaagcaactaacaaataagaggagcaggcgtgcattttgctcaagatccccccttttctggggacgaccttactcccacccccgccccctttgcagt

SEQ ID NO: 68575 - DNA, 590 bp, Homo sapiens
  chr1:217309653-217310243
  hyper
ttttagatggaagtgcgaaaggtgagtgcggaaggcacaaaggagttcctgcagtgcagatttcctttcccagaagcgacaataacccactcagcaactttacttcaaccctaggctctggcctaccgggagggcaaacgcgggcacccgggtcacgtcatcgcttgcttgggggcgccagctctagcgtaagcctgagctgcgagatagctccgtggggttttgccatggggtcttgcttactaatcaccccgcacgccctcacccctgtccctggacgcccttttgctgcacccgctcacatctgcagacccaacggatgggatctacttgactgagattcctgaacacaacttactgcccgcccttcccctttccttttggccaggccggattgtgggtggtgattggctcagtaggattttcattttcattctaggtgcttccttaaaaataaagccccccgaatataacagacactcgctccatacaccaaacttcccagttcctgaggttgctacgctaaatttatcctgaatgtcgcacagaaaccagggtcaataggacgatcagcacggatgggtgtgggg

SEQ ID NO: 68576 - DNA, 1217 bp, Homo sapiens
  chr1:217310819-217312036
  hyper
accgcgcctggggctcgagagctgacggactgccctttccaggctgccccaagggcctgggaggctgcggtaccgcctgtcggtcccggtcccgagcgcgcttgcttaagagttctcaaagacggggttggaagcagtacagacgtccccggttatcgctgccgggcttgtgcgccccacgccacctacctgtccggccttcccgctccaattgctgacccgtttagggagcccggcctggagcccgccgcctccagaggagcccgccctcgccctcccccgcgcgcctccgctctctgggacgcctggccaaatgcggggcggtctctcgcgggccattggcttgggccaccgttccgagtcagctcctaggatttccccaggctttgcggcccctttgtgggtctaggccagcgcctcaccttgcaccctattccacctccagtccccttaggtgcccccgcatccctcctccagagtccaggctttgaaactgcagcaactccgcaaagaaagcctttgggaaaacctcctagagggccgaatgtggaggtcgggtgggtgggtgggtgggtactcgcggcatttctcaaggttctgggtgttcgtaactaggggaacaggccctatgggggcagaaatgacagacgcacgaacagcgtctctgtggctgtctgcagcgcgaggttcacgtctattgttttatgcctccgggagagctaccccgcgtgatagatcttttcagatccatcactggaagaaaaaccctggtgataacgattatctcccgctcgcgctatctcgccatcgccccaattcatctccctctggctctagccccttggggagacgaggagggcgaggcgctggcaggaggaccggccaagccgctgtcctcggatggagaggagagggagaggcacgaggccacctcattcgtccctttccgcttcgggctggggagacaggacaccgagggtttctttctgtctctgccaagcctcacgcttctttcaaatgattttagcctggtgctacggtctatccatatacatttccaatctcatggctcataaactattagcaaaatggtttcattattcaccttctgtatcctacaaaagggagaaaagaaaggagcgggaggaaggcacagtgggggcgggggacagtcgtcggacactagttaacaatgatgcctccggtgtttaaatcat

SEQ ID NO: 68577 - DNA, 96 bp, Homo sapiens
  chr1:217312947-217313043
  hyper
tgaaaatataaaggacgctaggcaagtgagcttgcggtaattatccctggatagagaaaccaatctggctgggagaggcccctctgcaattgccgg

SEQ ID NO: 68578 - DNA, 679 bp, Homo sapiens; identical to SEQ ID NO: 5909
  chr1:217313068-217313747
  hyper

SEQ ID NO: 68579 - DNA, 146 bp, Homo sapiens
  chr1:21754473-21754619
  hyper
ataagccagggggggcgttctcggcgcggagtggagtggagcggagcgggctggtgctgggggcgcggagagcgcagtgctggccggggccgggagcggggccgagcgggagcggagtcgggcgtcgggcccggggagccggggcc

SEQ ID NO: 68580 - DNA, 197 bp, Homo sapiens
  chr1:217805039-217805236
  hypo
agtgctttttttcttcgacatcaccactctgcaatttgatgaaacctatgttcaataccctgactgggggtcaccctgactcactagcccaatgaactcagattgtgtcccatctacctagggatttgagcctccgttattttacaaacatcactaaactcaattgttctatgactcattcgcctttttaaaatgaa

SEQ ID NO: 68581 - DNA, 40 bp, Homo sapiens
  chr1:21831562-21831602
  hypo
gattacaggcgtgtgccactgtgcccggcccctgttatct

SEQ ID NO: 68582 - DNA, 2012 bp, Homo sapiens
  chr1:218337322-218339334
  hyper
acttctaaaacatttcgtggaagagagtagactgtttaccggatgcccttctatttttgccgtgcaggattagtaccttctacttccttaaatgtaggcaaataaaattacggagaaataaaatgactgcagcctttgagcgctggtttgtcctaggacaatcggatttcaccgggtaacgtatatgcaaacagacacgtcccgtttatttcattgtttgcactgcggagactctccgccgctctccacgcctttgttgacctaccgccagcaaagttgtgtggttataaatagatagaggcagctgattaagaagcggggggagtgactttctctgggctcttacggatcaatcaccgctaaggggatgcaggttgaggggaaggaagaaagtaaatcgcggggcagtttgactaagtgaaacccaattccttcgccccaaagctgtggtggccagacgtgcgcgaccctctagacccaaaacagttttagtcagcaacgggtcatcagcaggaccgagaagactgggtgggaggtctggccggtccgaaatagggaagaggtgcgggctcatcaccgaggcggtagggctcggcttatggtctagagccttgaggcgctcccgcgtgagccccgctgcttccagtccgccctcgcctggcccggcgcgggtcgctccctcctccccgtcctgttccgcactttacccagcaggggtcccaggtcgagcagggccaaccctgctcgcgcagcgccggacccctccccgctgcccggggtgcggcggcttccctccgcccaaacggggggtgtctcctccatcacccctgccgcggcttcccagtcggagtcgcgctgcggggcgagggaggctcgctcctccgcggccggggcctgggggtgccagtgcgcccccgagtgagcgggtagggaagccgaagagccgccgacccgctgcgcgccctccagtcccgggcggcgccgggacccagagcggccccagcccgcgccccagcggggacgcgaacggcgtctcgggacggcacctcgccggggccttgccctgtcccgccgcgtcgcggcctctccgcaccccacgtcccgggagccgaccgggagactctcacggcggagttccacagacctcgttaggttaaaggaacctcgccttgccccccactaatcggctagagagggaggccggcgaaacaaaagccgtagaggaaaattaagcgacttccccctcggcggggaacttggaggtgggggagcggggagcggcgcggggcgcaaggagaaggaagtgctgagctgggttgccgacgaaccccgggcagggggaggtggggggctgcggcagaagaaagacaaacatctggggatcggaccatatgccggagctttgtcttgtccttcaaagttcggctgcccttgaagtgatttgtcaggcggcccacgggtgacagggaggatgtgcagcggggagcgggggcgggacatgccggggggagcggagagggctagaagagaggggaggaaggggggacgccaacaagagggggagcaaagtgaccccgccgcccgaggaacggtagaaaccgggatcgcggaggtgcgagcccgagcccgggagcggagcgcttcccggggagacgccaagacggcgagaaaggaggagcgggaacgcagaggttaagcggagggaaggccgaggagaaacagccagaggacgggaaggaggaaatagacggggagaagaaactgaagattagtcgttgaggtgtattaagaaagaggacatgtcgcctattttaggaaaagtggctttgagctccccccgcacccccaccattttttctttctcttttgcccgccaaccgctgaactgattagactgtaattaaggccataaagccctcagattatacacctgtttattcactgaagtcggggtctcatcaagcaaattagctgcttgcaggctacacattgggcctcgagcttgcctgatt

SEQ ID NO: 68583 - DNA, 254 bp, Homo sapiens
  chr1:21835380-21835634
  hyper
agagtcagaggtgcacgtggacagagacagagagacagggacacgtgggcagagacggataaagacagagacccagagaaagccagatatgttgacagacacagagacagacgccagagaggaaggcagacaaagagacgggtggagacaaagactcccaccaagagacgcagaaggaagatgccgacggtaaagacaaaacaggagacgcgcgcaaggagcaggtcagagcccaggctcgctgagagaggaag

SEQ ID NO: 68584 - DNA, 505 bp, Homo sapiens
  chr1:21835915-21836420
  hyper
gccgcgttgcgctcccgccactccgcgcccgctatcctggctccgtgctcccacgcgcttgtgcctggacggaccctcgccagtgctctgcgcaggtaaggattcgacgctgccccgcgccctggttccccagggccccagcggacgtggtccatccccttctgcatcctccgctggccccgtggttgaactttaatggcagggccggggtctccagcgccacgccgcccacagcagcccattcgggacgccctgcaattggtcctgcccctgtcctcccgcgcatcccaagctcccggcgcgcgctctgggcgggacaggagattggacgtggcgcccgcggagccggcgaactcaggggaccgcgctcgggaccgccctgcagtcccagggtctcctacctcccgagccgctgcctgggaccctgcgctctgtctgggcacctgcccttggtgccccgtgactgagcccctcctggtgcctccttagccgtagctctagagac

SEQ ID NO: 68585 - DNA, 30 bp, Homo sapiens
  chr1:218417045-218417075
  hypo
agatttcccgccaggcgcggtggctcacgc

SEQ ID NO: 68586 - DNA, 42 bp, Homo sapiens
  chr1:21846323-21846365
  hypo
gagggtggtgggccccggaccacacagcgaataaacggtaaa

SEQ ID NO: 68587 - DNA, 30 bp, Homo sapiens
  chr1:218519769-218519799
  hyper
ttttttcttcttactcgccaaagtcagggt

SEQ ID NO: 68588 - DNA, 184 bp, Homo sapiens; identical to SEQ ID NO: 26864
  chr1:218520108-218520292
  hyper

SEQ ID NO: 68589 - DNA, 342 bp, Homo sapiens
  chr1:218520309-218520651
  hyper
cgagcgcgagaggagcgacgaagagtactacgccaaggaggtttacaaaatagacatgccgcccttcttcccctccgaaagtaagtacttattttgacttccatcccctgaggtttagctctgcccggagctctcaaaaccgcagcagctcccgggatcgcccttccctctcgcggttcccgttcgctcttttcccgttctcctgtccttcaccccaccacctccttttcagttgtatgcttgaggccatcaggctttaaaatgtttactttctactttattttctccatctttcccttccccctaacaattcggtgctttaaaaggcgttattctcttttt

SEQ ID NO: 68590 - DNA, 30 bp, Homo sapiens; identical to SEQ ID NO: 39240
  chr1:219253291-219253321
  hypo

SEQ ID NO: 68591 - DNA, 30 bp, Homo sapiens
  chr1:21934551-21934581
  hyper
gtcaatcccccagtccgggactccaccccc

SEQ ID NO: 68592 - DNA, 330 bp, Homo sapiens
  chr1:219347186-219347516
  hyper
gcggcaacgcaggggcggaaccgcatgactggcagtggcatcagcgatggcggctgcgtcggggtcggttctgcagcgctgtatcgtgtcgccggcagggaggcatagcgcctctctgatcttcctgcatggctcaggtggatttcaattttacgtcctggttttctacagctcgggaaacatcctcccctcggttaccccagtattgcccaagtggaggtgtcgccgggcccaaatagggcccagtgggtggctcccccgtcgccagccccggctgtagatgcacgggcagcgccacctgcccccagcctcccccgttagtcttcctct

SEQ ID NO: 68593 - DNA, 37 bp, Homo sapiens
  chr1:21948897-21948934
  hyper
ctgtgccatcctgagcgcggcccggcccggcccccgc

SEQ ID NO: 68594 - DNA, 30 bp, Homo sapiens
  chr1:21949180-21949210
  hyper
ctgcgcgttccggcccgagcgctagaagct

SEQ ID NO: 68595 - DNA, 315 bp, Homo sapiens
  chr1:21996075-21996390
  hyper
gtggcagaacctgggcgacagcccagctgtccaggcaacagctcatgctccaaggggactgggacaacttctggatcaagtggagacgtcgggataggtggggcccacggcccccatgggctccgcttgtctgcaggcgcgggaggaaggcgcacaggcttcgctgggcgagaaagctgctgtgccctggctgacgccctcctcacccgggcgctcggcgcgcttcctggcagaggccacgcggttgaccctcgccagcccattcgcggctcttggactttgtctctggactgggcagctcgcccccgccccagc

SEQ ID NO: 68596 - DNA, 30 bp, Homo sapiens
  chr1:220012557-220012587
  hypo
gagctgctgttccttcggcactactgaatg

SEQ ID NO: 68597 - DNA, 162 bp, Homo sapiens; identical to SEQ ID NO: 26867
  chr1:220101049-220101211
  hyper

SEQ ID NO: 68598 - DNA, 243 bp, Homo sapiens; identical to SEQ ID NO: 26868
  chr1:220101370-220101613
  hyper

SEQ ID NO: 68599 - DNA, 130 bp, Homo sapiens
  chr1:220101674-220101804
  hyper
cgcgatggagttgcccaggtagccggagaccagctccgccacgaagaaggcgacggtgagcaccagcatgaagagcagccggcacgtcttgccagagtagcggcccatctcgccaccagccccgggcgcc

SEQ ID NO: 68600 - DNA, 191 bp, Homo sapiens
  chr1:220101864-220102055
  hyper
cggatccgtgaggcccggtacccgcctcccagattgtctcgccggccctgccccaccgctttttataacgcgaggccgagcgccaccagtccccgcacgtccagagtctaaaggagtggcgggggcagtatctgaacagcccgtgcaccgcctcccgcggcccttttcccctccctcgcggcctgggcctg

SEQ ID NO: 68601 - DNA, 86 bp, Homo sapiens
  chr1:220552703-220552789
  hypo
tcccctggagttgggcggcaaactcctcagggagtcggaggagactccgactgccctggccaaactcctctttgttccaccagtcg

SEQ ID NO: 68602 - DNA, 136 bp, Homo sapiens
  chr1:220636394-220636530
  hypo
tgctcttgggggagctgggaacaggtaggatctgccctcccaggtgtcgctgcagctgcagcacctgtggctgcagacttgggcctccggcttcaggaagtcggtagaagcagggaacaagcgggaaacctgtccc

SEQ ID NO: 68603 - DNA, 137 bp, Homo sapiens
  chr1:220700814-220700951
  hyper
gagggtgctgcagggcgcccagagcgagacgtcttccgccggccccattcccgaagaggccgcgccgtcgggggctgagacccacttgtactgagtctccagccgcctccctaggctgctggcgcttctaggggctt

SEQ ID NO: 68604 - DNA, 370 bp, Homo sapiens
  chr1:220702115-220702485
  hyper
ccacagcccggccggcgagaccccggccagaccccgctgcccgcacaaaatgtcggcccggacgccattgccgacggtgaacgagcgggacacggaaaatgtgagtaaccggagcctccctcgggagcagtgggggcgagaccctcctctgatccccacttcacccgcgcttgggccgtcccccgtgcctcggcgcggccacccgcggcagggtctccacctggagcccggcgtgaccctcacccactgctcagccctattcttcattccaaccccatttcgcttgtttcccctcaagggtgagggtagggaaccgtaagtggcgccctctcgctcggaggtggtcctccaggggcggatggggtgatgg

SEQ ID NO: 68605 - DNA, 553 bp, Homo sapiens
  chr1:220863640-220864193
  hyper
gcccccccaatcccccgccccgtccgggctggggcggaggagcgggcggggaccaaaggttggtgtctttgcgctcggaccttcgccagaggggccgggacatcatgacggtgggagccaggctccgaagcaaggcggagagcagcctcctgcgccgcgggccccgagggcgagggcgaaccgagggggacgaggaggcggccgccatcctggagcacctggagtacgcggacgaggcggaggcggcggccgagagcgggacgagcgcggcggacgagcggggcccggggacccggggcgcgcggagggtgcacttcgccctcctgcccgagcgctacgagccactggaggagccggcgccgagcgagcagcccaggaagaggtaccggaggaagctgaagaagtacggcaaggtaggggccctgcgccaccactgcccggggggcgcgggtgtggtgtcccgcgggggagcgggagccgggtccttaccatcgactcacccagtttctccgggctgcacctgcgacccctccgcccccgctcccattccctc

SEQ ID NO: 68606 - DNA, 120 bp, Homo sapiens; identical to SEQ ID NO: 38884
  chr1:22092109-22092229
  hypo

SEQ ID NO: 68607 - DNA, 494 bp, Homo sapiens
  chr1:220921566-220922060
  hyper
gaccaccccagaggccgccccattagctcgcttgctttgggcggcgtcgctcccacggcgcccagggtacccccgccgctgtctgcctgtcttcctccattaccgcgcaggcttggtcaccgcattaaggcattcccgctctccgcggaactgctctgccgtctcggcggtgaaagtgtgagagggtccgtagttgggtcaactttgactcctctcgcctgcccggatccttaagggcctcctcgtcctcccggtctccggtcgctgccgggtctgtgcgccggtccgcgcccgccctcgctctgccatgggcgcttccagctcctccgcgctggcccgcctcggcctcccagcccggccctggcccaggtggctcggggtcgccgcgctaggactggccgccgtggccctggggactgtcgcctggcgccgcgcatggcccaggcggcgccggcggctgcagcaggtgggcaccgtggcgaagctctggatct

SEQ ID NO: 68608 - DNA, 602 bp, Homo sapiens
  chr1:220960001-220960603
  hyper
attggtcacttgcagcgatcgtggggtgggggagggcacagcgccctgcagcgcaggcgacggaaggttgcagaggcagtggggcgccgaccaagtggaagctgagccaccacctcccactccccgcgccgccccccagaaggacgcactgctctgattggcccggaagggttcaggagctgcccagcctttgggctcggggccaaaggccgcaccttcccccagcggccccgggcgaccagcgcgctccggccttgccgccgccacctcgcggagaagccagccatgggcgccgccggctcctccgcgctggcgcgctttgtcctcctcgcgcaatcccggcccgggtggctcggggttgccgcgctgggcctgaccgcggtggcgctgggggctgtcgcctggcgccgcgcatggcccacgcggcgccggcggctgctgcagcaggtgggcacagtggcgcagctctggatctaccctgtgaaatcctgcaagggggtgccggtgagcgaggcggagtgcacggccatggggctgcgcagcggcaacctgcgggacaggtacggccaagcgccggcgcggggcagcgctgatccggctcg

SEQ ID NO: 68609 - DNA, 1237 bp, Homo sapiens
  chr1:221051973-221053210
  hyper
cgctctcccgggtttcgggaggcagcctgttttgtagcctctgaggctccggggaaaggtttggctgcgtctaagagagacgtttggagccatccgtcttattttgtttgaaaagtcactcgttcaatttgtcactgtgtgacagctcagaataaaaccaatttgcggccgcccctcctcctcgcttcccggaggatctcctgggaggcacgaggcggacgcggtgctgagttgggccgggactcagggcggcaacatttgggcaagggcccaggaaagatgaggggctttgccgaggacacggactcctggaataaaagcagaatgaggtcaagagaagggaagcaaaggggccaaagcgcgctccgctctccaccgggaggcgggctttgcagagccctaaagagtgagattaccgtcccttccccacgcccccaactcgccccgggtgacaagcgcttcaggaaagctcctgtgatcaaccctccttgccccgtggcggttcggagctgcagaagttagaagagagtcagagccctccggagcggctgcctggcccctacgcagagtagcaagaagcactgcgatgtgcgctactaagcccacgcggccgcagcaaaaactttggcgtggccggggcgtggctagggtccggccaggcccccttgttcctaattcccctccactccccgctcccattggtcacgaggatgaccaatgagcgctcggatcgaggtcctaccccgggcctgactcgaaagctcctgccaaaactttgggagtttttagagacgagtttttttttttttctattacttttccccccccctaactaacggactattattgttgttgttttaaatttagctcttagggcttagctatttgggttttcttgcggtgtccggctcccgtctccctggctcccccgcccgccctgcggccccagcgcccctcgctctcatccagcccgcgaggagtgcgggcgccgcgccgcctttaaagcgaggccagggagcgaggcggtgaccggccgagatccggccctcgcctcctccctcggtggcgctagggctcccggcctctcttcctcagtgcgggcggagaagcgaaagcggatcgtcctcggctgccgccgccttctccgggactcgcgcgcccctccccgcgcgcccacccacccagtccggctggactgcggcagccgcgcggctcaccccggcaggatgttcgcagc

SEQ ID NO: 68610 - DNA, 655 bp, Homo sapiens
  chr1:221053255-221053910
  hyper
cgcttactgctcctcggccggcccaggcggctgctccttccccttggaccccgccgccgtcaaaaagccctccttctgcatcgcagacattctgcacgccggcgtgggggatctgggggcggccccggagggcctggcaggggcctcggccgccgccctcaccgcgcacttgggctcggttcacccgcacgcctctttccaagcggcggccagatccccgcttcgacccaccccagtggtggcgccctccgaagtcccggctggcttcccgcagcggctgtctccgctctcagccgcctaccaccaccatcacccgcaacaacaacagcagcagcaacagccgcagcagcaacagcctccgcctccgccccgggctggcgccctgcagcccccggcctcggggacgcgagtggttccgaacccccaccacagtggctctgccccggccccctccagcaaagacctcaaatttggaattgaccgcattttatctgcagaatttgacccaaaagtcaaagaaggcaacacgctgagaggtaggtcttgggcgggaggctgcaggcctctgaccactgacccactccccggaccccgggctggcttggggtgcctttgagtgtttttacaattaaggacaaatcggtaaaacgggaga

SEQ ID NO: 68611 - DNA, 401 bp, Homo sapiens
  chr1:221067432-221067833
  hyper
ccctaactcctgcctcgtaggcagcggtggggagccgcaggctgctccccgagtcccaacgctactagggtgctgtaacagtgatgaggcggcgttgcagtctggctaggcgctgcagcgggcaccagctacgttttgctgtcggcggcagttacccggacgcaagttaaggggtaggcgcgcagaggcggttggaggcgggcggccggcccctgacctcggagagctgcgccgagcagggcggaaaatttatggtctgtgtacactttctggctccagagccccgcgcaccagaaggatggggccctgcgagcgcgccccaggccgcgagctggggccgcaggcgccacggccatgtatagtgcccacccgactctgttctgcagcgctgtggtcataaa

SEQ ID NO: 68612 - DNA, 36 bp, Homo sapiens
  chr1:221176286-221176322
  hypo
tctgcctttcttttgcggttcttctagttcattttc

SEQ ID NO: 68613 - DNA, 90 bp, Homo sapiens
  chr1:221252407-221252497
  hypo
caggcgaggatagatcggtgtcccatcctgaaggggctgtccttttcacacaggcatttatttatttatttatttatttatttatttatt

SEQ ID NO: 68614 - DNA, 38 bp, Homo sapiens
  chr1:221320657-221320695
  hypo
ctgggattacaggtgctagccaccgcacccggccccaa

SEQ ID NO: 68615 - DNA, 341 bp, Homo sapiens
  chr1:22140673-22141014
  hyper
ggtttcgaataagggattgtagatttgaattaaattaaattaaatcatttaatccttacaatcattctgagattgattaatcatccccattttaccgatgaggaaaatgaggctcagagagggcgagtaactcgcttgggatcacacagcgggcaggggacagagtagagttcggggtcgcgccgcgcggctccagtttccgtgccttccgctgcagccgacctggcggaactgtgcgggcagacgtggcagggggacgggctgctgctgcgctcgcacgccgcatcgcgcaggttctacttcgtggctccggacaccgactgcgggctctgggtgcaggc

SEQ ID NO: 68616 - DNA, 293 bp, Homo sapiens; identical to SEQ ID NO: 26129
  chr1:22141015-22141308
  hyper

SEQ ID NO: 68617 - DNA, 53 bp, Homo sapiens
  chr1:221706685-221706738
  hypo
ttaaggagcttgctccggatgacaaggcaaatgcctggcggatagggatttgg

SEQ ID NO: 68618 - DNA, 357 bp, Homo sapiens
  chr1:221914136-221914493
  hyper
tgaattgttgcccaccggatctatctctgatttcagagtgtctgcaaaaagacagctccttcctcctgtaggcacaggggcactctacaactcaggcttgctaactcttcttcttctattagacatgcacatagcaaagacgccaaaccccacgccaagagacgctcacctaaacgaactttaagagctatcaggaaaaatgccatctatcatccgtctacacacgaccgtcaccattctcatccgtctacacacgaccgtcaccattctctgacacagaaccaaagtgtcacaggcggaatccacactcacgcgcgcacacggggcacgcacccatcacgtcggcagatctccaac

SEQ ID NO: 68619 - DNA, 166 bp, Homo sapiens
  chr1:222210334-222210500
  hypo
gcaaataaagcgaggcgagatgggcattcctgggtggaatgtcatttcacgggaggactcaaaaggccacactgagagcataatggatgagcagagaccttcagggagagtgggaacaagctgtgtgggcgtttgtggaagaagcagtgagcgagaagaccctgag

SEQ ID NO: 68620 - DNA, 167 bp, Homo sapiens
  chr1:222279248-222279415
  hypo
tccaagccttgatcccggattatctcctgatggtccctgatctccactcctctctgcttccagtcccactgtcctgcaattacacaggaagcactggaccaagaagccagggcagagaatagcggatgagatgaggatggtcagtgtggcatcgggagcgggggaag

SEQ ID NO: 68621 - DNA, 30 bp, Homo sapiens; identical to SEQ ID NO: 39244
  chr1:222391027-222391057
  hypo

SEQ ID NO: 68622 - DNA, 135 bp, Homo sapiens
  chr1:222794527-222794662
  hypo
aagatttcacaggcccggattgtcgttttgtgaattttaaaaaaggtgatcctgtatatgtttactataaactggcaagaggatggcctgaagtttgggctggaagtgtaagtaaaatatcgacatactttattt

SEQ ID NO: 68623 - DNA, 187 bp, Homo sapiens
  chr1:222987570-222987757
  hypo
ctcctggccagctaccggtacaagccaagctctcactccataacgtccttcttctctgcatgcccttctccactgtgcctgtcctttaactcttattcatcatttatttcagtctcaattgaagagtcattatttctagaaagccttctccgcccagctctctacattgcaccgttccctacagcac

SEQ ID NO: 68624 - DNA, 267 bp, Homo sapiens
  chr1:223302777-223303044
  hyper
ggaaggccctgctcccgaccgacccggagcgcgctgctgccctctaccggtcatccgtgcggccggacaccgtgtcaggcccgcgaggagggctctgccgcagtcccggggaacagcacccagcagcgccactgggagaggaaactggggtcagggaggtgtgactgggccccaggcagtcacactcaggccaacaaggtcagggagggagggcagctcactcgtgcaaacgtgagtgcaaaatgcactccacggccaggaacaggc

SEQ ID NO: 68625 - DNA, 179 bp, Homo sapiens
  chr1:22333829-22334008
  hypo
cccagacccctgactcggtgctttttatccttgcagccaatgggccactcccagacaagctgcagcaggcccggctgcccgtggtggactataagcactgctccaggtggaactggtggggttccaccgtgaagaaaaccatggtgtgtgctggagggtacatccgctccggctgcaac

SEQ ID NO: 68626 - DNA, 30 bp, Homo sapiens
  chr1:223361283-223361313
  hypo
actggaaacaacccccgtgtccttcaacaa

SEQ ID NO: 68627 - DNA, 30 bp, Homo sapiens
  chr1:223376610-223376640
  hypo
ggcaggtgctgctcccggtgagatggtgca

SEQ ID NO: 68628 - DNA, 208 bp, Homo sapiens
  chr1:22349452-22349660
  hypo
cggcctatgctcagttttaagtactggggtcatggtggtgacagggcagacaaagtccttagctttgtggacactgcctctagtggatgagatagaaaataactaggtaatcacaaaaacaaagtaacaggttataaaggaattggaagggtgcccggggtcgggggatagaggaggtgggcagaaaaggagacgctacagttgaact

SEQ ID NO: 68629 - DNA, 175 bp, Homo sapiens
  chr1:223536480-223536655
  hyper
ggacgcaggcaccctcgcgttgtcagatcctcctgaagtctgggtgtatgggggaggggtgcagggctgtcctggcagctaggctctttctcccctctgggccatccccaggccctcccaccacagctgggtcactcaccgcccgtgagctgtgcagggccgaagcacagcgcca

SEQ ID NO: 68630 - DNA, 304 bp, Homo sapiens
  chr1:223537183-223537487
  hyper
ctcacaatgtggcaccgtctcccccagctacttctctggttttcctcgggattgggatcgatcctactgccccagtccccagtgagatttctctgcgctgtcaaaaaaaaaaaaaaaattctcccttggggagctgcaccaggcaccaactccccctccccggcctgcgcgcgcctcctcggaatggaagacccttccgggactgtcggtcttacctgtgggtctcatgcatgcagcttccttccctcctccgcctcctccccccgccagtctaacccgcatctgtgcgcgacctctgctgccg

SEQ ID NO: 68631 - DNA, 33 bp, Homo sapiens
  chr1:223537913-223537946
  hyper
cggtcgccccttccccggcgctggactgcagcc

SEQ ID NO: 68632 - DNA, 423 bp, Homo sapiens
  chr1:223538158-223538581
  hyper
agtctcttaatttcccgcgttaacccctccccgctcccatctccgccgaagctctgcgcgtccccagggagcccgaaggaccatctgaggcggctgagagacactctccccctcccccacacccttggtattttccctctgccagccgcaggtgttgcgagtgaggacccctgtccggtcttggagatgcgcggggccctcggagccttggcctgggaggcgctcccgggggcggggaggcgggggtagcgggtgattggtgacacgcagaaggttgggtacctggaggaggggaggcttccggggtcgtagatgggaagccaagggggtcggtggtaattgccctcccagccccaagtggagagagttggcctggtcggtcccctgtctctgcgccgattctggtgtcggagctcagcccgc

SEQ ID NO: 68633 - DNA, 41 bp, Homo sapiens
  chr1:22378609-22378650
  hypo
gaactggtagtgggccgggcgcggtggttcacgcccgtaat

SEQ ID NO: 68634 - DNA, 30 bp, Homo sapiens; identical to SEQ ID NO: 39246
  chr1:223841897-223841927
  hypo

SEQ ID NO: 68635 - DNA, 18 bp, Homo sapiens
  chr1:223899327-223899345
  hypo
tttgatatggagtttcgc

SEQ ID NO: 68636 - DNA, 189 bp, Homo sapiens; identical to SEQ ID NO: 39247
  chr1:223907491-223907680
  hypo

SEQ ID NO: 68637 - DNA, 176 bp, Homo sapiens
  chr1:223922172-223922348
  hypo
tatttcttccttattcggacaccccttgcttccaaagaagagtttcggaaggctcaagacggtgagacagacaccttatgcactgcttcactctcccccgcagctcccctccctcctcactgacccccggccacaaccctctctccttgcccctcaccagccggcacccttggcaa

SEQ ID NO: 68638 - DNA, 25 bp, Homo sapiens
  chr1:223927954-223927979
  hypo
cttgttccctggtgccgtaaagaaa

SEQ ID NO: 68639 - DNA, 173 bp, Homo sapiens
  chr1:223936580-223936753
  hyper
ccaagtgcaagaaagcgcagccctgagcctcccaccccaggcctcggccgctgcgctagtgcgtccggcggtcccgcccggcagtaggacagagggagcgagggagtccgggaggaagggagagcgggtgcggccagtctgacggttgctgtgtttgcagatcaccagcgccg

SEQ ID NO: 68640 - DNA, 215 bp, Homo sapiens; identical to SEQ ID NO: 26882
  chr1:223936995-223937210
  hyper

SEQ ID NO: 68641 - DNA, 30 bp, Homo sapiens
  chr1:223990949-223990979
  hypo
tttggcaaacagctacggtctacctgcagc

SEQ ID NO: 68642 - DNA, 86 bp, Homo sapiens
  chr1:224072197-224072283
  hypo
catgcatgcacaatgcgttcattagcatatagtgctacagggtgcaggggaaggagctagctctcattagaagggttcagaaggtt

SEQ ID NO: 68643 - DNA, 30 bp, Homo sapiens; identical to SEQ ID NO: 39248
  chr1:224232559-224232589
  hypo

SEQ ID NO: 68644 - DNA, 24 bp, Homo sapiens
  chr1:224251284-224251308
  hypo
gattacaggcgtgagccaccacgc

SEQ ID NO: 68645 - DNA, 120 bp, Homo sapiens
  chr1:224267382-224267502
  hypo
tctaaatgcttctgcctctgagtcttcccttaagttataacagtacctacctcctaaggctattgtaaggattgaatgagtaaacatttataaaacacacagcacaggtgcaagggtttt

SEQ ID NO: 68646 - DNA, 159 bp, Homo sapiens
  chr1:224267802-224267961
  hypo
gactctgtctcaaaataataataataataataaagtggagagaattagaaggcttcccggagaagagtagattttacttggtccagaaaaatgagtaagatttagatgggatgaggaaatggcatgaggacgaggatgtgacagcgtgactaaggaaca

SEQ ID NO: 68647 - DNA, 29 bp, Homo sapiens
  chr1:224300927-224300956
  hypo
ggcgtgagtcaacacgcccagccttgtaa

SEQ ID NO: 68648 - DNA, 23 bp, Homo sapiens
  chr1:224361283-224361306
  hypo
tgagattccgtctcaaaaaaaag

SEQ ID NO: 68649 - DNA, 152 bp, Homo sapiens
  chr1:224386053-224386205
  hypo
gagggccagcatggccgaggcgcctggcagaggaggctctgagagcagaggggagacagagcagtgacacctggagtggaggcctgaaggctgatcagagcccagcgagggtcatgcctgcagggcgtgctagcaaacgcagggctgggaca

SEQ ID NO: 68650 - DNA, 34 bp, Homo sapiens
  chr1:224400490-224400524
  hypo
gatcaccagtgtccccgggcgctctgggaggcag

SEQ ID NO: 68651 - DNA, 119 bp, Homo sapiens; identical to SEQ ID NO: 38886
  chr1:22447958-22448077
  hypo

SEQ ID NO: 68652 - DNA, 277 bp, Homo sapiens
  chr1:224528612-224528889
  hyper
ggggctccaggtcctcgctgggcacctctctgcccaaccctctgcacccagccggcttctcccccaccgacggggagccccgcctggccccatcgcagagacccccagagcggcgggcttttgttggggggttcccgcttgtccctggctcctgccgtctctgtggagcgcggcaccgccttggatccagctccacctcctccccgtgccctccccacgaggcctgggagcgggtcctgcccggctgcgcaagggtgggggtcgcgcagttagctgc

SEQ ID NO: 68653 - DNA, 37 bp, Homo sapiens
  chr1:22468804-22468841
  hyper
ccttccttctgtctccggctcccgccccccaagcaga

SEQ ID NO: 68654 - DNA, 135 bp, Homo sapiens
  chr1:224803348-224803483
  hyper
caacaccaataccaccgagccctcgttgctgcctcttcagcgcagaatagcccaccaagtccacgtttccctagtcccaaggtcggatggctggggagggtagaggatgcaacggaaggacgttaatggagaatt

SEQ ID NO: 68655 - DNA, 549 bp, Homo sapiens
  chr1:224803747-224804296
  hyper
agtccctgctccaaccggtcccgccccacctccgctcggcctccagccctgcttgtactgctggcttcaagtttcctccgagaggcgggcgtgcacagctgcagtggcggcggcagcggccaccaagcgcccggcggcgcttcgccacccacctttcctcagcccccggcgctgcagtctccgcccgccggggagggcgcgctcagcggaacaggagtcgagggtggggcgccgagaggagggaatcccgggtcgcaccgctacagttctcgcagtggcaaaggcggcggcggcggcggcggcagcggcagcagcaggtggagcgagctacagcgtttggcctgaaacccactgctgcagccacccgggctggagttggcccgttgggtggagccagtgctcgccccggtccgacccccggtttccgggacacttgggttgcggaggccggctggccggagtcacggttggggacgggcgcgcctcggagcgcacggctgcgctggaagccgcgtctggggcgcaggaccaacgggacctacctcctcc

SEQ ID NO: 68656 - DNA, 292 bp, Homo sapiens; identical to SEQ ID NO: 26886
  chr1:224804395-224804687
  hyper

SEQ ID NO: 68657 - DNA, 270 bp, Homo sapiens; identical to SEQ ID NO: 121
  chr1:224804846-224805116
  hyper

SEQ ID NO: 68658 - DNA, 555 bp, Homo sapiens; identical to SEQ ID NO: 122
  chr1:224805197-224805752
  hyper

SEQ ID NO: 68659 - DNA, 18 bp, Homo sapiens
  chr1:224805848-224805866
  hyper
cgccggtcctctcaaaga

SEQ ID NO: 68660 - DNA, 29 bp, Homo sapiens
  chr1:225113123-225113152
  hypo
aaatttgtggccaggcgccatggctcacg

SEQ ID NO: 68661 - DNA, 425 bp, Homo sapiens
  chr1:225117226-225117651
  hyper
tgtcacatcgggggccgccgcgtacccgcggtggaatctcgcaagagccagggcccctcctcacctgcccggcacccaggatcccttgcgccgcgttcgggaccccacccccattgtggcctcttcgccagggcgcaggcgtggctcttggtcaggcggttacggccaggaggcgtcggagcctggcgtggtagggctgtgctgcgcggtccttcccattcaccctagtctggcgctcgccggcgtgggcgggccggaccttcgccgcttccaggaagggccacaacggccgtcggaccacggcgcggcgggtaaggtcgtcagcgtcttcctgtcagcggtcggcagagcctcggcgggcgggcggcgcgtggggcagccggtgtcgcactgggagggctgcgtgggcgcggagggcctgggcg

SEQ ID NO: 68662 - DNA, 120 bp, Homo sapiens
  chr1:225118168-225118288
  hypo
gcattatgtgtttgtggtgatgctattgtaaactgtgctgccagtcataaaagagtagcacatacaattatgtacagtacatagtacttgataataacagatgagtatgttacttgctta

SEQ ID NO: 68663 - DNA, 35 bp, Homo sapiens
  chr1:2253171-2253206
  hypo
cacaggactggccaccggaccggtcctggggggct

SEQ ID NO: 68664 - DNA, 148 bp, Homo sapiens
  chr1:225632491-225632639
  hyper
caacagataacaaatcgacattgtcgtgcataaatgtagagctgatccgtatttcatgtcaaaggcctggactgtgtgaaattggctggtatttgttccagaagcacttgttcatgttgaagatggggcagttctgagtgggttagca

SEQ ID NO: 68665 - DNA, 121 bp, Homo sapiens; identical to SEQ ID NO: 14333
  chr1:226062878-226062999
  hypo

SEQ ID NO: 68666 - DNA, 36 bp, Homo sapiens
  chr1:226069474-226069510
  hyper
tcgcctcaccctttccgcccccgcccttccccccag

SEQ ID NO: 68667 - DNA, 30 bp, Homo sapiens
  chr1:226085269-226085299
  hypo
aatgacaaagaaggccgggtgcggtggctc

SEQ ID NO: 68668 - DNA, 90 bp, Homo sapiens
  chr1:226109616-226109706
  hypo
cagtgcagaagcccacgctgctcatgagctgctccaggagctgcccatcctccaccagggcatgggtgcccgtggcgtacactgtagcgc

SEQ ID NO: 68669 - DNA, 99 bp, Homo sapiens
  chr1:226150253-226150352
  hyper
gcagccagcaggggtcgctgcagacatgggaatcacggtgctgaccgtgcctctgcagcgctgtcttcaggtgcttttgctgaacggtcatatcttctc

SEQ ID NO: 68670 - DNA, 86 bp, Homo sapiens; identical to SEQ ID NO: 39254
  chr1:226163129-226163215
  hypo

SEQ ID NO: 68671 - DNA, 30 bp, Homo sapiens; identical to SEQ ID NO: 39255
  chr1:226284013-226284043
  hypo

SEQ ID NO: 68672 - DNA, 127 bp, Homo sapiens; identical to SEQ ID NO: 39256
  chr1:226303892-226304019
  hypo

SEQ ID NO: 68673 - DNA, 370 bp, Homo sapiens
  chr1:2263053-2263423
  hypo
tgtgcccatgaaacccgggcttcccttggggcacagcttgtgaaggaaccttggctcctctttcctctgcctattttagggaacagtcaaagacgactttgcaggatcctgcctgagagttgtaacaaaggcgcgcgtttctcccgcatgcgccgtccttcttatgtaaccactgccgctcctctcccgcggctgcgcctctcccgccgctgcgcctctccctcgtgcggctctcccgcccctgcgcctctccctcgtgcgcctctcccgcccctgcgcctctccctcgtgcgcctctcccgcccctgcgcctctccctcgtgcgcctctcccgcccctgcgcctctccctcgtgcgcctctcccgcccc

SEQ ID NO: 68674 - DNA, 146 bp, Homo sapiens
  chr1:226314896-226315042
  hypo
gtgtggggccgcatgcgaagctgcctccgcgccttccccgagcggctggccgcctgcggggccgagtaaggacttctgcgcgcgggagttcgaggccctgcggagctgcttcgccgccgcggccaagaagacgctggagggaggct

SEQ ID NO: 68675 - DNA, 232 bp, Homo sapiens
  chr1:226410992-226411224
  hyper
caggcaaggtgcttccgccgctcttaacggggatttgacccggagaagagagttctgtcgcctgcggcccgcgcacccgggcccctccgggctgcccctcccaggcaaatagtccttcggggatgtggattgcgccgtccgggcgggtgggcggggaagaacacggagggggccgggacccaagttcacgcctccctcctgcatcccgcagccggcggaagcgattattccc

SEQ ID NO: 68676 - DNA, 758 bp, Homo sapiens; identical to SEQ ID NO: 26895
  chr1:226411246-226412004
  hyper

SEQ ID NO: 68677 - DNA, 81 bp, Homo sapiens
  chr1:2266113-2266194
  hypo
aacactccgactccgcggccaggtcgtcctgggattgaaacaatcctagtccaacgacacttaactcgaggacagtgcgag

SEQ ID NO: 68678 - DNA, 43 bp, Homo sapiens; identical to SEQ ID NO: 39258
  chr1:226620644-226620687
  hypo

SEQ ID NO: 68679 - DNA, 16 bp, Homo sapiens
  chr1:226702271-226702287
  hypo
ccgataaacacaagag

SEQ ID NO: 68680 - DNA, 597 bp, Homo sapiens
  chr1:2267155-2267752
  hypo
gtgctggtcactctgcgagcaacccagcagctcctccacagtgtgcggggccaggcgagggctggtgggacgggtccccagggcacatcagcgggggcctcctcgcctccatagcccagcccagcccagcgcgcagctgcccccaatttgtagacagagtcccgatttgaggtggcagctgttgctggactccgagccccgagccccagcttcctcctggtagaaccggccggttacggccctgcatgtgctgtgcccgtagcactgccaggcccaggatggtgagatgtgacggccacaaaccccccacggtgtccccgcctgcacgtgccgcggtgtgcacctggtcccactcctgtcctccagctcacagagtcccctcaagccactgccctgaaccctggccaccagccgtcttcctctgagaggccccgcacccctcctgcctctctgcttctgcatgcccacagcctggtccgcccggcgggtctgggagttgtggtgatcgaagcagatggaccggctccagctccacccacttcatgccagcccaggcaagtcgcagggcagctgttagccccgcgagaccctggctgg

SEQ ID NO: 68681 - DNA, 30 bp, Homo sapiens; identical to SEQ ID NO: 39259
  chr1:226725373-226725403
  hypo

SEQ ID NO: 68682 - DNA, 249 bp, Homo sapiens
  chr1:226735996-226736245
  hyper
agacgggagccactgcgctcgccccaaacaaaatcatttaaatcacaatgcactgaaggccgactaggtgtcaggcgccgcgcggtccgtcccttgtccccatgtccctggccaaaggcttgctctagatcaggggactcagcctcgaggctttcccgacggtgtcagccaagcacacactcccagttcgcagggcttcgtggtcaaggttcctagttcacctgtctgggagggcgaggtgtgtccacc

SEQ ID NO: 68683 - DNA, 1021 bp, Homo sapiens
  chr1:226736532-226737553
  hyper
acagtctcctgctcccgtacgctgggcgccagctccggccgtgctgcccggctgcctgagagcgcgcccggccatggagccctcgcacaaagacgccgagacggcggcggcggcggcggcggtggcggcggcggacccccggggggcgtcctcgtccagcggggtggtggtgcaggtccgcgagaagaagggccccctgcgcgccgccatcccctacatgcccttccccgtggccgtcatctgcctcttcctcaacactttcgtgccgggactgggtaagacacggctgccgcgacccttgcgacccccaccccgccgcgggagggcgtggggggagagaagggcgcggccggagacctcctggcggggccgcgcgctccaagtgctgcgaccacgcgccaccgcccgctcctggcgtccccgggcaggtggcagaagcgcgtggagtgtgcaccccagaggggagaggctgcgctggggtctccgacccgcaggcggggccccaaagagccggaaactttgcggccaatgttggagcccgcagcggcggccggaatggctctgccggcttcggagtagggctcccgtcccggcgccccgatttctgctccttctctccgtcgtgtgcatccgtccgcgagcccacttccccgagaggaatggggtcggatcagaatgagctctagggcctcggcggcgaggatcaaactcccgggcgtcgaagtcagctgagccggggaaagaggacgagccgggctagatatacctgcagccccctttggttcgcggagtgcggaccgcgtggggacgagaactctagccagagtctcctccgcctcattcaggggtacctgcacttccgccagcaccccgcagggcgccagggggatgggggatgattttattagtttggatgcatgtggccagagatgaacccatagctccctcggatcccttctgttcctgagaagtagagagtgcgccgatgtaattctgtgcaggactccggcagccggcaggg

SEQ ID NO: 68684 - DNA, 72 bp, Homo sapiens
  chr1:226737889-226737961
  hyper
ctttggcctttctcacggtctcctcgctcttcgcctgcttagcaggggcctctgctgcggtgacagccaagg

SEQ ID NO: 68685 - DNA, 139 bp, Homo sapiens
  chr1:226816229-226816368
  hypo
cctacaaagtggggtcgacgaagctgatcatagacttttttataaagattaagctacttagctttaatcacctggtatggtgcctggcacaaagcaatctttaattgctactggttgccattattctcaggcaggagtt

SEQ ID NO: 68686 - DNA, 18 bp, Homo sapiens
  chr1:226816428-226816446
  hypo
ctccgtgacaactacaca

SEQ ID NO: 68687 - DNA, 37 bp, Homo sapiens
  chr1:226826631-226826668
  hypo
gcttccccgcctacccgccgcacgccagggacaagca

SEQ ID NO: 68688 - DNA, 54 bp, Homo sapiens
  chr1:226829338-226829392
  hypo
ttcggtgccaggcaccgtctgggctaaatggagagtcctcggcagagggctgac

SEQ ID NO: 68689 - DNA, 300 bp, Homo sapiens
  chr1:226846358-226846658
  hypo
gccgtgtgatgttcccgcaggctggatggcaccgaacatcctccacagcgctgctcaccaggcacgaggttcttctcccccgccctttatggaacccatgagcgtagggtagggattactgagcgctgtcgggttggtgaagtccctccttcagaagcaactgctgggcctggggcaggagaacgaggatgatgggtccttaccagcccctgcagaccgggaccccctgcaggggctacacgaaccagctcagtgaactagctagctaaactagctccaggtgagcgctctgtcccctcc

SEQ ID NO: 68690 - DNA, 30 bp, Homo sapiens; identical to SEQ ID NO: 38735
  chr1:2268713-2268743
  hypo

SEQ ID NO: 68691 - DNA, 82 bp, Homo sapiens
  chr1:226908374-226908456
  hypo
agtattttttacagccgtaccacctgttaattcatattgaactggtagtaaaattataactcccagtgaatttcaaaagaaa

SEQ ID NO: 68692 - DNA, 58 bp, Homo sapiens
  chr1:226924772-226924830
  hyper
cctcttggcctcctccggccctggcggggagagggtaccggctgccaccacctgctgc

SEQ ID NO: 68693 - DNA, 759 bp, Homo sapiens
  chr1:226924900-226925659
  hyper
cgctgctactattcagcctgcgccggccgctccgccagcccccggggctccggggctcctcgggggacagcgactcggctggggggaagaggaaagaggcgcctctcccggggctgaaaacgctgccggggctcagcactgccctcctcgggggcgggggcgtctcgctgccactgggccccgggccgccgccgctcttcatctcgttggcgctattcatgatcaccaggctattgagcgcatagcagtacacagccatagtactgggtcccgcgctgcccgccgccgcggctcccgctcctgctccgccgccggcgcctcctcctcccggcgctcccggctcagccccggaggcccggcagccgcggctccgcgcgcagatggggcggcatggcctgggcagcgggctgggggcacgaccgcgggctcagcccccgcccaaagctccataaacaaccgtgcggctgtggagatacaaggagaaaagtcaggaccctggagggcgcgcggggggagttgggggtcgcctgcagaacccagagagagccccgggaacacaatctatccgggacccagcgccaccggacatctcacctatggggacggcgaggctcggcgagggcatgccccggctgcctcggtcgccagcgcggtttcgggtgtgcttccccgccccccacctcgccccaggctgcgatgcgctttatgaggtcccttcaaatcccaatcctaatactcgtctcgcggaccggcgagaag

SEQ ID NO: 68694 - DNA, 86 bp, Homo sapiens
  chr1:226926865-226926951
  hyper
caaaaaagaggagtgcgaaagaggggggaaagctcttcggttcaggggcccggcgatcccggcagtggcgacgccaagccggccct

SEQ ID NO: 68695 - DNA, 38 bp, Homo sapiens; identical to SEQ ID NO: 39263
  chr1:226954853-226954891
  hypo

SEQ ID NO: 68696 - DNA, 30 bp, Homo sapiens
  chr1:226972978-226973008
  hypo
aaaaaaatggttttccgtttgagagtctcc

SEQ ID NO: 68697 - DNA, 30 bp, Homo sapiens
  chr1:22710484-22710514
  hypo
aggattccacaagtacgagagtgtgtgtgg

SEQ ID NO: 68698 - DNA, 52 bp, Homo sapiens
  chr1:2271392-2271444
  hypo
ctgtgcagacacaggcgcctccgccgcgcggcttctccgtgtttgctgaaga

SEQ ID NO: 68699 - DNA, 30 bp, Homo sapiens
  chr1:227163741-227163771
  hypo
atgttgcctggctgccgggcagtggggctg

SEQ ID NO: 68700 - DNA, 55 bp, Homo sapiens
  chr1:227174055-227174110
  hypo
tgaatgagaactcagcgccccgggcactgtgggaggaacccgggctggtggaggg

SEQ ID NO: 68701 - DNA, 42 bp, Homo sapiens
  chr1:2273867-2273909
  hypo
ttggccctaaggggacgagaacagtctcgtttggaggtgacc

SEQ ID NO: 68702 - DNA, 54 bp, Homo sapiens
  chr1:2274776-2274830
  hypo
tgtagctgccagagccgctgggccctgtgacagagccgccgggccctggggatg

SEQ ID NO: 68703 - DNA, 343 bp, Homo sapiens
  chr1:227505516-227505859
  hyper
agtcttgcccggaggcggcttttcgtttctcctcccgaggtccttctttctttaaggctttgcagtcagtcctattttcaacggattccggtgaaaactcttcattttcctcccggcttcaccctagggcctgaccggcggcgcggccgggggtggaaggcgggctgcgggcggcactggcaccgggctccggagaagcggctacttggccgcccgagcccactccatgtcggtggtcgctcgtgggccgagccgcgccgcgccgcgccgggcagagagcccggtctccccgacacccgcaccgggccgccgcgccggaggctcccgacgccccaggcggggg

SEQ ID NO: 68704 - DNA, 196 bp, Homo sapiens
  chr1:2275639-2275835
  hypo
taggggcccttcttgcgagagcggcatcacctgagggctgggcgtggccaggcacaaggggctggcgggcctgggagggatctgcagggcaggttgagacatggttctgaagccaggcagctgctccccagaagctccggtgagcacactcgacaaggtggtgcggcgagctggctccgagcgtcccccacagggc

SEQ ID NO: 68705 - DNA, 111 bp, Homo sapiens; identical to SEQ ID NO: 38737
  chr1:2276089-2276200
  hypo

SEQ ID NO: 68706 - DNA, 815 bp, Homo sapiens
  chr1:227729829-227730644
  hyper
cggggccgggccggcgagagaagggtccggggcacccagtgggctcggatctcgagcggtccccgtgacggccccgcgactgcgcgacttcccgctctagagagtttatggaccctgtcccaggagggctccgcagccgccagggaggtaccggagggaccgcggcgctgggagagggtggcgccaggcggccctggagccctgggcgacgcggccgggccggccagagggcggagaagtccaaagcagcagcccggacagccgcttccgcccctgcgccgccctcccggcccaggtgaccggtcgccctacccggggagcagcgccctcctcctcctgggccggagccgggcgtgggggtcgcaggctggtgccacagcctgaggacaccgcggcctctgccccggggagcacgccaaatgccggacggagcggctgttgcagacggtgaggccgcagccccgcttgagggtagggtcgggcggggtgtcggggtcctggcagaggccgcggcgagggcaggagccggtgcgctggccgctgcacatgcgccgcccggcaccgggaccctgcgggcgcgccccctggtggcagccagcgggaggtggcgtccctgtccccagccaggcggcagcgcgaagctgcctccccgcggggggagcggaagtggcccagctgctcgagtgacttactagttaaaaagctggggttggagctgccacgcggggaagtgtggaggcctgcggggctccgcctagactttctgggtgtcctcctgggacctcaggttcctcacctgtcgcagaggactgatg

SEQ ID NO: 68707 - DNA, 203 bp, Homo sapiens
  chr1:227750829-227751032
  hypo
ggacagttccacaggcgcaccggaatgcgcctcccctttccacccgccagcattcccaagcacgcctcggcttctgactgttctgtgctttgggaggaaaactcatcttcaggtttttctccaacagaagatgatgatgacgttgtttagacactcaggaacagagattgcagattggcttaagagtgcgccctttattaaag

SEQ ID NO: 68708 - DNA, 184 bp, Homo sapiens; identical to SEQ ID NO: 38887
  chr1:22777513-22777697
  hypo

SEQ ID NO: 68709 - DNA, 30 bp, Homo sapiens; identical to SEQ ID NO: 14336
  chr1:227921541-227921571
  hypo

SEQ ID NO: 68710 - DNA, 53 bp, Homo sapiens
  chr1:227921780-227921833
  hypo
gagactagggcagcacgagtggggcaactgagaccaatcggctccagtggagc

SEQ ID NO: 68711 - DNA, 61 bp, Homo sapiens; identical to SEQ ID NO: 39268
  chr1:227926624-227926685
  hypo

SEQ ID NO: 68712 - DNA, 151 bp, Homo sapiens
  chr1:227955886-227956037
  hypo
ccacagggtatgtggcgcacatgcagtctccaggtgcagcttccgtctcgtcttcccctacagttgattcctggaaaaagcaaagctgtctgttgggctgagactgtgcactttggatcttgcagttctgtgtccacgcagggcatgggct

SEQ ID NO: 68713 - DNA, 71 bp, Homo sapiens
  chr1:227975163-227975234
  hyper
agaaggtaggggtctcggtgtggccggagcgattcactgtctggcacccacgataccggtctcctttgctt

SEQ ID NO: 68714 - DNA, 360 bp, Homo sapiens
  chr1:227976261-227976621
  hyper
ggctcctccaggtagcgcaggagcccctccggctgccggagccccgcgagggcgcgagtggagggcaggagcccgggcggcggaggagcggaagggatgctgcgttgccttggagtgtcagggtgggggaggaaagaccaagggacccacgtccttcgcccccgccgcggagtcccgggccggcgagacttccgcagcctgcccagcgccggggacctagggctttgcaggagtccgcccgggagctctatcagagcgggcgtcctccccgccgctccaaaggtggcttggggcaggtggggcgtcccggagggaatggagggaccctgcctagggaaggtgagtcgtgtgtggtcgggt

SEQ ID NO: 68715 - DNA, 30 bp, Homo sapiens
  chr1:228071573-228071603
  hypo
ctagctccctgtgtgcgcatccctagctcc

SEQ ID NO: 68716 - DNA, 43 bp, Homo sapiens
  chr1:228074452-228074495
  hyper
gtgggtggagagaggcggaacgggagcccgggaagcctggggg

SEQ ID NO: 68717 - DNA, 375 bp, Homo sapiens
  chr1:228074787-228075162
  hyper
tgagaacattttttccgacgcagcccgcagcgattgtctccctcagaagcagcgctggggacgccctcctgggccgggcagggggcgggggactggggccggggctgcagccagccagccttccttggggcccaaccccttcgccgaccctgcagggtgggaccccacccccgagtggaagaaggaaccggaagccaggcccgcgggcagggagggtgggggcgaatccctaccccacccgaggggaggggcctgagaagggcttttccccccctcttcctccattctgcccccttactcctccctctccaagattccaaatccccttcatcccatagaggggcttcctggcttctggcccgcccgcggtgcaca

SEQ ID NO: 68718 - DNA, 153 bp, Homo sapiens
  chr1:228082129-228082282
  hypo
gacacagggtgtccacgatgcaagcatccacgcacgtgcccatgccacatgcacacaaccatgaagggtgtccatacacaagccccggacacatggtgcttgcaggcatgcgcctgggacctttggttttcacgaacgcgtccatgctcttca

SEQ ID NO: 68719 - DNA, 221 bp, Homo sapiens; identical to SEQ ID NO: 39270
  chr1:228083399-228083620
  hypo

SEQ ID NO: 68720 - DNA, 30 bp, Homo sapiens
  chr1:228092133-228092163
  hypo
atctccatgggatcccgggtggcgggcatg

SEQ ID NO: 68721 - DNA, 47 bp, Homo sapiens
  chr1:228117865-228117912
  hypo
aacgtcggatccacacgctctgtggcgtgtcacgtggtccatgagca

SEQ ID NO: 68722 - DNA, 30 bp, Homo sapiens
  chr1:228126165-228126195
  hypo
acacatccacaggaacgaacacacccacac

SEQ ID NO: 68723 - DNA, 200 bp, Homo sapiens
  chr1:228134691-228134891
  hyper
caccctgcacctcagcgcgcccaaagcgcagcgagggtccctgtaaaggtcgcaggactgggcatcccagacctcagagagggggagggaagaaggaagggaaagaaaggaagagagagacgcgccgacagcccggcaaagcgctgctgcagagacacgtgagcacgggcaatgacaccgcgggacgccccggccgggcc

SEQ ID NO: 68724 - DNA, 197 bp, Homo sapiens
  chr1:228135107-228135304
  hyper
aagctgctaggtgggcgatggccaggggctgaggactcaggctccagccttttggcaaggacacggcggcccaaggaagtcgggacctgatcccagtccctaagcgcgaggcagtcctgctcacggcggcgactacgacgacgacgactctgcggtcacggaggaccgcggcccggcgcaagccggacgggtccacc

SEQ ID NO: 68725 - DNA, 359 bp, Homo sapiens
  chr1:228135362-228135721
  hyper
cgccaggcaacccggcggccccgccgcgccccggccccagccaccccgggtgcctcggggactccggacgaccccgccccggccccgccgcccccgcccaccagtgcgcgccggccgccgaaggcacctacccgaagtaggcggccgaagggcgcagcgcggcgagcagcagcgtcagcccgaaggccgcggccagccagcgcgccagcggggacccatccagcatcttgccgcgcctcggcggccgaccatcgcgctcccagctccgcgcagggcgcgccgcggccgccgccctcttatagcgcccggagcgcggccagctgggcccggccccgccccgcgcccgggaggggatcacg

SEQ ID NO: 68726 - DNA, 46 bp, Homo sapiens
  chr1:228136106-228136152
  hyper
ctgccccgagctgggcgctgcgcggctgctccgggggaagcttggt

SEQ ID NO: 68727 - DNA, 30 bp, Homo sapiens
  chr1:228136517-228136547
  hyper
tctgcgatacggattcggagctgcttctga

SEQ ID NO: 68728 - DNA, 30 bp, Homo sapiens
  chr1:228193886-228193916
  hyper
ctgggggcagcactgcgcttccccaccgtc

SEQ ID NO: 68729 - DNA, 285 bp, Homo sapiens
  chr1:228194126-228194411
  hyper
cagctctggtctcagcggaaggagtccggccgcaggcagacggggccaaaggacgtgcacccgacaaccgtccgctccctccccaaacccccgccccgagaaggttgatggatgaaggggagccctagcccagccacctcgggggcaagagacggagctcgccacagaccaggagcgagagggggactgcgggtcccaccgtgagcgcagggcgcgcggggctggaaacccaggacgcggcccgggagctccaggagggcgcctgcggatcgcgcggccccgggc

SEQ ID NO: 68730 - DNA, 1999 bp, Homo sapiens
  chr1:228194570-228196569
  hyper
cgcccgggccccggccccggcgggcgccccccgcggcgctgccccgcccccgccgccccgcgccgccccgggcctcggcccgcagcccggccgccggcccacctggcgcagcgccgccctcggagcccgcgcacacccgcgcacccgcggccgcaggagggcccagcgacgccgccgcgccagctcccagggcccggccccccccggcgctcacgctctcggggcggactcccggccctccgcgccctctcgcgcggcgatggccccactcggatacttcttactcctctgcagcctgaagcaggctctgggcagctacccgatctggtggtgagtgagcctcctcgcgttcgcccctgcccctgtgcgccgcgcccgcagcagacggtcccctcgggcagggaccccgcggtggcccgagcccgcgcccttctgctccagccccgcgtgcgggccgcgggcggttggttttccttgacggccactttggacctgttcaggccgctgggacgcgtgggtggcggagtttccggagacattgattcccgagcgggggagtaggggaggttgcggaggtcctagctgcccctggcgtcggacagggcgagcagtgggctggggagaggctgaaagaaggtcggcacgcacggtcaccgaggggacaggcagctcgaggccaggggacaggcgagggaagagggccagcgagagagaattcgccggagactttcctcaaaaaccgtatcttacacacaaacacacacacacgttttaaaacaaagtcgatgagacaagactgaacagctcggagcagcgtggttacgtaaagaaagctgggacccggcggggagtggcgcagagccggcggcggggcgcactgggggccggccctgggccccgcgcgcctccccgccgcagtccgggcacgggggtttccaggggccctctctgcgagccctccgcatgggtccacctggcaatgaggggctgctgtagagagagttaagggtgagttaagcacggggtgtgaggggctccaggaccctcaatcagaaagcgctgtgctgcgccctccacaccagaaaaggcgcgttccgtgagaccctccccagcctggcgatggaagtgcagataaaccaaaggaagggtcccgaaaggtctctctcaggcctcccacctccactgcacatatcctgtgggagggggaacggtggccacactttcgccagggcttgtgatccctcagagccctcaccaagcaaggatcaccccagttccgaattaagggcgctctgagatgcccaagattgaggaacacaagtgggaggaatgtgggcgcgcagggccgggcgcagcgctggtaggacccacagttggagagaagcctccccacaagcatgcacactcccccccatccttctccgacggcagcctggaattataataattacgccgaggggaaggggggagacccagcgagccgaggtacatctaatccgataataatttttctcttcgagatggttcaggagcgggggctcccgcggtaggggcgccgggccaggagcagcggggaggggaaggggcagccctaggcagctgaagggcctggaagaggccacgaggccgcggggacgcgcttcggggacccccgcgcgcccctatttccgcgtgccccatttcccgtgcggcacctgctgcgcccagtggcccacctgagggtcaggctcggggctcgccttggggtgcggggatactgacgcgcgtccagacggccgcagggagccaggggcagcgcgtccgtccgagagagccccgagggctgccggcttacgcaccaggcttctaattagaacccgccgccgcgttcctgagcgcaaaaggaagctccttcgccccgcgcccttcccataaatgtcgccagcctcctggcaaccccgcgccctaggatctttgtcttgtcggccctgagggttcctagcctcggtccccatccacc

SEQ ID NO: 68731 - DNA, 102 bp, Homo sapiens
  chr1:228201221-228201323
  hypo
taatcccagctgggccggcgggcaggaggaggtgcgggttgggagagctccaggcagggctgggcagcctggactgggaagggttgccgacacccaggaggg

SEQ ID NO: 68732 - DNA, 413 bp, Homo sapiens
  chr1:228225526-228225939
  hyper
cgcgggcggttcacacgcccttcgcggtgctgaattaaagcgtctgaatggggatttcccctcgcgccggacggcctggcgcgcggcgcatacttccaggttgctatgactggcctgcgctcgcctaatcaccgactagggggaaattcatataaaatatcgccggccattgtgggcctaactcggcgtgacagtggcgcacaaagccggattcaagcgccccagcgggtcagcacggcgcccggccgcgcgggccgcccggcggtgtcaggggccgtggccgcggtggggcgcgggccgcattccgctctcaggtggctccggggccttttgtgcaggccatgattaccaaatgccaccgcgacaccccctcccggccgcctggctcctcctggggccgcaggaatgaggga

SEQ ID NO: 68733 - DNA, 79 bp, Homo sapiens
  chr1:228238495-228238574
  hypo
gtggggtggctgtagcgaggacatcgagtttggtgggatggtgtctcgggagttcgccgacgcccgggagaaccggcca

SEQ ID NO: 68734 - DNA, 38 bp, Homo sapiens
  chr1:228247050-228247088
  hyper
gccacaacgcgcgagcggagcggcgccgggagaagtgc

SEQ ID NO: 68735 - DNA, 30 bp, Homo sapiens
  chr1:228247856-228247886
  hyper
ctcttccctgggaaccgccctcctgattaa

SEQ ID NO: 68736 - DNA, 497 bp, Homo sapiens
  chr1:228248302-228248799
  hyper
ggaactggcctgctgcgccccaggccccgcccgtctctgctctgctcagctgcgcccccttctttgcagctgcccagcccctcctccctgccctcgggtctccccacctgcactccatccagctacaggagagatagaagcctctcgtcccgtccctccctttcctccgcctgtccacagccccttaagggaaaggtaggaagagaggtccagccccccaggctgcccagagctgctggtctcatttgggggcgttcgggaggtttggggggcatcaaccccccgactgtgctgctcgcgaaggtcccacagccctgagatgggccggcccccttcctggcccctcatggcgggactggagaaatggtccgctttcctggagccaatggcccggcccctcctgactcatccgcctggcccgggaatgaatggggaggccgctgaacccacccggcccatatccctggttgcctcatggccagcgcccctcagcctct

SEQ ID NO: 68737 - DNA, 30 bp, Homo sapiens
  chr1:228264825-228264855
  hypo
cacccaggaggagcccggcaggcaccttca

SEQ ID NO: 68738 - DNA, 30 bp, Homo sapiens
  chr1:228322401-228322431
  hypo
taaaataaaggagaacgcagcacaccattc

SEQ ID NO: 68739 - DNA, 78 bp, Homo sapiens
  chr1:228331863-228331941
  hypo
gtgtgtggtgggtgtcgctgtgcatgatggagttgcagccgtggtgcatttgtgagattacctcggtggcctaaattg

SEQ ID NO: 68740 - DNA, 30 bp, Homo sapiens; identical to SEQ ID NO: 39274
  chr1:228342820-228342850
  hypo

SEQ ID NO: 68741 - DNA, 30 bp, Homo sapiens
  chr1:228343136-228343166
  hypo
ttgaggccctgcaggcggggccaggctcag

SEQ ID NO: 68742 - DNA, 163 bp, Homo sapiens
  chr1:228397736-228397899
  hypo
agaaagggtgaaactcggaccccggtccctgctgtgggcaggcccctgcccaggtcctccccagccccagagccctgctgtgggtggggaggctgggctgcagcataggtgctgcctgcacagtgagtcagcagactggtgcccgctgcgcagtccagccctg

SEQ ID NO: 68743 - DNA, 72 bp, Homo sapiens
  chr1:228398961-228399033
  hypo
ctgaagttttaggcccgagaggcagcagtgtgtgcggtaggagaaaggataccaccccgcaggtagggagtg

SEQ ID NO: 68744 - DNA, 66 bp, Homo sapiens
  chr1:228400877-228400943
  hyper
ctgtctcctcccctgcgcccttcccaacccttagcccctctgcctcctgctcgctcctctccccag

SEQ ID NO: 68745 - DNA, 30 bp, Homo sapiens
  chr1:228444438-228444468
  hypo
tggctcaggcccagacggaggtgatgtggt

SEQ ID NO: 68746 - DNA, 700 bp, Homo sapiens
  chr1:228463170-228463870
  hyper
ggcacaagggcctggcgtcttgttcagagcaggggagctggaggtgggagcggggcttaaggaagcttcctggtttcctcgcttaaagtcgcacccgggagggtgcgcagctgcggcccgcgtgtggccagggccgcgctgtttggattgggatcccggggcgcggtgccggcagctctgcctgggcccggctcagggcaggcgccggggctgtgcgggccctctgtaccttggcttgtccgtggaggagggcgagggccgccgtgacctcccctctcctgcgaccccagaggcgcctgtgctgttcaaaaagaagctggagccgcagacggtggaggagcggagctcggtgaccctggaggtggagctgacgcggccgtggccggagctgaggtggacacggaacgcgacggccctggcgccgggaaagaacgtggagatccacgccgagggcgcccgccaccgcctggttctgcacaacgtaggttttgccgaccgtggcttctttggctgcgagacgccggatgacaagacacaggccaaactcaccgtggagagtgagccgcgggcgggaagggcggggcatcgaggaggagtgaggagggaggcggggcattgaggattagtgaggacgtaggcggggtgctgaggggaggagggaggaggggcactgaggaagagggagcggaaaagagaggag

SEQ ID NO: 68747 - DNA, 30 bp, Homo sapiens; identical to SEQ ID NO: 39275
  chr1:228466507-228466537
  hypo

SEQ ID NO: 68748 - DNA, 30 bp, Homo sapiens
  chr1:228473902-228473932
  hypo
acccctgcatgccaacgagctcaatgagat

SEQ ID NO: 68749 - DNA, 206 bp, Homo sapiens
  chr1:228495816-228496022
  hypo
gaggtgaccattgtacgggggctggttgatgcggaggtgacggccgatgaggatgttgagttcagctgtgaggtgtccagggctggagccacaggcgtgcagtggtgcctacagggcctgccactgcaaagcaatgaggtgacagaggtggctgtgcgggatggccgcatccacaccctgcggctgaagggcgtgacgcccgagga

SEQ ID NO: 68750 - DNA, 47 bp, Homo sapiens
  chr1:228501386-228501433
  hypo
gtgaggtgtctcacgcgggtgggccggaggcccgctggtggctggat

SEQ ID NO: 68751 - DNA, 35 bp, Homo sapiens
  chr1:228502582-228502617
  hypo
ctctgccagtattcacggcccgtgcaggccacgtg

SEQ ID NO: 68752 - DNA, 293 bp, Homo sapiens
  chr1:228504399-228504692
  hypo
acatctgcaggctggcgcctggagatcctggagcctctgaaaaacgcggcggtccgggccggcgcacaggcatgcttcacctgcacgctcagcgaggcggtgcccgtgggagaggcgtcctggtacatcaatggcgcggcagtgcagccggatgacagcgactggactgtcaccgccgacggcagtcaccacgccctactgctgcgcagcgcccagccccaccacgccggggaggtcaccttcgcttgccgcgacgccgtggcctctgcgcggctcaccgtgctgggtgggtg

SEQ ID NO: 68753 - DNA, 591 bp, Homo sapiens
  chr1:228528791-228529382
  hypo
ccagggccacttcatcgtgtgggagggtgcaccgggggcccgcatgccctggaagggccacaaccgtcacgtgttcctcttccgcaaccacctggtaatctgcaagccccggcgagactcccgcaccgataccgtcagctacgtgttccggaacatgatgaaggtctgcaggctctgggctgctgggcggggctccctgtccctcagcgccggggtggatgccagtggccacacctgcagccgctggtccagggtggcctgaatgtttcctcgtcgggtcccacatctgttgaggatggtcagcccgtgtccccctccctgtgctgacaccctcccccacccacagctgagcagcatcgacctgaacgaccaggtggagggggatgaccgcgccttcgaggtgtggcaggagcgggaggactcggtgcgcaagtacctgctgcaggcacggacagccattatcaagagctcgtgggtgaaggagatctgtggcatccagcagcgtctggccctgcctgtgtggcgtgagtgtccaccttcccgggggcccaggtggctgagccaggatggggcacccggctgcagccgcac

SEQ ID NO: 68754 - DNA, 30 bp, Homo sapiens
  chr1:228533007-228533037
  hypo
gcccatgactgaggacggggctggagagga

SEQ ID NO: 68755 - DNA, 94 bp, Homo sapiens
  chr1:228536497-228536591
  hypo
aatcataagtcggtgctggttgtgacctttgtgatttaagcaatctgtggggcacacccggcactattggaatgtgaatcgatgccgttttatg

SEQ ID NO: 68756 - DNA, 30 bp, Homo sapiens; identical to SEQ ID NO: 14339
  chr1:228552593-228552623
  hypo

SEQ ID NO: 68757 - DNA, 33 bp, Homo sapiens
  chr1:228554180-228554213
  hypo
ggcctcgaaggatgccggcgtttacacctgcct

SEQ ID NO: 68758 - DNA, 172 bp, Homo sapiens
  chr1:228554797-228554969
  hypo
ccgcgctgagccacccgctggtcacggggctgctggaccagtttgagacccgcaagaccctcatcctcatcctggagctgtatcctgccctcagcccctgagacggcttgaggaggggcaggcagggccaggccggggctcagaggagccatgtgcacggtgtcccctgcct

SEQ ID NO: 68759 - DNA, 865 bp, Homo sapiens
  chr1:228558699-228559564
  hypo
ctgctgccccccatgcggttccagcgttccctgatgagctacaagtccatcctggtgatgcgctccatccctgagctgctgcggggcccacccgacagcccctccctcggcgtagcccggcacctctgcagggacactggtggctcctccagttcctcctcctcctctgacaacgagctcgccccatttgcccgggctaagtcactgccaccctccccggtgacacactcaccactgctgcacccccggggcttcctgcggccctcggccagcctgcctgaggaagccgaggccagtgagcgctccaccgaggccccagctccgcctgcatctcccgagggtgccgggccaccggccgcccagggctgcgtgccccggcacagcgtcatccgcagcctgttctaccaccaggcgggtgagagccctgagcacggggccctggccccggggagcaggcggcacccggcccggcggcggcacctgctgaagggcgggtacattgcgggggcgctgccaggcctgcgcgagccactgatggagcaccgcgtgctggaggaggaggccgccagggaggagcaggccaccctcctggccaaagccccctcattcgagactgccctccggctgcctgcctctggcacccacttggcccctggccacagccactccctggaacatgactctccgagcaccccccgcccctcctcggaggcctgcggtgaggcacagcgactgccttcagccccctccgggggggcccctatcagggacatggggcaccctcagggctccaagcagcttccatccactggtggccacccaggcactgctcagccagagaggccatccccggacagcccttggg

SEQ ID NO: 68760 - DNA, 32 bp, Homo sapiens
  chr1:228560007-228560039
  hypo
ttctccctgggtggtcgcgggggctacgcagg

SEQ ID NO: 68761 - DNA, 45 bp, Homo sapiens; identical to SEQ ID NO: 26914
  chr1:228566475-228566520
  hyper

SEQ ID NO: 68762 - DNA, 246 bp, Homo sapiens
  chr1:228566723-228566969
  hyper
ctcactccgatgctccgcgcgttcagcccctcggggcgtctccgtcctcacacccatgcgcgtttattccacccgccgtgcgccttcctctcttccatcacgctgacctgcagccccgcagcccgctttctccgccgtcgggccagccgcttgtttccacaacttctctgccccgggaagagttcttgggcaaagcgtgcaagcgagggcgagaagccgcgggccacgatccgctggaggagagga

SEQ ID NO: 68763 - DNA, 328 bp, Homo sapiens
  chr1:228603596-228603924
  hyper
cacagatgcacatatcggtaaacatacatgcatgtacacacaggtacacgcgcgcacacacgcacaggcacacaagcatgcacatagatgccccctgcaatctcaacactcgcgaccccacgcagtggagatctacagactttcgcctacgccacggggttgctatggggaccgagttgcagaaggagttgaaaatcgcgtctacactgcaagcacgattctccccttccgttctgccatcccctaaagcgagggcgtctaggggtctcagacttccccggctctgtcccacgtccagtttctcggagctttctgcacgccaaccacc

SEQ ID NO: 68764 - DNA, 486 bp, Homo sapiens; identical to SEQ ID NO: 26917
  chr1:228604123-228604609
  hyper

SEQ ID NO: 68765 - DNA, 433 bp, Homo sapiens
  chr1:228633487-228633920
  hyper
aaggcgcctgtcactcgtcactctccacgcgggctggctctggaaagcccaaaggaaaaaaccctcactttcaggaagaataagcctcagcccatgtatctagggaacacgtgatgctgcaagaaaccagtgacttaacgcgtgtaaaagcaggagagcgtcagaggttctgaccccgggggaggagcagacccgcggcagcgtgcggagacttagcgggcggaatctgccaccaacgcaacctggcccagaggttttgaactgaccaactgggagacgtccccgagcttgaataagggcctcaaaagcttagcgttttatgcagagtcgcaaccacccagcgctgggaacctgagcctgcacaacccactagaaagcacccgtgaccgtcccctgcgcccgttatccctgcgccccgcacccctgtatcccc

SEQ ID NO: 68766 - DNA, 29 bp, Homo sapiens
  chr1:228633921-228633950
  hyper
gcttctctgcagctgtacaccctgcactg

SEQ ID NO: 68767 - DNA, 278 bp, Homo sapiens
  chr1:228633983-228634261
  hyper
cgcaggtctccaaaacgaatcccggcttggaggggctcagcggccctgggcctgtgcgccgttgcggccgggagggtcattttcatgcctaaggacccgccccttgcacgcaacctcgggtagccagccggaaacggcgtcccgggctccaaaggacatctctttttacatttcagcaaaacagccgcacaccttctccccagatggcctctgtgcagcctgaaaatgcccgctccctccaagtccctgggcaattgctgggacgcatctcagagact

SEQ ID NO: 68768 - DNA, 343 bp, Homo sapiens
  chr1:228644901-228645244
  hyper
acacgttgcccacctcgcaagtatgcagcccaatcagtccccagggtctcggttcccgttgcgcccttccccatggccactgcgctcattcatgagcctagggtgatcaggcctccggcctataaagaactgcaggatcagtgcggctcttttctcgagatagtaggtggctctgaaaagagcctttatgtccatcaaaggggccccgggggcggcgggcggcctcacttgcccttggccttgtggtggctctccgtcttcttgggcagcagtacggcctggatgttgggcaggacgccaccctgcgcgatggtcacgcggcccagcagcttgttgagctcct

SEQ ID NO: 68769 - DNA, 586 bp, Homo sapiens
  chr1:228645305-228645891
  hyper
cgccgcgttgccggcaagctccaggatctcggcagtcaagtactcgagcaccgcggccagatagaccggggcgccggcgcccacgcgctccgaatagttgcccttgcggagcaaccggtgcacgcggcccacggggaactgcagccccgcgcgcgacgagcgcgacttagccttggcgcgcgccttgccaccctgcttaccacgaccggacatttccgagtcaaggaaaaaagacaacggcaaccgaaaagcgagactaaaaacaagagggcagtgaaggccagcgagcccttatgtatggtacagaggtaggctagaccgcggcgttcgattggatggctatggtagccaatcagaaaaagaacctggcactcctaatttgcgtattcctttcccagcgatgacgtagaacaacgtttgatccaatcagaagtgagcaaatcctgagccttcatttgaatacaaaacgtacaaatagagttactccgagcgccgcgcgtttctgtttggagagactcagccatcatgccagacccgtccaaatcggctcctgcgcccaagaagggttctaaaaaggctgtcacca

SEQ ID NO: 68770 - DNA, 360 bp, Homo sapiens
  chr1:228646191-228646551
  hyper
agtacaccagctccaagtgaggcgttcctcggcgtcctgaacccaaaggctcttttcagagccacccacacgatcaagaaagggtttcgaacacggtgaagggttatgtaacctaatgtgtctccatgcaccctagcggttgccgggtgcggccgaatctgagccgtgtgtgtgtgtgtgtgtgtgtgtgtgtgcgcgcgcgcgccggcacagaacgagaaaaactgctcgttacagaaatcggggtagaaactgctcaggtgatgtagctcagtaatgttgggaggcgatcaaggaccccctctccatcccctccctccgcgcagagctattaactcacgacgagatttcttttttttt

SEQ ID NO: 68771 - DNA, 90 bp, Homo sapiens
  chr1:228646851-228646941
  hyper
gcacctggccccaaatgtcttttataagcaagtggtgcattcctggatgttgagcgcttgcgcccggttcaggaccgggtccaaatgagg

SEQ ID NO: 68772 - DNA, 123 bp, Homo sapiens
  chr1:228647194-228647317
  hyper
ttcctggcaggataccgcgatggcaggatgtttgataccgaatcgaagcacggcgtcaaagcagcgtcctgcgcgggggagccggatgtaataagcgaccccagctgccggtaactttaaccc

SEQ ID NO: 68773 - DNA, 648 bp, Homo sapiens; identical to SEQ ID NO: 26927
  chr1:228651254-228651902
  hyper

SEQ ID NO: 68774 - DNA, 211 bp, Homo sapiens; identical to SEQ ID NO: 26928
  chr1:228652242-228652453
  hyper

SEQ ID NO: 68775 - DNA, 121 bp, Homo sapiens; identical to SEQ ID NO: 26929
  chr1:228652508-228652629
  hyper

SEQ ID NO: 68776 - DNA, 30 bp, Homo sapiens
  chr1:228671304-228671334
  hypo
aggcgtgagccaccgcgaccagccttttgc

SEQ ID NO: 68777 - DNA, 134 bp, Homo sapiens
  chr1:228677767-228677901
  hypo
gtgccattttctctgcgtttcataaattcctatctccttcttttaacctgaaagacagagtgcttttcacaggtgcagcagctcttgggtaactggctgcatctcgaggctgaggcccacgtttttaccccagc

SEQ ID NO: 68778 - DNA, 94 bp, Homo sapiens
  chr1:228870805-228870899
  hyper
ggagccgtggccagccgggggctccacggagtgaataggaggcggctcaggcttcctggctcgcgtgggcgccagaaagcggaacctcccgggc

SEQ ID NO: 68779 - DNA, 369 bp, Homo sapiens
  chr1:228871227-228871596
  hyper
agcgcttgggatccacggcgctcggaccgctgtcctccaacagcgcagggcagagcggctggcgccgccggagcgcggagccacgaccctccctggccgcctttgtctactggccgtgcggcccggaaccgccactctccagggccggggacgcgcccgcagctgtcggtgacagctcctccctaccgcaaccctccggggcggaggggcggtcgggccgggccctgctagcccgcgaccgcaagcccgcgctcgcggatcgatgcccccgcagcagggggaccccgcgttccccgaccgctgcgaggcgcctccggtgccgccgcgtcgggagcgcggtggacgcgggggacgcgggcctggggagcc

SEQ ID NO: 68780 - DNA, 585 bp, Homo sapiens
  chr1:22889595-22890180
  hyper
cggagtgtgtcaccacgcgaagcactcggtgttggggtcatgcgggcaggagcgagcatgcggtggatgtgcggcccgcgcgtgtgtccacagagggaatccctgggtgggtctggtcctggtgtcgccgggacgtcccgatggtggcttcgcgcactggggccctgagccctgagtccaagtgcgcagcgcggggcgcgcccccgaaggtgcccgccgggggagtgtgggcgtgcgcacgtgcggcggcggtggccgcgggccgggtggccgcggtgcgggctccgtgtcccccacccccccgcctcggtgctgattggctcggcgccgtgacgggccggcccccgcccggggcggcggcggcggcggcgggcgcgggtgcccgcgtgtgcgctgggagccgcgtgtgcgccggggtgtgcgcccggccgggtgtgcggagagcgagggagcgcgctccctcccgacgcgcgggccgcagcggccaagcccgagggtgcgtggcgcccccgcccgcccggcccggcccggccatggcccccgcccggggccgcctgccccctgcgctctgggtcgtcacggccg

SEQ ID NO: 68781 - DNA, 220 bp, Homo sapiens
  chr1:22890189-22890409
  hyper
cggccacctgcgtgtccgcggcgcgcggcgaaggtgagcggcggcggcggggcggggcaggggcggccgaggggcgcggggcgcggcgcgcgctgcctgcggctcaacttcctttgcatggaccctgagctccaaggcggccgggatccctcggcccggggggcggggtggcaccgcggaagagacccgggattaagggacagagcggtggagatgggaa

SEQ ID NO: 68782 - DNA, 46 bp, Homo sapiens; identical to SEQ ID NO: 39283
  chr1:228919370-228919416
  hypo

SEQ ID NO: 68783 - DNA, 30 bp, Homo sapiens
  chr1:22893250-22893280
  hypo
tgggcctaatggtggcgttctcttcagcac

SEQ ID NO: 68784 - DNA, 193 bp, Homo sapiens
  chr1:22896425-22896618
  hypo
gagtaggagtgagcccgcgagcctggtgagatcccagctctgcccttgacaagcaggtggacttgggtcaccatttcacctctctgagtctcagtttccccatctatagaaagggacaagtctgtgatgacctcccaggtctgcgccagggtgagagcagatgacacagtcttggcaccgagtctggcacagg

SEQ ID NO: 68785 - DNA, 154 bp, Homo sapiens
  chr1:22900779-22900933
  hypo
ttctttctttcttgtttattctggtgaaatacacataaggtaaagtttaccgtcttaaccctttttaagcgcacaccttggtgacatgtagtgcattcacattgctgtgtggccatcaccaccaccactgccagaactccgttcatcctgcaaa

SEQ ID NO: 68786 - DNA, 107 bp, Homo sapiens
  chr1:22902850-22902957
  hypo
atcaagtttaccctgcgcgactgcaacagcatgcctggtgtgctgggcacctgcaaggagaccttcaacctctactacctggagtcggaccgcgacctgggggccag

SEQ ID NO: 68787 - DNA, 78 bp, Homo sapiens
  chr1:22903278-22903356
  hypo
caagatgtactgcagcgcggagggcgagtggctcgtgcccatcggcaaatgcgtgtgcagtgccggctacgaggagcg

SEQ ID NO: 68788 - DNA, 222 bp, Homo sapiens
  chr1:22927359-22927581
  hypo
gacggctgagcccagcgctgatcccctgcaggtcatcagctctgtggaggaggggtaccgcctgcccgcacccatgggctgcccccacgccctgcaccagctcatgctcgactgttggcacaaggaccgggcgcagcggcctcgcttctcccagattgtcagtgtcctcgatgcgctcatccgcagccctgagagtctcagggccaccgccacagtcagcag

SEQ ID NO: 68789 - DNA, 48 bp, Homo sapiens; identical to SEQ ID NO: 26132
  chr1:22933907-22933955
  hyper

SEQ ID NO: 68790 - DNA, 30 bp, Homo sapiens
  chr1:229354058-229354088
  hypo
agtacaaaggactcccgtatccccttcact

SEQ ID NO: 68791 - DNA, 165 bp, Homo sapiens
  chr1:229542788-229542953
  hyper
cccgccctggtctctcggtttagttcatgctgaggttggtcgcttgtttcattcactgtctcctacgcagtccatgccacgggggataagtttttcacaagtggctttttttccccacagtgaagagacgtggcctgggtctggagttcctcaaccggcaaaata

SEQ ID NO: 68792 - DNA, 316 bp, Homo sapiens
  chr1:229543220-229543536
  hyper
cgagagggagctctggtccccgaggggctgtcccgggagggagcgaggtggggagggggagcaggccctgccccgagcaccccgcggactgagcgtctggcgtgcacggcggaggggttaccgcggggaggtgacaccccagggtggtgagggcacgcagatgaggctggcctgaggggtgcctgctttggggaaagcagtctgtggagggagggaaggagggcgatcgcggccccacgcgggttgtgctgctgaggctccgcgccgcaggaaaggcaccctagccggattcgccctcggacgccccagctgggca

SEQ ID NO: 68793 - DNA, 257 bp, Homo sapiens; identical to SEQ ID NO: 26933
  chr1:229566603-229566860
  hyper

SEQ ID NO: 68794 - DNA, 190 bp, Homo sapiens
  chr1:229567087-229567277
  hyper
gttaatgtatgtacacgttataaacactgtgtcagtttacgatggcagcaacggaagttgttacaaagaaagtgactgcggggtggctggagctcagccgcccccccattgagaagattcgtcgtcctgagaagtcgcgtgctggaggtggagtgtgtctagaagcatttgcggtggacgatggaagggc

SEQ ID NO: 68795 - DNA, 624 bp, Homo sapiens; identical to SEQ ID NO: 134
  chr1:229567369-229567993
  hyper

SEQ ID NO: 68796 - DNA, 217 bp, Homo sapiens
  chr1:229568157-229568374
  hyper
cgccggagtccagcacgatgcctgtgcgcgcgcgggagagagtgagtggctgggggcgaggccgaggctaggctctcagcgctagcggcgggggcgggggcgggggcgggggcgggagaggggactgggggcagcgggcactcaccggtggtcctgccggaggcgtagagggacagcacggcctggatggccacgtacatggcgggcacgttgaagg

SEQ ID NO: 68797 - DNA, 1128 bp, Homo sapiens; identical to SEQ ID NO: 26937
  chr1:229569458-229570586
  hyper

SEQ ID NO: 68798 - DNA, 33 bp, Homo sapiens
  chr1:229706004-229706037
  hypo
attacaggcgtaaaccaccgcacccagccgtct

SEQ ID NO: 68799 - DNA, 30 bp, Homo sapiens
  chr1:229764690-229764720
  hypo
gagtcatcttggcagcgtggccatcacctg

SEQ ID NO: 68800 - DNA, 30 bp, Homo sapiens
  chr1:229911522-229911552
  hypo
gtcgtgccctagcatcgctttaagaattta

SEQ ID NO: 68801 - DNA, 150 bp, Homo sapiens
  chr1:230080008-230080158
  hypo
gggtggcacctagggcgtatgggaacagcagcagtgggagacaggtgagcatgtcagtgccaggccactggttctctgattgcccgggttctgtgtttctccttctctcactgttccttgcttcacggcttctcacggtgctgccccaga

SEQ ID NO: 68802 - DNA, 64 bp, Homo sapiens; identical to SEQ ID NO: 39285
  chr1:230107209-230107273
  hypo

SEQ ID NO: 68803 - DNA, 30 bp, Homo sapiens; identical to SEQ ID NO: 26938
  chr1:230240615-230240645
  hyper

SEQ ID NO: 68804 - DNA, 73 bp, Homo sapiens; identical to SEQ ID NO: 26133
  chr1:23038177-23038250
  hyper

SEQ ID NO: 68805 - DNA, 132 bp, Homo sapiens
  chr1:230404233-230404365
  hypo
gcctctgctggaaagcgacacaccttacgctacagcacattaaacagaagcgtgtgctcaggccccggccgagagagttcgtcatcagagtctcgggccccagcttcatcccctgtgcgtcaggctctgtga

SEQ ID NO: 68806 - DNA, 72 bp, Homo sapiens; identical to SEQ ID NO: 39287
  chr1:230423782-230423854
  hypo

SEQ ID NO: 68807 - DNA, 176 bp, Homo sapiens
  chr1:230424479-230424655
  hypo
tggacttccggcatccggggctgtgcgttgtgcaagcccccccgagcctgcactgttttgttctggcagctccaagctgactcatacaagcccagagccctcgcaattcccacacgccacatgcatggctcagctgcacctcctgccagctccaaacctcacggcacagggtacac

SEQ ID NO: 68808 - DNA, 154 bp, Homo sapiens
  chr1:2304327-2304481
  hypo
ttgggttttcctgcccgtggaatgttcccgcacgtcttcccgctggtcgggatttaggccctgcattccctgcatctgagtcagcaccctgaggtgctggacctgggactagggcaaggcctggcaagggtgggtccaccggctggccagtgcc

SEQ ID NO: 68809 - DNA, 65 bp, Homo sapiens
  chr1:230453297-230453362
  hypo
ccaagaacagaggtgcgctgccgggggctgacccttggggaggggagggccgaggctgatttatc

SEQ ID NO: 68810 - DNA, 73 bp, Homo sapiens
  chr1:230453632-230453705
  hypo
cacaatcaagtctcccgcaggagtctcctcattacgaccgtgtatacatgggtatacacggaagggtgaaggt

SEQ ID NO: 68811 - DNA, 54 bp, Homo sapiens
  chr1:230458365-230458419
  hypo
gatcatgcaaagagccgtgactgaggccggggtcagcgtcgggggtggagagga

SEQ ID NO: 68812 - DNA, 796 bp, Homo sapiens
  chr1:230561177-230561973
  hyper
caggagcagtcagaccgatcaccgctcctgcagcctcatttgtttccggagagacacccacaagccagcccacggagagtctggactcgcccgccccagcacccacgcctcccccgcgcccggttccagcgccgcccccgacatccacccgcgggcagccccttaccgccggtatcctcgaagcgcgggggcgggcggtcccgcagcgctgcgctccagcccgcgccggcctcgtcctcctccggctcctgtgcgtccggggcgcggggcggtggcggggcggcccctgggggtcccgggggctcgcgctcgtcgtccgaggaggcggccgaggaggagcgcgaggcggccgaggtgctgtagaaggggttcccgccgctgtccgggccggactcgccgaacacgtcgtccgagatgtgcaggctctcgtagcgcgcgcgggcagcctcgagcagcgccggcgccctcctccgcgcgcccccgccgccctcggccatggccccggccgccgcccgcgcgcccgcccccacagtgcctcccagccgcacacgccgggccctgggcccgcgccgcggcccgccgccccccaccagcgcagcccgcagcacagcgcccgccgccccgtgcccggccggcccgccgtcttggccgcctcgggcccagcgcccggggaagcgccctcggagctcgggcgccgcaggctgcgggccgcggcgggaggcgagccgcgcgcggggctggcaggggcgacccagagcgggcgggacgcagaggctgcggccgagaccaggcgccg

SEQ ID NO: 68813 - DNA, 268 bp, Homo sapiens
  chr1:2307626-2307894
  hypo
tcctatgactccagacgttcccaccaaactgggtgagagtccaacgcatttgattggcatctcttgagggtcccttcctgggaccattgtcctcactgtctctcatctcattcacgctggacggggagaggcgcgagtcagcgcacagctgagggctcttcagggcgtccggggcccccgtcaccgtcagtgatgagaatggcgatgtctggtctctgcccccttccacctgctcggcctctggaaggtgccccgggctttcaggagg

SEQ ID NO: 68814 - DNA, 553 bp, Homo sapiens; identical to SEQ ID NO: 38740
  chr1:2308105-2308658
  hypo

SEQ ID NO: 68815 - DNA, 30 bp, Homo sapiens
  chr1:230841649-230841679
  hypo
cattccaggggagaccgggaggctcctacc

SEQ ID NO: 68816 - DNA, 48 bp, Homo sapiens
  chr1:2309850-2309898
  hypo
ggcagtaggcccaaacgtggaggctataggccccgtggaggcccccgg

SEQ ID NO: 68817 - DNA, 128 bp, Homo sapiens; identical to SEQ ID NO: 39292
  chr1:230992827-230992955
  hypo

SEQ ID NO: 68818 - DNA, 96 bp, Homo sapiens
  chr1:2310148-2310244
  hypo
ctactctgtctgctccgtctcccaccgaggatgttctggaggacgtgtggggcctgcccaagccctcgggtcctgggaggtcgagcagtaagctgt

SEQ ID NO: 68819 - DNA, 35 bp, Homo sapiens
  chr1:231019380-231019415
  hypo
aaaaaaaaaaaaaaaaaaagcgaaaccacctcttt

SEQ ID NO: 68820 - DNA, 30 bp, Homo sapiens
  chr1:231037612-231037642
  hypo
ttaaggctaagaatgcggcagtcaaatccc

SEQ ID NO: 68821 - DNA, 43 bp, Homo sapiens
  chr1:231150213-231150256
  hypo
tgtattttgtagagaaggggttttaccacgttgcccaggctta

SEQ ID NO: 68822 - DNA, 53 bp, Homo sapiens; identical to SEQ ID NO: 39293
  chr1:231163086-231163139
  hypo

SEQ ID NO: 68823 - DNA, 28 bp, Homo sapiens
  chr1:231205699-231205727
  hypo
aaccgcagtgtccatcggtggatgaatg

SEQ ID NO: 68824 - DNA, 30 bp, Homo sapiens
  chr1:231269325-231269355
  hypo
tgtccgcgaggacagcgtgctcacaccctg

SEQ ID NO: 68825 - DNA, 67 bp, Homo sapiens
  chr1:231296717-231296784
  hyper
gccccaagccctgggcgcaggctgcagcttccccctgcctgaccccgccagcctgcgcctcctcacc

SEQ ID NO: 68826 - DNA, 286 bp, Homo sapiens; identical to SEQ ID NO: 26941
  chr1:231296817-231297103
  hyper

SEQ ID NO: 68827 - DNA, 465 bp, Homo sapiens
  chr1:231297104-231297569
  hyper
cagctcgtggctggcgttggagaatgtggagattttcccattcataaaaggaacgtctccgcttgccgccttcccgtccgccgcacaccgccacatccgcagcggggtagggctgggtctgggggcgctgggttcccaggggtctacccgggcgcgctctcgcctttctcaggaaaccccattttgtgagcggcaccgcgtgtcctctctcagtccgtgcacacagttgacctggagcgcggatgagcacccttggttgaaaggaagagacaaaatggcttgtggttcaattcataaataaaacctcacccttggacttcaggctgcccgacattttgggacttggatttttttgctttatcgtagttttaggaagcgactgtcaggccatgttgcctatccatttctaaacgactggctttttaggatcccgttttcacccttctatggcggtgggttgggggt

SEQ ID NO: 68828 - DNA, 854 bp, Homo sapiens
  chr1:231297797-231298651
  hyper
gaaattacaactcctcggcgcgccgcgcggggaggcagcggcagcggcgggagggaggcggggaggggattcccgagccagccggacgctcgccctccgcccgccggctgcagcgtcgcgcggcccaaggtcagaggcgccgcaggagcagcagctgggaaccagggaagcgggtcaatcccggccgcagggagaaagccccagggcgcagtcagccggcgtccacagccgcccaggagtagggtgagcggctgtctccgggccggtcgggtcccgccgaggtggccgcggccccagcgacccggcgggtggcggcccaggggtcggcgagcaggcagctggagccccaccttcggctcccgggcgctgtccgccgcctcgtggtgctgatcccagccccacggctgagcggccttcgcacctgcctgtctcacctcgctatcaccccgataaggagttgggccggggcagaaggggggcctcggggtagccgcccaccggagccaggggctgaagcagcgagcgcacagcagcccggccgctggtcctggggtggagaggaggcgcgcgctgcagccggcggcggcgctggtgctgattcatcacctaaagctcctcgcaggccaccgcgagggcagccgaccggctccggaatctggccgcaggttgaagccgctggtgcgggaccctcgggcaggaggtgaggaccccctcccttctctcgcccctcaatcatcttagggcggtggctacaggacagagagaggggcgtgcccctcggctgtgaagtgggcatgcccgtgtgatgcccccgcccgtcgtctcaccggggcgcaccgcgctggtcctcctcc

SEQ ID NO: 68829 - DNA, 56 bp, Homo sapiens
  chr1:231298652-231298708
  hyper
ccagtctcccgagctccggccattcatccccagcgcagagcagcgctggcagccgg

SEQ ID NO: 68830 - DNA, 295 bp, Homo sapiens
  chr1:231298924-231299219
  hyper
cgctgcggctggcccggcctgcggcggtgcaggcgggagtgcagctggcggcctcggcggcggtgcgggaggtggcggagaccacgcggacaagctcagcttgtacagcgagacagacagcggctacgggtcctacaccccgagcctcaagtcccccaacggggttcgcgtgctgcccatggtgcccgcaccacccggctcctcggctgcggcggctcggggtgccgcctgctcctcgctgtcctcgtcttcgagctccatcacgtgcccgcagtgccaccgcagcgcatccctg

SEQ ID NO: 68831 - DNA, 36 bp, Homo sapiens
  chr1:231299423-231299459
  hyper
aagtgccatccatcccggggacccttcgccaagcat

SEQ ID NO: 68832 - DNA, 163 bp, Homo sapiens; identical to SEQ ID NO: 26947
  chr1:231299478-231299641
  hyper

SEQ ID NO: 68833 - DNA, 145 bp, Homo sapiens
  chr1:231475674-231475819
  hypo
agactgctgtgaattcgcctgtatgtatcgttaaaaaaagtcactttgccctcagtgaaagcttgaattatggggcaaacaataatgaacaccttatgttttttatagtgcttcatagtaaaaaaaaaaaaaacaaaaaaaaggc

SEQ ID NO: 68834 - DNA, 413 bp, Homo sapiens
  chr1:2316053-2316466
  hypo
gccccgcctcagctgcgccaccagtcttatccccgtgactggcccccagcacccttcttcctttggtttggctgaagatgggatttaagtcaaaagtgagagccgcctgtgagcttccctgcctctccgcgtacctcctgagtatacacaaggcacacatatgaatacactcctgtttttctcttttcccaacagggaactgtgaggggagagagaaacttatcttcccacacgggatcagggaatcgcagggcctggcacatggagaagctgccagggtgaggctccccatacaccccacgcgccctgcccaccacgaggcctgtaccctctgggcagcaggtgccgcgcgcccccgggtaccttgtaggtggagccgtcggcgcagcgcagcaccccgtgtccctgacgcc

SEQ ID NO: 68835 - DNA, 114 bp, Homo sapiens
  chr1:231663293-231663407
  hypo
gagtttctctctagacggtgctgaattgccatctagttacctattctgacaccaggaacatgattcttcaacaaacattgacggaagcttacatgggaccggatcacagcgctg

SEQ ID NO: 68836 - DNA, 120 bp, Homo sapiens
  chr1:231738890-231739010
  hypo
acattttcttcctttgacttgtttgcttgtgtttgttctcagtttttagaatcattaaacattttggccatatagaaaaatatacagaagcctggccgggcgtggtgactcacgcctgta

SEQ ID NO: 68837 - DNA, 30 bp, Homo sapiens
  chr1:232761027-232761057
  hypo
taacaatttcatcaccggcttaagtaaaga

SEQ ID NO: 68838 - DNA, 30 bp, Homo sapiens; identical to SEQ ID NO: 39296
  chr1:232761388-232761418
  hypo

SEQ ID NO: 68839 - DNA, 60 bp, Homo sapiens
  chr1:232765315-232765375
  hyper
cctcagtgcctgtgtcgccgagacgggaataacctttcagccgatcgataacttggagag

SEQ ID NO: 68840 - DNA, 30 bp, Homo sapiens
  chr1:2330625-2330655
  hypo
gggcccttgcttgtccgctttgtctctgtt

SEQ ID NO: 68841 - DNA, 30 bp, Homo sapiens
  chr1:233116414-233116444
  hypo
gaactcagggccaaacgcacacagcctgta

SEQ ID NO: 68842 - DNA, 30 bp, Homo sapiens
  chr1:233118122-233118152
  hypo
cacactcgagatgcccgctctcatagacgg

SEQ ID NO: 68843 - DNA, 33 bp, Homo sapiens; identical to SEQ ID NO: 38743
  chr1:2331363-2331396
  hypo

SEQ ID NO: 68844 - DNA, 30 bp, Homo sapiens; identical to SEQ ID NO: 38744
  chr1:2336335-2336365
  hypo

SEQ ID NO: 68845 - DNA, 292 bp, Homo sapiens
  chr1:233750219-233750511
  hyper
ctgggacttcacctccgcgctcttcttcgccagcaccgtgctctccaccacaggtagggtatcctgcgcgccccctggccgccccggccacctcgcccacaacccacacaccccggccccggcgccccgggcccctctaaccctcccaccccaccccccacctttcgccatcccggctcctccagcccgcctcccctcactgtcctcccgaccctccgaccttccccttactggcgtccccggcctctgcctgggtgactcgggagggcaagccctgcggagccggaagcca

SEQ ID NO: 68846 - DNA, 174 bp, Homo sapiens; identical to SEQ ID NO: 38745
  chr1:2338063-2338237
  hypo

SEQ ID NO: 68847 - DNA, 234 bp, Homo sapiens; identical to SEQ ID NO: 26950
  chr1:234040247-234040481
  hyper

SEQ ID NO: 68848 - DNA, 89 bp, Homo sapiens
  chr1:234040885-234040974
  hyper
gccccgggcgtgggtgagcgagccggcgggcgggaggccggagcgccggggtagccctttgcagctgggacactgggcagtctgaggct

SEQ ID NO: 68849 - DNA, 213 bp, Homo sapiens; identical to SEQ ID NO: 1897
  chr1:234041148-234041361
  hyper

SEQ ID NO: 68850 - DNA, 209 bp, Homo sapiens
  chr1:234041415-234041624
  hyper
cgggccggtggggctcacgtccatcgaggagcggatcctgcgcatcactggctactatggctaccagccctgggcagcgagctgcaaaagtaagaccccctcacgtcatgtttcccgttcactggtccatcttcttaccattgtcacagcagcctcggggagcgcacgcagtgaggcgtccagccaccccctcccgccctgcctgctga

SEQ ID NO: 68851 - DNA, 182 bp, Homo sapiens; identical to SEQ ID NO: 26954
  chr1:234349869-234350051
  hyper

SEQ ID NO: 68852 - DNA, 289 bp, Homo sapiens
  chr1:234350052-234350341
  hyper
gccgccgcagtgagcaacgcggcaaccggagcccggcgggcagccggggaggccgggactgagaggggcgagccgctggtgctccccggcggcagagggccgcgtcggccacgggcccgggagagacgcgctccagccggccccaggatgtaggcgatcggcggcagcgctcctgcaggcggccggctcatcatgaagaagcactcggcccgggtggccccgctcagcgcctgcaacagtccggtcctgacccttaccaaagtggaaggtaatgcgcggccgcctcgcc

SEQ ID NO: 68853 - DNA, 30 bp, Homo sapiens; identical to SEQ ID NO: 39297
  chr1:234445373-234445403
  hypo

SEQ ID NO: 68854 - DNA, 278 bp, Homo sapiens; identical to SEQ ID NO: 39298
  chr1:234621065-234621343
  hypo

SEQ ID NO: 68855 - DNA, 42 bp, Homo sapiens
  chr1:234625024-234625066
  hypo
gaagtctagagaaagcgcttccaagcacgttttacctgctcc

SEQ ID NO: 68856 - DNA, 30 bp, Homo sapiens; identical to SEQ ID NO: 39300
  chr1:234724806-234724836
  hypo

SEQ ID NO: 68857 - DNA, 30 bp, Homo sapiens
  chr1:234736426-234736456
  hyper
aagcactttggacttcggactgtgttccta

SEQ ID NO: 68858 - DNA, 30 bp, Homo sapiens; identical to SEQ ID NO: 39301
  chr1:234795478-234795508
  hypo

SEQ ID NO: 68859 - DNA, 30 bp, Homo sapiens
  chr1:234812002-234812032
  hyper
cgtctttttccctgacgtggaaagattaca

SEQ ID NO: 68860 - DNA, 94 bp, Homo sapiens
  chr1:234845049-234845143
  hypo
acgcagcagcagaaccggtgagttttgcctcagggaaattcacattcaaggggacaatcatctcagtctgaagggtacccgggagtttgacagg

SEQ ID NO: 68861 - DNA, 36 bp, Homo sapiens
  chr1:234881213-234881249
  hypo
agagaaatggcgtaacgtgctcgtgaagaggcggca

SEQ ID NO: 68862 - DNA, 169 bp, Homo sapiens; identical to SEQ ID NO: 39303
  chr1:234882410-234882579
  hypo

SEQ ID NO: 68863 - DNA, 242 bp, Homo sapiens
  chr1:234959367-234959609
  hypo
gtttagaactgtagtcgaatccccttttatcacagaggaaactgagtcactgtgcagcgagggctggagggcatacagggtttgttacaagggaggactctcggagacacccccaatagaagcccttcagggagcgggccagcgggagagcacccccgaccacacctttgttctgcatttatatgtacagattcttatccctacgtataaattctacccacacatcccgagccatgtctgag

SEQ ID NO: 68864 - DNA, 42 bp, Homo sapiens
  chr1:234964788-234964830
  hypo
tacccggtcagtgtgcggcggagcatacgtgcatgcctgggc

SEQ ID NO: 68865 - DNA, 140 bp, Homo sapiens
  chr1:235003811-235003951
  hypo
aaaaaaaaaaaaaaaaaatttaattttaatccactcggattttaaaatagcatatcacgatggaaaaagccttgaacttggagtgtaaggggcctgggttgaagttccattctagctgtgtgaatcggtcacatttctgg

SEQ ID NO: 68866 - DNA, 39 bp, Homo sapiens; identical to SEQ ID NO: 39306
  chr1:235005711-235005750
  hypo

SEQ ID NO: 68867 - DNA, 128 bp, Homo sapiens
  chr1:235034454-235034582
  hypo
ggcctaacaaaatctcgggttcagagcagatccttaaagccttccagtccagctccctggttaggctcatgagacggccacgatgtgtctgcccagtgacaaccagcacaaaccggaaggtccacccc

SEQ ID NO: 68868 - DNA, 79 bp, Homo sapiens
  chr1:2351881-2351960
  hypo
atccacagtgggatgcggggctgaacggttatgtcccggtaggtaggggctgcagaaagagccccgagggctggggagt

SEQ ID NO: 68869 - DNA, 30 bp, Homo sapiens
  chr1:235260531-235260561
  hypo
gattgctgactctgacggcagctgggctgc

SEQ ID NO: 68870 - DNA, 155 bp, Homo sapiens
  chr1:235267075-235267230
  hypo
aaaaaaaggaaaaaaaaaaaaaaagaagatattctcatgccctttggaaatgaggcacctaagcctcagagaagttaagtgccccagtacgctgcacatttagaactcaaacccaagcccctgcttctaaaaaccgtgttcgttccgccacccca

SEQ ID NO: 68871 - DNA, 76 bp, Homo sapiens; identical to SEQ ID NO: 39308
  chr1:235292638-235292714
  hypo

SEQ ID NO: 68872 - DNA, 16 bp, Homo sapiens
  chr1:235325301-235325317
  hypo
ccaggtgcggtggctc

SEQ ID NO: 68873 - DNA, 120 bp, Homo sapiens
  chr1:235325377-235325497
  hypo
tgaaccagcctggtcgatctagcgagacttattctctacagaaaagaaattagacgggcaccttcgcgctcggcgcctgtagtcccagcactttgagaggctcgggcaagaggatccctt

SEQ ID NO: 68874 - DNA, 15 bp, Homo sapiens
  chr1:235325557-235325572
  hypo
cggcagaccctggct

SEQ ID NO: 68875 - DNA, 30 bp, Homo sapiens
  chr1:235443853-235443883
  hypo
tcctcgccacgcaaacggctcctgccagaa

SEQ ID NO: 68876 - DNA, 30 bp, Homo sapiens; identical to SEQ ID NO: 39311
  chr1:235793720-235793750
  hypo

SEQ ID NO: 68877 - DNA, 1146 bp, Homo sapiens
  chr1:235812015-235813161
  hyper
tccggctgagaggcacgggcccggtgccagcatttgacagtcctgggaggcgacgggtagaggagagacgcggcagccgcggggccggggagacggtgggaggcccggcgtccatcatccactttattacttgatcaaactttaacattttcgggtttcctaacaccttagccccaaatactcgaaatgaagcaaatcttaaattaaggagtctttccccaccacgctctgtcctcctccccacttcaccctcccgccgtttcgcgttatttccaaggcaatttaaaaaatcaagccaaacaaagctccccggttgctgccgggcgcgcgcggcgaacgaagcacatttcagttcagcaccagcctcggggacagacgccatcaaggaggtgaggaaaaccaccctcagctgcggtggctccagcgtcaccccgagtgctcccgaggcggcgtctgggctgctggggagccaggagggcttcctcaggcactcgccagaaacatttccccaaagaaaacgcccaaccagccacgccatctcctgccactgaggtccttttccacgggggacgtccccgctgggaaaacagcaaacgctctgtgacctacaaatggaagaggggacccccgagcccccgcctgcctcatgccggagggaccgggcgcccccagccccggaagcccctggacgcgctccgagggggctgtccacacccgcgcgcgggcttccccggggcccggcgggaggtcccgggagaggaggccgagggaaccacaggtctttgtgtcgcgtgcagcagcagctggcggcgtgaggaccacaccggcgccagagccgtctccctaggtccggagactttcaccccgagtttcccttccgcgtctggctgcaccgggctgggctctccccgcggacacccggggctccggccgggcgcccacttacccggagcgggatcacgcgcgggcttcgtctgcagcgcggtgctcgcggggggcggccaggccgagcggcatcgctccgcatcggggcgcgggccgggctcgggtgcaaacgcgcgcctcgtgcccctcccgccgcccgcggggtctccgcgtcccgtcaccggccccgccccgcgccgcgcctcccgccctgcagggccc

SEQ ID NO: 68878 - DNA, 176 bp, Homo sapiens
  chr1:235813621-235813797
  hyper
cgggggggaaatcaccggaggggtctggggcggggccggggttgctggaggggtctggggacggggccgcggtcagcgcgggctccccgaagcctcaggtaccgccctcgctcggggtgagctccagcgcctgggccgttggggcgcgggccgcttcccaccctgcaccaagggac

SEQ ID NO: 68879 - DNA, 193 bp, Homo sapiens
  chr1:235814009-235814202
  hyper
ggttctaggagcgactgctctccaggcctcgtccctgtggcaccgcaggcttttgcgctggagattttaaaacactttagtgattacagccctcttcctttcagggaaaaaacagtttaagcgccgtccattttccgacttggtaaaataatacgaaaccttgggaatagagaagcaacgaaaacatttcacg

SEQ ID NO: 68880 - DNA, 93 bp, Homo sapiens
  chr1:235872465-235872558
  hypo
ctgacagatgttctgcgacacgtagtcagactctagagcctgccgatggatgaggataaaaagacgaggatcattacgcgcccaagggggaag

SEQ ID NO: 68881 - DNA, 30 bp, Homo sapiens
  chr1:2358761-2358791
  hypo
gccgcaggtctgggacgagtcaggtgctgg

SEQ ID NO: 68882 - DNA, 348 bp, Homo sapiens; identical to SEQ ID NO: 14181
  chr1:2359972-2360320
  hypo

SEQ ID NO: 68883 - DNA, 27 bp, Homo sapiens
  chr1:236044127-236044154
  hypo
aagaattccatttagcggccgggcacg

SEQ ID NO: 68884 - DNA, 30 bp, Homo sapiens; identical to SEQ ID NO: 39313
  chr1:236081438-236081468
  hypo

SEQ ID NO: 68885 - DNA, 30 bp, Homo sapiens
  chr1:236087376-236087406
  hypo
tcaagacagcaacagcggaccattaaacca

SEQ ID NO: 68886 - DNA, 30 bp, Homo sapiens
  chr1:236184191-236184221
  hypo
tctggacaaggatatcggaggattttctag

SEQ ID NO: 68887 - DNA, 30 bp, Homo sapiens
  chr1:236192796-236192826
  hypo
cacgaggctagtggccggtctggggctggc

SEQ ID NO: 68888 - DNA, 282 bp, Homo sapiens
  chr1:236227462-236227744
  hyper
aggcccggccagtcacggggaggatccagggagctgtaggtcatctggtcccgctcctcgtttggggcctccgtggtgacaatgcctggccacaggaaatgggatcactgggagccctgtgtttcccgctctggactctggactctgaaacgagcccaactggaaagcagcatcactgccaagacacatccggagtccacacacaaatacaggaggctgccggcgaaactctcccgcagccacaagagtcccggggcccgcgcgcagactgcgatccagctc

SEQ ID NO: 68889 - DNA, 152 bp, Homo sapiens; identical to SEQ ID NO: 26961
  chr1:236227769-236227921
  hyper

SEQ ID NO: 68890 - DNA, 603 bp, Homo sapiens
  chr1:236228021-236228624
  hyper
cgccgtgcccggtgccccggcggccagcgggtccgggtccccgcctgctacgcccaagtccgtccggctccacgggcgcccccggcccgccgcgccctgcagcccctcgcccgccctcccggggctcactcacgtagactgcgtcgatgtcggatctgtcgtagaagcggagcgccccactcagctccagggcaggagagacgaagtcatccccgtcctccagctccaggtccccctgtccggggccgaagggaaagagctcctggcggctcaggcagcccacaggccccgccagcagcagcggcagcagcagcgcccgcgtccacgcagcccggatccggctgctcgaggccaacatgttcccgaactgcggtcccgcaaacccggtcccgcggccaggacagaggaaggcggggatgtaaccggacgcccctggcagccccctctcctcccgcctcccggcgttcccaccccgggaaataggggaggggagcggaggggagagcggagggccccgccccgtccagcgggcgcgccgcggggcagcccaatggccgcgagggggagggcgaggggcgaagccgaacctcccgccttgggcgc

SEQ ID NO: 68891 - DNA, 146 bp, Homo sapiens; identical to SEQ ID NO: 26964
  chr1:236228705-236228851
  hyper

SEQ ID NO: 68892 - DNA, 29 bp, Homo sapiens
  chr1:236252519-236252548
  hypo
gcttaccaggccaggcgtggtggctcatg

SEQ ID NO: 68893 - DNA, 55 bp, Homo sapiens
  chr1:236304825-236304880
  hyper
aaagagaagggctctcgggtggcggggacagaccctccttcggcatgggttggat

SEQ ID NO: 68894 - DNA, 30 bp, Homo sapiens
  chr1:236464650-236464680
  hypo
gcgtctagctgagggcggccagactctggg

SEQ ID NO: 68895 - DNA, 95 bp, Homo sapiens
  chr1:236558422-236558517
  hyper
tgtctcagctgagggcgtgagtagggagccaggaaagcgacccgcgactgcagccgtttcttaaggccagtccttcgctcgcagtctgtcccggg

SEQ ID NO: 68896 - DNA, 660 bp, Homo sapiens; identical to SEQ ID NO: 26966
  chr1:236558547-236559207
  hyper

SEQ ID NO: 68897 - DNA, 229 bp, Homo sapiens
  chr1:236559256-236559485
  hyper
cgggatgccaggttgagacacgtcctgcaaacctctggcagaaatgggcgcaagggggtggatttcgttttcgcctcccgggctttttctttctccccgctcacatgccttctcattactcctcttcctctctcccattgcactttgatgaaatggttttgtctgtctaaacattggccctcggagctatttcatcagatagtatccgcagaatcgagaggcggatccc

SEQ ID NO: 68898 - DNA, 37 bp, Homo sapiens
  chr1:236607992-236608029
  hypo
ggattataggcgtgagccaccgcgcctgaccaactct

SEQ ID NO: 68899 - DNA, 84 bp, Homo sapiens
  chr1:236614144-236614228
  hypo
agcctaactcatatagttttcaaaatgaccttatgcagaatgtaccattattatgctcactttacacatcgagatccagagtgg

SEQ ID NO: 68900 - DNA, 51 bp, Homo sapiens
  chr1:236687037-236687088
  hyper
ttatccctctgtgctcgtcccacagcaagccagtcgcggtccaaggctcca

SEQ ID NO: 68901 - DNA, 204 bp, Homo sapiens
  chr1:236768620-236768824
  hypo
tgcagtgggccaagattgcaccactgcactccacagagcgagactgtctcaataaataaattaatcgaatcctgttgaggtataatttacaaacaatggttacacccacgtcagtggaagagtttgatgacttttagcaaatgcatgtataggtgtaatgacctccccagtcaaaatgacagtttccatcgcccctaaaaattg

SEQ ID NO: 68902 - DNA, 83 bp, Homo sapiens
  chr1:236771371-236771454
  hypo
acaaaaaacaaacaaaaaaacaaattctccctatgctcttaggcagcgtccggaaacagtacaatccacggatattcagtgta

SEQ ID NO: 68903 - DNA, 30 bp, Homo sapiens; identical to SEQ ID NO: 39317
  chr1:236811244-236811274
  hypo

SEQ ID NO: 68904 - DNA, 49 bp, Homo sapiens; identical to SEQ ID NO: 136
  chr1:236849457-236849506
  hyper

SEQ ID NO: 68905 - DNA, 15 bp, Homo sapiens
  chr1:236850197-236850212
  hyper
cgctttgtggaggtg

SEQ ID NO: 68906 - DNA, 113 bp, Homo sapiens
  chr1:236900491-236900604
  hypo
aatatgagaggctagcgagtgaggtaaaggaaactggtgacctgcagttctgtccatcctcacgcaggggctgaggcacagagggtgaaaaaatactccgtgggggcatatat

SEQ ID NO: 68907 - DNA, 116 bp, Homo sapiens
  chr1:236907863-236907979
  hypo
ctggcatgaggaagccgctgtgccctcagcatattcatactttcttgctaccacctttgcaggcaaagagcagatcttgctgcagaaggattacgagtcggcgtcgctgacagagg

SEQ ID NO: 68908 - DNA, 29 bp, Homo sapiens
  chr1:236931484-236931513
  hypo
tgatctgcctgcctcggcctcccaaagtg

SEQ ID NO: 68909 - DNA, 30 bp, Homo sapiens
  chr1:23693485-23693515
  hypo
acacgatctcaaaaacgtggaggcaaagaa

SEQ ID NO: 68910 - DNA, 33 bp, Homo sapiens; identical to SEQ ID NO: 38890
  chr1:23694078-23694111
  hypo

SEQ ID NO: 68911 - DNA, 33 bp, Homo sapiens
  chr1:23704242-23704275
  hypo
tcacccaaggttggccggacgcagtggcttacg

SEQ ID NO: 68912 - DNA, 127 bp, Homo sapiens
  chr1:237056379-237056506
  hypo
tgattgctgtctcttcgaaggtaccatggggctctgtgatctctctctcctgtggcgcagggaagctttgggtccccctctggcctttgttagcaaagaataattgatgggccgagtatacctggaa

SEQ ID NO: 68913 - DNA, 30 bp, Homo sapiens
  chr1:237204993-237205023
  hyper
tgcatcgattatctgcgaaaagcatggtac

SEQ ID NO: 68914 - DNA, 165 bp, Homo sapiens; identical to SEQ ID NO: 26970
  chr1:237206101-237206266
  hyper

SEQ ID NO: 68915 - DNA, 224 bp, Homo sapiens; identical to SEQ ID NO: 137
  chr1:237206511-237206735
  hyper

SEQ ID NO: 68916 - DNA, 27 bp, Homo sapiens
  chr1:237230203-237230230
  hypo
tgggattacaggcgtgagccaccgcgc

SEQ ID NO: 68917 - DNA, 299 bp, Homo sapiens
  chr1:23748862-23749161
  hyper
gtatgtagctgtgaccgtaggcacttggttgcatgtttgaagttgcttctgttagtgcatgctcagaggatgtgacaaagccttaagtggctgagacttcagcaaccggcagtaaaccccgggcctgagctgcaacgtggaggatccgtcttattacaggaagtatgtcctcctctgcctaaccactgctgggcgggtccactttcactcccagagcaggccccacctttctcggccagacgcccagagctccatgcccacccagacactgccgagagcccaggcgcagacgtggctgt

SEQ ID NO: 68918 - DNA, 691 bp, Homo sapiens
  chr1:2374950-2375641
  hyper
gggaggtgtggggagcggaaggccgcaggagcatctttgcggagaaagtactttggctgcggcgggcgcagggcgggccggctagccccgcgccccacctgttctgtgcgtcgcgctcgcccggttgcgcccgatctgcctccagcccggtgcccgccgcggagcccgcgcccccggccccctcccggcgcggggcgggcagggggtgtggtgcgggcggcacgagtgacagcgcgctcctcgcgcggcgcctccacggggcgcagtgtcaccgcgcacagcccgccgcgggccgcccgagctggcggggcgatgccgcgggagccggagccccagcccgagcccgagcccggccgctgactgcgcctcccggcccgcagcccccgcccccgccgccctcgctgccctcgctgcagccgccacggagacaatggacgcgggagccgccccgcagaagcacagtaggtgccgctcctgccgctgcgccgctgccaaccgggatgcgcgggtggacgcgcgggggcgccgcagccctggtgcgggtcggggctgagccgcctgggcttcagactcgggagcggaggctcggatcgcggtggcacgggcaggggtgcgggcgcgggactgtgggcgggacgggcggagcggtcttgagctctccggatggcctcaggtgcggggtgagggatct

SEQ ID NO: 68919 - DNA, 74 bp, Homo sapiens
  chr1:23750737-23750811
  hyper
ccagctctcttcgcccgctttcctgggccctgcactagctgcccagggtgaaccctacacgtccaaagggacgt

SEQ ID NO: 68920 - DNA, 30 bp, Homo sapiens
  chr1:237732599-237732629
  hypo
ggactttgatgttggcgatggtaagtctac

SEQ ID NO: 68921 - DNA, 30 bp, Homo sapiens; identical to SEQ ID NO: 39319
  chr1:237753724-237753754
  hypo

SEQ ID NO: 68922 - DNA, 30 bp, Homo sapiens
  chr1:237919696-237919726
  hypo
cttgagttcccctcacgagtgtctgttctt

SEQ ID NO: 68923 - DNA, 71 bp, Homo sapiens
  chr1:237947252-237947323
  hypo
gaagagttcgtcaaacgcttccacgaacctgcgaaggacatcggcttcaacgtcgccgtccttctgacaaa

SEQ ID NO: 68924 - DNA, 135 bp, Homo sapiens
  chr1:238018308-238018443
  hypo
cctaagaaagggttgcgccacttgtgaaataatagaaaataaaaagggctcatagtatatgtgtcgattgcatttccagtgccctgttctaatcgctatgcagtcatccataacttaatacgttctgagaaatga

SEQ ID NO: 68925 - DNA, 43 bp, Homo sapiens
  chr1:238027719-238027762
  hyper
tgctctgcctccaagcgccacgtgggggcgctgcctcaccact

SEQ ID NO: 68926 - DNA, 30 bp, Homo sapiens
  chr1:238081199-238081229
  hypo
ggtcaggttcagctacgccctgctacttgg

SEQ ID NO: 68927 - DNA, 35 bp, Homo sapiens
  chr1:238235527-238235562
  hypo
ttagtaaaaatgggccgggcacggtggctcacgcc

SEQ ID NO: 68928 - DNA, 146 bp, Homo sapiens
  chr1:2382686-2382832
  hypo
gtggtgggcttgcctcgtgtcccgattgtggggtctggggccagagatgtgtgtgcctccccggcccccgaagatcatacgcagtagcgtctccgagggatgccactagcagtgacaggcagagattgtcgcggagaatgtggctg

SEQ ID NO: 68929 - DNA, 88 bp, Homo sapiens
  chr1:23833064-23833152
  hypo
gttccagctcaccctcgaaaagtgccacaggcaaggttcttcagctcacccaggagccagcaggctggccaggcgtgtggccaccatg

SEQ ID NO: 68930 - DNA, 29 bp, Homo sapiens
  chr1:238508028-238508057
  hypo
tttgtccttacacgcgtgagccactgcgc

SEQ ID NO: 68931 - DNA, 84 bp, Homo sapiens
  chr1:23859450-23859534
  hypo
gtgagtcaccgctcccggtcacatctctgaccttatctccagtgcataagacccttttactctagtctacgtatctcattggtc

SEQ ID NO: 68932 - DNA, 72 bp, Homo sapiens
  chr1:23884932-23885004
  hyper
ggagcagtcagtttccgccgagcgtgccgaggcgggggccgtccgcagactggccggcgccagggaggaaac

SEQ ID NO: 68933 - DNA, 19 bp, Homo sapiens
  chr1:239516662-239516681
  hypo
agagcgatactctgattaa

SEQ ID NO: 68934 - DNA, 192 bp, Homo sapiens; identical to SEQ ID NO: 39322
  chr1:239523114-239523306
  hypo

SEQ ID NO: 68935 - DNA, 231 bp, Homo sapiens
  chr1:239549584-239549815
  hyper
acaaaactaacagaccggcaaaatctatctttgaagcgccgcgggaggcacaatttgggaacaggtgaggccatgctgggtgggtgaggcccccctctctcctgcttggtgttccgctttcagccaacccaccccaggagtaccctgggatctcctcgccccctgccaggcggagaacgcggagcccagcgggcacgcgggaatggagctaggcgccggcagggcaactgg

SEQ ID NO: 68936 - DNA, 1184 bp, Homo sapiens
  chr1:239550034-239551218
  hyper
gagaaagggaatacacgataaagaaggagacggaaagaagagaaaaagtgaggcgggagacagagggaaaagggcgtgaacagaaagggccggagcgtgcaggggagcacagggcgcgggggcggcactgccgagccgggagcgctgccgcttgggcaggtgccgcggccgctgcccggaggcggcatgtgacgcgcggccgcagctgcccgcgggcggagcgctctcagaccccggagcgcacaccgcggggccatcggtgccatcgcggatctccaggctcctcatcagtccgccggggccgcagcagcgcttctgggaagacgggcgatgaactgaagggcggctccgggcaggggggcacgatcttaaggacagtcgctccctgaacgcggagccggaggagacgaagggaaggtggagcggacgccacccgcgcaccgggcaggcgcggagaccggcgtgggacagccacctggagcgcagctgccaggtagggacggcgcccgccacccaggcgctgggcagagcgggtggcggtagcggctgacctggtttcttgccttatctcgttgcgaaaggaggaaaaagttttcggcgcgggtaggagaggtcttgtgtttggagtccaaagaaggggctgggtagggacgagagaggctgttgatttggggaagatgggggcacttgaattccgacagcgcgatctggtgcggagttggagttctgggactgagggtggggaacgcccgctggcactcaagtgccccgaaagggacgggaatcatgcgagcggtggccgggagagagtcggggacgtcccaccccgctctccctcgcttcgattctctcttcgccactgccggatctgaggctccaaagtgcccgagcatgaggagctactgggctccgggtgtgtttgtgagcgcactcgtgtgttgagcgtttgtctcccatctccccatttggtttcctgtcatttctaagaaggctaaagctggcacccgccaacctcgcagtggggccgcaagttcggattgcatttcagggggcgagaaggcaaatttggcacttcgagtaacacttgggcgaaggtacctagcctagtgcgcatctttactgacccggggagagtctgcactcgcgaggcagcggccgctggactgcaccggttctcctctttg

SEQ ID NO: 68937 - DNA, 195 bp, Homo sapiens; identical to SEQ ID NO: 38748
  chr1:2396998-2397193
  hypo

SEQ ID NO: 68938 - DNA, 125 bp, Homo sapiens
  chr1:239987328-239987453
  hypo
actcgggagcatgtgcgtgaccatctgctacgggcacagaatgccaggctgccggcggtgccctctgtctcgttggtgaggccgcatttcactccagctccttgtgccatcgtatcacacatctt

SEQ ID NO: 68939 - DNA, 23 bp, Homo sapiens
  chr1:240102287-240102310
  hypo
caagactccgtctcaaaaaaaaa

SEQ ID NO: 68940 - DNA, 250 bp, Homo sapiens; identical to SEQ ID NO: 39324
  chr1:240118753-240119003
  hypo

SEQ ID NO: 68941 - DNA, 157 bp, Homo sapiens
  chr1:240160929-240161086
  hyper
ggactggggaggctccgagggagcaagacatttaaacccgggcggtgggggggcgggcggtgtcagacgcccaacgaccacctccctcccggcccgcgccgagcccggccacaccctccccgcgacacccgcgatcgccccccaggactggcggccc

SEQ ID NO: 68942 - DNA, 259 bp, Homo sapiens; identical to SEQ ID NO: 5995
  chr1:240161122-240161381
  hyper

SEQ ID NO: 68943 - DNA, 41 bp, Homo sapiens
  chr1:24017587-24017628
  hypo
accaccactcctttccgtttgtataaattctatttgtgccc

SEQ ID NO: 68944 - DNA, 667 bp, Homo sapiens; identical to SEQ ID NO: 26977
  chr1:240254819-240255486
  hyper

SEQ ID NO: 68945 - DNA, 672 bp, Homo sapiens; identical to SEQ ID NO: 139
  chr1:240255487-240256159
  hyper

SEQ ID NO: 68946 - DNA, 281 bp, Homo sapiens
  chr1:240256624-240256905
  hyper
cgctgtttcaagccctacccgctcatcaccccctgctacatcaagaccaccacccggcagctcagctcgcccaatcactccccgtctcagtcccctaatcagagccccaggatcaagaggcggccggaaccctccctgagccgagggtccagaactgccctggcctccgtagccgccccggccaagaagcaccgggccgacggcggccttgcggccggcctgagccgctcggctgactggacggaggagctaggcgcccgcacgccccgggtgggaggctc

SEQ ID NO: 68947 - DNA, 38 bp, Homo sapiens
  chr1:240267184-240267222
  hypo
tatttttttttgtgacggagtcttgctctatccccagg

SEQ ID NO: 68948 - DNA, 30 bp, Homo sapiens; identical to SEQ ID NO: 39325
  chr1:240308662-240308692
  hypo

SEQ ID NO: 68949 - DNA, 120 bp, Homo sapiens
  chr1:240372826-240372946
  hypo
gacaggcgtgagccaccgggcacggccgcaaatcaaattcttaggtaaactgactctggagcatgatttagtgcacactttaaaatgcacagccctgtccgggtgcggtggctcacgcct

SEQ ID NO: 68950 - DNA, 169 bp, Homo sapiens; identical to SEQ ID NO: 14351
  chr1:240463082-240463251
  hypo

SEQ ID NO: 68951 - DNA, 34 bp, Homo sapiens
  chr1:240655738-240655772
  hypo
tcctcatcacagcagcgaccgagggcagcctgcc

SEQ ID NO: 68952 - DNA, 393 bp, Homo sapiens
  chr1:240774920-240775313
  hyper
aagagaaagaaagagcgatcacggtcaagtttgaaggtccttatgttacacccacgcataattcaataggtgaataaaccttgtggcccccagacacacgccaacagcttgaattacccggggtgaaaccggcgagacgtccactcagggctttcggtcctgaccagccacggaacaaacaacgtcaattcattctaagtgcctggtgaaggtagaaatcagaaaccgtgtctgtgtcacgttagtcgtgacaagctgcgtacctgcaatgacgtgatggaagcctcctcctcgggtcccttctctctctctctctccctctccctctgccttctctgagttctctagtccacagcggggtctaagtttggtctcccgccgccgctttcagtt

SEQ ID NO: 68953 - DNA, 77 bp, Homo sapiens; identical to SEQ ID NO: 6000
  chr1:240775378-240775455
  hyper

SEQ ID NO: 68954 - DNA, 40 bp, Homo sapiens
  chr1:240892900-240892940
  hypo
ccttccggccgggcacggcggctcacgcctgtaatctcag

SEQ ID NO: 68955 - DNA, 40 bp, Homo sapiens
  chr1:240893180-240893220
  hypo
gtctcaaaaaaaaaaaaaaagaagccgcttcctattggta

SEQ ID NO: 68956 - DNA, 56 bp, Homo sapiens
  chr1:240986717-240986773
  hypo
agggcagatgcctcacgttatagtccagtccgctcaggacacgggctgcggccggg

SEQ ID NO: 68957 - DNA, 142 bp, Homo sapiens
  chr1:241052144-241052286
  hypo
ctggaggttagggaacgcggaggcagagagagggaagcagcgggtgcaaagggcagagctacttcggattttatgacggtcaaaggcctcaatgaagaaagaggtaacatttgtttttgttttgtttttgagacggagtccc

SEQ ID NO: 68958 - DNA, 39 bp, Homo sapiens; identical to SEQ ID NO: 39330
  chr1:241096456-241096495
  hypo

SEQ ID NO: 68959 - DNA, 206 bp, Homo sapiens
  chr1:24119111-24119317
  hypo
ggttttgctcttgaccgccgccccgatgtatgcaggcccccgccgtggagccgtgtggtgtatgtgtggtaacaccatgtctgtgcccctgctcaccgatgctgccaccgtgtctggagctgagcgggaaacggccgcggtaagggtcccctttcacccacggccagacactgtgggagcagctggaggaccggctggagggggtg

SEQ ID NO: 68960 - DNA, 462 bp, Homo sapiens
  chr1:241520071-241520533
  hyper
gctcccgggggcggccgccctgcgcccgcggacgctcccgctgcgcagagcgagggctgggtgcgggccgggggccgggagggctctgggtggcgctgcctcctccccgcccgccttccctatttacctcctccgccaaggtcacggccccgcggcgtctcccctcccgggcgggctgggtgcaggcggtgtcagctggcggcaagcggagcagcgaggcagggtagcttcatcacactcgcggcggatgcggattccgcgccgccccggctctagctgctcaggcgaccgccaccctcgcctcgccgccgcccgtgcacaggcggctccggcagccgccactcgcgcccgctcccctgggccgcctcgctggctctctccctcctccgcttcttctcccggggactgggaccagccgagcgcgcgcgggagtcgagacgcccggcccgtgcgcgcgactgg

SEQ ID NO: 68961 - DNA, 30 bp, Homo sapiens
  chr1:241520759-241520789
  hyper
gagaccggagtttaacgcccagtgtaagcc

SEQ ID NO: 68962 - DNA, 503 bp, Homo sapiens
  chr1:241587106-241587609
  hyper
gcaggcagtcctgagcggccgctgccatcgcgccggctgcagcggaaaggtacaagcggtggcggcaggagccgctgtgggagcagcagtggcggcagtgggagccctgtgccacgcgtcccctgtgcgccgtgtccccaaggcagctgactacacctcccccaccctcctgcagcagggtggatcccacctagcgggactccccacccacccctccaggccttctccactccggactctggccacttgccaccgttgtcgcccgccgccgctgcagggagggtgcacggagggagcagaccgtctccggagcccgccgccctgggggctgcagtgatggggccgggctgaggcacctgccggcggggtagcagggcagtcgagcacggagggaggggcgggcctccaggggacttcagcgggagccgggcctggggcggtgccgcacttgcacacggagtgtggggggccaggcctgggaccaggagctggggccgggcttc

SEQ ID NO: 68963 - DNA, 268 bp, Homo sapiens; identical to SEQ ID NO: 1911
  chr1:241587610-241587878
  hyper

SEQ ID NO: 68964 - DNA, 87 bp, Homo sapiens
  chr1:241647308-241647395
  hypo
gtgctgggattacagccgtgagccactgcgcctggacgtgtctatccttttctatagcacctctaggaaacacgaaccatgtccaag

SEQ ID NO: 68965 - DNA, 123 bp, Homo sapiens
  chr1:241753208-241753331
  hypo
ttgtgtttggcattgcgatgagtgggaatgaagaataatactaagtcgcagtgagaaatagctgtatttgttcaaaagcgttctttaagactgtcattattgcagatgcgagcacatgtcaac

SEQ ID NO: 68966 - DNA, 30 bp, Homo sapiens
  chr1:241888798-241888828
  hypo
tctccaaggcccagtcgttccctccatgct

SEQ ID NO: 68967 - DNA, 30 bp, Homo sapiens; identical to SEQ ID NO: 39332
  chr1:241913315-241913345
  hypo

SEQ ID NO: 68968 - DNA, 30 bp, Homo sapiens
  chr1:241979590-241979620
  hypo
gagtcaacatgcagacgttctaaaaaacaa

SEQ ID NO: 68969 - DNA, 30 bp, Homo sapiens
  chr1:242012857-242012887
  hypo
tattaccagaatgttcgtgcttagaataat

SEQ ID NO: 68970 - DNA, 38 bp, Homo sapiens
  chr1:242013289-242013327
  hypo
tgaacaatttctggccgggcgcggtggctcacgcctgt

SEQ ID NO: 68971 - DNA, 85 bp, Homo sapiens
  chr1:242087513-242087598
  hypo
tgtgcccggccttacttccttcattcctatagctgggtactattgctttgtctggatgagccacaatttacgtcatccaccttaa

SEQ ID NO: 68972 - DNA, 27 bp, Homo sapiens
  chr1:242122948-242122975
  hypo
catgagccaccccgcccagcccacttt

SEQ ID NO: 68973 - DNA, 54 bp, Homo sapiens
  chr1:242161776-242161830
  hyper
cagcgcaccttcctccggggcacgctctgcgccacctaccggatgatgctgagg

SEQ ID NO: 68974 - DNA, 30 bp, Homo sapiens
  chr1:242182244-242182274
  hypo
atgagccactgtgcccggtctcttacaaat

SEQ ID NO: 68975 - DNA, 20 bp, Homo sapiens
  chr1:242194963-242194983
  hypo
gccaccgcacccggctgcta

SEQ ID NO: 68976 - DNA, 177 bp, Homo sapiens; identical to SEQ ID NO: 14352
  chr1:242286750-242286927
  hypo

SEQ ID NO: 68977 - DNA, 17 bp, Homo sapiens
  chr1:24246049-24246066
  hypo
atttattttttaagacg

SEQ ID NO: 68978 - DNA, 31 bp, Homo sapiens
  chr1:242633349-242633380
  hypo
attgggaggggctgccgggtgcggtggctca

SEQ ID NO: 68979 - DNA, 1343 bp, Homo sapiens
  chr1:242686691-242688034
  hyper
agagccaattcacttcgcgtgaagtcggcactccttgggagtagaggtcccctctcaccggctcccaccctccagaggggaggatttctggggagcccgacgatccgctcgcttttagcctttctccttgcaacgcgcaaatctctccctagttgggctcaagtagagaggatcaccaactgctcatcccagcggacactctgcaaaaaactctaatggcttgtgcgcgggtccacgctggtcgctagcggcgccaactttactcattcgttaatttgctagtttttggactgagtaaaacagcccccaaagacgcgggcaaacgccgctctaaagcccactaccatgcaacgccaggttgctcggagccacgctggtggcacttccccttcgtgctcactctgcacaggcacctccagaaccccgtgcaaatgaaccctaccgggagacgcaggtgggcaggtcgggtcggcagggaccaagagcctgaaagggaacctgccctcccctccccgcagcccggtcattaaggcaagaaactgcaggcagagaagcccccgaatccgacctaggacgtcggcgcctgccaggatcccctcgcctgccccccgcgccccgcgcgcgctcatgccaccaccacggggagggtgcatgcggcaggtgcctggccgaggcccccgggagcgagtcgcccttacgtgctccagcttgtctttcctccgaagccagacgctggcgctgtagtcctgctgcttgacgctgctgtagaagttcgcgcccactcgggtcaggcttggggagggctccttggggcggcttttgagcctcatctgctcgaagccctcatggggggaggccgagagccactcgtgctgccggatctccatcctgacatgaccgggcggccgccggcgagcagcggactcgggacgggcgcgcggggagccgggcgcggagggcgagcgggaggcccagcgggagccggaggtggagctggagactgagctggaggagctggaggagcgagcgggcgcggggagcgcggggtgctgagcgccagctgggagcgcggccgggcgggagggggcgatcgcgggaggcgcggggcggaaggagggagggcgaggtgcgggcgggggcgggggcgggggcggagggggacggacggggagaagggggacgagaggggacagggagggaaaggaacctgctccggggagacagaagtgcccggtgcggcggcgacgtcgcccggcggctgcggtcccgagcgggcgctccgctcgccggctccttgcggcacctactgggacccgggccggctcccggggcggcggcggcgg

SEQ ID NO: 68980 - DNA, 164 bp, Homo sapiens; identical to SEQ ID NO: 26989
  chr1:242688080-242688244
  hyper

SEQ ID NO: 68981 - DNA, 418 bp, Homo sapiens; identical to SEQ ID NO: 26990
  chr1:242688277-242688695
  hyper

SEQ ID NO: 68982 - DNA, 383 bp, Homo sapiens
  chr1:2428099-2428482
  hypo
gaagtacaccaagtccgtggccacccacgacatagagatggagggtgagtggctcggggacctggggccacgggcggaggcctccctgtcccccatccctgctatgctgctgggcgccgggcgaggtcgaggactggcagtctgatgcccggtcaccggcgccacagcggcgtccagctggcaggtgtcgtccttcagcgagaccaaggcccaccagattctgcagcagaagccggcgcagtacctacgcttcaaccagcagcagctctcccgcatctacccctcctcctaccgtgtggactccagcaactacaacccgcagcccttctggaacgccggctgccaaatgggtgggtgcgggcatggtgcgctgggtgtggtgg

SEQ ID NO: 68983 - DNA, 30 bp, Homo sapiens
  chr1:242843570-242843600
  hypo
ctcatctgagatgtgcgtgacagcagtcag

SEQ ID NO: 68984 - DNA, 140 bp, Homo sapiens
  chr1:242973108-242973248
  hypo
attacaggcgtgagcaaccgcacccggccagataaagaatgttttaacaagaaagatgacctcattcccttagtaccgtattttagttcagtcaaattttgactggtgccattctcctcagctgccgtgatttccaattt

SEQ ID NO: 68985 - DNA, 30 bp, Homo sapiens
  chr1:243002516-243002546
  hypo
cctgctgtggggcttcggggtcacaggcac

SEQ ID NO: 68986 - DNA, 90 bp, Homo sapiens
  chr1:2430433-2430523
  hypo
gggagtggtgtgggccgggggctccaggctggagcggtgctgggccgggccctccccatgggacactcctcctggcgctgcttccccagg

SEQ ID NO: 68987 - DNA, 92 bp, Homo sapiens; identical to SEQ ID NO: 26991
  chr1:243053773-243053865
  hyper

SEQ ID NO: 68988 - DNA, 167 bp, Homo sapiens; identical to SEQ ID NO: 26992
  chr1:243053866-243054033
  hyper

SEQ ID NO: 68989 - DNA, 17 bp, Homo sapiens
  chr1:243057071-243057088
  hypo
gccaggtgcggttaccg

SEQ ID NO: 68990 - DNA, 84 bp, Homo sapiens
  chr1:243080471-243080555
  hypo
tgcacaagtcaactgcggttctacgctcgcacagtattgctcacatggcggcgtacaacagtggacatgcgtattatgcatctg

SEQ ID NO: 68991 - DNA, 16 bp, Homo sapiens
  chr1:243120279-243120295
  hypo
ccgtctcaaaaaaaac

SEQ ID NO: 68992 - DNA, 29 bp, Homo sapiens
  chr1:243139472-243139501
  hypo
caggcgtgagccaccgtgcccggcctctc

SEQ ID NO: 68993 - DNA, 82 bp, Homo sapiens
  chr1:243145032-243145114
  hypo
ttacaggcgtgagccaccgcgcctggccgtgagaatgtaattttttatagttactcttatcgtgagtcgtaagtagctcatt

SEQ ID NO: 68994 - DNA, 30 bp, Homo sapiens
  chr1:2434250-2434280
  hypo
gtgcctgcaggcaaccgggggccctgcagg

SEQ ID NO: 68995 - DNA, 66 bp, Homo sapiens
  chr1:2435884-2435950
  hypo
agcctgggcctgggccgcagccgtgagaacctcgctggagcccacatgggacgcctgccccccagg

SEQ ID NO: 68996 - DNA, 385 bp, Homo sapiens
  chr1:243646379-243646764
  hyper
tgcactctctcaaaacgacagtcgccctgaaacggacgctggaagaggtttccaggcccgtggcgacggtgaggggggtgaaggtcgcaggtggagggcacggggcggcggctgcggagcccggggaggaggcggcgggcgcccgggtcttcctcggagcgcgccccctgggctgggcggcgtgtccctgcctcccgccggcgccctcgtccccgcagcagcgtccccgccgccaccccgctgcctcgtcgcctttctcgcaaacagcggtgccctctacgtgggggatcctggaggctgctgagcacgagcgccctccgcgacccgcccctgctcccgcctccactcttgcctcggggggagggtctcagtcttctgcctaagg

SEQ ID NO: 68997 - DNA, 33 bp, Homo sapiens
  chr1:2437266-2437299
  hypo
tacttaccaggtgcccgtcggagcctgcgccag

SEQ ID NO: 68998 - DNA, 30 bp, Homo sapiens
  chr1:243844807-243844837
  hypo
tcagccacccatctacgacatctatatttg

SEQ ID NO: 68999 - DNA, 120 bp, Homo sapiens
  chr1:243982361-243982481
  hypo
gccttgcgtgccaagcgcagagctgtgcagatgtttggcggtcactcaactggagaatgcctaagactaccgaattcccagggaaaggggccaccgtcatcactgcggctgcctgctgtc

SEQ ID NO: 69000 - DNA, 424 bp, Homo sapiens
  chr1:244014247-244014671
  hyper
cccacccgccctggccgcggacgcgcgcgccgccaggccccgggcgtctcctccagtccgccgcggccccttggggagatgggcccggcgcgagggctcgcacctggaagcccacgaagtgggcggtgcccaatgaggtagggaccggagagcgcggagcagtccagaagccgaccccaccccctgcacctcggggaagagggaacccgggtcagcccgtagcaagaatcattcctgactatcccaggagaccacggcagaccaaaaacacctctctgaacagccttccgcaccgctcgctgcaagcattcgtccacacacggtacacagattgcgggcggatcgtaattcactcttgaaatcacaccctttttagggatattcgttttcaatgactttgggaaagccacgaggtactacattt

SEQ ID NO: 69001 - DNA, 30 bp, Homo sapiens
  chr1:244019046-244019076
  hypo
tttttgagagcagagcgttaagccaagtac

SEQ ID NO: 69002 - DNA, 364 bp, Homo sapiens
  chr1:244080431-244080795
  hyper
ggtagaacagagaagcgagcaagaacaggtgggaagaaaaacagcagcctgatccgtcttgcttttcccttttctccatgcagccagcacttttccttctcactctccccgcacgcccacgcccacccgcttctgcaccgagaacctcgaggcgcgcacgcacgtggaggtgacgccaagcccagcggcgaggtcggggctgggggtggggggagccggcgtcccgcgggcccccgaggccggggagctccgccagcgcattgtgcgagcgagctgaatgcagccgaggggcgagcgcgcgggctcgcacggattagccgtgctttcccatgagccacaaaagaatgcccgaatctgggacatc

SEQ ID NO: 69003 - DNA, 170 bp, Homo sapiens
  chr1:244087001-244087171
  hypo
agggaggaacacggccggctcattttccctccttgctttccctcatctcacgctcactggctggctgctttggctccccagggtcaggcactgggtggggtgcagggagttagggacaccattgacgtctggcagtggtcccttctgggtgggaccgatgtccaaaatga

SEQ ID NO: 69004 - DNA, 44 bp, Homo sapiens
  chr1:244115675-244115719
  hypo
agacatggtggatgacgaggacacgctgacgaaagcaatgaaag

SEQ ID NO: 69005 - DNA, 30 bp, Homo sapiens; identical to SEQ ID NO: 39341
  chr1:244139857-244139887
  hypo

SEQ ID NO: 69006 - DNA, 111 bp, Homo sapiens
  chr1:244142957-244143068
  hypo
gggggggtggtgggacggaaggtacccacgagggtggcgtgtggggccatcggccaggagtgggggggatgggacggaaggtacccacgagggtggcgggtggggcagatg

SEQ ID NO: 69007 - DNA, 35 bp, Homo sapiens
  chr1:244198767-244198802
  hypo
tgtgtagtaggttatcgcatctaggtctgtgtgag

SEQ ID NO: 69008 - DNA, 105 bp, Homo sapiens; identical to SEQ ID NO: 39343
  chr1:244200765-244200870
  hypo

SEQ ID NO: 69009 - DNA, 206 bp, Homo sapiens
  chr1:244243925-244244131
  hypo
ccggtgagactctgccggatgatgacaaatcgtgttcacattaaccttgtgccctgaaggttgcctttggtgggaagaggcagagaagacgtgagtttcttgccaattccacctggtggagagcctgccaggcctcctgacttgtggtcctgtctctgaccggcacggtggctgcttttcctaggcaagtgcggcataatgtccct

SEQ ID NO: 69010 - DNA, 21 bp, Homo sapiens
  chr1:24426643-24426664
  hypo
ccaccgcgcctggcctccagt

SEQ ID NO: 69011 - DNA, 55 bp, Homo sapiens
  chr1:244319117-244319172
  hypo
catcacaggcggctgcgtgcttattaccccctcttcctgccgtgtaggggtggtg

SEQ ID NO: 69012 - DNA, 47 bp, Homo sapiens
  chr1:24435099-24435146
  hypo
acctcccaagctgtgcggcagagtcatggttacgagagcaacaacct

SEQ ID NO: 69013 - DNA, 30 bp, Homo sapiens
  chr1:244402710-244402740
  hypo
gctgtgaccctatcccggctgattcaaagg

SEQ ID NO: 69014 - DNA, 21 bp, Homo sapiens
  chr1:244625361-244625382
  hypo
tcctgccggggcctcccaaag

SEQ ID NO: 69015 - DNA, 30 bp, Homo sapiens
  chr1:244805002-244805032
  hypo
aataaatctactaagcgcatatcattggta

SEQ ID NO: 69016 - DNA, 16 bp, Homo sapiens
  chr1:244893239-244893255
  hyper
atttttttgacggggc

SEQ ID NO: 69017 - DNA, 188 bp, Homo sapiens
  chr1:244893315-244893503
  hyper
gtttgagtccagcccgggcaacatagttggttttttttttttttctcctgtctcaaaaaaaaggcattgcagagattgaaaaccgtttcccaccttctcccctgcagtgtttaggaagagacaatccgcccccgattcagcgcttcccagcccgcagcaactgcgcagcggggggaacccagggctcc

SEQ ID NO: 69018 - DNA, 846 bp, Homo sapiens
  chr1:244893504-244894350
  hyper
cggcacccgcaggctttagttactgctccgaggccctcggaccaaagagaggctgcgaggaggacgcggctcgtttagctcgctgcgaacctcaagataacccttggtttccatgcacatccccccaacattgcatgtgctttcattcctacggtgctggggttactttcatttattgcttttgttgaccaaaaagaaaaaaacaatcctgagcgtgcacagggggcgcaacgggggaccggctcctcgtggctgaccggcggcggggctggcgcgcgggggcggcctgcgcgggccgcccggggacgctgctctggggtccggccgcggcctcgtggccgccctgcgcgcggtccagcaccagcagcgggatctcctccagccggtccggccgctccttgcgccgcaggtagcgccgcctccacgtcgccagcctctgaagcagcctctgcaggctcgaggggccccacaggccgcgctccggggcctccttgcctgcgcgcgcgtgagcttgcctgagcttcttcctgcgcgggccgcggaacagccgccgccagcaccagcacccagagcaggagccgccgtcgccggccaccgcgcgccgcccgaccgcctccggatccccgcgcggaggggggccccgctccaggcgcgccgccttctccagcagctcgtgctgcgcgccgccgcgccgggggccaccaaaccggggggccgccatggcccgcgcaggcctcttctcggagcgcggggcccacatctcgggaaccgtcgggctggacaacaacgctgccgcctccaggactccaaagggcccctcgcgtcctctcccgggaatgtacccac

SEQ ID NO: 69019 - DNA, 30 bp, Homo sapiens; identical to SEQ ID NO: 39346
  chr1:244914578-244914608
  hypo

SEQ ID NO: 69020 - DNA, 23 bp, Homo sapiens
  chr1:245032177-245032200
  hypo
accgtgcccggcctatatgcagt

SEQ ID NO: 69021 - DNA, 180 bp, Homo sapiens; identical to SEQ ID NO: 39347
  chr1:245060866-245061046
  hypo

SEQ ID NO: 69022 - DNA, 144 bp, Homo sapiens
  chr1:245135719-245135863
  hypo
tgtatccttgtagtccgtggacagcagcctggacatcactggctgccaccgacctaataatgaatcagtcttcattttaacatgtttgtaggtgatttgtatgtacattaactttcgagaaggccgggcgcggtggctcacgcc

SEQ ID NO: 69023 - DNA, 32 bp, Homo sapiens
  chr1:245254414-245254446
  hypo
gagatgaggatgaaccgcgtgccttcaggaca

SEQ ID NO: 69024 - DNA, 50 bp, Homo sapiens
  chr1:245305933-245305983
  hypo
tccttcctgtgggagcgaggaggctgcctccctcacgggtggctgtgagg

SEQ ID NO: 69025 - DNA, 178 bp, Homo sapiens
  chr1:245317376-245317554
  hyper
cccgcggggcccaggcgcaggaagaaacgggcggcggggggcgaggggcccgatcccacgcaaggagaggccaaggccagctcgcgccacaccccctctccaggccagagtcgtccgcgtgcagcgcggcgaagccctcagtttcccctgcccggcagcggcccgctgggtcaccagg

SEQ ID NO: 69026 - DNA, 82 bp, Homo sapiens
  chr1:245318718-245318800
  hyper
aagccaccatgaattcggtagctgggaataaagagaggcttgcggtctccaccaggggcaagaaatacggggtaagttgtga

SEQ ID NO: 69027 - DNA, 311 bp, Homo sapiens
  chr1:245319150-245319461
  hyper
cggagagttggaccccgtatgaataaaaatcctgaaatcacagccctccccctaccccccccatagggtcttccaggattttgttcccgggatcttgctgggataggtgccggcttcaaaagcgtggggcgctgaacctatggatcccccccgccttgcagaagccgtggaaacggccccgagcgagtccccttcctgaccccaggaggaggccaccggggaccagcgcaggggtcacctgggcggtggggactcacttaaggacaattaacgagacagacggagggcaatttggccgcagggcttggaga

SEQ ID NO: 69028 - DNA, 37 bp, Homo sapiens
  chr1:245376976-245377013
  hypo
atcatcatcagaaggcgttgtgcgtggtgtggatgca

SEQ ID NO: 69029 - DNA, 151 bp, Homo sapiens; identical to SEQ ID NO: 39350
  chr1:245461494-245461645
  hypo

SEQ ID NO: 69030 - DNA, 30 bp, Homo sapiens
  chr1:245472787-245472817
  hypo
atggaatgacgccatcgggtctcctggttc

SEQ ID NO: 69031 - DNA, 32 bp, Homo sapiens
  chr1:245494495-245494527
  hypo
gaccgagacatggatcgcgctcttgccggagg

SEQ ID NO: 69032 - DNA, 32 bp, Homo sapiens
  chr1:245498973-245499005
  hypo
gaaagaagggtcccacgcggggaaagaagggt

SEQ ID NO: 69033 - DNA, 182 bp, Homo sapiens
  chr1:245499593-245499775
  hypo
aaggagacaggagtgcgtagagtgagtgggccatcagaaaaaggactgctctggggatgcaggagacccgcttgtaggatttaggggcaccgtgcaagacaggggtcatggtatgcgggtgcctccgactggcggctgcgtggtggatctggccacttggtgaaggtcgcagtgaccttgat

SEQ ID NO: 69034 - DNA, 31 bp, Homo sapiens
  chr1:245522555-245522586
  hypo
agtgatcctcctgcctcggcctcccaaaggg

SEQ ID NO: 69035 - DNA, 38 bp, Homo sapiens
  chr1:245627605-245627643
  hypo
aggtaatgtgtgtcccgtcccccgacccagtgagcacg

SEQ ID NO: 69036 - DNA, 120 bp, Homo sapiens
  chr1:245627763-245627883
  hypo
cgtgcgcgtgtgggggtgtgtgcccgtgggtgtgtgtgggcgtgtgcatgtgtggatgtgtggcaccatgtgtgtgggtgtgcgtgggtgtgttcctgtgtgggtgtgtgggtgtgtgtg

SEQ ID NO: 69037 - DNA, 30 bp, Homo sapiens
  chr1:245633295-245633325
  hypo
ggttggcgggagtctcgggggagaaatggg

SEQ ID NO: 69038 - DNA, 170 bp, Homo sapiens
  chr1:245725716-245725886
  hypo
ttggctccgtggtgacggcacatcctcactctgagaaccaggaccggcctcgggagtccaggttctgttcccagtttgtatgcacaccgatttccccactgtctgtcacaaccagtcaacttcccatgtgttaacagttactgaatctacctgtccgcacgtggccaagc

SEQ ID NO: 69039 - DNA, 176 bp, Homo sapiens
  chr1:245750646-245750822
  hypo
ttgaagacagcaactcgtttttaagctctttataaccccagagcctcgcacagtacctggaccagattaaggggtacttaacagatgcttagtgaaggaaggaatggatttctcacctggttgcttatcttctagactcatttggggagtggccaggagtccgggagagctgccgg

SEQ ID NO: 69040 - DNA, 38 bp, Homo sapiens
  chr1:245753462-245753500
  hypo
cctgcaaggggaggccgaggcgccggtggaagcacaaa

SEQ ID NO: 69041 - DNA, 95 bp, Homo sapiens
  chr1:245755482-245755577
  hypo
cctctctgatggcatcgctgctcattatttgctgtctggcaccacgggagctcacccagcggcacctcggagaagccagccgcccagggtgcagg

SEQ ID NO: 69042 - DNA, 30 bp, Homo sapiens
  chr1:245761829-245761859
  hypo
tgtctgctgtgatcacgtgtagtggtcacg

SEQ ID NO: 69043 - DNA, 297 bp, Homo sapiens
  chr1:245772571-245772868
  hypo
atcctacaccatgatcggaaaggatgattccatgcagaacctgggcatcattccctgtgccatctcttggctcttcaagctcataaacgaacgcaaggaaaagaccggcgcccgtttctcagtccgggtttccgccgtggaagtgtgggggaaggaggagaacctgcgggacctgctgtcggaggtggccacgggcagcctgcaggacggccagtccccgggcgtgtacctctgtgaggaccccatctgcggcacgcaggtgattgcttctgaagcctggctcgccccaaggtggct

SEQ ID NO: 69044 - DNA, 30 bp, Homo sapiens
  chr1:245786226-245786256
  hypo
ggagctgatggaggccgcaggatgtagttg

SEQ ID NO: 69045 - DNA, 30 bp, Homo sapiens
  chr1:245835512-245835542
  hypo
tcctggaaccatattcgggatccccaactg

SEQ ID NO: 69046 - DNA, 32 bp, Homo sapiens
  chr1:245859338-245859370
  hypo
tgatcatatcccatccgcggtagccaggctcc

SEQ ID NO: 69047 - DNA, 23 bp, Homo sapiens
  chr1:245969918-245969941
  hypo
aaagagggagaaggccgggcgcg

SEQ ID NO: 69048 - DNA, 141 bp, Homo sapiens
  chr1:245979706-245979847
  hypo
catttcagaataggacgactggaacaatgcaatactcatctaagcaactgcaaaagccagctacaacccaactcaaggtgccatctattatgagaggtccccttcatctatgtaaaaaaaaaaaaaaaaaaaaaagaggag

SEQ ID NO: 69049 - DNA, 178 bp, Homo sapiens
  chr1:245986618-245986796
  hypo
gtgtgcacacacacacgcgcgctcgtgcttgctcgctctcgctctctctctctcttttctaaggctccaggcatccgtccctggagaagtgcaccttgggaaggcgatgaaatgaaagaagggcacatcctcctttaaccccaaacatctgaagtcagcgccgcgcactactgcgatt

SEQ ID NO: 69050 - DNA, 92 bp, Homo sapiens
  chr1:2460806-2460898
  hyper
caagcccggggcggacgacggcgggaaggcgcttccctacaggcgagaggagcaggctcgccctctggtcgtcgggccgcgcgcccgcaggt

SEQ ID NO: 69051 - DNA, 43 bp, Homo sapiens
  chr1:24611924-24611967
  hypo
cagctgctccccaaacgcagctacaccccgacctccatcttga

SEQ ID NO: 69052 - DNA, 218 bp, Homo sapiens
  chr1:2461311-2461529
  hyper
ccatctccaggatgtcggccttctccagcttggagttgggctggtgccgcgcgaactcctgctccagcagcagcttcagctgctcgatgctgctgttgatgcggtcgcggcgcatcttctccaccaccggcttccgcagctgcgggaggagggggtgtcaggctggcccggcacggcgcagggacccccgaggaccggaggccgcggggacagcgcgc

SEQ ID NO: 69053 - DNA, 30 bp, Homo sapiens
  chr1:246171927-246171957
  hypo
tttcctttcctttctcgagcaacgcaggga

SEQ ID NO: 69054 - DNA, 109 bp, Homo sapiens; identical to SEQ ID NO: 39357
  chr1:246172251-246172360
  hypo

SEQ ID NO: 69055 - DNA, 38 bp, Homo sapiens
  chr1:2461950-2461988
  hyper
ggggcctgatgccgggagccccgcgcctcaatatgctg

SEQ ID NO: 69056 - DNA, 30 bp, Homo sapiens; identical to SEQ ID NO: 39358
  chr1:246330476-246330506
  hypo

SEQ ID NO: 69057 - DNA, 30 bp, Homo sapiens
  chr1:246363402-246363432
  hypo
tagaatgtacacagacgtccactgtaatag

SEQ ID NO: 69058 - DNA, 30 bp, Homo sapiens; identical to SEQ ID NO: 39359
  chr1:246363735-246363765
  hypo

SEQ ID NO: 69059 - DNA, 112 bp, Homo sapiens
  chr1:24648230-24648342
  hyper
tgtaaggcggcacttcgaaggctggtctctgagaagcatggaggccccggcggtgtagttagaaaccagctggaggtggctggcgggtgctgagcgccgggcctttcatgtg

SEQ ID NO: 69060 - DNA, 165 bp, Homo sapiens
  chr1:246488142-246488307
  hypo
tcttcacccagttcccgtgtgcttgatgtgacttgcaccatcacacaccgtcaacattctgggctcagtgactcatccctgaaagctgcaggatctatttaggttaatttaggatctttcatgaacaaggaaggagaaggagtcagggggcgggaaggagggaga

SEQ ID NO: 69061 - DNA, 319 bp, Homo sapiens
  chr1:24648832-24649151
  hyper
tctgatctccaggagcgccggctccagactgcctggagcgctgaaagagttaatcaggaacgcctccccgctgtggttttgtggtcgaaaccatgattgccaggagcaaatttttgtcgtgcacgaggtgtgttattaaaagtcggagctacgctgctgctgaatgaaaagttaaaagccctctttgagttcgggctgtaaaactggcggactgggccgagaggcttgagccaaccctaacggcggcggcccgggcggcgcgggggtcctgcggctccgccagctgctgggagcgggcaggctgcgcagtcccagcagt

SEQ ID NO: 69062 - DNA, 17 bp, Homo sapiens
  chr1:246666970-246666987
  hypo
taagtgatttcaggccg

SEQ ID NO: 69063 - DNA, 31 bp, Homo sapiens
  chr1:2468551-2468582
  hypo
gtgtaccagtgtgtgcgcttgtgtacgtgtg

SEQ ID NO: 69064 - DNA, 150 bp, Homo sapiens
  chr1:2468642-2468792
  hypo
tgcatgcatctgcgtgcatgtgcccaggaatgctcacgcctgctcagatgtcctcagctgggccacccgtccccaccctgccccgctgccctaactcccagagtacccgcattggccgagcactgctctgtgccacgtgagccctgggcc

SEQ ID NO: 69065 - DNA, 142 bp, Homo sapiens
  chr1:246899152-246899294
  hypo
aggctattttattaacagttgatttcttgataactaggactgtttacttccaggattagatggcattttattcatttaaacttgtcaagcaagaataacctctttgttctttttgtttccctagtatcggttttatggagaa

SEQ ID NO: 69066 - DNA, 39 bp, Homo sapiens
  chr1:246912280-246912319
  hypo
aggaatgctaacttttccgtctgccgtgaaaggcacgag

SEQ ID NO: 69067 - DNA, 70 bp, Homo sapiens
  chr1:246959219-246959289
  hypo
gggggttaggtgctacgcgtaggtccacatctggcatgtccagtttttgatggtacggagatttgtgaca

SEQ ID NO: 69068 - DNA, 120 bp, Homo sapiens
  chr1:246964078-246964198
  hypo
ggagagcttggctgtcggccttgcaggttctctgttctctttgcttcttgagataatggatgccaccctctgcctctccccagcctgctcctttgttaaagcttgcgggttcctgagatg

SEQ ID NO: 69069 - DNA, 95 bp, Homo sapiens
  chr1:246991090-246991185
  hypo
cattctcttcagtgtcggctcgagtactattttttggcctgacatggtgtttcacacttaagatcccatcactttgggaggcagaggcagaagga

SEQ ID NO: 69070 - DNA, 83 bp, Homo sapiens
  chr1:24701375-24701458
  hypo
aaagtgttgggattacaggcgtgagccactgcacctggttttctactatttttactgttttcaggacacgtagtcctacccat

SEQ ID NO: 69071 - DNA, 176 bp, Homo sapiens; identical to SEQ ID NO: 26997
  chr1:247171005-247171181
  hyper

SEQ ID NO: 69072 - DNA, 315 bp, Homo sapiens
  chr1:247171251-247171566
  hyper
cgcaatacctgcaggccacagggcgatggagcctgcggcagtcacccgggactctccgagaggcagcagacgggaacccagcaccccgccggccgcaaggagacaaaggccccgccagatccccaaggccgccccttcctctctggctgcacgcctgattggacagttctcacgctagcgccgctgactggatggggctccaggccccaccccctcaggtcttgagtgacaggaggtgcgatcagacactgggccgaatgaaacaagagtgacaggtttttgggtgcagcccttttgaagcgacattcctcacgg

SEQ ID NO: 69073 - DNA, 176 bp, Homo sapiens
  chr1:247185335-247185511
  hypo
tgacgtgttatcttacgaaaaatgttagcgtattccaccttgctcaaggtcctaggtagcagacggtaatactgtactattgggtaatacatgccaatcatctctagcaatccttattcccagtggcattacactccagagagtgtggagaatattgatcccgtatgttatatttt

SEQ ID NO: 69074 - DNA, 403 bp, Homo sapiens
  chr1:2472147-2472550
  hyper
gcggggattaggggccgtccgggcccacgtggccgcacgccccgccccgccggtgtccccccaccccccgtgcgccccggggcagggccgggtcgccgtcccaagctggttaaaaaccccgcggtgtcagagagcagctcgttcccaacctctgaaaggcagacaagccctttattgctctattataacgcggagccagatggtcttttgggagttgcccccccgcgccccccgccgccgccctcattcattcagactcagaccccggcactaatgccgcgggggggcccaggcacgcttccctcgccgcccgcccgcgcagtgtgggaaccgccggcgagcgcgaacccacagccgggcggagggaggggcttggaaacccgcgcatcggagagctggggag

SEQ ID NO: 69075 - DNA, 274 bp, Homo sapiens
  chr1:247274326-247274600
  hyper
aaattgggtggaggccgagagctcggggccgcgagcaagcctccgacgccctggtcccctggacccgccggttaaactgtgattctctttctaaatcctttgtctgcgccggactcggggtacccgccgggtggtgtggggctggtttccccaccagctctcgaactcctgcactgaagcgctcctcccgcttcagtctccccagtggttgggattacaggcgtgagcccccgcgcccggccaaagggccccctaggaccggctgtctcccccg

SEQ ID NO: 69076 - DNA, 204 bp, Homo sapiens
  chr1:247274826-247275030
  hyper
gctccggaaagtttgcggcggctgccccgggagggacttcggcggggaggaggcggcggcgccaggtggccgaagtcggaggggtccgtccgctcccgcagcctaggagcgcgccctccccgccggtgccggggcccgtggtgggggtcgcacccaccgccgcttggccgggaccgtcttggctggcgccgccttggagctcgt

SEQ ID NO: 69077 - DNA, 121 bp, Homo sapiens
  chr1:247275546-247275667
  hyper
ccggccttagctgggcggagcaattccggtgccgccgccccttccccgcccggccatgctcgggctccaggcgggctgctgcagggggcctgatccggtggacgatcggctcctcaccccg

SEQ ID NO: 69078 - DNA, 30 bp, Homo sapiens
  chr1:247278844-247278874
  hypo
gtccctgcttgcccccgcctacctgaccat

SEQ ID NO: 69079 - DNA, 91 bp, Homo sapiens
  chr1:247399809-247399900
  hypo
acaaacaattagcccagtgtggtggcaggcgcctggtgggaaccagggtggcgggcgcctggtgggaagggcgcctcgtgggaacccgggg

SEQ ID NO: 69080 - DNA, 180 bp, Homo sapiens
  chr1:24740809-24740989
  hypo
acaggcgtgagccaccacgcccggccccaagccctgtttctaacagaagaaaaaaaaaaaaattgacatgggcgactatacaagggcagccacttagtattccaggagcccctcttcacacgcttcagggcagggcggtctcagcgaccttgtcactcccctgcttaaagtcctccaatg

SEQ ID NO: 69081 - DNA, 30 bp, Homo sapiens
  chr1:247582310-247582340
  hypo
tgtggatcttcgctgcgatcaacaggagag

SEQ ID NO: 69082 - DNA, 30 bp, Homo sapiens
  chr1:247587392-247587422
  hypo
tgagcctgtgcacaccgtggtgttccaggg

SEQ ID NO: 69083 - DNA, 261 bp, Homo sapiens
  chr1:247589856-247590117
  hypo
tcagctttcttgatccgttgacattaccatgaccaggaccaccttcctagtcatggtttggccatgaaggactgactgcccacagggccgcagtggtggtgaagacccaggtcctggtcacagggacttgaggtctggctgtgggacagtccggaaacaagtgcagatgtcggggagggggtcatgggctctgacaaggaaacttgcagagtatccaaagcacaaggggacgaacctgttcaccagcggggcacgggtggg

SEQ ID NO: 69084 - DNA, 224 bp, Homo sapiens
  chr1:247615881-247616105
  hypo
attcatgctgatctccgctgtcatgaccacacacgcacaggcagccctgtcactcacactggcagtaaaagcagcacaattctaggtcctgtgagtctctggagtggaagagccaaggtatacgttacttcagcccctgaataggtcatggtagttaatgagaccccagaccatggaattttgagcacagggagaaagctcttgattggcgtgagaaaggtagc

SEQ ID NO: 69085 - DNA, 30 bp, Homo sapiens
  chr1:247617725-247617755
  hypo
cacaaacatcgccatcgcattcagacggaa

SEQ ID NO: 69086 - DNA, 38 bp, Homo sapiens
  chr1:247682027-247682065
  hypo
cgcctgcagtcccagcgctttggcaggccaaggcgggc

SEQ ID NO: 69087 - DNA, 154 bp, Homo sapiens
  chr1:24768639-24768793
  hypo
cgagctgggtgtgttcgcctcctacgccttcgcgccgctgtcactcatcgtgcccctcagcgcagtttctgtgataggtaagaccagggctgccccaccctcccctggggtgctcccagctgcgtgaccagagtgccagcgccaggatcaaagg

SEQ ID NO: 69088 - DNA, 195 bp, Homo sapiens
  chr1:247694897-247695092
  hypo
ccatgtgccggagggcgctcttcacctccgtgttcctcagggtgtaaataagtgggttcagcgcaggagtgactacggtgtagaacagagctatgaacttgccctgctcatgggaggtgctcttggctggctggagatacatgaagatgatgctcccgtaaaacagagacaccacagccacgtgggaagaacagg

SEQ ID NO: 69089 - DNA, 209 bp, Homo sapiens
  chr1:247709336-247709545
  hypo
ggtagcataaatgtacgcatatgtccaaactcatcaaattatgtacattaattatattcacgttcttttatatcaatatatcaacaaagctaggaaagaaagaaataaatttttgtttgttcgttttgttttgttttgtctaatgatgggacggtttcgctctgttgctcaggctgatgtgcagtagctattcacgggcatgatcattg

SEQ ID NO: 69090 - DNA, 203 bp, Homo sapiens
  chr1:247752018-247752221
  hypo
gtgatgtcctgtgaccgctatgtggctgtctgccgtcctctccattacactgtcttaatgcatatccatctctgcatggccttggcatctatggcatggctcagtggaatagccaccaccctggtacagtccaccctcaccctgcagctgcccttctgtgggcatcgccaagtggatcatttcatctgcgaggtccctgtgct

SEQ ID NO: 69091 - DNA, 40 bp, Homo sapiens
  chr1:247910639-247910679
  hypo
catgaactgctaatgcgaagactttttttttttttttttt

SEQ ID NO: 69092 - DNA, 28 bp, Homo sapiens
  chr1:247994928-247994956
  hypo
tattctggccaggtgcggtggctcatgc

SEQ ID NO: 69093 - DNA, 32 bp, Homo sapiens; identical to SEQ ID NO: 39368
  chr1:248002278-248002310
  hypo

SEQ ID NO: 69094 - DNA, 134 bp, Homo sapiens
  chr1:248020315-248020449
  hyper
tgggtgtgtgtgtgacgggggcggggaaccacaacgttaattttatccccgacatagggagcgcctgagtggtggcttttcaccgggtgtggctcgtctgagctcttgaactgaagccagcggacaccacccgt

SEQ ID NO: 69095 - DNA, 116 bp, Homo sapiens; identical to SEQ ID NO: 140
  chr1:248020515-248020631
  hyper

SEQ ID NO: 69096 - DNA, 393 bp, Homo sapiens
  chr1:248020956-248021349
  hyper
ggcagctaccaggtgaggcgccccccggcgggggctgcgggcgctgcggtgaccgggaagcgggcgacagtccggagcggagccgccgaggccacccgtctcctgagcggctcccacggccgctccccccaccgcgcgccgtcccccccgcccacgcggctcactcagtgtgggtctctttgccttggctgtggtaaccccctttgcgacacacacccattattttacaccgtccgcccctcccccaagcactctcctgtcgtcgaactcgcgctgggctggtttctcccgatgcggatagtctggtccctcagctgggctctggtcgggagggctgtgtggtccagttcattcttggtaacaattgtacgtctatatcgtaaacttgccata

SEQ ID NO: 69097 - DNA, 22 bp, Homo sapiens
  chr1:248026563-248026585
  hypo
gggcacagtggctcacgcctgt

SEQ ID NO: 69098 - DNA, 141 bp, Homo sapiens
  chr1:248026825-248026966
  hypo
cgagactctgtctcaaaaaaaagattaaaaaaaaaaccaggcaaatgacttcacctacaaggccgtataacaatgtaacaaaactgcatttgtaccccatgaatatatacaaaaaataaaataaatcgataaaacaggaca

SEQ ID NO: 69099 - DNA, 294 bp, Homo sapiens; identical to SEQ ID NO: 39370
  chr1:248027965-248028259
  hypo

SEQ ID NO: 69100 - DNA, 30 bp, Homo sapiens
  chr1:248029451-248029481
  hypo
atacaagaactttgacggtttcttttcttt

SEQ ID NO: 69101 - DNA, 197 bp, Homo sapiens; identical to SEQ ID NO: 39371
  chr1:248034262-248034459
  hypo

SEQ ID NO: 69102 - DNA, 113 bp, Homo sapiens
  chr1:248039213-248039326
  hypo
tggatcccgccacggcgcacccgagtctgctcttgaccgccgacctgcgcagtgtgcaggatggagaaccatggagggatgtccccaacaaccctgagcgatttgacacatgg

SEQ ID NO: 69103 - DNA, 22 bp, Homo sapiens
  chr1:248047093-248047115
  hypo
taaattatgacaggccgggcgt

SEQ ID NO: 69104 - DNA, 120 bp, Homo sapiens
  chr1:248047790-248047910
  hypo
gctgggattacaggcgtgagccaccgtgcccgttctaatgagagtcttctttaacctccacttcactttctaaaagtgagtctctttttggcgggggtcggggaggacagggtctcactc

SEQ ID NO: 69105 - DNA, 37 bp, Homo sapiens
  chr1:248048162-248048199
  hypo
tcatgcgttgcttaacgatggggatgtgttctgagaa

SEQ ID NO: 69106 - DNA, 34 bp, Homo sapiens
  chr1:248074314-248074348
  hypo
accaccctcttgtatcgttcgtaatatccagcag

SEQ ID NO: 69107 - DNA, 90 bp, Homo sapiens
  chr1:248074687-248074777
  hypo
tttctaatatccaggcgaaaaaacaataatacttccaatattgcagggggtgtacaccgctcctatgacagtattcctaatatccacggg

SEQ ID NO: 69108 - DNA, 90 bp, Homo sapiens
  chr1:248074837-248074927
  hypo
tccttataaccgggggggacgggatgatattagtcccaatgtcgcagagggtgtacaccgcctctgtaatatccacgggggaaaaggatg

SEQ ID NO: 69109 - DNA, 32 bp, Homo sapiens
  chr1:248092102-248092134
  hypo
agaaacaggatgggccgggcgcggtgcctcac

SEQ ID NO: 69110 - DNA, 21 bp, Homo sapiens
  chr1:248098787-248098808
  hypo
aatgtatgggccaggcgcggt

SEQ ID NO: 69111 - DNA, 30 bp, Homo sapiens; identical to SEQ ID NO: 39377
  chr1:248099290-248099320
  hypo

SEQ ID NO: 69112 - DNA, 424 bp, Homo sapiens
  chr1:248099705-248100129
  hypo
tggacatggcaggggcgtgtccagcccagatcaaggatcagttcaggcaggcgacagtgaccgtggtcaccatggcgatgtggtgcccacggtcagaggtggcattggggaagtcagccactcggacgctggtgctcctcactgacttctcatcgctcctgtgctcgctgtagacggtgtttaactcagaatccacatgcaggatgttctcggttttcaggtgtgcgtgggtcagccggttctcgtgcagaaatctaagggtgtggcagagctggtgggccatgtgccagacatgtgggaggggaatggctggatgttattctccttcgggaactcaagggttttcctgcccaggagctcaaaggtgatatgcatggaccgcggagggtgaaccagtcacaccccaagacgcacagcagctggt

SEQ ID NO: 69113 - DNA, 203 bp, Homo sapiens
  chr1:248140923-248141126
  hypo
aagcatgaaccagctcgcccgatagcctacttccgtatgactgcttactgcttaaaagtcaggtagcccttctcacagggtcctaactaccgttaattgtttctttagatatcatctttaattttaggaaacctcaagttttctatttaaaatgttttccggatcctgaattctagtggatccactgacgcagggggtctgtg

SEQ ID NO: 69114 - DNA, 30 bp, Homo sapiens
  chr1:248244670-248244700
  hypo
agataaagttcattccgtttttgttgttgt

SEQ ID NO: 69115 - DNA, 30 bp, Homo sapiens
  chr1:248292238-248292268
  hypo
ctgtggcttagtaggcggttttaccctgct

SEQ ID NO: 69116 - DNA, 203 bp, Homo sapiens; identical to SEQ ID NO: 39379
  chr1:248328673-248328876
  hypo

SEQ ID NO: 69117 - DNA, 30 bp, Homo sapiens; identical to SEQ ID NO: 39380
  chr1:248329246-248329276
  hypo

SEQ ID NO: 69118 - DNA, 33 bp, Homo sapiens
  chr1:2483840-2483873
  hypo
atcctgctgctcctccgccggccgccccgcaca

SEQ ID NO: 69119 - DNA, 30 bp, Homo sapiens
  chr1:248538382-248538412
  hypo
ccgaggcaggcaggtcgcctgagctcagga

SEQ ID NO: 69120 - DNA, 30 bp, Homo sapiens
  chr1:248685560-248685590
  hypo
tctttctaattgtcccggtgttactcatct

SEQ ID NO: 69121 - DNA, 126 bp, Homo sapiens
  chr1:248792899-248793025
  hypo
ccgtgcatcccgccacgccactttctgcttgaaaccctgcagttgtgctttacatcatacattaaggcccatcacgttctgaacattttgtcttctgaaatgatctcccgccgactccagtctgtc

SEQ ID NO: 69122 - DNA, 24 bp, Homo sapiens
  chr1:249121618-249121642
  hypo
gagccaccacgcccagcctagctt

SEQ ID NO: 69123 - DNA, 30 bp, Homo sapiens
  chr1:249151579-249151609
  hypo
gccccccatcttggccgccaggcccccgaa

SEQ ID NO: 69124 - DNA, 129 bp, Homo sapiens
  chr1:249212385-249212514
  hypo
gggaggcgaagcaggcggttggagactgagagccgcttcgatatgattgggcactggattatccatcaggacaagaggacccggtgtgccctctgccactcacagaccaacacccggtgtgagaagtgc

SEQ ID NO: 69125 - DNA, 40 bp, Homo sapiens
  chr1:2500708-2500748
  hypo
cagcaggatcccaggcgggagggcacggccttctgagagg

SEQ ID NO: 69126 - DNA, 30 bp, Homo sapiens; identical to SEQ ID NO: 14185
  chr1:2507045-2507075
  hypo

SEQ ID NO: 69127 - DNA, 304 bp, Homo sapiens
  chr1:2519610-2519914
  hypo
ccctctgtggaccctcggctagcagccactgggctcggtgtccaacctgccggtgggctgggctggctactgatctggtcgcctgtgccatctctgagccctggtgaggcgggtgggtggggtggggcctgacctaggaactggtctcatggacactggagcaggctctggacccaggcttctccggagtttggccaagcgacctggtgtcttcgcaggtacaacagcctgagcatcctcccagcagctctggggaagcccgtgcgtgatgtggctgccaaggtgtgtgcgggtcaagggtgta

SEQ ID NO: 69128 - DNA, 30 bp, Homo sapiens
  chr1:2520957-2520987
  hypo
gctgggtcgggatgccgaacctctcctgat

SEQ ID NO: 69129 - DNA, 88 bp, Homo sapiens
  chr1:25220516-25220604
  hypo
tttcctaatttcaggcgtcagtgatttaggacggagttgttttcatggaaaaagaaatagaacctgtttgtggcggggcaagactgat

SEQ ID NO: 69130 - DNA, 43 bp, Homo sapiens
  chr1:25228594-25228637
  hypo
aggagtccaccagggcggtcagtagggccgccacacggcctca

SEQ ID NO: 69131 - DNA, 884 bp, Homo sapiens
  chr1:25255940-25256824
  hyper
actgaaccgggtgcccgggtgtcgccgcggcgtctcgggcacctcccatccccactgctcccgaggctctggctcccgcagctcagacgcccggagccccagggccggcgccctcccgccccgggtcccgcactcaccttgaaggcgacgggcagcgtcttgttgcagcgccagtgcgagggcagcacggagcagaggaagttggggctgtcggtgcgcacgagctcgcctgcgtggtccgccagcacgtccaccatcgagcgcacctcgggccgggcgcgccctccgggccccacggccgcctgcgcgctcagcgcgccgctgttctcgcccatcttgccgccgccgccgccgcaggggaaggccggggagggaggtgtgaagcggcggctggtgcttgggtctacgggaatacgcataacagcggccgtcagggcgccgggcaggcggagacggcgcggcttcccccgggggcggccggcgcgggcgcctcctcggccgccgctgccgcgagaagcgggaaagcagaagcggcggggcccgggcctcagggcgcagggggcggcgcccggccactactcgccagggcccgcccgctgcgaggcctcgctggcccgacggccgcccgcagcctgcccggctagtcccgcatcctcggcgcgcggccccgcgtgcggccgcccctcgtggctgtcccggctgcctgggccgcggcggggcccgcgcggggctgtgccgctgccgccgcctcccgccccgaagctcgcccgcggccgccccgactccgcggccgcagccccagaacaaatcctccagaatcaagtggcggggccgcggccgcccgcgcggggttagtacccccggggcccgcggggcggggctgg

SEQ ID NO: 69132 - DNA, 212 bp, Homo sapiens
  chr1:25257156-25257368
  hyper
gggcctgtgacttctgcaaccccgggctgggggccgcggggtctcagggccggtgacgccgcactgggagccgccccaaagaggttactcacctccctcgtcccgcacattattctgacccaagagcctccaccccacacgggattttgcgcgtcgtccacgcccggccggcggcctttgctgctcccagccctgcgcggctttggtcccag

SEQ ID NO: 69133 - DNA, 117 bp, Homo sapiens; identical to SEQ ID NO: 26139
  chr1:25259018-25259135
  hyper

SEQ ID NO: 69134 - DNA, 64 bp, Homo sapiens
  chr1:25269281-25269345
  hypo
gagggtcagcatcagcggtgccctaatgccaggacctgacccgggctcccgcctcccagcctgg

SEQ ID NO: 69135 - DNA, 231 bp, Homo sapiens
  chr1:2527304-2527535
  hypo
gggctgccttctccccgtggggtcctgtctgcgcctcccggggctgccttctccccgtggggaccgtcaggaggctttgtcggggcggtgctgcccgtgcccagatccagtcggggctgccctgacctctgcgagccacataccttctcctgcgccttcttcttggactcctcgtccatccagcccagctcgtccagcgtctccacaaacactgtccgcaccttgtcaatg

SEQ ID NO: 69136 - DNA, 30 bp, Homo sapiens
  chr1:2527977-2528007
  hypo
gccatggatgaggggcgcccaccatgctct

SEQ ID NO: 69137 - DNA, 30 bp, Homo sapiens
  chr1:25351684-25351714
  hypo
ggctgggccgctgcacggggcctgggggga

SEQ ID NO: 69138 - DNA, 66 bp, Homo sapiens; identical to SEQ ID NO: 14186
  chr1:2537084-2537150
  hypo

SEQ ID NO: 69139 - DNA, 141 bp, Homo sapiens
  chr1:2537758-2537899
  hypo
ctgtgagttcatcagcgccagctgccgctccagctcccactcgagtcctggggagacagtgccccgcactggagactggcgggccctggggccccagcccggccccttgtcggtgaatctggcctccggagccaggaacta

SEQ ID NO: 69140 - DNA, 164 bp, Homo sapiens
  chr1:2538565-2538729
  hypo
acagaactgtgggggcgccgttggccggcgtcacaggtccccacagcccctgcagtgctccgcgagaggcggcctcccagcctctgggcctttacacctgcaccctcccgtcacaggtcagcatcttggcagctctgcagcgcaggaggcggaggctgagactg

SEQ ID NO: 69141 - DNA, 64 bp, Homo sapiens
  chr1:2541226-2541290
  hypo
acacggttccgtggtcgggtccatgttctggaggatcctggcagctgctcgtccccatggcgtg

SEQ ID NO: 69142 - DNA, 30 bp, Homo sapiens
  chr1:25417486-25417516
  hypo
cagagccacaaagagcgcaggctctgagga

SEQ ID NO: 69143 - DNA, 35 bp, Homo sapiens
  chr1:25425784-25425819
  hyper
gcagggacaaggcaccgcagcgtgtttttggctgc

SEQ ID NO: 69144 - DNA, 30 bp, Homo sapiens
  chr1:25501519-25501549
  hypo
gggtccagagcaaggcgccatgcgagagtt

SEQ ID NO: 69145 - DNA, 29 bp, Homo sapiens
  chr1:25601203-25601232
  hypo
ggggaaacaaagggccgggcgacgtggct

SEQ ID NO: 69146 - DNA, 612 bp, Homo sapiens
  chr1:2560341-2560953
  hyper
ggtgagcccgggcggcgggagggacacggacgccggtggtccccagccggggctgcgcggccaggcagggagggggtgggcggaggggcgggcgacgggtctgcgccccccaccctccgggagtccggcggaggcggaggcggaggcggaggcgggcgggtgcggagctgcagaagcagcgcgcgggagtcggggccggggcagagctttctggaagggaccgcgggctccctgcaggtcagtgcccctcccgccgcctctgagtccgcagctcggccccgggagcccctgggtgcccagtgcagacccacctgccccatctgacgggcgggctcgggctgggggcaggcggaccctgcagcaggtgcagcggggcgagcgcggagagcgggcacggggacaggcgggggcggggcacccgcactcacctctgcggtcggcgtagaggacacccaaggccaccagggcagcggtcaccagcagcagcagcagcagcagccccccctccaggaaccccgggcgcttctgccctgcacggccggcgctctccaccatccccactgggccttcggacttccccatcagcagggctctggacgggagagcaccgcg

SEQ ID NO: 69147 - DNA, 156 bp, Homo sapiens
  chr1:2571507-2571663
  hypo
gaccatggaaggaagcggcagagaaggggacagaaatgggacaaatgcaagtgcccaggaggagagagaagccaggagggggggtcgtggccctgtctccccagggtgaagtcaggcagggcttgggggcacgttttgcaccgagtcagctcaccc

SEQ ID NO: 69148 - DNA, 30 bp, Homo sapiens
  chr1:25856663-25856693
  hypo
atctccaggggcctgcgccatcctgtagcc

SEQ ID NO: 69149 - DNA, 30 bp, Homo sapiens
  chr1:25857535-25857565
  hypo
ctcctgagtgagggccgggccttgctcggg

SEQ ID NO: 69150 - DNA, 30 bp, Homo sapiens
  chr1:25999651-25999681
  hypo
gcagcaggatgacagcgctgtctcccgatg

SEQ ID NO: 69151 - DNA, 30 bp, Homo sapiens
  chr1:26222050-26222080
  hyper
gcagaacacaagtcccgcctcaagggggca

SEQ ID NO: 69152 - DNA, 602 bp, Homo sapiens
  chr1:26249024-26249626
  hyper
tccagaaaatggcttcgctgcgctccacggatctgctctcccaccccacctgcggcttgcacagcgacacacaagcgttgtgattggctcttccttggctgagacaagggtggggaccgaaatggcgtctctaacagctgatttttcagggcagcagctctgtgctaggagaagagaaggccgggctcactggcggtgcggagcccgccagggccaatccgcatccgggcggaggtgcaagcccgaccgcagtactgacacgtgccgcgacgtcccctcccggcagctcgcggggacctgggagcgggtggggtctctggctggcggggagccagggctgcgggaaaccgcacgaggtcgcgttcgcgagtggcggagaagcccagacccccgggcgcacgcggccgcgcccacccaggtcgctgggaggtgcccgcccgggaggcgccgcggccagtgcctgccgttagcttcaggaagaactaggattgagtaagaaacgactagggatggaagcacttggcactccgggtctcggagcaggctggggacgcccgcggcaggaacctggtcctccactccgggtgcggaccaaagtctgc

SEQ ID NO: 69153 - DNA, 32 bp, Homo sapiens
  chr1:26336891-26336923
  hypo
ttttattttttgagtcggagtctcgttctgtt

SEQ ID NO: 69154 - DNA, 92 bp, Homo sapiens
  chr1:26337163-26337255
  hypo
ggcgtgagccaccgtgcccggcagtggcgactttctttgtttggctaaagccttggcgttagcggggatggtgtcagcgaggtaatggtatg

SEQ ID NO: 69155 - DNA, 30 bp, Homo sapiens
  chr1:26372114-26372144
  hyper
gccccaggccccccgcgggcaggggtcaga

SEQ ID NO: 69156 - DNA, 30 bp, Homo sapiens
  chr1:26372535-26372565
  hyper
agctcccccggctcccgctgcggctgcagc

SEQ ID NO: 69157 - DNA, 113 bp, Homo sapiens; identical to SEQ ID NO: 26142
  chr1:26372988-26373101
  hyper

SEQ ID NO: 69158 - DNA, 533 bp, Homo sapiens
  chr1:26551728-26552261
  hyper
cgcgggcaagacgcccatgccaaccagtgagtgggcagccccgggacctcctgcgcagccgccgcagccttgcctgcaaagcagttcctgccgggcaggctgggtagccggactcccagctgcgccgtcttcacggaagcggtgctgatgcgggacctgggggactgcggtgctggggactggccagtcctaccgggggcggggcttgtggaagactgggcgggattttgaagacctaggtcttgtggatggtgaactcacttggggcggggagggaggtggggctaccctggggtcttgggcaaagtcctcgcctggccggcttcgctacccttgtgcttgcgttgcccacaagcttgtagtcagaagaactcgcctgggagggatcgctcctgggagatccgaacgcgggagggcctggagcgcggcggcagctggatagcattcgggcccatccgaataagcggtaaatggatcatttctggggcctccctgactcctcttccagagcctcctaccgacctgctctgtcc

SEQ ID NO: 69159 - DNA, 36 bp, Homo sapiens
  chr1:26612389-26612425
  hypo
atgggctcgagggtacgcagccgtgccccgccgggc

SEQ ID NO: 69160 - DNA, 30 bp, Homo sapiens
  chr1:26627535-26627565
  hypo
gtcaccgctctggggcggagacccagagga

SEQ ID NO: 69161 - DNA, 30 bp, Homo sapiens
  chr1:26648095-26648125
  hyper
gtttgtgtctgtgcccgcacagcctagggc

SEQ ID NO: 69162 - DNA, 31 bp, Homo sapiens
  chr1:26723047-26723078
  hypo
atggagacaataggccgggcgcggtggctca

SEQ ID NO: 69163 - DNA, 121 bp, Homo sapiens; identical to SEQ ID NO: 26144
  chr1:26735162-26735283
  hyper

SEQ ID NO: 69164 - DNA, 342 bp, Homo sapiens
  chr1:26735645-26735987
  hyper
tcttggagagcaccccgtacgagagaaagggaaataacttctgcagtctcttgctttcctccccatcttccccttccctacccccactcatccggtctctctgaaatacacatgtgcccacatccgcacgtgcacacacacacacacacaaacacacacacagagccacagcgtgagaattccaaaaggttctgcacactcggtggagaagattgaattcagagcaagcggatgcccccgaaagcaggctctgtccctttaaatgggttgtagtggtgggggaggggaactggccggagctggcattgtccagtttgaactgaacaccggaagtgaaggggc

SEQ ID NO: 69165 - DNA, 702 bp, Homo sapiens; identical to SEQ ID NO: 26146
  chr1:26737181-26737883
  hyper

SEQ ID NO: 69166 - DNA, 417 bp, Homo sapiens; identical to SEQ ID NO: 26147
  chr1:26737907-26738324
  hyper

SEQ ID NO: 69167 - DNA, 30 bp, Homo sapiens
  chr1:26758265-26758295
  hyper
atgcgtgccttaagtcggcacaaaatagat

SEQ ID NO: 69168 - DNA, 18 bp, Homo sapiens
  chr1:26879273-26879291
  hypo
gcccggcttaaattgtga

SEQ ID NO: 69169 - DNA, 43 bp, Homo sapiens; identical to SEQ ID NO: 38900
  chr1:26969603-26969646
  hypo

SEQ ID NO: 69170 - DNA, 101 bp, Homo sapiens
  chr1:2702371-2702472
  hypo
ggcagctcctacctgcggcaaagatggccagagacaggtaggcgatggcctccttggtgtgaaccctgccgtcggccccgcctggccgtgcccgcaggatg

SEQ ID NO: 69171 - DNA, 30 bp, Homo sapiens
  chr1:2702696-2702726
  hypo
tccacctggtgccaacgctcccagtcccac

SEQ ID NO: 69172 - DNA, 28 bp, Homo sapiens
  chr1:2706307-2706335
  hyper
cgcagcagtccccggccgcacagcgcgc

SEQ ID NO: 69173 - DNA, 159 bp, Homo sapiens
  chr1:2708372-2708531
  hypo
tctctcctctctttccgagattccagttacacacacgagactttgatattgtccccaggtcacccagcctctgttcatttttcttctgttcttcgtatcgagtaatttctattctgtcttcaagttcaccgacccttctactgtcgctaatattttcat

SEQ ID NO: 69174 - DNA, 90 bp, Homo sapiens
  chr1:27113624-27113714
  hyper
caagaaatccaccaacggagaaggatttatcatctgtttcctttaaggagggtgcaaagttgttctaacagtttccgttacaagggtaca

SEQ ID NO: 69175 - DNA, 503 bp, Homo sapiens; identical to SEQ ID NO: 38760
  chr1:2716736-2717239
  hypo

SEQ ID NO: 69176 - DNA, 30 bp, Homo sapiens
  chr1:27183642-27183672
  hypo
ctgacttccccttcccggatttgtgaggtg

SEQ ID NO: 69177 - DNA, 406 bp, Homo sapiens
  chr1:27189908-27190314
  hypo
gcaacgaggagggctcggaggagaaggggcccgaggtgcgtgagtaccgggagaaggtggagactgagctccagggcgtgtgcgacaccgtgctgggcctgctggacagccacctcatcaaggaggccggggacgccgagagccgggtcttctacctgaagatgaagggtgactactaccgctacctggccgaggtggccaccggtgacgacaagaagcgcatcattgactcagcccggtcagcctaccaggaggccatggacatcagcaagaaggagatgccgcccaccaaccccatccgcctgggcctggccctgaacttttccgtcttccactacgagatcgccaacagccccgaggaggccatctctctggccaagaccactttcgacgaggccatggctga

SEQ ID NO: 69178 - DNA, 39 bp, Homo sapiens
  chr1:2719879-2719918
  hypo
acagacaaaagtgggcggctgagccggacagggaggccg

SEQ ID NO: 69179 - DNA, 75 bp, Homo sapiens
  chr1:2725182-2725257
  hypo
gggacttgtcttcctcggggccacctcctatggcttccctgtcccatcagtaccactgctcgggggactgttctt

SEQ ID NO: 69180 - DNA, 462 bp, Homo sapiens
  chr1:2725529-2725991
  hypo
aggagctggggctgccggcctcgcaggtgtggttggggtgggtggggctgccgtgggcctggctccatggctctgtgcaggtggcagccggcgccgcgtgtcgccacccacacaggaaaggcgagattggtggcagaggccgtgtccgcgtcatcatgggagctgcagctcttcccttagttccctgcacccacttattgaggggggctggtcctcctgggaaaggacctggcagcatccccgggcgtgggacacatgcctcgcagcagagttgggggacacggggctgtgcccgccctccctgcactagaaccagcagcagcaaacagcccccagctcggccgctgaccatgtcctgctcgggtctcccgggctggccctggcccgcttagcctggactcaggtgcctgtggccggctgctcgtgccttcccatcctggggcaacccggggagtggcagtg

SEQ ID NO: 69181 - DNA, 119 bp, Homo sapiens
  chr1:2726839-2726958
  hypo
tgctcctggactgaacgctgctaccgtaacttcatcagcaccctccaggcgaggaccacgtgtccagcccctgctgtgcacacgactgagggttgtcggttccccgagctcagctgaac

SEQ ID NO: 69182 - DNA, 70 bp, Homo sapiens
  chr1:27319476-27319546
  hyper
tgggaggagtaaacacgagccggggcagggaaagaactttgcacaccgtggggtccggggctcctctgtg

SEQ ID NO: 69183 - DNA, 35 bp, Homo sapiens
  chr1:2733564-2733599
  hypo
caccagcagtgcccacggctgcggcatttactgag

SEQ ID NO: 69184 - DNA, 95 bp, Homo sapiens
  chr1:2733659-2733754
  hypo
actttggaaacaaaagccatcattctattattttgtttttagtcatggtatttccatttacaaatatagtaactttcgatcgctgcaaaaaacca

SEQ ID NO: 69185 - DNA, 112 bp, Homo sapiens
  chr1:27339342-27339454
  hyper
cagcccgcggcccagcggactcttataggccgcgggcgacgtgcccattggtccgggccgctgccaacagcgagagccgccccgcctctgaacgctccggacactggtctgt

SEQ ID NO: 69186 - DNA, 30 bp, Homo sapiens
  chr1:27358149-27358179
  hyper
gggcgcccgctgcagcgacagcagttccca

SEQ ID NO: 69187 - DNA, 18 bp, Homo sapiens
  chr1:27558365-27558383
  hypo
tgggggttctctggccgg

SEQ ID NO: 69188 - DNA, 187 bp, Homo sapiens
  chr1:27628242-27628429
  hypo
gctcagtcaggctcccgctaggcattcacacctgcttagacagggccctggtggttccacttgggcatctgagaggcagaagctggtcattgtgtttgttccgagtgtacaagtgcagcagagacaatagcgcagagcagtagaaatgcctcaggcttggaatgtggggcctcggttccaaatgcag

SEQ ID NO: 69189 - DNA, 30 bp, Homo sapiens
  chr1:27675398-27675428
  hypo
aagcactggtctcaccgctcctgcagctgg

SEQ ID NO: 69190 - DNA, 2 bp, Homo sapiens
  chr1:27684179-27684181
  hyper
gg

SEQ ID NO: 69191 - DNA, 15 bp, Homo sapiens
  chr1:27684240-27684255
  hyper
cgctggcagctcctg

SEQ ID NO: 69192 - DNA, 30 bp, Homo sapiens; identical to SEQ ID NO: 38765
  chr1:2770901-2770931
  hypo

SEQ ID NO: 69193 - DNA, 30 bp, Homo sapiens
  chr1:27710201-27710231
  hypo
cctgccttcagggctcggtgcaggccccgc

SEQ ID NO: 69194 - DNA, 32 bp, Homo sapiens
  chr1:27719783-27719815
  hypo
ctggcgggagcttcacgcgcattccctggggg

SEQ ID NO: 69195 - DNA, 30 bp, Homo sapiens
  chr1:2775401-2775431
  hypo
gaggcccagcggggacgccccagtggccat

SEQ ID NO: 69196 - DNA, 104 bp, Homo sapiens
  chr1:27844518-27844622
  hypo
ggagagcctggctgtcggggagcagatctgagcacgctcctcaccagccctagctcaggctcggacctctctgacttcctgccttcccacgtgctcttgcctct

SEQ ID NO: 69197 - DNA, 30 bp, Homo sapiens
  chr1:27844988-27845018
  hypo
acacgatagaattgacgggacccaggaatc

SEQ ID NO: 69198 - DNA, 35 bp, Homo sapiens
  chr1:27868411-27868446
  hypo
attacaggcgtgagccaccgcgcctggcaaggagg

SEQ ID NO: 69199 - DNA, 244 bp, Homo sapiens
  chr1:27876089-27876333
  hypo
gaatcgagcagcgagcgaaagtagccggtgaagaggttttggcgctcctggctgagctcggtctggcctgagggtgcacccgtgctgtagtagctgccacggcctgaggctccactctccagcccagtggaggcaaaggcccgggcctcggtcccctgaaacccacagtttcggccagcttgtccgcctgggtgcccatggtgaggggcccagccaccacccttatccccggcccactcagcac

SEQ ID NO: 69200 - DNA, 475 bp, Homo sapiens
  chr1:27960621-27961096
  hyper
gattccaaaagggggcgaaggcggagagcaaagggggctgcgcccacccggagccccgcggcggcccagcgcggcccgccctctcgttgccttggaggcagcccctgcgggcactcgcggtcaaaggcaggatttccgtcggggcggcagcaattcccggatccagcggggagcgcgggccgagaccgccgcgggcgcggagggggcgcccggagaggcctgtccctgccgagggcggggacttccccaggaagcggggacccacgcctcgcgcgcccggcaggagtcccctgcagcccggaacctaccgcaagggcgggccgagagggtcgcggggccgcggtcgcggccgctaacgttaccctgcgggctgtgggcttcaccccgacttcggccggctcggaagaggggaacttcctggacccgcaattgcaccccaggttctccgtcctccagaagtcgttctcctcaaccc

SEQ ID NO: 69201 - DNA, 30 bp, Homo sapiens
  chr1:28198358-28198388
  hypo
cctaacgtcatacaacgagcaagaggagac

SEQ ID NO: 69202 - DNA, 688 bp, Homo sapiens
  chr1:28199059-28199747
  hyper
gagcccagagagccgcggggaccatggagccggtgccgctgcaggacttcgtgcgcgccttggaccccgcctccctcccgcgcgtgctgcgggtctgctcgggggtctacttcgagggtgagcgggggctggaacccctccgagcactcccttggtgtggggcgggggcagagacccggagaagacgttagcaatccggggaaactgcccctgggttcaaatcccgacactgccactggccaagctgtgtgatttggggccgcactcaacctctttggacctcggcttttgctttcgtggaacggggaccgctgacctgccccgcagggtagtgatgaaaagtcagtgggttgaggcgcgggaggtggatgcagccgggccactcctaggtggccccgcggtgcgcatgggacagagctccgaccgcgccgggacgcagcattaggccgctggtggtcgtggctgcgtcttgattctgaagtgcagggtcagtcttcccgtctgtgtcctcccactcctcccccggccctcctctacactgccttccttcagtccctgcgtccaccttggccttctgtttgaccatgggcagtacttgatttgatcagctcttcagttctcagcttaaatggcgcttcctcccggaagccttcctggctctctgctccttgcacgcccccgtacatct

SEQ ID NO: 69203 - DNA, 89 bp, Homo sapiens
  chr1:2823329-2823418
  hypo
atccacgccatcacacgcctgtccacacccacggaatgcagggtagagagcgagcccggcggtgactctgggcgcggggtaaggcggtg

SEQ ID NO: 69204 - DNA, 52 bp, Homo sapiens
  chr1:2826173-2826225
  hypo
tgcccacccatggtccgggccctggatcctgcggagccggaagccagctgta

SEQ ID NO: 69205 - DNA, 95 bp, Homo sapiens
  chr1:2827790-2827885
  hypo
gtctgggcgccaggacgctggaggcgtgggatgatggcgattcgtctcccatcttcaaggccaacacagataggcggtccactgtcccagtggga

SEQ ID NO: 69206 - DNA, 113 bp, Homo sapiens
  chr1:28293291-28293404
  hypo
tccgagtggctgtaccgggtgacggtggccaccatcctctatttctcctggttcaacgtggctgagggccgcacccgaggccgggccatcatccacttcgccttcctcctgag

SEQ ID NO: 69207 - DNA, 48 bp, Homo sapiens
  chr1:2830003-2830051
  hypo
ccagcagggacacaacgcagaaaaaatgaccctcggcaatgtcccgtt

SEQ ID NO: 69208 - DNA, 71 bp, Homo sapiens
  chr1:2831835-2831906
  hypo
aggacagagccttttcgagttcctggcttgacagtgcaggaactgtgccagggtgccggaaggtgatcacc

SEQ ID NO: 69209 - DNA, 161 bp, Homo sapiens; identical to SEQ ID NO: 38769
  chr1:2833818-2833979
  hypo

SEQ ID NO: 69210 - DNA, 30 bp, Homo sapiens; identical to SEQ ID NO: 38770
  chr1:2836432-2836462
  hypo

SEQ ID NO: 69211 - DNA, 227 bp, Homo sapiens
  chr1:2840699-2840926
  hypo
cacaggaggatgagacggacggaagccaccacgcaggaacgaacaagggatgtcccacgatggcggcccctcccccaagcctcccaccagctggcttcgggcggctttgtgagcaggcacccagggccaagacttggggccagatgcagagaacaggccaggcttcccacccagggatgggcccggaggctcaggttctcccctggggtcagcgtcatcctggggca

SEQ ID NO: 69212 - DNA, 30 bp, Homo sapiens; identical to SEQ ID NO: 38772
  chr1:2846793-2846823
  hypo

SEQ ID NO: 69213 - DNA, 30 bp, Homo sapiens
  chr1:2850995-2851025
  hypo
acgtggaaggcagggcgccctgtggggtga

SEQ ID NO: 69214 - DNA, 129 bp, Homo sapiens
  chr1:2859680-2859809
  hypo
cggcttgccagggctcgtggtgtttgccgcatcctctccagcccatctaacccttacgatgcaatgtggcatctcttggctggtgctgggctgggcttctgggcaaagaccacccgctacacaggcacc

SEQ ID NO: 69215 - DNA, 153 bp, Homo sapiens
  chr1:2866038-2866191
  hypo
ggtgtgacagctgcacgctacatgtttgaaagcagcaacaaggctgtctttgtacggcaggggtggtgctggcagctctgtggcggtgccgggctgcagagtacggcaggggtggtgctggcagctctgtggcggtgccgggctgctgggtac

SEQ ID NO: 69216 - DNA, 89 bp, Homo sapiens
  chr1:28853681-28853770
  hypo
atggcactcacatgccgggcaactgatgctcagagtaaccttcccacagcagccgcgatcttcagtgcatgtgtgtttttgtttttttg

SEQ ID NO: 69217 - DNA, 74 bp, Homo sapiens
  chr1:28865161-28865235
  hypo
gttgcttgtgtacatcgtacccatccattcggcttcacctgcagccaacggcctggaatcgcaaagagacacca

SEQ ID NO: 69218 - DNA, 171 bp, Homo sapiens
  chr1:2888921-2889092
  hypo
tggcccccactgcaccgccacaggctcctgcccacatgggtccccctcagaagtccccgtcagcatcttatcctttggaagcctggaaattaaggctgcccgcaaagccccagggtcccaggctcgctgggccccaagagactcggggtctgggaccgacattcataggaa

SEQ ID NO: 69219 - DNA, 246 bp, Homo sapiens
  chr1:28919075-28919321
  hyper
cggcggtgggcaagacgtcgctgctgcggagctacgtggcaggcgcgcctggcgccccggagccggagcccgagcccgagcccacggtgggcgccgagtgctaccgccgcgcgctgcagctgcgggccgggccgcgggtcaagctgcaactctgggacaccgcgggccacgagcgcttcaggtgcgggtagccggggcgcgggagggacttctggtggggggctcggtgagcgtgctttaggccac

SEQ ID NO: 69220 - DNA, 23 bp, Homo sapiens
  chr1:28926140-28926163
  hypo
atggcacgcgcctgtggtgccac

SEQ ID NO: 69221 - DNA, 41 bp, Homo sapiens
  chr1:2896547-2896588
  hypo
ctgtcccagcctcagcgcgtctttcccgggtggacctggcg

SEQ ID NO: 69222 - DNA, 18 bp, Homo sapiens
  chr1:29047659-29047677
  hypo
tttttttttgtgaggcgg

SEQ ID NO: 69223 - DNA, 23 bp, Homo sapiens
  chr1:29061371-29061394
  hypo
accgcacccggcttttttttttt

SEQ ID NO: 69224 - DNA, 39 bp, Homo sapiens
  chr1:29074244-29074283
  hypo
taagtgagtatcctagttctcagccggtgagcaaaccac

SEQ ID NO: 69225 - DNA, 616 bp, Homo sapiens
  chr1:29138528-29139144
  hyper
tccctagggagggggcgggaggcctcccctgcccagctccgagccggtggtgcagcgtccgcccccggtcgcgggcgcagactggcggccgcctccgggccacgtggtgcgcgcggcgggcgcgtccgaggagcctgcggctgctcctggctcacagcgctccgggcgaggagagcgggcggacgccgggggctgggccggtgcgggcggcgaggcaggcggacgaggcgcagagacagcggggcggccggggcgcggcagccggcggcgtcggggccgcggcctctgccttgccgctcccctcgcgtcggatccccgcgcccagggcgcacggtggagagggacgcggcggagccggccggcagccatggaaccggccccctccgccggcgccgagctgcagcccccgctcttcgccaacgcctcggacgcctaccctagcgcctgccccagcgctggcgccaatgcgtcggggccgccaggcgcgcggagcgcctcgtccctcgccctggcaatcgccatcaccgcgctctactcggccgtgtgcgccgtggggctgctgggcaacgtgcttgtcatgttcggcatcgtccggtgagtccgctgcgggccggcg

SEQ ID NO: 69226 - DNA, 448 bp, Homo sapiens
  chr1:2918274-2918722
  hypo
ctagttctgcgaccccggtggaaatgtacccttctggcagccacagagtcacagggtgagggcggcaaacccatgttcccacagtaagccacgtggaacgacgacgaggggaccccctatgtgtccactccgtagctcccagatccatgcattctgcctgtcatggacacggcaccgtgtcatcgtcactggctcaagaaatagcctgcaaactaaaggacagcgcccaccttctcggacgtccacattctcggacgcccacattctcggacgcccacattctcgggggcgcccacattctcggacgcccacactctcggacgcccacactctcgggcgcccacactctcgggcacccacactctcgggcgcccacactcttggacgtccacactcttggatgcccacactctcgggcgcccacactctcgggcgcccacactcttgg

SEQ ID NO: 69227 - DNA, 129 bp, Homo sapiens
  chr1:2919035-2919164
  hypo
ccctgtcctctccagcgtggagtggttctttgtaaccggcttgccaccaaagggctggttggtgtctttgagggacgatgtcaggacttgagctgcggtcagtttctgatacagcggtgacagtgatca

SEQ ID NO: 69228 - DNA, 30 bp, Homo sapiens
  chr1:29205490-29205520
  hypo
ttcatattacaggcacgcacatgcatgcac

SEQ ID NO: 69229 - DNA, 30 bp, Homo sapiens; identical to SEQ ID NO: 38775
  chr1:2939161-2939191
  hypo

SEQ ID NO: 69230 - DNA, 395 bp, Homo sapiens
  chr1:29448515-29448910
  hyper
aggcggggagccgcccgcgctcgggttttccgcagcggagctccgagccaggcacgcgcggcagaagccggagttggcccggccagcgggcggagaggagggaggggggcgcaggctgttccctggcgcatcccgggctgcaaatctgccgcctgcgtccggtccgcaagcccgcgggtcttgggcctcgggaaacgtgcggcccccagctgccgcgtctccagggtaagtacctcccgggctcgaccccacccccgcacgtggctgcaccgtagcaaatggggcgggggcgctcgggcctcccaggtccgcaggggtcgctcgccgggccccacctcccccctactgtgctttacataccgcagcgcgggaggagggggcgtcaccggctccag

SEQ ID NO: 69231 - DNA, 139 bp, Homo sapiens
  chr1:29449756-29449895
  hyper
cacagattgcaactacggcccagggaggccggggagactgcccgaccccgcactaggcgggggctctgccaggtccgacgccgggctccggggccccagccctagacccctctcaggacagccacgggagtatccagga

SEQ ID NO: 69232 - DNA, 333 bp, Homo sapiens
  chr1:29450241-29450574
  hyper
ggggaacgggagggccgcgctcccgcccccaggggccctgaccgagggagggagggagggagggagggaccaaacgaaaagttgggaaaagtggagtgcggacccctggaccccagctcggctcacctggcgccgcagcgccgcgcgggtccgggtcccagtccgcgcgcggaggctccagagccgcccgggtctccacggcccggccccagccccgccccggccccgcctccagcccccgggaccgtccgacccgcgccgggcccggccccaccgccgctgaaaggcggcagctcaggtcaaaggatcgcaggtaggcgccctgtgcgcgcc

SEQ ID NO: 69233 - DNA, 223 bp, Homo sapiens
  chr1:29462383-29462606
  hypo
ctctgatcactgaggcgaaaccccctgcctgaagtgcttgttcaacatgcttctgcaacatcacttggtcctcgaaaatttctggtttgggagaactgccaacgatgcccctagagacctttcaaacctctttgctaattcctcttgccaagagatgcttgagaggaaaaattaacatgaataaaagatcattgaaagaatctacaggccgggcgcggtggct

SEQ ID NO: 69234 - DNA, 32 bp, Homo sapiens
  chr1:29463290-29463322
  hypo
ggtgtaacgcgataccgcggggttgtcctaat

SEQ ID NO: 69235 - DNA, 42 bp, Homo sapiens
  chr1:29463615-29463657
  hypo
ttgaatgttcagggccgggcgtggtggctcacgcctgtaatc

SEQ ID NO: 69236 - DNA, 45 bp, Homo sapiens
  chr1:29516592-29516637
  hypo
gtacatagtcaaggccgggcgcggtggctcacgcctgtaatccca

SEQ ID NO: 69237 - DNA, 36 bp, Homo sapiens
  chr1:29564766-29564802
  hyper
tgtcggatgtgtgtgcgtgcgcgtgttccacatccc

SEQ ID NO: 69238 - DNA, 863 bp, Homo sapiens
  chr1:29586000-29586863
  hyper
caacgcgggccagaacgcgtcgttccagtgcatggccgcgggcagagcggccgaggccgaacgcttcctcttgcaagtgagcgggagcggtgatcttggctgggggcggggtgggagggggttggtggctgcttctggccctgactccccccagattgctgagtccctgcttcatactccagcactgcgcacagcgtcccggccctcccctagctctgctctgcgctttcttgggtcccccattcccccaggttagagcgcggctccaggaacctatgtccgcgcggtgtagtagggacggctaaatggggcccgggtcagagcgagatcgggacccctcgctccgaggcgcccctgaccccctcactctcttccctgcagcggcagagcggggcgctggtgccggcggcgggcgtgcggcacatcagccaccggcgcttcctggccactttcccgctggctgccgtgagccgcgccgagcaggacctgtaccgctgtgtgtcccaggccccgcgcggcgcgggcgtctctaacttcgcggagctcatcgtcaagggtcagctggtggacgccggggagcgccgggacctcaccctcgaggggcggggccggcgacgggggcgggctctgcccgggggcgtggccgtggggggtggggccggcagggtgtcgctggggcgctatctgaagatgggcctgtggaaatggcagtggcccagccgggatgagatctgatctaggggtcggggctggcttcgagggggacggacagggtcaaggtgagagcctaaagaggggtggggttctggctgtgtgacttctgtgttgatcctagctggcctgcggtccgctccaggaggcga

SEQ ID NO: 69239 - DNA, 38 bp, Homo sapiens
  chr1:29785074-29785112
  hypo
atctaatctttgtgacgtctgtacgagacacctagtat

SEQ ID NO: 69240 - DNA, 616 bp, Homo sapiens
  chr1:29804767-29805383
  hyper
gtgtccatcgcagtccgccggccccctcccagcgtctctcgaccccttccccccttccctgtactccagccgcggctgattcctgctgtctgggtggggtccctgtaaggctcaggcggctgactggggaggcgatcccaggaggcacagtggggaggggatagcagggcggaaagaggctgaatcacaaggaggcgggggcggcggctcggtcccagggccatctcagggaccgtgtcggggggtgctgactctgcccatcaaggggagccggacatttatccgccaaagcccgtccctcgcggtgagggtcgctcctgggtgtgggacccctggcttcccgcgctgccctgcccggggctggtctcgtcccaggaccctggagagcggccccaggaggcgtggaggaggggagagagccgagggaagtggtcatggagcaggtgaacgcacaggggcttcggctggagcgccctcctgggaagagcccctcctctgcaaggacctgccgcagcttaaccagcctgcgctgctgtcgccagcgccagttttaaatagccaaaccctactcacttcatccagcaacgcacccccaacttcacgctaaatgcataat

SEQ ID NO: 69241 - DNA, 246 bp, Homo sapiens
  chr1:2984623-2984869
  hyper
gaggaagcgtctggtcggctcccgtccgagctgctccacctgcgccgctggcctttccgcccgctacgcacctgggccccgagaggccagaggggagtgtccccagtggcccgggtccccgaaggtggcccagctcgggcgctcgcgcagccgggtactcaccttgggggcgcggcggcaggagagcgcgggcggagaggtgcgggcgccctgggacgaccagccgaggacgcctggtgtttggac

SEQ ID NO: 69242 - DNA, 582 bp, Homo sapiens
  chr1:2984870-2985452
  hyper
gctgcccccgcgctgtccccccgtgcgaggcgtgttggcctccgtggcctcgcgagggaccgagggcggcgggtccgagtgccgcccgccggcctgggcagtggcggagcgcggagctggcggcgcctccgctgttgtttttgagccgcgaagcccgaagcagcagccgttgggtgggggcgaaggggaggaggcgggggccgggaggcgcgaggggggcggtggggcccggagggggcttcggaggagccgggttctggcgcgcgagccccgacgccccctccagcgatcgcagggcggggacgggggccgaggggagaatgcaggagaaaagcgggccggggcgacggggaacgcaaagcttttaaattagtaatcaaacgcagtaaaacggagcaaaaccagcccggactcgcgtccgaactatcggcgcgtgtgccccgagatccaaggaagtcgtgtggaaaaccgcagccgccgccccatcttcggccccggctggggcgggagcagcagcgcgacgcgccgcgacgcaggggcagggtggggggatagtcacctcgcctccggggccacctgggt

SEQ ID NO: 69243 - DNA, 43 bp, Homo sapiens
  chr1:2986039-2986082
  hyper
cgcggaggctcggggcgcccgggccgcgcgctccccgaaggcg

SEQ ID NO: 69244 - DNA, 441 bp, Homo sapiens
  chr1:2986346-2986787
  hyper
gagcaccgcctttggcgtccgccagccgggcgcagaggagggagaccccgagccggggaggggcggaggagggggcgcgggccggcgcccacccggctccgcgggcgcaggggcaggggtggcgacggcgggacagccgcagccacttggggagcaaaatggagacttttgcccgggctgggaactgtggtcgtgaagtttatccccggctgtgccccgcgtggtggagggcgctcctctgggacgccggcagcctgcgcgggccgccggggcgacagtgcctccgacaggagggacccacccggccacctcccgacccgccgctgccgccctcgggcccgcgtggacccctctgtacccgcttgcctggcacagccgggcccggcggggacagagctgccccggccaggctgcccggtcctcggtcttactttctctttc

SEQ ID NO: 69245 - DNA, 507 bp, Homo sapiens
  chr1:2987055-2987562
  hyper
cggaatcggcgccgcctgctcccgccgccccctcctctgcaggccgcccgcccgcccacccgcagaagaggcgcccgggccgctcccctcgaggtccccgcccgacccacgccgttccgtccgcgcctccggggccgggtccctccaggccggcctcgcagctcccggggccgagcccccaaacgtgagccgggtgcgcgcgggactcgcggcggttttccgaagctccgctccctcggctcggggcccgcccggctcgtcccaacagctgccccgcggccgtaggccccgcgctctgtgcaccagggaaaagcagctcccgagtttgtgccggacgctcctgcgccccgccatcggccgttcccggcccctgggtgaggcgcccccttcccgccgcgctccgctgccgggtgccctcggcctcggcctcccgtgacctctgacccctcttggtgcgaacaagaccgggcgtttcgccgccgacgcgaaggggctgtctgtgcgcgg

SEQ ID NO: 69246 - DNA, 43 bp, Homo sapiens
  chr1:2999363-2999406
  hypo
ggcctgggggacaggcgagattggaaagcgatggggccggcgc

SEQ ID NO: 69247 - DNA, 41 bp, Homo sapiens
  chr1:2999823-2999864
  hypo
caagcagcaacctggcggctgggccccggaactgcacatcc

SEQ ID NO: 69248 - DNA, 30 bp, Homo sapiens
  chr1:3008545-3008575
  hypo
gcgttagccccaggacggcttcatggggag

SEQ ID NO: 69249 - DNA, 69 bp, Homo sapiens
  chr1:3015467-3015536
  hypo
tccccaccaaggacccggcaaatgctgcttctcagtgcccgttgagtggctgagcggcctcactgagga

SEQ ID NO: 69250 - DNA, 83 bp, Homo sapiens
  chr1:3032896-3032979
  hypo
ccacagtgtgagaaccgagagccagggccaatgacgggggggacgcgggttcacgggtggcctggagacgtggcaccgtacct

SEQ ID NO: 69251 - DNA, 141 bp, Homo sapiens; identical to SEQ ID NO: 38777
  chr1:3035035-3035176
  hypo

SEQ ID NO: 69252 - DNA, 188 bp, Homo sapiens; identical to SEQ ID NO: 38915
  chr1:30351554-30351742
  hypo

SEQ ID NO: 69253 - DNA, 153 bp, Homo sapiens
  chr1:3051442-3051595
  hypo
cacctcctgagagcccggcgaggggatcgggccgggtattagccggggattagacggccgagctgctggcctggtaggggagctgccggggagctgccggccacccgcaggctgggcctgggaggccctcctggtccgcgtgctgctgccccc

SEQ ID NO: 69254 - DNA, 30 bp, Homo sapiens
  chr1:3052897-3052927
  hypo
ggggacctctggtgtcgtccattttacaga

SEQ ID NO: 69255 - DNA, 215 bp, Homo sapiens
  chr1:30558965-30559180
  hyper
gcgccaccttcaggccgcggccgggagcggtgccggtgcggggcgccccaccaggaggaggtggcggaggtcccgggggccgccccgcctcgcagcctgggctctgcctgctctgcgtccacgccagcataagccccagccggctccgtctcccctaacgactctaattaccagccaagctcggctccccaaggcccaggcgccagaactgatga

SEQ ID NO: 69256 - DNA, 30 bp, Homo sapiens; identical to SEQ ID NO: 38778
  chr1:3063272-3063302
  hypo

SEQ ID NO: 69257 - DNA, 30 bp, Homo sapiens; identical to SEQ ID NO: 38779
  chr1:3070343-3070373
  hypo

SEQ ID NO: 69258 - DNA, 45 bp, Homo sapiens
  chr1:30723094-30723139
  hypo
aatagcaggagccaccgctcattgactggacgccctgtgctggga

SEQ ID NO: 69259 - DNA, 155 bp, Homo sapiens
  chr1:3078686-3078841
  hypo
gtcattttaaccacccgtgagcgtggcattaggtggcgttcaatatgcccgggccactgcggaaccatcacccctctctgtgcccaggattttcccgtcaccccccaggaaaaccccgtgcccggtaaatagtgactctgcgtccctcctcccga

SEQ ID NO: 69260 - DNA, 34 bp, Homo sapiens
  chr1:3080320-3080354
  hypo
tgtcatattctaccccgtgcgtgttcacgtccag

SEQ ID NO: 69261 - DNA, 5 bp, Homo sapiens
  chr1:30815412-30815417
  hyper
taaaa

SEQ ID NO: 69262 - DNA, 388 bp, Homo sapiens; identical to SEQ ID NO: 26157
  chr1:30815454-30815842
  hyper

SEQ ID NO: 69263 - DNA, 122 bp, Homo sapiens
  chr1:3087601-3087723
  hyper
gcacccctgtcccagcgggaccccgcacccctcagcgccccacggagacctgcaccttccagactgacagtgctcggggccctctctccctcttgcgatttttatttcggggccacgtttgt

SEQ ID NO: 69264 - DNA, 54 bp, Homo sapiens
  chr1:3089947-3090001
  hypo
gctctgaaatgggaacgctgctgtccccggagcattgcacggataaataatcgt

SEQ ID NO: 69265 - DNA, 241 bp, Homo sapiens
  chr1:3102576-3102817
  hypo
gcccctgagcaccctcggtgcccattgatgcccgagtccccggcgctccctgagctgtacacactgggtggggcacgtgctgcagaggttgacgctgcgttgtctcctttaggtgacggtgacgttgtaaataatatgtatgagcccaaccgggacctgctggccagccacagcgcggaggacgaggccgaggacagtgccatgtcgcccatccccgtggggccaccgtcccccttcccca

SEQ ID NO: 69266 - DNA, 226 bp, Homo sapiens
  chr1:3111237-3111463
  hypo
cgtctgatcgccacacgccatcgtctccccgccacacgccaccgtctccccgccacacgccaccgtctgatcgccacacattagggcttggtattctcagtcccacgttttatcatctaaacgccaaaactcgttcctggcctgccctttctctccaaggttcccagatgcacgctccactgcccacaccacccccacggttgagtgggctcggccccgggacgtg

SEQ ID NO: 69267 - DNA, 232 bp, Homo sapiens
  chr1:31157994-31158226
  hyper
cagtgggaacaaggacgaccgtcgaggaacccgacaaatgaattaaaccagcaccagcgtgatgagcaaagcggagaaggaaagagggcgctgtgaggagagcgaggctcctccgggaaagctccttctgctccaggtgacagcggagagagatgccaccgcgcggcgaccggcagggccgcgtcccctctgcgtcctagcacagcgacgccccgcccgccacccgccctac

SEQ ID NO: 69268 - DNA, 181 bp, Homo sapiens
  chr1:31208071-31208252
  hypo
atcaatctgtagcaccgccacacgcacttgaacatgtagacctggaaaaaggcccaggtcaggctgtgctttgctgagcgtccttctcacgctccagcaggcctaggacatatgccaggcaggagccaccactctctccagaagccagcatccagctgctcctgctcggacctctcattct

SEQ ID NO: 69269 - DNA, 33 bp, Homo sapiens
  chr1:31249862-31249895
  hypo
aactctgctcttgcccgccgcatgccagcattt

SEQ ID NO: 69270 - DNA, 32 bp, Homo sapiens
  chr1:3128445-3128477
  hypo
gagcgggtgtgtatccgcggctgctccattct

SEQ ID NO: 69271 - DNA, 157 bp, Homo sapiens
  chr1:3129210-3129367
  hypo
tcgctgcggtcctcccgctcatcctcccggccccctcgctgcggtcctctctgccactgtggatgggcttcacacaaactgagatggggaggccccatcctcttggttcccaccagcacctgcatttccgccgctacctcggcgtggctctgcctgc

SEQ ID NO: 69272 - DNA, 30 bp, Homo sapiens
  chr1:31439991-31440021
  hypo
gtccactcagatgtgcgctcacctgcttgt

SEQ ID NO: 69273 - DNA, 35 bp, Homo sapiens
  chr1:3147215-3147250
  hypo
ctgagaaggcagctccgacgcggccccggttgggg

SEQ ID NO: 69274 - DNA, 52 bp, Homo sapiens
  chr1:31481385-31481437
  hypo
aatgggaaagagccccgatcgagggtagcattagggtcgggaagcactaaac

SEQ ID NO: 69275 - DNA, 30 bp, Homo sapiens
  chr1:3149618-3149648
  hypo
atgtttgtatagaaccgatcattgatcctg

SEQ ID NO: 69276 - DNA, 18 bp, Homo sapiens
  chr1:31498805-31498823
  hypo
aagcttatcttccaccgg

SEQ ID NO: 69277 - DNA, 48 bp, Homo sapiens
  chr1:31712619-31712667
  hyper
gcctcctttgtctagcgggccgtccgtcaggcgcgcctcctgccccgg

SEQ ID NO: 69278 - DNA, 30 bp, Homo sapiens; identical to SEQ ID NO: 38784
  chr1:3179577-3179607
  hypo

SEQ ID NO: 69279 - DNA, 30 bp, Homo sapiens
  chr1:3182769-3182799
  hypo
tgggattttgtgcaacgctggccctctgac

SEQ ID NO: 69280 - DNA, 90 bp, Homo sapiens
  chr1:3183016-3183106
  hypo
gagactggggaggaccgagcggttcgcatttgcaaagctcttaatcagtgaactgcgttggaggcattgctgctccgctcctccgacgag

SEQ ID NO: 69281 - DNA, 18 bp, Homo sapiens
  chr1:3183533-3183551
  hypo
gcccggccacgtgcattt

SEQ ID NO: 69282 - DNA, 30 bp, Homo sapiens
  chr1:31846047-31846077
  hyper
catcccccaacccaccgaggtgggtgggga

SEQ ID NO: 69283 - DNA, 72 bp, Homo sapiens
  chr1:3184625-3184697
  hypo
tcaaaccatgacccccgaatctaacagggtgcccgtttgcacacacgtgggagcgtacggtgagcaggtcct

SEQ ID NO: 69284 - DNA, 356 bp, Homo sapiens
  chr1:31846296-31846652
  hyper
actagaaaagcaaaacgcccttgggctggtgcccacgccggggaaagctctggttgacttctggcacgggcatctgtcctcgttttacaagtgaggagtccgaggctcacaggggaactgacaaggtctcaagaaataggagggggtgaatggagctcagattgcaagcttagtctagcgggcttcagagctcgcgctctcccttcactctcactgcctggtggcggagacagtcaccagcggctcggtctgcggctgagctgaccttgtcctctgcctgttttgagcaaaagcctgacccttcgcgccccgcccgcctcacacgtgcttgcccctccctgcggaatgtctcctgc

SEQ ID NO: 69285 - DNA, 30 bp, Homo sapiens
  chr1:31863025-31863055
  hypo
ggaaacctgctctgccggtgtgtgttctgg

SEQ ID NO: 69286 - DNA, 30 bp, Homo sapiens
  chr1:32098396-32098426
  hypo
catcaagcgttgcaccgtcctcctactctg

SEQ ID NO: 69287 - DNA, 112 bp, Homo sapiens
  chr1:3213652-3213764
  hypo
gcagatctcagacctcgtggggtgtaggagccctaaggggagcggtcagcccttgtcctctgtccgctttctgcccagtggcccctccaggtcccggcgtctccttggactc

SEQ ID NO: 69288 - DNA, 178 bp, Homo sapiens
  chr1:3217150-3217328
  hypo
cgttccctggagcctcggaaccgcggtgcaactggggtgcgtttgtgccagggaaaatggattctgccggtgtctgactctaccaagatccacgcatcattgttagcatttcctttcatttctctttgttattatttgtcttttccaccttgtaccatccccccgaaccccatttatg

SEQ ID NO: 69289 - DNA, 433 bp, Homo sapiens
  chr1:32179994-32180427
  hyper
tgtttgctccagaaccgctaatatccaggtcgggactttgtgttgctgcgagcccaggtccccaccctgaagtctaggacagacccatgagcttgggtgggagagaagagcaatgcagacgtgactgtcctgccaggcgggggcgccgccgccagacgcacgaaaacaaccaaataaatcaggcccaggaactcctaatccttcccggctgtggctgctaccgcttgccccgccggcaccgccctgccaagggcgcagagtcgggccagcagagccggagtgatgccgggccatcgaggcgtcctcagcccccgaggtgggaggtggtgggggggcggggaggagaagaagaaggctctcccgacacggtgactcaggcctccttgacccgctcctgggtgggcacgttcctgcgccccggtctatttttaga

SEQ ID NO: 69290 - DNA, 133 bp, Homo sapiens; identical to SEQ ID NO: 26162
  chr1:32180688-32180821
  hyper

SEQ ID NO: 69291 - DNA, 589 bp, Homo sapiens
  chr1:32180905-32181494
  hyper
cgccctaggccctgcctcctatctggctccgcccagccctggccaaccttagaacctgtcccaaggtccagagaggcctagatgaggggtagcctgcctctgagaggcatggagccctcctcccgcgtggggtcagggaatagaagggcgtcgagggtggcgggtgagggaacgttcctggcgccgcgaacgggaagcctccaggctgcaggacgtagctgcggggacccggcagtctgcgaggctggagtggccgaggccgccccgagcatagaaacagccctgtatacgtgggcacagaaaggcccagggaggcgcctgggcagaagtgtctaggacgatgcctctgccacggagccctggagtgggggcagctgatggctcaagacacatgagctctggtggcgagtacagggacgcggggtttggggaggcccaagtcaaggtccatccttctgggatgaggggcggaggatgggaggcggagcccggtctccagggcaccagccctccacctagcgggaagcttgggaatcgcggagtgcagaggtggggtgcggaaagggttccaccgcgcctgggctccttt

SEQ ID NO: 69292 - DNA, 30 bp, Homo sapiens
  chr1:3222385-3222415
  hypo
agaagggaacccttccgggtgatgcccgtg

SEQ ID NO: 69293 - DNA, 127 bp, Homo sapiens
  chr1:32226201-32226328
  hyper
ggccgggggaaggggcgcggcgacgcgcacatccgtcgcgtttatccacctggcagctccaattcgcccgcccgtcactcaccctccgcctccccggcgctcgccgcccgacctgcccaggccgcca

SEQ ID NO: 69294 - DNA, 19 bp, Homo sapiens
  chr1:32226372-32226391
  hyper
cgctcggacccaaggacag

SEQ ID NO: 69295 - DNA, 25 bp, Homo sapiens
  chr1:32237521-32237546
  hyper
cacaaagggccccaccgccggaagc

SEQ ID NO: 69296 - DNA, 1078 bp, Homo sapiens
  chr1:32237638-32238716
  hyper
cggcggcggcggcgcgggtgtggggccgcgcggccgggagcgggcggaagagagcgcgaatttgaatttcaaaggcatctggaacccaagtgcttctgcgttgcccgattgtgtgtgtggcgcttttgtgtgtccgcgaatgcgcgcgtgcgtgtgtggcgtgtgtctgggtgttttatgactgtcctccgtgaggccgtgtgtgagcccttgcgtgggccgtgagtgcggcagggagcgcggtgtccgggggccgcctgtcggtgtgtctgtgcgtgcttgtgcgctagcctttgcctctgcgagtgcgtatttttaggaccgagtctgtctatatgagcctgtgtctgtgtgtgtgcgctcccggccctgcgtgtgtctgtgagcgtctgccggggcgcgtgtgtgctcggaaccccgcggtggtgtgcgggtgtgtccgtgtgtctgtgcacgtgcaggcgagcgttcccatctgtgtgtgtgcatctgagtctgggctatgtgtgactcagggaccagtctatgagcctgcctgtgcctttgagccgatacctgtgtgtgactcagggacgagtctatgagccgatacctgtgtgtgcttgggtgtctgtgtcgtggtgtgtccctgcaagcgtttgtgcctgcaggtgctggagtgtgtagctgtgggaatgagtgcgtgtgagtgtgcggaaggggcaccgcgcgagggagcgccggtgcggaaggctaagcgagcccgcgccctccacggacggtgccgccaccccctccctccgccccgcgctatgtgcccctgtgtgcccgcgccgccggggccgtctctgggctccgggagggggctgagcgagcggccctttcctcccagggaccccgggcccgccgccagccctgggcacacccgccccttcctccagcggccccgctcgctgacccacgggcactcgatgggcactcgggaggcaatggccggagaggatgggcagttagcgggagggactgagtggcgccggcttcacgctcattctgctgagggcttgggggcagctcatcagtcttccgcaatgggcctgct

SEQ ID NO: 69297 - DNA, 130 bp, Homo sapiens; identical to SEQ ID NO: 5388
  chr1:32410234-32410364
  hyper

SEQ ID NO: 69298 - DNA, 30 bp, Homo sapiens
  chr1:3263565-3263595
  hypo
gtgcgcagcactcaccggcagcttgggaca

SEQ ID NO: 69299 - DNA, 70 bp, Homo sapiens
  chr1:32705509-32705579
  hypo
tggtctctgtgcctccgccagtcacgcgggcttgtttcgcggcctgggccgagagcgtgtccatgatgaa

SEQ ID NO: 69300 - DNA, 84 bp, Homo sapiens
  chr1:32741460-32741544
  hypo
gggccagactcactgcgttctttcgtcgctttgtccatccattcattcattcaggatcgttttcactgtcggtccgggacttcg

SEQ ID NO: 69301 - DNA, 21 bp, Homo sapiens
  chr1:32756498-32756519
  hypo
cctgccctcctaggccgggcg

SEQ ID NO: 69302 - DNA, 164 bp, Homo sapiens
  chr1:3276914-3277078
  hypo
ctgtgatgggtgtgccgggccacaggtccccagccagaaacagaggctaagaactatgccagaggttttggttcacctctgtcaccggctgacaccaccgacacgttgtccttaggcaccagacctgccagtgagcccccagcagagcccggtccaagtgcggg

SEQ ID NO: 69303 - DNA, 84 bp, Homo sapiens; identical to SEQ ID NO: 26169
  chr1:32827740-32827824
  hyper

SEQ ID NO: 69304 - DNA, 30 bp, Homo sapiens
  chr1:32829362-32829392
  hypo
ccactgcctgaaagccgggccaaggccctc

SEQ ID NO: 69305 - DNA, 18 bp, Homo sapiens
  chr1:32918164-32918182
  hypo
aaaactatgtctaggcgg

SEQ ID NO: 69306 - DNA, 30 bp, Homo sapiens
  chr1:32930129-32930159
  hyper
ttttatcttttgtaacgactacccagtgaa

SEQ ID NO: 69307 - DNA, 408 bp, Homo sapiens; identical to SEQ ID NO: 26170
  chr1:32930619-32931027
  hyper

SEQ ID NO: 69308 - DNA, 82 bp, Homo sapiens
  chr1:3294711-3294793
  hypo
aggtgcacatggctgcgaccttggacaccacctccctgagtgttcctgttgccagtgtttcttccaccgatccctgatttcc

SEQ ID NO: 69309 - DNA, 66 bp, Homo sapiens
  chr1:3297673-3297739
  hypo
tcaccaaaggcttctcgccgcgttcccccaggacaagcacacatacatgaacgcacacacatacat

SEQ ID NO: 69310 - DNA, 192 bp, Homo sapiens; identical to SEQ ID NO: 26008
  chr1:3310353-3310545
  hyper

SEQ ID NO: 69311 - DNA, 136 bp, Homo sapiens
  chr1:3310755-3310891
  hyper
cggtggggggcatcccaggagatctggctcggtgtgtagagaagggagtccgggcggcgtcctgggagtgtctgtggcctgcagagaggggatggggttggggtgtggatcccgggaggctcggaggcgctcggag

SEQ ID NO: 69312 - DNA, 262 bp, Homo sapiens
  chr1:3321998-3322260
  hypo
agaaccaggccaaggcgggtgtccaggcagggcacgcgccaacggcatccgtctccccaggtgttcacggaccccagcaaccttcagcggcacatccgctcgcagcacgtgggcgctcgggcccacgcctgccccgactgcgggaagaccttcgccacgtcctccggcctcaagcagcacaagcatatccacagcacggtgaagcctttcatatgtgagtggtcgcccagcctggccgcctgccctccgggtgcgcggatgc

SEQ ID NO: 69313 - DNA, 74 bp, Homo sapiens
  chr1:33220942-33221016
  hypo
tggtgggagaatctacgggtgtattcccaggatggcccacattcctagagattccgaaccggagcttgatgatc

SEQ ID NO: 69314 - DNA, 560 bp, Homo sapiens
  chr1:3325238-3325798
  hypo
tgtgagcacgtgagccggtgcatgtgttggcgtgcatgagagtgtgtgagtgtgggcgcgtgagccggtgcatgtgttggcacacgtgagagtgcatgagtgtgggcgcgtgagccggtgcgtgtgtgtgagcgcgtgtgggcgcgtgagctggtgcgtgtgttggaggatgtgagagcacgagggtgggcacgtgagctggtgcgtgtgtgtgtgagagcgcatgagggtgggcgtgtgagccagtgcttgtgttggcacgcatgagagtgaggggcgtgtgagccagtgcatgtgttggcacgtgtgagagcatgtgagggttggcgtgtgagccggggcatgtcagtgtgtgtgagtgtgggcgtgtgggccggtgcgtgtgtcggcgcacgtgacagcgtgagtgtgggcgcgtgtctgtgagtgcgagtgtgggcgtgtgagttgatgcatgtgagtgtgtgagtgtgggtgtgtgtgagtgagtgtgggcacgtgagttggtgcgtgtgtgtgtgagagtgtgggcgcgtgagttggtgcgtgtgggtgtgaga

SEQ ID NO: 69315 - DNA, 155 bp, Homo sapiens
  chr1:3327868-3328023
  hypo
agtaatttcatgtggcgttttcagcagggtttcccggtcatttcatgcgggtttgtcttggcttctgctgatgttttaggtgaggtctgccacaagtcctacacgcagttctccaacctgtgccggcacaagcggatgcacgccgactgccgcac

SEQ ID NO: 69316 - DNA, 50 bp, Homo sapiens
  chr1:3328269-3328319
  hypo
gcctcccacgttccccgcactcacccccggcttcccgggcatcttccctc

SEQ ID NO: 69317 - DNA, 92 bp, Homo sapiens
  chr1:3328533-3328625
  hypo
gaagaccaggagcagcgacatgtcggacggcagtgactttgaggacgtcaacaccaccacggggaccgacctggacacgaccacggggacgg

SEQ ID NO: 69318 - DNA, 30 bp, Homo sapiens
  chr1:3329300-3329330
  hypo
tgccccagcagcccccgctccactacgcca

SEQ ID NO: 69319 - DNA, 30 bp, Homo sapiens
  chr1:3330244-3330274
  hypo
gcaggtttaccaaagcgctctcagtgatgg

SEQ ID NO: 69320 - DNA, 130 bp, Homo sapiens
  chr1:33336741-33336871
  hyper
ggtcactctctctcccgtgcacagccctgacttggctgccgctttctgccctttcccagggtagagagaggacaagtgccaccgagatgcccgtttgtgcccccacccctaagcgcgcctcccttccctg

SEQ ID NO: 69321 - DNA, 121 bp, Homo sapiens
  chr1:33351599-33351720
  hyper
agctggaggaatgggcgctccacgctcccagctccgttagttgggagttgaggcgcaggagcagggagggtgcccagggtgccaattcggccctcgaagcgacgtgcggctcagagcccag

SEQ ID NO: 69322 - DNA, 131 bp, Homo sapiens
  chr1:33352075-33352206
  hyper
gcgccgccttccctgcgcagtcggtgtctccgcgtcgctgggtgagtgggggcagctccagccggggccgggggatgagggcagggggttcccggagctgggggcccacgtccagggcttcccaacaccgc

SEQ ID NO: 69323 - DNA, 218 bp, Homo sapiens
  chr1:33352236-33352454
  hyper
cgggtggcgggggcgctggggactgggaagcgcgcggtgctctccagggtcctgaccgccgagtggccggcccctaggaaccgcgttcgaccgccctggagcgccccctccaggaggggccacgcgccgggcgctgtcctagtgctgagcggatggaggcgggggctgggggacagagctgagggaggtttggagcgggtccccggggctggcttctc

SEQ ID NO: 69324 - DNA, 79 bp, Homo sapiens
  chr1:3335837-3335916
  hypo
agcctggatgggaagcggtgcgtctgcttccaggatccccccgtgctcctctcatctgaggagccggctggcacctgca

SEQ ID NO: 69325 - DNA, 435 bp, Homo sapiens
  chr1:33358628-33359063
  hyper
cgccgcgccccctgccggcagcagacggccccgcagcgcagtgccgcccccttggcccggcgccccctttcgaccaccgagcgcgggccgccctgggcccgggtgccagcccggtacttacccccgacgcgcgtgccccggggcacgcgctcctgagcccgccgctccaggccctccactgtcgggccccggtgtcctccaacatctctcctgacccctgcgcccgctcggagcttccacctgcggcgcctttgctcctttcccacccagccctccaagggagcgcggcagggcccgcccgatagccctctcttctgggaggccttcccggacacgccttcccgaagccctcggctccccacgcctccgtgattccccactccaccttgcccaggcgggggcagcaaacgtcagagagcccgggggcgcctctga

SEQ ID NO: 69326 - DNA, 75 bp, Homo sapiens; identical to SEQ ID NO: 26173
  chr1:33390730-33390805
  hyper

SEQ ID NO: 69327 - DNA, 180 bp, Homo sapiens
  chr1:3342141-3342321
  hypo
caggtgtaagtactgcgaccgctccttcagcatctcttcgaacctccagcggcacgtccggaacatccacaacaaggagaagcctttcaagtgccacctgtgcaaccgctgcttcgggcagcagaccaacctggaccggcacctcaagaagcacgagcacgagaacgcaccaggtgggcc

SEQ ID NO: 69328 - DNA, 19 bp, Homo sapiens
  chr1:33425641-33425660
  hypo
actccgtctcaaaaaaaaa

SEQ ID NO: 69329 - DNA, 421 bp, Homo sapiens
  chr1:33438500-33438921
  hyper
gcgtcttcccttgcccggggcagggccagcgctttccttgggcactcgaacgaggggagggggccgcttagtgcctggaaatccgagcagccttggcttgcttggctgcgcaacccgccaatccggctgcgcccggtggcggtgccatgtgaccagcctccctttccctccctggccttccagggaagaccggcatccccgcagtgccgccaccctcgccatcccgcccccgcccctcgcgtgccgcatccgcgcgggagagcgcccggcgaggggccgggattccgccgcggtccgctacggcgcaggggacgggaagggagcggaggcgagcgagttgctgccgcagctcccgcagtgttttctgtcaaggtcaagcatacccactctttgacaaggctgcctccgaaatccctccctt

SEQ ID NO: 69330 - DNA, 149 bp, Homo sapiens; identical to SEQ ID NO: 38921
  chr1:33441493-33441642
  hypo

SEQ ID NO: 69331 - DNA, 93 bp, Homo sapiens
  chr1:3347130-3347223
  hypo
cttccaccccaacaccgccccggccctggtgtcctcccggccatagcagcttgctgctgggccttgccctgcccccaccgccccgagcgcttg

SEQ ID NO: 69332 - DNA, 143 bp, Homo sapiens; identical to SEQ ID NO: 14223
  chr1:33473115-33473258
  hypo

SEQ ID NO: 69333 - DNA, 69 bp, Homo sapiens
  chr1:3350089-3350158
  hypo
ctgtctgggatggcccgccctgcccacgcgctcacctgcctgtctgggatggcccgccctgcccacgcg

SEQ ID NO: 69334 - DNA, 55 bp, Homo sapiens
  chr1:3350407-3350462
  hypo
cgagggcaccagccacgaaggacggaggcgggcggggccccggagaaccctgtcc

SEQ ID NO: 69335 - DNA, 77 bp, Homo sapiens
  chr1:33631065-33631142
  hypo
gctcaccttggtctccgccagttgtcgcttgagcagctgcagcgcttcggtgtgttcccgctcgctgtcttgaaggg

SEQ ID NO: 69336 - DNA, 33 bp, Homo sapiens; identical to SEQ ID NO: 38794
  chr1:3372809-3372842
  hypo

SEQ ID NO: 69337 - DNA, 170 bp, Homo sapiens
  chr1:33772445-33772615
  hyper
gggctccagcagaactcgggcgacagcaccttggcgggcttgtgcagccagaagaacttgttgaggtggctctcgtcgtgccagcgcgcctccaggccgcgcgcgcggtcccagtccaggccccccgcacagtgcgccgtcagcccgcgcagcgccgccacgctgccccc

SEQ ID NO: 69338 - DNA, 38 bp, Homo sapiens
  chr1:33772904-33772942
  hyper
cgctccacgggcagccggcgtcccgggcccagcgccac

SEQ ID NO: 69339 - DNA, 32 bp, Homo sapiens; identical to SEQ ID NO: 38924
  chr1:33798865-33798897
  hypo

SEQ ID NO: 69340 - DNA, 118 bp, Homo sapiens
  chr1:33896068-33896186
  hyper
cgccccggtcaggcccgacgcccgggtctcaccgcactctgcgggacaagcggagcaggcgcaggccgcgcaagaccacgggctgccgcggcgcgggcctctccgcaggaggggggtc

SEQ ID NO: 69341 - DNA, 30 bp, Homo sapiens; identical to SEQ ID NO: 38925
  chr1:33981589-33981619
  hypo

SEQ ID NO: 69342 - DNA, 48 bp, Homo sapiens
  chr1:33985077-33985125
  hypo
cggggctctcggtggcggtggtggcggccaggccgggtggctatactg

SEQ ID NO: 69343 - DNA, 45 bp, Homo sapiens
  chr1:3402666-3402711
  hypo
ggccactgcctgattcgcatttttaacctccgtttacaccagtct

SEQ ID NO: 69344 - DNA, 206 bp, Homo sapiens
  chr1:3408498-3408704
  hypo
catgcccggcacacacgcctgtgccccctgccgcacatgcatgcactattgcgcagacgcactggctacattcacacactgatgcacacgtaacacacaggcactggcacgcacaggtgcctgctgcctgtgcaggactgcgtgcgtggactggcacgcacaggtgcctgctgcccgtgcaggactgcgtgcgtggactggcacac

SEQ ID NO: 69345 - DNA, 41 bp, Homo sapiens
  chr1:34090896-34090937
  hypo
aaactggcccagggacggacatacaacgggtctggaacaaa

SEQ ID NO: 69346 - DNA, 34 bp, Homo sapiens
  chr1:34100658-34100692
  hyper
agaaacgtcagcactcggccgtccttttggggag

SEQ ID NO: 69347 - DNA, 272 bp, Homo sapiens
  chr1:3411032-3411304
  hypo
caggcggctccgtagcgcccagggggacaggctggggacagggcagggtgggcagtccttcggcaccagccttgcccagccctatggcagcccagggcacctccctgaggggatgctggggtcccgctggccccgcacactcacccagctcgcagtgccgccccgtccagcccaggccacaggagcagctgccgttgctggcgtggcacaggcccccatttctgcaggagcaggtgtgctcgcagcccacgccaaaccggttctgggggcag

SEQ ID NO: 69348 - DNA, 30 bp, Homo sapiens
  chr1:34115492-34115522
  hypo
ggggactgggaggcacggggcacagagcca

SEQ ID NO: 69349 - DNA, 28 bp, Homo sapiens
  chr1:34130113-34130141
  hypo
attttaggccaggagcggtggctcatgc

SEQ ID NO: 69350 - DNA, 30 bp, Homo sapiens
  chr1:3416275-3416305
  hypo
gcaggctgcagacagcgggcagtgatgtgg

SEQ ID NO: 69351 - DNA, 36 bp, Homo sapiens
  chr1:3417132-3417168
  hypo
gtgtgcatatgtgtgcgtgtgcgcactcaggagggt

SEQ ID NO: 69352 - DNA, 89 bp, Homo sapiens
  chr1:34180223-34180312
  hypo
tctgccccccaggcacgtgatgcgggcggtgccctccagacggtacccggggaagcaggagaaggtcaaggtgtcgcccacgccaaact

SEQ ID NO: 69353 - DNA, 30 bp, Homo sapiens
  chr1:3418316-3418346
  hypo
tgcagcctggggaggcggaactggggctgc

SEQ ID NO: 69354 - DNA, 103 bp, Homo sapiens
  chr1:3426374-3426477
  hypo
cagctggggcaaactcgagaaggcagaggccggtgctccgcggagggcgggagactcacggctgcagcccctacggtcctcgtgcagccggtagccggcctcg

SEQ ID NO: 69355 - DNA, 30 bp, Homo sapiens
  chr1:3431090-3431120
  hypo
ggagcaggggaggggcgtcctaccttcaca

SEQ ID NO: 69356 - DNA, 30 bp, Homo sapiens
  chr1:3431513-3431543
  hypo
ctgacaccaaggcggcggccccccagctct

SEQ ID NO: 69357 - DNA, 30 bp, Homo sapiens
  chr1:3450321-3450351
  hypo
gaatccctgcacctccgactccagtcaccc

SEQ ID NO: 69358 - DNA, 22 bp, Homo sapiens
  chr1:34558017-34558039
  hypo
aataggaacagctcccgtccac

SEQ ID NO: 69359 - DNA, 1323 bp, Homo sapiens; identical to SEQ ID NO: 26177
  chr1:34628590-34629913
  hyper

SEQ ID NO: 69360 - DNA, 920 bp, Homo sapiens
  chr1:34630137-34631057
  hyper
tcccggaaagtttatcgggaaaaagcctagcaccgtgggggctgggaggctggagaaactgaagccacagaccaggtgccccgcaaccccgggcggggatgtctgtctcccaggcccccacaccggccgcatccgtccaagttgcggctggggttggggcagcagtgagggtgagggtggaggtgaggacgtggctgagggtggggtgggagacggaggcagggatgagaatgagagtaggcaactgggagggtgggagattcaggcagggatagaggcggggggagggactgggaccgggtcgaggatgggtgggctcggggctcgggtggggcgcgcggcggccgctggctcctcggcgcggctggactcacccgcggcggccgagacgctgagcaacccacagcccagcaacagcagcagaggcggcggcgttggcggcggcgggcggccccagcggctcccggcgcccggcacaagcgccgaaatcccggtttcgccgcgagccctccccgcggggcagccgcagcgccccagctcccgtccccgcgagcgcggcatggcgcggccggcagcgccgagggagaggctccgctcgccgccgaggagaaaggaggtcaggagagctctggagcttttttctgctcggaaaaaatcccggtacgcgggagccctgagcttctgcggctggaatgaaccaagtgtccgcccggccggggagaggcgcgctgcgctctcggaaatgactcgctccaatcccgcttcgcggggttcgcgccggggggcgggagggggtgaattatccccggattaatcactccggagccgcttctccgccgctccaaatgctgggggtggaggcgcagctaaggataaaatattggggggcgggggttcctcttcagcgccacctccacctc

SEQ ID NO: 69361 - DNA, 375 bp, Homo sapiens
  chr1:34631434-34631809
  hyper
atcccaggagaggggcgtgtgtgcgtagacagaggcagggttaagaattggagggcggtggaggggggttgtgtgtggggtggggaggggggggaaccggttcatttgacccagtgcggtcccactcctaccctaagacaaaaatctcagggtggcagaggcggtccctgtgtgcacgcgagttgggggtggggagtgaggttggtggaaggacggtgcaagagttactagtacaatttatccccaaatttaaataatcggatcctacttcttcttctccccttcctcctcccagccaaggccccaaaccaagagagttcttcccaaggacgtgagctgctccccacctctccccagtagcggctgcctctaggc

SEQ ID NO: 69362 - DNA, 399 bp, Homo sapiens
  chr1:34632102-34632501
  hyper
ctgatttggccaaaacggagcgttggcatctgtgtggccaagggggcagtggccggcgggcggtggggcctgagaatttccggggaagggtgtggagagggactgtagggatggcgagccaggctgggggtggctggcgacccaggttggccggctgtcagcgtggccaggaatttccatccaaggaagggtgtgaagaggggctgtggagttgacgatatgaattggggggcgggggcagggctggaggagtggaggcttgtccctactccccatgaaaaacttcctccccagagccacgctttcgcagcctcctagatgccactcttcctccctccccccaccccaagttgttccggtttccctgcatgagctcatcccacagctggggagccagcc

SEQ ID NO: 69363 - DNA, 285 bp, Homo sapiens
  chr1:3463596-3463881
  hypo
ctgggggggggccagcggcagtagaagccccccacggtgtcccggcaccgacccgcacagcccccgttggcgttggcacactcacccacatctgcgaggggagaagcaggtgaggtgccagccacgcggccacctcctccctccagcctcggcccacccgaggcctcagagggatgaggctcagggctccccacagcacaggggacattgtccaccagaacaggccccgcaggagggaggctgggtgtggaaacccagcagcaggggagccgcactgcagaacgg

SEQ ID NO: 69364 - DNA, 123 bp, Homo sapiens
  chr1:34642367-34642490
  hyper
gagatttgtgtggagcggcgaagtggggcggcggcgcgtttggctttgacttctgatcccccgaagcgctctggggtcctttgggccccacccccacccaccccaccggcgggtcttgggctc

SEQ ID NO: 69365 - DNA, 276 bp, Homo sapiens; identical to SEQ ID NO: 26182
  chr1:34642862-34643138
  hyper

SEQ ID NO: 69366 - DNA, 675 bp, Homo sapiens
  chr1:3466869-3467544
  hypo
catggaggacgacagcgaggaggaacctcaaacctcgtgctgtgtgaaaggagcccatctcgagaggtcacacagtgtaggatagggcgtaccagctggcgggtctggggtctcctgggagggtgaggaaaatgtctcggaatgagataaaggtgatggctgcatagcacgatgaatgcacaaagggtcgctatgtttcaaaggggttattttatgcaatgtgaatttcaccttcatttaagaaaaaagagaaaaacgtcatcccaagactggattctgcacctcacttctccagcagttttgatacagaaagaagcggtcgtgcccaggcctccggggtgctccgtgccggatctggccccatgccaggggcctaactcagcagcagtgactgcaatgtcacaagtgcccagcagccacccaaccggggcagggctccgaagacccagcccttgcagccgatccagcaagcacaggctgcagagtgagaacccgaggggagcaagagggggcccacacccccaccgcccgtgcactcaccctgggggagccagtgtcccccgtgtgctagtccattggcaggagaccctaacgggtgtgacagtggggctctcagatcagccgccaggtgtggacagggccaggatccgaggctccagccggccagggctgggc

SEQ ID NO: 69367 - DNA, 30 bp, Homo sapiens; identical to SEQ ID NO: 38801
  chr1:3470143-3470173
  hypo

SEQ ID NO: 69368 - DNA, 27 bp, Homo sapiens
  chr1:34979405-34979432
  hypo
aagaagagggctgggcgcagtggctca

SEQ ID NO: 69369 - DNA, 34 bp, Homo sapiens
  chr1:3511274-3511308
  hypo
cagaggcttgagagccgcccgctcagctcagacc

SEQ ID NO: 69370 - DNA, 296 bp, Homo sapiens
  chr1:35246877-35247173
  hyper
ggcctccctggaggccgaggtcgacggcccgtcgcaccgggagggggggctcccaggggtgccccacgcacggtcaaggtcccgcgccaagcggggaccgggctgggccggaagcgggcacggtactcgcggcaaactagcgtgggcgagtcctgattgcagtcggacctgccgccgcggcacttaacagtttgcagagtgcttcccgcccctgatctcattggagccttcggacagcccagcccatggccaccgatgcccccatttcacgcctgaggaagcggaggctcagacgg

SEQ ID NO: 69371 - DNA, 391 bp, Homo sapiens
  chr1:35258480-35258871
  hyper
gcacctcccagtccccgcccccgccctctctccagcgcccgccgccctccccgtcgcgtttcctgcccccaccccgcccctctgcgctatttaaggcgcccccgccgctcgtgcggtccagcagggctcccgcgggcgtcactccggccatcgtccccacctccacctgggccgcccggcaggcaggcggtgagtcgggggctaggaagggaccaggggcgccacctgctcgcgggaggccgggaggagtcttgggtcctccgatgccgggacgggggttgctgcggaacgcccgccgcgacagagccgcgctcacccaggtggccttggccaggctcccaccctctttccatggaatccttgtaacaacccgaggcgggaggaatactat

SEQ ID NO: 69372 - DNA, 30 bp, Homo sapiens
  chr1:3527351-3527381
  hyper
ctgccttctcccagccgggctctggggcca

SEQ ID NO: 69373 - DNA, 61 bp, Homo sapiens
  chr1:3527713-3527774
  hyper
agcgggagcaggggccgcggcggaacgctggcgcccacgggcacggcggggagcagcagca

SEQ ID NO: 69374 - DNA, 35 bp, Homo sapiens
  chr1:3528381-3528416
  hyper
cctgctcgtctcatgcggaaagtccaagtcctaac

SEQ ID NO: 69375 - DNA, 876 bp, Homo sapiens
  chr1:35350991-35351867
  hyper
atatatccagaaggccgcttccagcccctcaccccagccccgaccgaccagggtcagagccctcgtgggcgcctccccgttccatacctgcaccccaatggacggccgccacttccgctgccgcgccaggctccgcagctcctccctgccagggatggtcttgatgatgagtgtggggggcttggggctggcccggggcggcaccggcgccaactccagtgtgcgcgcacccatggcggggccgtccagcccgtcggcggagctgcagcgccgggcggggccctcggccgccgtgaagctctcgtgcgcggagtcggtgctgctctgggcggtgatggagatgcggggcggggcctggcttcccggcgggatggggggcggggcctttctgaagttgaaggctgtggccggcgagcgcagagacgcagtgggtgaggctcgcggccctgcctgggtcctgggcccgcgcccgactcccaccctcaagaggccctacgggaccctgcagcggcgcgcactccacatgctgctgcacacacgccaacggacgctctccccgtcatccgaccccgggagcgagcgatctgcgcgggtcacagcacagtcgagggggaggccagaacccggacccagggcgctctcctgcctagggccgggccaggggcaggaaggtgtactcacaggagccgggcctccctgagacagcggcaggggtagcgaggaggggcaggcagtcgtcgtcttgagagcagccggcctggatggcccggaggtagctgtggctccgcatgcggaaacagccgggcaggtccagggcgtccacggcctgggactccagctccccaaacaccgacccgcacacggcctccagctgct

SEQ ID NO: 69376 - DNA, 128 bp, Homo sapiens
  chr1:35369947-35370075
  hypo
cccgggtatccatcccggccctggctgaccatcatggtatgccaggcacttcgcttgaccgactgtccatccagtgacatggacatgccagtgcaggcaaggcagcggccttccgacccgcccgagcg

SEQ ID NO: 69377 - DNA, 108 bp, Homo sapiens
  chr1:35390565-35390673
  hyper
gcctcattcagcactcgggacagctccgaaggagcaaatccccgccgaatcccactcagcacccgggacagttcccagcgacattgccggccccggtagccagaaacc

SEQ ID NO: 69378 - DNA, 176 bp, Homo sapiens
  chr1:35394614-35394790
  hyper
acacagtgacacactcggcacagacacacagcgacacgcactcacattcacacacctgcagaggaaacttctctccggatctccccagcaccacgacttcccccacaaccagctggctactccctcccagacccgagcctccagccgggcgagggctgggccggggctggcctgtc

SEQ ID NO: 69379 - DNA, 499 bp, Homo sapiens
  chr1:35395042-35395541
  hyper
gcggcttacctggcccggctcgggctccggccgggttacatggtgccggcggcccgggccgggggcgctgcggcgttgggcaggcgggcagggaccggggcccggcactgcggagcccccagctgaggggccgcgccggctgcggagccccaagcgagcgccgagcggcagcgggcgcgggagcgggaggcggccaagccacggaggctggatttcccggggaccgggaaggggaggcggggggatcccgcccgcgcgctccgcccccgcccccgcccccgcgcagggcagccgagcagggagagggagagggagaggaagagggagggggaccgagctccccgcccccgcgcggacccaggagggccgaggtcgccgcccgcgggcggccgccggggtcccggaggagcgcccacctcgctgagcgacggtgctgggggcgcccagcgtaggggcaggaatgagatccccctccccggggacccaggaacaggcaccc

SEQ ID NO: 69380 - DNA, 507 bp, Homo sapiens; identical to SEQ ID NO: 26188
  chr1:35395542-35396049
  hyper

SEQ ID NO: 69381 - DNA, 24 bp, Homo sapiens
  chr1:35396107-35396131
  hyper
cgcccagagcgatgctgtaatggg

SEQ ID NO: 69382 - DNA, 30 bp, Homo sapiens
  chr1:3564809-3564839
  hypo
ttcaagtaaaaataacgcctgagtactcac

SEQ ID NO: 69383 - DNA, 23 bp, Homo sapiens
  chr1:35660562-35660585
  hypo
aggcgggaccgggtgcggtggct

SEQ ID NO: 69384 - DNA, 136 bp, Homo sapiens; identical to SEQ ID NO: 38930
  chr1:35664720-35664856
  hypo

SEQ ID NO: 69385 - DNA, 242 bp, Homo sapiens
  chr1:3567103-3567345
  hyper
taatacggtgtctgtcgcacatatattatatcgtgtatgtaatgtataagtatttatttcgtttgcttggggttttgtttgcttttgctgagtccgacccctctacctgccgcctggcccttgcctcacgctccagtgccactgagatcaaggagagaacgaatttgccgctgactgggcagagcgagcgcgtggatcgcggccaccgcccgttcatcacccgcgcgcatctgggctggcac

SEQ ID NO: 69386 - DNA, 114 bp, Homo sapiens; identical to SEQ ID NO: 2
  chr1:3567737-3567851
  hyper

SEQ ID NO: 69387 - DNA, 576 bp, Homo sapiens; identical to SEQ ID NO: 26011
  chr1:3567882-3568458
  hyper

SEQ ID NO: 69388 - DNA, 79 bp, Homo sapiens
  chr1:3597274-3597353
  hypo
cctcagctggacctgcggttctgcttcctgtcacactctcccattttaaattaacggaatggtgcggtccccatgcaca

SEQ ID NO: 69389 - DNA, 30 bp, Homo sapiens
  chr1:3597733-3597763
  hypo
ggggaaggacaaaaacgacaggttccaggc

SEQ ID NO: 69390 - DNA, 132 bp, Homo sapiens
  chr1:3601814-3601946
  hypo
tgtcctccccagccccggagggttccctgagctccatatcggggtctggtccgagcccccgcctgctggaacgtgccactccccagccacagggtgacagtgggagcctcgaacctccgcaaacagcaaggt

SEQ ID NO: 69391 - DNA, 30 bp, Homo sapiens
  chr1:3602547-3602577
  hypo
tgtttccggggctaccgatagtcctgagtt

SEQ ID NO: 69392 - DNA, 1240 bp, Homo sapiens
  chr1:36042478-36043718
  hyper
tcacgtgcacaaccgcgcgggacggggccacgcggactcacgtgcacaaccgcgggaccccagcgccagcgggaccccagcgccagcgggaccccagcgccagcgggaccccagcgccagcgggaccccagcgccagcgggaccccagcgccagcgggaccccagcgccagcgggtctgtggcccagtggagcgagtggagcgctggcgacctgagcggagactgcgccctggacgccccagcctagacgtcaagttacagcccgcgcagcagcagcaaaggggaaggggcaggagccgggcacagttggatccggaggtcgtgacccaggggaaagcgtgggcggtcgacccagggcagctgcggcggcgaggcaggtgggctccttgctccctggagccgcccctccccacacctgccctcggcgcccccagcagttttcaccttggccctccgcggtcactgcgggattcggcgttgccgccagcccagtggggagtgaattagcgccctccttcgtcctcggcccttccgacggcacgaggaactcctgtcctgccccacagaccttcggcctccgccgagtgcggtactggagcctgccccgccagggccctggaatcagagaaagtcgctctttggccacctgaagcgtcggatccctacagtgcctcccagcctgggcgggagcggcggctgcgtcgctgaaggttggggtccttggtgcgaaagggaggcagctgcagcctcagccccaccccagaagcggccttcgcatcgctgcggtgggcgttctcgggcttcgacttcgccagcgccgcggggcagaggcacctggagctcgcagggcccagacctgggttggaaaagcttcgctgactgcaggcaagcgtccgggaggggcggccaggcgaagccccggcgctttaccacacacttccgggtcccatgccagttgcatccgcggtattgggcaggaaatggcagggctgaggccgaccctaggagtataagggagccctccatttcctgcccacatttgtcacctccagttttgcaacctatcccagacacacagaaagcaagcaggactggtggggagacggagcttaacaggaatattttccagcagtgagcaggggctgtatgggacgcgggaggagctcagaggaggcgcggagagtgcccgaggttgggtgagtgcctagaggggagatagttgaaccgggttcaagaggtg

SEQ ID NO: 69393 - DNA, 139 bp, Homo sapiens
  chr1:36056226-36056365
  hypo
ccccccaggagaggccgtgcacctggcccgagacttcggttacgtctgtgagacggagttcccagccaaggcagctgccgagtacctgtgccgacagcacgctgacccgggggagctgcacagccgcaagagcatgctg

SEQ ID NO: 69394 - DNA, 94 bp, Homo sapiens; identical to SEQ ID NO: 38803
  chr1:3607472-3607566
  hypo

SEQ ID NO: 69395 - DNA, 66 bp, Homo sapiens
  chr1:3614470-3614536
  hypo
tcctgctccaatgtccgcttatcaccgagggccatcggaggtggcacgccccgtgactgcctcccc

SEQ ID NO: 69396 - DNA, 41 bp, Homo sapiens
  chr1:36173241-36173282
  hyper
ctgaatgttgggggccggtgctaattcgcaccactcaagaa

SEQ ID NO: 69397 - DNA, 237 bp, Homo sapiens
  chr1:36173696-36173933
  hyper
ccggcccgcgccactcgaggcgccgcggggctccggggaggccgcccctttgtctgcgcctttcggggacgagccccgcccggggagcgccgagcaccagctgagcgccgcgctcccgccggctacctcttccccggcgcggaggcctggaggcccctcctggggcgaggtcgcggccccccgccacgcccgagcccctcggacggctcccatcccacagcccgagccccctttcat

SEQ ID NO: 69398 - DNA, 120 bp, Homo sapiens
  chr1:36271443-36271563
  hypo
cacccaagcctgggcgacagagcgagactccgggtcaaaaaaaataaaagaatatagggtatggtatcagtagacaagaatgtaggcactagattaaaagtcccagttccggccgggcgc

SEQ ID NO: 69399 - DNA, 105 bp, Homo sapiens
  chr1:36334781-36334886
  hypo
gggaatgaatagggtcgttatattgattgttgtgaaggtttcatgtgtgtatatttgtttcaaaactcatcagaccgcacactttaaacgtgtgtagtttttttt

SEQ ID NO: 69400 - DNA, 75 bp, Homo sapiens
  chr1:3644699-3644774
  hypo
gcagagcccccctgccgtccccgcccttggtgccggtgtgaagaagcggcggcatggagacgaggacacgtacta

SEQ ID NO: 69401 - DNA, 167 bp, Homo sapiens
  chr1:36549703-36549870
  hyper
cactggagctcagagcggggggcgcggagagcgaagcgggaaaggaggtaagggagctagggaagcgggggcgcccccttcctccgcgctggaccggggtactgatctaaaccaaaggcgatcatcctgcggaggggaagaaaggggtttgacggggaaccggactg

SEQ ID NO: 69402 - DNA, 252 bp, Homo sapiens; identical to SEQ ID NO: 38933
  chr1:36563342-36563594
  hypo

SEQ ID NO: 69403 - DNA, 47 bp, Homo sapiens
  chr1:36591033-36591080
  hyper
ggccgccggggagtccgcgcagcccctgccctcgaggggccacctgc

SEQ ID NO: 69404 - DNA, 15 bp, Homo sapiens
  chr1:3659628-3659643
  hypo
tctctttagggaagc

SEQ ID NO: 69405 - DNA, 30 bp, Homo sapiens; identical to SEQ ID NO: 38806
  chr1:3661766-3661796
  hypo

SEQ ID NO: 69406 - DNA, 30 bp, Homo sapiens
  chr1:3662534-3662564
  hypo
ggtgttgcatcctcccgggcagacaagtcg

SEQ ID NO: 69407 - DNA, 98 bp, Homo sapiens
  chr1:3663195-3663293
  hyper
ggtctccaccacagacgtgtccccagagtcactgtgctcaatcaggtgcttcaccaccaggtcggtgaactccgccgcgtagtcgtgtaaagccttct

SEQ ID NO: 69408 - DNA, 444 bp, Homo sapiens
  chr1:3663539-3663983
  hyper
gtggtctccgaggggcggcggatgctcggagggggcggatcccttagggctgggggccaggacgatcccacccggagaagcctcgcgggcgagaagagggtcccttcctgcgggggcagatggaggcgcgggagccttccccgggaggtgaccgaggccagtcagcggccccggggacccaaggccggggactctcggcggccggtggacgggcagggccggcccgcctgggcaggcggcggggtgaaggtgtccagggcctgaggcggcaaagtgccgccgccgtcagccccgactgccacccaccaggcacccggcccatccccggctcccatctagggatccacacccgggcgccgcggcgccgcggtttaaagcctgtgagatcccgcaacaacccggatccggaagcgcggggtcgcggctgggcgagggcaggggtgg

SEQ ID NO: 69409 - DNA, 32 bp, Homo sapiens
  chr1:3664709-3664741
  hypo
acacaccttgccccccgcgatggccagacttc

SEQ ID NO: 69410 - DNA, 30 bp, Homo sapiens
  chr1:36666375-36666405
  hypo
gaactgggggctgagcgcagtggctcacac

SEQ ID NO: 69411 - DNA, 30 bp, Homo sapiens
  chr1:3673312-3673342
  hypo
cagtaagagcatctgcgagttcgattactt

SEQ ID NO: 69412 - DNA, 22 bp, Homo sapiens
  chr1:36736011-36736033
  hypo
aggcacacgcacacgcacgcat

SEQ ID NO: 69413 - DNA, 88 bp, Homo sapiens
  chr1:36762204-36762292
  hypo
gatcctgttgatctccgccttgatattgaacgtcgtaaaaaacataaggagagagatcttaaacgaggtaaatcgagagaatcagtgg

SEQ ID NO: 69414 - DNA, 114 bp, Homo sapiens
  chr1:3678034-3678148
  hypo
cggttgttttcaaagcgtccaaagctgctagtgacacacaggcccctggcaaacccccaggccccctggatcctatcaggtcctcactggaacgtggaccggttctcagggttc

SEQ ID NO: 69415 - DNA, 94 bp, Homo sapiens
  chr1:36789434-36789528
  hyper
ctggagctctgcctgcgtgcgggccaagggctaaaccttggacaggttctttcacttactccgcctgacaaccctgcgacgtgataccattatc

SEQ ID NO: 69416 - DNA, 68 bp, Homo sapiens; identical to SEQ ID NO: 38808
  chr1:3680032-3680100
  hypo

SEQ ID NO: 69417 - DNA, 55 bp, Homo sapiens
  chr1:3680304-3680359
  hypo
caagaaacccagctgcgaaagatcaatacggaaaatgagacgctgcagaaggagc

SEQ ID NO: 69418 - DNA, 680 bp, Homo sapiens
  chr1:3683703-3684383
  hypo
ccggccatcttttaggaaaaagtggatgggtgccacacatactcaggttgggcgaaatgaccccacctcttttttctccccggctgtccccagcaagtgtcggaactggagagaaagctcaccaagcgggactgtgtcatctcagagttggacaccaaggtcagccagctgcaggagcaggtggaactggaccagaaccacctgcagaggtggaagcagctgcaggaggatttgcagagcaagaaggagatgattcagcaggcagagcagcacacccgcgtggccctggagagctcccagtccagggtatgcccagcccttcctcctgagggtctgtcccagcagctggcggccgagcacccaggcctctgcccaccgcccaccgaggtagaaccggggtctgtgtacgctggggctcgggctggttctgccgtgtacaccagcatccacacagagttgacactcaagaaatgtgggtagaggacggagtgagagtgcaacagagtagcccggaaatgttcgtcaatggcagtggtgggcggagccccatgggcagggctgcgggtcttgggttgcattgtgaaggggttggatcactggctggaaaggaggagggcacctggatagggaggcatggtgttgcccccctcatctctgagtcatagcgtgcttgctggacc

SEQ ID NO: 69419 - DNA, 30 bp, Homo sapiens
  chr1:3693714-3693744
  hypo
ggagggctgaggctgcgcctgccccaggcc

SEQ ID NO: 69420 - DNA, 20 bp, Homo sapiens
  chr1:36966967-36966987
  hypo
ctggccgattagcactgttt

SEQ ID NO: 69421 - DNA, 30 bp, Homo sapiens
  chr1:3701022-3701052
  hypo
cagcccaggacagcacgacacagcaactca

SEQ ID NO: 69422 - DNA, 35 bp, Homo sapiens
  chr1:3706065-3706100
  hypo
cgggcggggccccaccggggcgcccagagcagcca

SEQ ID NO: 69423 - DNA, 30 bp, Homo sapiens
  chr1:3714226-3714256
  hypo
gcatgccaccgtggccggttaatttttata

SEQ ID NO: 69424 - DNA, 180 bp, Homo sapiens; identical to SEQ ID NO: 38934
  chr1:37148125-37148305
  hypo

SEQ ID NO: 69425 - DNA, 30 bp, Homo sapiens; identical to SEQ ID NO: 38935
  chr1:37227648-37227678
  hypo

SEQ ID NO: 69426 - DNA, 206 bp, Homo sapiens
  chr1:37498362-37498568
  hyper
gtgttcaagagggtccggctcccgggcggccgcccaggaggagacccacccgctgggtttctgaccgcctcctaggaaaatctcaagtacggaaaccaagcccgacaccggttccggcacctctttcacgccgctggcagcccaaggtccgccctgaagaagagctgtagaggaggaaggtggccctggctcggcggagtccggct

SEQ ID NO: 69427 - DNA, 248 bp, Homo sapiens
  chr1:37498597-37498845
  hyper
cgagtgaacccaggcggcccaggtgtccggcctggtggcgggcgcagggcctgcggtgatggaggctccgtcttagcccggccaggcccagccctgccggtcgtcggcccgggacatgcgcggcgctcaggcctgcagggtgccttgggcggccacaacaaagttaaagaccggagtaagagtctccggcgagaagagacgcggagaagccggagccccggaaagccgcgcgcagccccgccagccgc

SEQ ID NO: 69428 - DNA, 795 bp, Homo sapiens; identical to SEQ ID NO: 26194
  chr1:37498888-37499683
  hyper

SEQ ID NO: 69429 - DNA, 428 bp, Homo sapiens; identical to SEQ ID NO: 26195
  chr1:37500013-37500441
  hyper

SEQ ID NO: 69430 - DNA, 133 bp, Homo sapiens; identical to SEQ ID NO: 26196
  chr1:37500442-37500575
  hyper

SEQ ID NO: 69431 - DNA, 430 bp, Homo sapiens
  chr1:37500602-37501032
  hyper
cgggagactgacccgggaaccggcttccctccccaaccccattcctcctggcagcagagttggggctgggggttcggagaggcagaattcaaagcgaattgtctacgctgggccaggggagctgagggagttggtagaggtgggagagcccaagtcagaccccctgctgtgggaagctggacttgaccgcgcacaggtcctggggctgcggaggaggaagaccgctcacgccttagatgtaggggggcgtgggcgccgggcccgctccctctcagccctctcccgtaactgtgcaggaagggctggtgccccctccctcattctcctgagaaagaataaagagaaactgtaatttgtcgtgggatggagtaggatccgtgggggagcaagctaaaggggttaaaaagaaaaacaacgttgtttattagca

SEQ ID NO: 69432 - DNA, 30 bp, Homo sapiens
  chr1:37501855-37501885
  hyper
ccccttccttggggacgcacacccctcccc

SEQ ID NO: 69433 - DNA, 192 bp, Homo sapiens
  chr1:37549296-37549488
  hypo
gttaggttaaggcagcgtcaacaaccaactgtgtgggaagcaaagaagaaaagagagaaaaaaaccaagtacaaccgaagctttattcattgtccgggctatttagcaggaggagttgaaaagaaagtagttagctgttagaggaaaaaatggaaaactctggtccctcattaatctcgctgccctccatgt

SEQ ID NO: 69434 - DNA, 107 bp, Homo sapiens
  chr1:37721088-37721195
  hyper
ggcctgcattccagccgcccaaaggagccattttcgggcgaagccaggggcccacgtgggagggagctccaggagagatcagtctctgctggcgtggagggggcggg

SEQ ID NO: 69435 - DNA, 192 bp, Homo sapiens
  chr1:3786388-3786580
  hypo
acagcccgcctggggcgaggcgggtggggaccttcagcccttgccctgcctgggcaaagccttgtgaagaggtacagccctcacattcccagggagggcggcagtgtctcagccagtgcctctcaagctgcagtgcacacaggaatccctggggagcttgcagagggctgcagggcccgccccagggcttgt

SEQ ID NO: 69436 - DNA, 26 bp, Homo sapiens
  chr1:37899676-37899702
  hypo
gcgtgagacaccgcacctggccaggg

SEQ ID NO: 69437 - DNA, 30 bp, Homo sapiens
  chr1:38099986-38100016
  hyper
ggatggaggggagttcgaggggaagaggct

SEQ ID NO: 69438 - DNA, 30 bp, Homo sapiens
  chr1:38100242-38100272
  hyper
tgctgccagtcgcgacgggggcaggcccgg

SEQ ID NO: 69439 - DNA, 33 bp, Homo sapiens; identical to SEQ ID NO: 26198
  chr1:38100650-38100683
  hyper

SEQ ID NO: 69440 - DNA, 30 bp, Homo sapiens; identical to SEQ ID NO: 38936
  chr1:38207058-38207088
  hypo

SEQ ID NO: 69441 - DNA, 481 bp, Homo sapiens
  chr1:38219523-38220004
  hyper
tggcagcatggggaccgaaccgatggtgcgaaggtcgggagcccccctttcggctggagggtaggcagggtgaggagagggcagcggaggggcgctctcctcagtgatctgccaggcatcctaaccccatcctccgtctggactctcgcagttgtcctggttcttctcatcaaaggccccggcccccagggcgcgtccaggctccgctcccccgtacgccgccttccggggcgctggcccccatatccgcccacgtgcgccccagtgcggagaccctgccctcaccaccacctggatcaggccttccttcttggccactcccaccccccaccctccgcagtgcagcctggaggggggactcacgggtgcaggaagccgagggcgggtcggtgggtgagcgcgcatagctgtcctggcacacgcagaaggtggaggcgttttccagggcccggctgtgctctgggcacggtgagcagagggg

SEQ ID NO: 69442 - DNA, 358 bp, Homo sapiens
  chr1:38229885-38230243
  hyper
caactgacagcacatcggaatcgcgaactggaaggcatcagccatccagggcccagaccaaccccgcggtcaacgcctcagattccagctcctccggattctgcacctagatatgacgcctctggattcaactgagcgtatagctcccctaaatgcacaatcagaggcaagacgcgggctccagtatcgccgacagcctcaaacccggcaacgcggagcgcgcccggcagactacgctcagaattcagcactgcggacagttccatgatcagcacgtcgggcagcgcccggatccagccccctcgaccagcattccaccttctgttggccacactgtggtctcctagcccctgtagtc

SEQ ID NO: 69443 - DNA, 566 bp, Homo sapiens
  chr1:38230282-38230848
  hyper
cgcatctccctgtctccactcttcatctccccgcccccgcacctcccacctccaatcactcagcttgtccgtctcaccggccgctggaccgccgcctctggctcccgcggttcctggcctctttctttcccaacctcccgggtctccagcccccaagctcctcagcgcccctctcttcgctactgcttgatcacatttttctctgtctctccagttctttgctgcctgcttgcttcaagccccaatacagactctagtctctccaatgactccttcccccagaacccccatcgccagccccctatcttttggtatgccacgctccgagcagagctcaccagtcttctcaccttcctcggcggtcccaggccgccagggtcccaaaagcagcgcgagacagagctgcatccggcagaggaagaggcgcagcgggtgtggaccggcgcaggtctccatggtccgcagaccgagctgtcagtccggcggcggctcaagccgcgccagcctagcaccgctgagcaatgcccccagaccccagagccagcggggggcggagtctcaccgct

SEQ ID NO: 69444 - DNA, 99 bp, Homo sapiens
  chr1:38342587-38342686
  hypo
acaggcatgcctgtaatcctacctactgaggaggctgatgtatgtgggaggattgcttaagcccagcagattgaggccgcagttcgctgtgactgtgcc

SEQ ID NO: 69445 - DNA, 87 bp, Homo sapiens; identical to SEQ ID NO: 38937
  chr1:38398355-38398442
  hypo

SEQ ID NO: 69446 - DNA, 85 bp, Homo sapiens
  chr1:38456465-38456550
  hypo
attcacgtgtagaaacgacttgtctatcggcagcgaatatgttaaataaaatactgtgcatccaacgagatcaggagattgagac

SEQ ID NO: 69447 - DNA, 36 bp, Homo sapiens
  chr1:38493396-38493432
  hypo
ggccagagggaagaacgtctccgctgcttctcaggc

SEQ ID NO: 69448 - DNA, 676 bp, Homo sapiens
  chr1:38510058-38510734
  hyper
aacttttccaagtttcgtttggtgtggccaggagggcagggccccgcggggagcaggggccgcgctatgcggcggtcggtctgcagcagggcagaagccccttcccgtctgggtgtgtgggagcgcagacccctccggcgtggccgggaaccaagccggggctcggatgaaacgaaacgaaaaatgaacactcgaattttttttgttagttttttttttttttttttgcttttttttggggggagggtagggtagggaaatataaggggaaaaataaattaggctagattaaagctttggctatttcctgcttttatacacagacgcggctctcgcgacctcccctccggggccccgataaatacagtatactgcgatttaaattaagggcgcgggcggagttagaaggaccccaggagccgagaggctccacgaataaataaaaaccgtaaaaaaccaagcccggagaaaggggaaagcggggtggggcgcatccttataggagagaagaggcgtgtagcgaataaagtgacagccccccaccctggacccgcaggctcaggagtccacgcggggagaggggatggagaactctcctcgcttcgtcctctctcccggggaatccctaaccccgcactgcgttacctgtcgctttggggaggccgctgccgggatc

SEQ ID NO: 69449 - DNA, 160 bp, Homo sapiens; identical to SEQ ID NO: 24
  chr1:38510773-38510933
  hyper

SEQ ID NO: 69450 - DNA, 866 bp, Homo sapiens; identical to SEQ ID NO: 25
  chr1:38510934-38511800
  hyper

SEQ ID NO: 69451 - DNA, 293 bp, Homo sapiens; identical to SEQ ID NO: 26207
  chr1:38511821-38512114
  hyper

SEQ ID NO: 69452 - DNA, 353 bp, Homo sapiens
  chr1:38512126-38512479
  hyper
cgcctgccttgccgtgttctaggtgcgggccgccggcccaatcgccgccgccgcctcctcccgtgggtagccactgggggtgcgctaggcccacggggtggcccgcgcccgcgcccagccactcgtggtgcatcagcttctgcacttcgcggtacgcggcccctgcatgcaatcgctccgcggccgccgccgccgccgccgccgccgcggcgtccgggtgcataagcggcccggtgcccccggctccgccaccggggccccgcggcaggtactgcgcggtggtggccatgccgccccgcgccctgcgccgcgccgccgccgccgctccgctccgtctgcgggccccgccgcct

SEQ ID NO: 69453 - DNA, 90 bp, Homo sapiens
  chr1:38513064-38513154
  hyper
tcaccgcgcccgcctcgcctcccgcggctgccagcgtgcactgggcgctcctcggcgcgtctgcccggcccgtctcggctttccttctcc

SEQ ID NO: 69454 - DNA, 111 bp, Homo sapiens
  chr1:38599710-38599821
  hyper
cggagggcccagggccggggtgggggcctcgcggggttggggggactgcctatcttctcccggagcagctggggccggccacacagaaccccctctcggctcccctgcccc

SEQ ID NO: 69455 - DNA, 30 bp, Homo sapiens
  chr1:38673189-38673219
  hypo
ggagggagacaggctcgggcccattcgctg

SEQ ID NO: 69456 - DNA, 88 bp, Homo sapiens
  chr1:38953066-38953154
  hypo
tacaacttacagttgcgtcaatacaggatggagctccccagacggtgctggctgttgagtgctgcagcgagtgcgatattggcccttt

SEQ ID NO: 69457 - DNA, 20 bp, Homo sapiens
  chr1:39025499-39025519
  hyper
cggggcggggcggggggcga

SEQ ID NO: 69458 - DNA, 15 bp, Homo sapiens
  chr1:39044044-39044059
  hyper
aacttaagaggggag

SEQ ID NO: 69459 - DNA, 101 bp, Homo sapiens
  chr1:39044095-39044196
  hyper
cggcggcggcgagagcgggcgggggacacggggaccgggagacgcgatccggagagcggtgggaagtattcgcctccgttcctcaaacacaggatgcgagc

SEQ ID NO: 69460 - DNA, 269 bp, Homo sapiens
  chr1:39044197-39044466
  hyper
ccctttggagaagtcgcgctcggcggaaacgctaactccccggccaagtgcaaatgtaaagaggccctgagagcactttgtgcaaatatcaggccgggaagtgctgcgcccgcggagctgccgggcacctcggcgcccccgcgccctcggctgcgcgctaattcactttgccgtcacctctcgggcggggtcgggcgggcgcgggcagccggagcgcgcagagggcgcagagcgcctcgcagggccaggggccgcggccctgcctaatg

SEQ ID NO: 69461 - DNA, 30 bp, Homo sapiens
  chr1:39061965-39061995
  hypo
gaaagaggacaagtacggggtcagaaagac

SEQ ID NO: 69462 - DNA, 151 bp, Homo sapiens
  chr1:39075192-39075343
  hypo
gtgggtggctctcagcggaaagggaagctggaaaggggataggaaagtgatctttccctgaagccacaccatctgaagtcatcagcatctatccatagtctccgatgctcagttgcttttatgctcaccgctcagccgcttgtatcctcaa

SEQ ID NO: 69463 - DNA, 550 bp, Homo sapiens
  chr1:39269643-39270193
  hyper
ccgactagcattgatcgctttttgatcttaaaagaaatactttttaattcgaaagttaatagaaatgcggagtcaggggcaggcctcggcggcgtccgggctgggggcgaggcgcccacgccccaccctcccgctgtggccgctggcgccggcccgagcgcgcgcagcccggtgcgcttcggcgcccgctgagcccgcgaacctctccgccgcgccatcagcgcagccatcagccgcgccgcgtgctgtcccgcgccccgctgctcgcggccgcgggccaccggcggtaataatgaggcacagcgccatgaccgcggccctcggctgcgccgccggcagcagcgcgggcgccgcattagcatctccgaagccttcctgtgtgttcttttgtgctcattttccagcccgaatgctcggcacatcccggaccgcggacggagccgcaggagccaccgcggccgaacgtagctgccctggttttagaaagagctgcgggctgcgggcccggctgtccccgagacctctgcctcccgcacggcccagccagatc

SEQ ID NO: 69464 - DNA, 156 bp, Homo sapiens
  chr1:39284433-39284589
  hyper
tgctaatgatttattcgtgctcaaacgccgggggctgcgtcgccgcttttgaagacagctccaagcgtggctttccaggaaggcaggcctccccgcggcgccttccagggctccccggggcctcctccctggccgcgggtccgggctgggggacag

SEQ ID NO: 69465 - DNA, 31 bp, Homo sapiens
  chr1:39345389-39345420
  hypo
tctgttttttttgttcgtttgttttctgaga

SEQ ID NO: 69466 - DNA, 142 bp, Homo sapiens
  chr1:39416821-39416963
  hypo
tgctgtatatcataacgctgccttataaaatcacagcacatgtcagcgtcatgaagtctctaaccttctaagaagtccttcaacaaacaagtctgttcaatgttgcttcacctagcacttcccaaacttgtctgacttcttt

SEQ ID NO: 69467 - DNA, 32 bp, Homo sapiens
  chr1:39547658-39547690
  hyper
gcgcgcggacccacccgcgccgccccaggctc

SEQ ID NO: 69468 - DNA, 34 bp, Homo sapiens
  chr1:40025741-40025775
  hypo
gttagccactgtgcccagccgaggtgacaccaga

SEQ ID NO: 69469 - DNA, 696 bp, Homo sapiens
  chr1:40105024-40105720
  hyper
caggatccaggcactcgtgcgtgtaacggcacggcccgcacacgccccctacgccgacacctgtggcccccgcgctcacctgcctctgcccaggcggtgctggagggctggcccgcctgctcggcgagcccgtcgggccgacccccaccccgctcgccctccgcctgctcggtccccgcatcccggcccttacctcagctggccctcttggcccacgtcgatgggtccgtcggactccccgtcggagccgctcggctccttgggtcgcttcatggcgaacgcaggctgcctggtctcagccccgcggctaaggctcccagtcgggaagtcaggccccgccccggccccgccccggccccgcctcgggggcgccgccaccgccctttcccagggccctttcctgcgccgcagctccgggcgcccaggcgccccctcgcccccgcggtgacgcgccgccgagccgtgggaaggccctaggcggtcgccgccttcatcgacggctgggaggtccggctctgctccgctgtctcggctgccgcgcgctgggtggccttgggcaggtgccctgggaggccccgcggggaagccaggagtccccgtctgtccctgggtcgcctgggcgctgctggcctgtagaggcgccgcttcgatgcccgggattccgcaagggtcaaccctgcgcgctcctgcctcctg

SEQ ID NO: 69470 - DNA, 47 bp, Homo sapiens
  chr1:40136996-40137043
  hyper
gcctgcggccaggggcgccgatcgccccccagcgcagagtgtggatc

SEQ ID NO: 69471 - DNA, 47 bp, Homo sapiens
  chr1:40137560-40137607
  hyper
gtgcattgcttttaccgatttgggtttcttcttgggcgcgaggttgt

SEQ ID NO: 69472 - DNA, 355 bp, Homo sapiens
  chr1:40137646-40138001
  hyper
cggtctccgctcctggcccgggctcgcggggctcctggggctcccggggctgcccaggttccatgctccggctctgacccggcccggccagagcaggcggcggcgtagacgcggaggtggctggggctgggctgcaggagggaggcgagtcccggcgagggaagggggcgggcagcggcgaggaggctgtgcgtgtgagctgggctccccgcccgccgggcggggggaggtcacactggccctctcggtcgcccgtgtgtcgctgccgctgctgctgctactgctgtacggtatgagggatagctgggctctccttccccgaccgacccacgccagcagccggttgggtggtgag

SEQ ID NO: 69473 - DNA, 581 bp, Homo sapiens
  chr1:40157602-40158183
  hyper
cagtccacatctctgcgtcccccctccccacgcatccactcccctcacgccgtggggcagagaggagggtgctggttgcgcgcggagagcgcggtatgggtggcgaagtcccagcctctacctagccccgcgctagtcgtgggttccctccagccacccctctggcccttcattccggtccctccccagacgggccctcctcctttctcatggacccccaagaggcctctcgcgttctcccccgaaggacccctatgcctagccatggatcctccattccccaccctcccgttttcccgtcccgcagacggagccggtccccagccgccgccagtctccggcctcggatgttgacacaaacccgaggcggtttacactgagcgggtctggaagctttcagggccccggcaacacctcctccccgcacttgggggtctccccacagcccgggccggccgcctgggctgcactggcgtctgagagctcctgacacaaggctgtgggaaggaacccttttaagccaaactgggggcaaaaggggagccagacatccccgggctgggccacgtgcggggcaggga

SEQ ID NO: 69474 - DNA, 140 bp, Homo sapiens
  chr1:40204314-40204454
  hyper
tttgcccataataatcgggttgattcggccaaggtttccctcccccaacacggtgcgcactgggaagcgcgaggaccacgtcccttggtttaccactgcgcacctcacaaggcgcccagtgcatccgggtagcgggatgc

SEQ ID NO: 69475 - DNA, 181 bp, Homo sapiens
  chr1:40236124-40236305
  hyper
cgatctacataaatgttaggaacgtggatgtcttctggggggaaagcccccacctccacgatctcttccacctccaccgccgtgacgtctgcagctttgcacatgggcacgttgaaattgcgggcgcttctcctgaagaccacgtttcctgcccggtcggccttccaccctttcaccaggg

SEQ ID NO: 69476 - DNA, 144 bp, Homo sapiens; identical to SEQ ID NO: 26221
  chr1:40237059-40237203
  hyper

SEQ ID NO: 69477 - DNA, 140 bp, Homo sapiens
  chr1:40254091-40254231
  hyper
gccgcccccgcccagcgcgcatagcgccaggcccaggagccagagcgggccggggagcgcggtcatggcaggccgggggcgctcagctggggcgctcagcgggcgcgcatcggctccgcggccgacccagggcctgggga

SEQ ID NO: 69478 - DNA, 70 bp, Homo sapiens
  chr1:40254279-40254349
  hyper
cggggcgggacgggcggcgaccgcggcctcagcgcggtccctggagcgcccgccgcgcgacacctgtcct

SEQ ID NO: 69479 - DNA, 85 bp, Homo sapiens
  chr1:40349616-40349701
  hypo
caggcatgcgccactgcgccagaccacctgccgtcttaaatggtagatggcaaccctatctaaatagatccgtccctattattct

SEQ ID NO: 69480 - DNA, 23 bp, Homo sapiens
  chr1:40350021-40350044
  hypo
agcaaacctttggcccggcacag

SEQ ID NO: 69481 - DNA, 24 bp, Homo sapiens
  chr1:40409694-40409718
  hypo
accaggcaatataggcgtattcat

SEQ ID NO: 69482 - DNA, 27 bp, Homo sapiens
  chr1:40573661-40573688
  hypo
agactttttttttttcgagacggaatt

SEQ ID NO: 69483 - DNA, 37 bp, Homo sapiens
  chr1:4066154-4066191
  hypo
tgggattacaggagtgagccaccgctcctggcctgcc

SEQ ID NO: 69484 - DNA, 30 bp, Homo sapiens
  chr1:40722325-40722355
  hypo
tggatcaaaatgacacgattgcaaatattg

SEQ ID NO: 69485 - DNA, 1008 bp, Homo sapiens
  chr1:40781208-40782216
  hyper
ttctcctttgtctgccgcctccctcccgccctggtctcaggttagagacttacgtcgatgccgtcggatccaggcactcccggcggtcccgggggacccggggggccccgctctcccggtggacctctctgaaaaacacacacggggtggggcagtcctcagacagtgcaggaagctgggcgtccccggggctgcaagcgaccctgggagcggggtcctaggggcgcagctcttccgcgaactcccacgtattgagaatcttctgtatagcaggcactgtgtgccattacatgcattcattatcttacagaatactcagaaccgggaggcgggcgctattacgggccccagtttgcagtcgaagaaactggctcagaacgtgaagggtccatggtcactgagagtgggcggcggcgccaggagtccgccctggatctgcccgactccttccactgtgccagtttgcccttgcgcggtcgcggtggggaatagatggagacgtggacagctcaaataaatcacagatggaatgtaaggttgtgcctagcaggctgccggccctcagtgagcggtggctcgggttgttgttcttacgtgaacgacaggcagagacagcgcctcctcctctccccatggtgcgggaaaacccgacgggaaagtgggggaggcgcagagaaaggaggtgtagggaggtgaagcgggtactatcttcccactcggagcgccccttcggcagcacagctgcccggtcctccctctgctaagccctgactgctgcaggggagcaggaggagccggcacctcccagaaagcagaccctctctctggatcccgtttgcctgcaattcaatgcccctgggtgggtgtgaggtttcagggaggtcacaagtcatatcaagatgaggcgagctcacagctggagagtctccatcctgctgcccatctctgaacagatcagagatcttaaaaggcggcccttttaagaggccagctcggacccaggcaggg

SEQ ID NO: 69486 - DNA, 234 bp, Homo sapiens
  chr1:40782674-40782908
  hyper
cctcaggtggcctctcgggctaggggtgtcagtaggcgcgggacacaggcagagctcctccatcccggactccagaccccgcaccctggaccctggcagcggaggggctgcgaaacttacaatctgcgccagagcgagcactaccacctggaggagaacaaggaggctgcggggggaggccgtagcggcggccatggctggcggcgagaccaagggggacgggtgcgtgtccgc

SEQ ID NO: 69487 - DNA, 193 bp, Homo sapiens; identical to SEQ ID NO: 38813
  chr1:4082814-4083007
  hypo

SEQ ID NO: 69488 - DNA, 138 bp, Homo sapiens; identical to SEQ ID NO: 38945
  chr1:40905029-40905167
  hypo

SEQ ID NO: 69489 - DNA, 32 bp, Homo sapiens
  chr1:40974460-40974492
  hyper
agtccgctccggcagcgcgctctgcccggctt

SEQ ID NO: 69490 - DNA, 151 bp, Homo sapiens; identical to SEQ ID NO: 14198
  chr1:4111083-4111234
  hypo

SEQ ID NO: 69491 - DNA, 30 bp, Homo sapiens
  chr1:4111541-4111571
  hypo
gggagcagggagttccgcagacggcaggtg

SEQ ID NO: 69492 - DNA, 17 bp, Homo sapiens
  chr1:41117054-41117071
  hypo
gccaggggaggggcacg

SEQ ID NO: 69493 - DNA, 17 bp, Homo sapiens
  chr1:41117191-41117208
  hypo
ggcgctttattgcagct

SEQ ID NO: 69494 - DNA, 196 bp, Homo sapiens
  chr1:41267850-41268046
  hyper
ttacttgaggtcacacgtgaaactacctactccaagagccctttaggatggtgctgtgaggtggaagggcgaggccgaggcggcggtggcgtcgcgtcccccctctccgcccctggcctcggggacgcggcggcaccttcacactttccgcttggcccgctgctcgcctttcaggccgccgcgttttcaattgtta

SEQ ID NO: 69495 - DNA, 611 bp, Homo sapiens
  chr1:41284141-41284752
  hyper
ggctggctgtgatctcgccgcccccgcccctgcagacttcatcgtgttcgtggcctcggtggccgtcatcgccgcgggtacccagggcaacatcttcgccacgtccgcgctgcgcagcatgcgcttcctgcagatcctgcgcatggtgcgcatggaccgccgcggcggcacctggaagctgctgggctcagtggtctacgcgcatagcaaggtgaggcctgcaagccgcgcgcggagacccgagggcgtgtctggggcacgaccagagcgggcagggcggagagggcgaggtcagaggggctgtctccgtgctgggaaggggtgtggcctgcgggggttggagccctagcaggaggcgaggtctaagcgggtggggcgaagtggattctgaattaggtaggggcgggcctaggagtccggaccggatcagggggcggggccggagaggcggggcttgagggtttcccctggatgcttctgggtttgaagggaccactcgtaccacaaagtgggcagctgaggtgggacttgagggtggggctggagcggggctagggtgggccccaggtggaagcctgaaagtgggacttgggggacggggcaaggtaggc

SEQ ID NO: 69496 - DNA, 95 bp, Homo sapiens
  chr1:41288701-41288796
  hypo
ccatggagcccagctcggtcccacgggcaggcgggcatcaagcttgtggctggggcaggatgctgtgctcagcgcttctgcgggtgccttttttg

SEQ ID NO: 69497 - DNA, 90 bp, Homo sapiens
  chr1:41326990-41327080
  hyper
aagctgaagctggtccggtctctttcactttacggccgaggctggggtcagagaagtgaagccaaactgtcctcccgcaggaggcaaggc

SEQ ID NO: 69498 - DNA, 211 bp, Homo sapiens
  chr1:41327843-41328054
  hyper
gccggctcccccggcccgggccagcggctgctctgcggcgggagacccgggcaccgtgcggtccctgcagctcggccgggcggagcaaaaccaaacccgactggtgccccggcccagcccactactgcgcaccttgcggccgcagcctggggtcacaaaggcccgcaacctgtagtgctccgaaacctccgcgtcgcgtagctgggctcgg

SEQ ID NO: 69499 - DNA, 61 bp, Homo sapiens
  chr1:41350136-41350197
  hyper
cgcgctcaccaccaccgcggaggccgggctgtaattaggataattgcgctgctcccagcct

SEQ ID NO: 69500 - DNA, 136 bp, Homo sapiens
  chr1:41444838-41444974
  hyper
tcggtgctcagggagcgatagctagatgaaaccgtacttttcgggatcctagtccatccaaagcagccgccttcggggcaggtgtggggaggagggaggccgacgaggagccaacgccgcgcgaccctccgcactt

SEQ ID NO: 69501 - DNA, 36 bp, Homo sapiens
  chr1:41451976-41452012
  hypo
ggaggcgcagggctacgaaggcgtggttggtccggg

SEQ ID NO: 69502 - DNA, 116 bp, Homo sapiens
  chr1:41486048-41486164
  hypo
agtgcataggccttccgcggccgcctcaccacttcaatgtgctcccgcgccaccggcatctccagccgctccagggtgtctcgcagcaggcaggcaagcaccggcactgagaactg

SEQ ID NO: 69503 - DNA, 33 bp, Homo sapiens
  chr1:41602320-41602353
  hypo
ggtgtgagccattgtgcccggccatttcttatt

SEQ ID NO: 69504 - DNA, 30 bp, Homo sapiens
  chr1:4182092-4182122
  hypo
cgctggaggaaacatcgattcttctgtgat

SEQ ID NO: 69505 - DNA, 1022 bp, Homo sapiens
  chr1:41847296-41848318
  hyper
cggcacaacctgtcgctgcacacccgtttcatccgcgtgcagaacgagggcaccggcaagagttcgtggtggatgctgaaccccgagggcggaaagacagggaagaccccgcggcgcagggccgtgtccatggacaacggggccaagttcctgcgcatcaagggcaaggcgagcaagaagaagcagctgcaggcgcccgagcgaagcccggacgacagctccccgagtgcgcccgccccggggccggtgcctgccgcagccaagtgggccgccagccccgcctcgcacgccagcgacgactacgaggcttgggccgacttccgcggcggcgggagacccctgctcggggaggcggccgagctggaggacgacgaggccctggaggccctggcgccatcatcgccgctcatgtacccaagccccgccagcgcgctgtcgccggcgctgggctcgcgctgtccgggtgagctgccccgcctggccgagctgggaggcccgctgggcctgcacggcggcggcggcgcggggctgcccgagggcctgctggacggcgcgcaggacgcgtacgggccgcgggcccgcgcccaggcccggcccggtgctgggtgcgccgggggagctggcgctggcgggcgcagccgccgcctaccccggcaaaggggcggccccgtacgcgccgcccgcgccctcgcgcagtgccttagcccaccccatcagccttatgacgctgcccggcgaggcgggcgccgcgggcctggcaccgccgggccacgccgccgccttcgggggcccgcccggcggcctcctgctggacgctctgccggggccctacgctgccgccgccgccgggccgctgggcgccgcgcccgaccgcttcccggccgacctggacctcgacatgttcagcgggagcctcgagtgcgacgtggagtccatcatcctcaacgacttcatggacagcgacgaaatggacttcaacttcgattcggccctgcctccgccgccgccgggcctggccgggg

SEQ ID NO: 69506 - DNA, 30 bp, Homo sapiens
  chr1:41848613-41848643
  hyper
gggagtagggaggagcggggtgggccgcct

SEQ ID NO: 69507 - DNA, 12 bp, Homo sapiens
  chr1:41848877-41848889
  hyper
caaatcgccctc

SEQ ID NO: 69508 - DNA, 34 bp, Homo sapiens
  chr1:41848942-41848976
  hyper
cgcttctcccctcccccgtcggagtcagtccctc

SEQ ID NO: 69509 - DNA, 66 bp, Homo sapiens
  chr1:41967207-41967273
  hypo
caagagatgatgcagcgtggaccaggcctaggtgtcatcaccctggaccctcgccaggatcaccat

SEQ ID NO: 69510 - DNA, 195 bp, Homo sapiens
  chr1:41991590-41991785
  hypo
gagaggccactggcacggcacgtggaggaggcgtggcttctcaacctgtggggcgcaccttccaacgccagccagagttgccctcacatactcacgccgcaccacctgcccctgcctggttccagcacagaggggcaggaggtggctgggaggaggtgagcaagggacagcgtgtcggggcgggggggctccacc

SEQ ID NO: 69511 - DNA, 191 bp, Homo sapiens
  chr1:4212772-4212963
  hypo
gtgtttcagaatggacgcagaaccagagacagaaaatctctcctctgagctgcttggtgtcattcccccaggatgccaggaaagcctgagcccagtgctccagtgacaggccccctccccaatccaggagcgatagcagacacgaggggtgatggggatgcgacagcccgtggcagcggggccctgagtca

SEQ ID NO: 69512 - DNA, 115 bp, Homo sapiens
  chr1:42128232-42128347
  hyper
ggtcgcagatgggcccgggcgcggctggcggctgccaggggagggtctcctcgcccggggaatccctggctgccggcggccgcggggagggtctgcgcgccggcctcctcggtga

SEQ ID NO: 69513 - DNA, 30 bp, Homo sapiens
  chr1:42610107-42610137
  hypo
cacaaatggcagctgcgtcttggacatcaa

SEQ ID NO: 69514 - DNA, 23 bp, Homo sapiens
  chr1:42633276-42633299
  hypo
tgtgctgacgtgtgtgtatacac

SEQ ID NO: 69515 - DNA, 82 bp, Homo sapiens
  chr1:4279385-4279467
  hypo
ggaggcagggtggatcgtgccttcctgtgtaggtatgagcctcttccccaagatggcctgtgaccttcagagcagttaagaa

SEQ ID NO: 69516 - DNA, 78 bp, Homo sapiens
  chr1:42802583-42802661
  hypo
gcctggcctgcaattttaaatagagccgtcagcatgggcctcatttataaaatgactttaaatcggagacctgaaaga

SEQ ID NO: 69517 - DNA, 30 bp, Homo sapiens
  chr1:42803057-42803087
  hypo
agatgcagtctcagccgggcacagtggcgc

SEQ ID NO: 69518 - DNA, 99 bp, Homo sapiens
  chr1:4285363-4285462
  hypo
aaaacagtggacatgcggctgcactcacgtatccgattccagctggcttgactccagtggctaatgacaccacaatggtgagcacctctgtcacgctag

SEQ ID NO: 69519 - DNA, 75 bp, Homo sapiens
  chr1:43209082-43209157
  hypo
ctacttgcctcagggcgcacagctagaaagcaatacagccagctgtgtggccacccccaacgattctgcctgccc

SEQ ID NO: 69520 - DNA, 1 bp, Homo sapiens
  chr1:43250818-43250819
  hyper
c

SEQ ID NO: 69521 - DNA, 30 bp, Homo sapiens
  chr1:43393760-43393790
  hypo
gcctgcagcacagtccgcctgtggcaggat

SEQ ID NO: 69522 - DNA, 30 bp, Homo sapiens
  chr1:43414183-43414213
  hypo
caactgcttagtccacggctcaaaggagtg

SEQ ID NO: 69523 - DNA, 57 bp, Homo sapiens
  chr1:43446019-43446076
  hypo
tcctcatacctgccccgctccgatgaggctccctccaggctccgcatcttgacttag

SEQ ID NO: 69524 - DNA, 16 bp, Homo sapiens
  chr1:43531822-43531838
  hypo
gcgcccagccaagatg

SEQ ID NO: 69525 - DNA, 20 bp, Homo sapiens
  chr1:43533892-43533912
  hyper
ggcaggcggggtgtgcgccc

SEQ ID NO: 69526 - DNA, 131 bp, Homo sapiens; identical to SEQ ID NO: 26234
  chr1:43534114-43534245
  hyper

SEQ ID NO: 69527 - DNA, 369 bp, Homo sapiens
  chr1:43613473-43613842
  hyper
tggcagagtgagacccgccccgaccgggcagcactacccgagcgctgttgcctggagaccacgggacgccgttgcctggagacagcggggacgcgttgcctggagactgtggaaggcccaggcaagagggcgcgtggcagcccaaggccatggcgggacacccaaaagagaaggtgattccagatgaggtccatcagaaccagatcttgcgggaactgtacctcaaggagctacgaacccagaaactctacacgcagtatcacgtgaatcccctccgcaagagtgagaggcacggcggggtgggggaagggcgagagcgggagggcgccggggaaggaggagccctccgggttgcggggtgggaacgcg

SEQ ID NO: 69528 - DNA, 30 bp, Homo sapiens
  chr1:43750677-43750707
  hypo
ctgcagggagctgggcgttcagcccctcag

SEQ ID NO: 69529 - DNA, 30 bp, Homo sapiens
  chr1:43752107-43752137
  hypo
tggaggccccgaattcgcaaggataggccg

SEQ ID NO: 69530 - DNA, 30 bp, Homo sapiens
  chr1:43787010-43787040
  hypo
ccccaccttaccccacgtggagccctggac

SEQ ID NO: 69531 - DNA, 92 bp, Homo sapiens; identical to SEQ ID NO: 38953
  chr1:43826882-43826974
  hypo

SEQ ID NO: 69532 - DNA, 91 bp, Homo sapiens; identical to SEQ ID NO: 38954
  chr1:43834716-43834807
  hypo

SEQ ID NO: 69533 - DNA, 177 bp, Homo sapiens
  chr1:4385832-4386009
  hypo
ccctgcagggagctccggggtgtaggttgtccctctgcatttatccctattagaagcgagagagctgtgctgttctattcctgcaccggccagcccttgacctaggcaattgtggggttgaagtggaggttgagggggaagaaagtaaatttctggacattccggctcactgatttg

SEQ ID NO: 69534 - DNA, 89 bp, Homo sapiens
  chr1:43893329-43893418
  hypo
gctgttcactggaagcgctgagggaacaaatggttggcatgcagccccctcaggcgccccgagacctcatcttccggtgagtgccttca

SEQ ID NO: 69535 - DNA, 49 bp, Homo sapiens
  chr1:43919778-43919827
  hyper
ggctgcccgagggcccggttgcaatgatgggacgcgcactttaatactg

SEQ ID NO: 69536 - DNA, 57 bp, Homo sapiens; identical to SEQ ID NO: 38955
  chr1:43991727-43991784
  hypo

SEQ ID NO: 69537 - DNA, 30 bp, Homo sapiens; identical to SEQ ID NO: 38956
  chr1:44000506-44000536
  hypo

SEQ ID NO: 69538 - DNA, 30 bp, Homo sapiens; identical to SEQ ID NO: 38957
  chr1:44016696-44016726
  hypo

SEQ ID NO: 69539 - DNA, 152 bp, Homo sapiens; identical to SEQ ID NO: 38817
  chr1:4402113-4402265
  hypo

SEQ ID NO: 69540 - DNA, 57 bp, Homo sapiens
  chr1:44043730-44043787
  hypo
ttttgctacccaccccgatcctggctcctgtctgtccgtctgcggccagagcagccc

SEQ ID NO: 69541 - DNA, 115 bp, Homo sapiens
  chr1:44068774-44068889
  hypo
gatatcctcagtctccgttcacagcacagtggagtgagggaaacagtctggccctttgttcttgtctgaaaagaataatgagctgtctgccccaggcgtgcggctcctgggatgg

SEQ ID NO: 69542 - DNA, 214 bp, Homo sapiens
  chr1:4426176-4426390
  hypo
ccagatgccacacatcggcctgcaccttgacgttggatttccagactgcacagctgtgagaaggtgcatttctgttatgtaagccccacagtctacggtgttttgttgtgggagcccgagtggactaacacagtggaggacccagagacagcagtgggtggagagtatccaggcagagccacccccgctgcagagggcccggggcagggaccca

SEQ ID NO: 69543 - DNA, 30 bp, Homo sapiens
  chr1:44304865-44304895
  hypo
ccctttcttttctaacgtgagcagtctcag

SEQ ID NO: 69544 - DNA, 142 bp, Homo sapiens
  chr1:44351091-44351233
  hypo
cctgaggctgcctcgcgtgccggggtgctggcggggctggcgggctggggcctgtcttttggagcctgccccaccctcccctgctaccccctaggccagggcaagcaggtcaggcgtcccacacccccgctagtctgaccag

SEQ ID NO: 69545 - DNA, 30 bp, Homo sapiens
  chr1:44396459-44396489
  hypo
ttcttggggagaaggcggggtattcccact

SEQ ID NO: 69546 - DNA, 351 bp, Homo sapiens
  chr1:44401909-44402260
  hyper
gagagggcgagggggcggggcggggctggcccgggacaccgcgcgtgactgggtctcattccagggggacgcacggcccgctggtgcagtggaagagcccggcggccgccgccgcagccttctcggcccgcgcccccgccgcctgcacccccatctgctcttccccgcgggggccgcgcggcgcgggctgggggcccgggcagccgcgctcgggcagcgggggcgcggggctgccgcctgcgctcgcagctggtgccggtgcgcgcgctcggcctgggccaccgctccgacgagctggtgcgtttccgcttctgcagcggctcctgccgccgcgcgcgctctccacacgac

SEQ ID NO: 69547 - DNA, 45 bp, Homo sapiens; identical to SEQ ID NO: 38961
  chr1:44463208-44463253
  hypo

SEQ ID NO: 69548 - DNA, 173 bp, Homo sapiens
  chr1:44463830-44464003
  hypo
tgtcaacatctgggccgtggaagaagcaggcagggccgggggccggagcgcggtgagtgggaaggctctgcggaagggagaagtctgtctttgccacagtcctgaactggccaagcacagtagagctgctgccgcctttggaatcagtcagttctgctcgctatggctcccca

SEQ ID NO: 69549 - DNA, 150 bp, Homo sapiens; identical to SEQ ID NO: 38963
  chr1:44497521-44497671
  hypo

SEQ ID NO: 69550 - DNA, 146 bp, Homo sapiens
  chr1:44584392-44584538
  hypo
cctggggcagggctgcgagggcggcgcagggcgggacgggtggggcctgaccccgccccttggcgcagctgtaaataggtaaatagaaggtgattgtggcgtggcgatgtaccgatacccgcctgcgacgccgtggtggctggttc

SEQ ID NO: 69551 - DNA, 92 bp, Homo sapiens
  chr1:44718072-44718164
  hypo
ctgcgacgggcctgccgcatagccctgctgtaggtgcggcgggtggccccctgtgtaacagggagctttgccattagcgcctttaatattct

SEQ ID NO: 69552 - DNA, 423 bp, Homo sapiens
  chr1:44726893-44727316
  hypo
aggagcggggtgggccggctggcagatctgagagcgtggcacgccccagcgggcagggcgcacagcgcggaggaaggcgcgagtcagtctggagtgctccccatttatcaagctcacgcaggccgccagccgagcgagtctttctatcattacacctctcaaaatccgattcataccactaatcctgccttcattctcccagattaataacatctctttcaaccttcacagtgtgataaatagacaaagagagaacaaaaggagagacagaagagagagaaagagctggagcaagtccccataatagagagagctgagaaagaggagagggaaaaaaggagagcgaacgagagcaggcagcggccagagactgcagctaccttagagagccgctctgaggagagctggcggctgcgccccgct

SEQ ID NO: 69553 - DNA, 30 bp, Homo sapiens; identical to SEQ ID NO: 38967
  chr1:44794138-44794168
  hypo

SEQ ID NO: 69554 - DNA, 71 bp, Homo sapiens
  chr1:4486495-4486566
  hypo
aggcagctcactgcacggttgtttgcggaatgaaacgactttgccaaagccatggccgcagacatacgatg

SEQ ID NO: 69555 - DNA, 26 bp, Homo sapiens
  chr1:44871018-44871044
  hyper
tcgcgaacacaaacccggggccagcc

SEQ ID NO: 69556 - DNA, 86 bp, Homo sapiens
  chr1:44871104-44871190
  hyper
ctctgcgaacccgggacttttcatgcaccacactctccgcctgcttccctccgtgtcctgaaaagtgcgaccgttctcccaaggaa

SEQ ID NO: 69557 - DNA, 430 bp, Homo sapiens
  chr1:44872293-44872723
  hyper
gcgaccttctctgcccggaacccagccccgccaccgcactccggagcctccggcctcccccaccccacccccgccccccaacccggggcttttcagggctcggcctgggcgtttcgcctttgtgctttgtaagagaaagccttttcttccagggcacaacaaacttgggcggagagcttccgtgtggccccccgggcgaggccgcccacggtggtgaggccatccgaggggatgcccggttcatcccccagtccaggagcctctccgagagctcgcggcccaggtcgaccccagctggcgagggcgcgcaggagtcccgaagtagcggggactagggcagccaggaggcagggggaaagctctcgcttcccgttaagcacaccctgcattctcgggtcgtggatgcagctccagcggagagcccgtgttc

SEQ ID NO: 69558 - DNA, 141 bp, Homo sapiens; identical to SEQ ID NO: 28
  chr1:44872923-44873064
  hyper

SEQ ID NO: 69559 - DNA, 108 bp, Homo sapiens; identical to SEQ ID NO: 29
  chr1:44873065-44873173
  hyper

SEQ ID NO: 69560 - DNA, 336 bp, Homo sapiens
  chr1:44873509-44873845
  hyper
gggtgacccccggggcggggctgctcgggggctggaggtccttggactttggtcgaaggctggcagctctgagcccctgccccgcgggccccgcgcggctgcggaccaggggcccttgcacgtgtcggttcttcctggactggcgctttggttgcccaaagttgggcgcagattgtttcgtgcggaggttgttgggacccagagtattctatatacaaaggcaaccgagagccggagggagaggtcgggccaaagagtagtgggctcggctccgcgttgggcccaagtttatgtaggtttcgccttcacctcttcttcccccgttttccctaaaag

SEQ ID NO: 69561 - DNA, 146 bp, Homo sapiens; identical to SEQ ID NO: 26241
  chr1:44883069-44883215
  hyper

SEQ ID NO: 69562 - DNA, 372 bp, Homo sapiens; identical to SEQ ID NO: 26242
  chr1:44883751-44884123
  hyper

SEQ ID NO: 69563 - DNA, 82 bp, Homo sapiens
  chr1:44884203-44884285
  hyper
cgttaaagtctgggcaatttctggaactcttcccacgggaagttttccggggctgccttccggtcagcggccccaggttgat

SEQ ID NO: 69564 - DNA, 30 bp, Homo sapiens
  chr1:45063652-45063682
  hypo
tctctcgttctctctcgaacacaggtgtac

SEQ ID NO: 69565 - DNA, 62 bp, Homo sapiens; identical to SEQ ID NO: 38968
  chr1:45103094-45103156
  hypo

SEQ ID NO: 69566 - DNA, 49 bp, Homo sapiens
  chr1:45106627-45106676
  hypo
tttcaggttccaggacgatactgcccccagtaaacgggcatctccagtt

SEQ ID NO: 69567 - DNA, 38 bp, Homo sapiens
  chr1:45156636-45156674
  hypo
aaggttgttgaggggcggggcgcggtgactcacgcctg

SEQ ID NO: 69568 - DNA, 30 bp, Homo sapiens
  chr1:45194741-45194771
  hypo
aagctcttgtctcaacgctattgtactgac

SEQ ID NO: 69569 - DNA, 18 bp, Homo sapiens
  chr1:45197991-45198009
  hypo
ttttttaaagagtctcgc

SEQ ID NO: 69570 - DNA, 20 bp, Homo sapiens
  chr1:45240494-45240514
  hypo
caccgcgccaggcctaaaaa

SEQ ID NO: 69571 - DNA, 154 bp, Homo sapiens; identical to SEQ ID NO: 26243
  chr1:45250008-45250162
  hyper

SEQ ID NO: 69572 - DNA, 197 bp, Homo sapiens
  chr1:45250192-45250389
  hyper
cgggagcggggacgcgggatcggctctcggggaaggaccgaggcatcggtgccccagaggctgagcgaggacccgcgtgccgggtcaggcccagtgcaagccactcaccgcaggttgaaggtggagcccaggaatgagggccgcagagactcggccgccgtggccacagtgtagggtggctgcggctggtcctcatc

SEQ ID NO: 69573 - DNA, 434 bp, Homo sapiens
  chr1:45251837-45252271
  hyper
agtacttgttgaagtcggatttcaggctctcaaactttttcctctcttcctgggacatgaaacctgagggggtaaagcaggtggggtgcagttgcaccctctgccgccaggggaggctgctgttccgccgtctggctcccctccctcgcgtccaccggctgtcccaggactcgcggttccgcgttcctgtcgcagtccagacccttccctggaggcccctgctcccaggactctcccaggcgccacctgcatccggctgtgggccggacccccagaggctcccggcgggcggcgcacctgcgtccaccacgtgctccatggtggggaagcgcttaagcacgcgggtgctgaccgagcgcagcaccagcacggacgccaggttcgcgtagcggatgagggtgcggcgcagcaggcggccccgctggtccacgccg

SEQ ID NO: 69574 - DNA, 24 bp, Homo sapiens
  chr1:45264938-45264962
  hypo
aggcaaggtggctcacgcctgtaa

SEQ ID NO: 69575 - DNA, 100 bp, Homo sapiens; identical to SEQ ID NO: 38971
  chr1:45280516-45280616
  hypo

SEQ ID NO: 69576 - DNA, 100 bp, Homo sapiens
  chr1:45293217-45293317
  hypo
tcaccagggccacctcgtacagggagaagtacctgagctgggcgctcaggaaggcatgctccttggtgccccgaggcaccacatccgtcagggccaggcc

SEQ ID NO: 69577 - DNA, 80 bp, Homo sapiens
  chr1:45308235-45308315
  hypo
accgcgcccggccggcataggcccattttctgagagcaggatacatatgtacacacacctgtcgtcgggtggacacagag

SEQ ID NO: 69578 - DNA, 113 bp, Homo sapiens
  chr1:45308747-45308860
  hyper
gtgtgggtgttaaagcggctgggagggaggagtgcagggagctgcgggtccggggcgcggcgccgggattcacccgctccgtgggccgtgggccgcggcggctggaggaggaa

SEQ ID NO: 69579 - DNA, 75 bp, Homo sapiens
  chr1:4542688-4542763
  hypo
ccgaacgctgtcctgcgtggccaccacgtgctcctccctgctgcagccctgccctcccgccgggcctgcatgtcc

SEQ ID NO: 69580 - DNA, 104 bp, Homo sapiens
  chr1:45466045-45466149
  hypo
cacgccactgcactccaacctgggcgacagacacgctgtataaataataataataataatggttaaaatgagtgcccccttggcccagtcgtcatcatttcctg

SEQ ID NO: 69581 - DNA, 30 bp, Homo sapiens
  chr1:45468126-45468156
  hypo
ccatcttcttggctccgagtaggacactaa

SEQ ID NO: 69582 - DNA, 16 bp, Homo sapiens
  chr1:45645619-45645635
  hypo
aggagccaagatggcc

SEQ ID NO: 69583 - DNA, 23 bp, Homo sapiens
  chr1:45936888-45936911
  hypo
caagactccgtctcaaaaaaaag

SEQ ID NO: 69584 - DNA, 38 bp, Homo sapiens; identical to SEQ ID NO: 14239
  chr1:46079131-46079169
  hypo

SEQ ID NO: 69585 - DNA, 68 bp, Homo sapiens; identical to SEQ ID NO: 38821
  chr1:4652230-4652298
  hypo

SEQ ID NO: 69586 - DNA, 94 bp, Homo sapiens
  chr1:4659147-4659241
  hypo
gaacgcaaggccctccgggtggctgagtcagtatgctctgtgagaattgcagagggacagagaaagtttgagcccggccgggtgcggtggctca

SEQ ID NO: 69587 - DNA, 93 bp, Homo sapiens
  chr1:4659541-4659634
  hypo
tcctccattccctattatgaaaggctctgaaggtagatagtttagaaagggctgcctcgggcagggggctgcatagagcgatgagtctatggt

SEQ ID NO: 69588 - DNA, 76 bp, Homo sapiens
  chr1:46632620-46632696
  hyper
ccgcacttctagctgcgttcaaccaggctcaggaggtccttcaagatcttggcttccttttcctgactccgcgccc

SEQ ID NO: 69589 - DNA, 275 bp, Homo sapiens
  chr1:46632697-46632972
  hyper
gcgcggttaattatagccccaccccgcgactacctgcttcgctcccacccgcgcgcccaggaccctagctgcgggactctagcggggaaggcacccccaattctgggccctggcgaccttgggtcagggccaggaaaggcacttccagccaagcgctggcgccgggtgcgcctcgctttacggaaagaacgccccgcgaataaatccggagcggatttgcatcacagcagccgcgagaaggctagctgctgccaaagctccgaagctctggatgt

SEQ ID NO: 69590 - DNA, 41 bp, Homo sapiens
  chr1:46653449-46653490
  hypo
aacaaacactgaaggcgtcagggtggcgagatatgtccaag

SEQ ID NO: 69591 - DNA, 40 bp, Homo sapiens
  chr1:46668917-46668957
  hyper
gaatacatccacagacggtgctgcgcggcttttctgagtg

SEQ ID NO: 69592 - DNA, 44 bp, Homo sapiens
  chr1:4673712-4673756
  hypo
caggccatgtgcacacgggggcaggtgcccgcaatcacttaaca

SEQ ID NO: 69593 - DNA, 124 bp, Homo sapiens; identical to SEQ ID NO: 38823
  chr1:4677050-4677174
  hypo

SEQ ID NO: 69594 - DNA, 51 bp, Homo sapiens
  chr1:46859925-46859976
  hyper
ccggctgatccagtccgggttttgcggcggagcgggcgggctgcgcgtgcg

SEQ ID NO: 69595 - DNA, 30 bp, Homo sapiens
  chr1:4691300-4691330
  hypo
ttgatgattgagccacggggctggtctttc

SEQ ID NO: 69596 - DNA, 218 bp, Homo sapiens
  chr1:46913659-46913877
  hyper
gggccctgactaggacgttacgggaagggggtcttgaattctgatctcgtttctgcctaagacctatcgcctttttgaacctcagtttcccctttggctgcatagggaaggggtgcccacatgcccccgcccgcattcagttcgaaggaccagccagtaggccctgcgccgcccagggaccgcccggcctttgcgtccggcccagctcaagccccttc

SEQ ID NO: 69597 - DNA, 360 bp, Homo sapiens; identical to SEQ ID NO: 1693
  chr1:46913886-46914246
  hyper

SEQ ID NO: 69598 - DNA, 257 bp, Homo sapiens
  chr1:46914285-46914542
  hyper
cgcggagggccggacgggagccaaggcggctcagttcctcttctcccccgagcaggcgaggagaggtggggtctcaggacctccaaggccctgttccccttccattggcatttgtgtaaggacgcaggccctccgcactgctgactgtggcactgggcagggagtcccctagactaggggtttggggttagatctggggctcaggcagcgctgggctgggcgtagtttgcagagggaccggccgtcctggcaggaaa

SEQ ID NO: 69599 - DNA, 111 bp, Homo sapiens
  chr1:46921772-46921883
  hypo
tattcatcaccagctcgtggcgccggcgccgacgctgatacaatattagtgttgccccccctttcggagcccgctccgcccggctccccgatggcacgaatccatcacctg

SEQ ID NO: 69600 - DNA, 249 bp, Homo sapiens
  chr1:46932507-46932756
  hyper
tgggaaaagtttactcgggcggagggggcggagactcccccgggcgggcggccgggacttctcccagccgggtgaatggaggacccgcctgcaggagcagccgcgaaagagtggagcgggcgcgcctgctgagccacagccacagcaacactttgcaggcgtgcacactcacacgcacacccaggccacaacagccgtgtctgcaccagcccacgggcgcacgcgcgctgcccacgatcaccctcccaa

SEQ ID NO: 69601 - DNA, 149 bp, Homo sapiens
  chr1:46951169-46951318
  hyper
gggggtatctctgagcggtgaaggggagtagccgtcggagggcggggacagagcggtagctgccttgcgctgggattgggggtgggggtgggagtggggagggctctttaagcggcggccgcgctaataacctgtccaggagatggctc

SEQ ID NO: 69602 - DNA, 118 bp, Homo sapiens; identical to SEQ ID NO: 26252
  chr1:46951644-46951762
  hyper

SEQ ID NO: 69603 - DNA, 40 bp, Homo sapiens
  chr1:46954864-46954904
  hyper
ccgcgagttccagcccgcggcctcccggcccagaggccaa

SEQ ID NO: 69604 - DNA, 375 bp, Homo sapiens
  chr1:46956241-46956616
  hyper
cagcttcctggtccacgcgaaccccgcagtgctccgggcattgcccgggtctggctttggtctcgcccgcgcagatcccgttcaaactcagctgccaccaagtgcgccttttctctctggattgcgattctgcacgaattttccagttgagggtggttcggcgctcagccagcctctgccctcgaagacgcggccttggtctaggaaccttcaggtgggtgtttggggcgcagtggccctagttccctagaattcgttttgcctcccgcggcctcagccggcgtgggtcaggcgagctccggcgaggaacggcaggctggggccagtccccggagcggctctcggggcgcttctaggggagcagtcaaagggttg

SEQ ID NO: 69605 - DNA, 155 bp, Homo sapiens; identical to SEQ ID NO: 34
  chr1:46956684-46956839
  hyper

SEQ ID NO: 69606 - DNA, 331 bp, Homo sapiens
  chr1:46956840-46957171
  hyper
caccaaatctggggccccgacttttcctggattccagccacactcggtttgggaggcagtgggctcctcaggcttgtgatttgcggcaggaaggagtcccggaatggaagaacggggaggacgagatccgaggccttttcaccctctttgcaagcatgcagttcaccaaagccgagaacccaccgggcctggagcgcagcctcagcgctggttccgacccgggccccagaaggtctttttcgtttgagaaaagtcctcggaggccggggcagggtgcgccgatattggtttactaagggcgcctccagtttgagggcgttggggaaagagg

SEQ ID NO: 69607 - DNA, 30 bp, Homo sapiens
  chr1:46958750-46958780
  hyper
cctgccttcccatttcgccccccaccccac

SEQ ID NO: 69608 - DNA, 101 bp, Homo sapiens
  chr1:4696797-4696898
  hypo
agaggacttcggggacgagcacacgaggcaatggcagcgctgaggaaggagcgggcgatgtaatggtgagtaccaaggagcacgcccggaggaaagaggag

SEQ ID NO: 69609 - DNA, 350 bp, Homo sapiens
  chr1:46998912-46999262
  hyper
gccgccgagcgcccacggggcgcgaggccccggcggctacacacgcagcaggccgcgaagaagccgagcgccagcaccagcagcgccagccccacgacgagcagcgcgttgtgctcgggcaagaaggaggcgaaggcgcctgccagcgtcacgttcacgcccgccagcagcgcgcacagaccgcaggcgcagcacagcgccggcgacggcaggccgggcacccggccccgggcgcgttccgcgggcgccgggaccggtggcccctcgctcttttctgccggcggcatcggcctgcgcacgccaggcacgcatcaagctccctcctgccgccggcccggaacagcccaact

SEQ ID NO: 69610 - DNA, 437 bp, Homo sapiens; identical to SEQ ID NO: 26256
  chr1:47009449-47009886
  hyper

SEQ ID NO: 69611 - DNA, 126 bp, Homo sapiens; identical to SEQ ID NO: 37
  chr1:47009910-47010036
  hyper

SEQ ID NO: 69612 - DNA, 28 bp, Homo sapiens
  chr1:47010104-47010132
  hyper
cgtccgcactttccgagagccaggcacg

SEQ ID NO: 69613 - DNA, 30 bp, Homo sapiens
  chr1:47041243-47041273
  hypo
acttgtggccttccccggtgagcactctct

SEQ ID NO: 69614 - DNA, 23 bp, Homo sapiens
  chr1:4711648-4711671
  hypo
taataataagctgggcgcggtgg

SEQ ID NO: 69615 - DNA, 355 bp, Homo sapiens
  chr1:4712671-4713026
  hyper
aggggttcctggagccgacacggtccggtccggagcccctccctgccctgctggctcctagtgtgcgaagccggccccttccaggcccactccggttgcaggaagggcctccctggtgcagcaccgcctcctcacaccgctaggtggcagcactgccggcgcctccttccccgccggccgccataggccccgctggttccaggacctccctgcctccttcgcctcttaatgggatccgctccctcacacccctcagggagaggctctaggggacgatgacccaggggcggcccggcagggaaactgctgagtcaccctgctgcctctcgggtcctctgaccggctcacagatcac

SEQ ID NO: 69616 - DNA, 131 bp, Homo sapiens
  chr1:4713944-4714075
  hyper
ttccagtgactcctccggagcaagggcctggccaggcagcagctgcgctgggcgatgagggaccgttgggtaattgggggcataggaccgggcttcgctgggttcggggcagaagcgccgaagctccgacc

SEQ ID NO: 69617 - DNA, 199 bp, Homo sapiens
  chr1:4714163-4714362
  hyper
cggcccgcgtggctcagctccgccccaggaaacttttcgcgcagcccccgctccatgcgcccccacccagtccttcttcggggccgccccctccccaaagtagctctccgggtccactgggcgcccccgtaaccgggtcggaacctcgaacggcttcgcgtgccatccggttaccctggcaacaccatccggcggcgcc

SEQ ID NO: 69618 - DNA, 113 bp, Homo sapiens; identical to SEQ ID NO: 4
  chr1:4715427-4715540
  hyper

SEQ ID NO: 69619 - DNA, 963 bp, Homo sapiens; identical to SEQ ID NO: 26018
  chr1:4715574-4716537
  hyper

SEQ ID NO: 69620 - DNA, 126 bp, Homo sapiens; identical to SEQ ID NO: 5294
  chr1:4716538-4716664
  hyper

SEQ ID NO: 69621 - DNA, 235 bp, Homo sapiens; identical to SEQ ID NO: 38825
  chr1:4726593-4726828
  hypo

SEQ ID NO: 69622 - DNA, 137 bp, Homo sapiens
  chr1:47691603-47691740
  hyper
ccgcccctgacccaccgacgtgggctggggtaaaggggagaagggcagagagaggaactcacgcaccgagacgtgagaagaggcagacaaagttagcgccacgtggggctagggcgggaggccggttggggctaggg

SEQ ID NO: 69623 - DNA, 135 bp, Homo sapiens
  chr1:47694793-47694928
  hyper
ttcctcaccccaggccggaacacaaggccttcctagacaccgtttccaccggcaccattcccctgaaaactcacctggggcatatttagagagaccggcccctctgaataggatctccactccgccggaaagggg

SEQ ID NO: 69624 - DNA, 607 bp, Homo sapiens; identical to SEQ ID NO: 26261
  chr1:47694979-47695586
  hyper

SEQ ID NO: 69625 - DNA, 625 bp, Homo sapiens; identical to SEQ ID NO: 26262
  chr1:47695896-47696521
  hyper

SEQ ID NO: 69626 - DNA, 345 bp, Homo sapiens; identical to SEQ ID NO: 40
  chr1:47696620-47696965
  hyper

SEQ ID NO: 69627 - DNA, 269 bp, Homo sapiens
  chr1:47696986-47697255
  hyper
cgcccccaccagcgcctcgatctctcgctcgccctccccccactcccgcccccagcgatttgcaaacgcacctctaaaggacacaggcacacaggcatacaactcagtgcggacaggaccacacagggtccagccccacagaagggcagcaaacaaacaccacctagcactgccccagaagccgacttggtcagccccgcacactgcccaacaggacacaacgaaatcagtcaaacgcagcggctcacggacacacaatccagcacagt

SEQ ID NO: 69628 - DNA, 668 bp, Homo sapiens
  chr1:47697279-47697947
  hyper
cgacgacaccacccaaacacagtcgcaggggccacacacccccacacacagaatcagatccctgctgagaacaccaacggagcacaatcgtacgcaacgaagaaaacgcagaagggcctcgaagggtccacatctacacaccccaaccgcgcaggcacaccacactcggacacagagcctgtcgccaagaagaccacacttagaagcagccaacgccgcccacagttctcatgaacgcactctcacaatcccaccgcatgcacacaaccacgaagaagaaatgaaaaccaaccacagcctcgcgcatttctgtatattgcgtaaggaaaagggggaaggaaggaagagagtctccgaggcgggaggggcggcggcagccggggcgggggcgtccgtggaaaatgcccccccaccgccccccccggccatcgaaaggaaccgagggaaagggagcgaagacctcttttgcggacgtggggaaaaagaggaggaaattgatgaagaattcggtgggaggccgcgggttgcttttcccctagaaaaaggccagaatgctcacgtttttccgctacgggggtacgcgtgtggccattttgaggcccggtcctgagcggcggcggcccggcccctcccgcggcccccgctcccccgcccgccccgcgcccgcc

SEQ ID NO: 69629 - DNA, 204 bp, Homo sapiens
  chr1:47698006-47698210
  hyper
cgaggcgcgccggggccgtgtgcgccgcagagataaggcactgccgcgggtccgcccgcccccgataagcgcctcggccattatgggccaaatgattcattttaatttggcaatttcaccggagggagtggggactggttgagcggcgctaggaccggctccggaacgcgctgcggggagcgttggacgcgctgtctaggaccc

SEQ ID NO: 69630 - DNA, 30 bp, Homo sapiens
  chr1:47701225-47701255
  hyper
cacccctcctccacccgccccaaacggagg

SEQ ID NO: 69631 - DNA, 120 bp, Homo sapiens
  chr1:4771547-4771667
  hyper
cttacgtcctctcgtcgtgtgatgggcaaaaggaaggagggactcacaggtcttttcaggttatcttgtcgaggctgccctgaaaggctgggggtttctgaggctcggttttcgctcgcg

SEQ ID NO: 69632 - DNA, 224 bp, Homo sapiens
  chr1:4772478-4772702
  hypo
ggggcccacgggggacgaggaggccctggagtccaacacatttccgggcgtttacggccccaccacggtctccatcctacaaacacggaagacaactgtggccgccaccaccaccaccaccaccacggccacccccatgacgctgcagactaaggggttcaccgagtccttggatccccggagaaggatcccaggtggggttagcacaacggagccttccacca

SEQ ID NO: 69633 - DNA, 84 bp, Homo sapiens
  chr1:47749513-47749597
  hypo
atatacacacaaaaccgttgacactgagcaataaaacccatttcttagcttttttttttgcgggggggtggggggtggatagag

SEQ ID NO: 69634 - DNA, 177 bp, Homo sapiens
  chr1:4782333-4782510
  hypo
ttagcagcaccgagccgcggggcaggtgcaagttcacagcgcagaggcgatccgtggtttgcacacttgtcctgtgcacggcaggacctgtggcgtccatacctgcctcattctgtgactgttatgaatctctgctctagtcctagacattccgaaagcagccgttcacccagctgg

SEQ ID NO: 69635 - DNA, 268 bp, Homo sapiens
  chr1:47881997-47882265
  hyper
gcagcgacatggatccgcccgccgcgttctctggcttccctgccctgccagcggtcgcgccgtcggggccgccgccgtcgccgctcgcaggagccgagccagggcgggagccagaggaggcggcggctggccgcggagaggcggcccccacgcccgcgcccggcccggggcggcggcggcggcggcccctgcagcgcgggaagccgccctactcgtacatcgcgctcatcgccatggctctggcgcacgccccgggccgccgcctcac

SEQ ID NO: 69636 - DNA, 122 bp, Homo sapiens
  chr1:47882266-47882388
  hyper
ctggccgccatctaccgcttcatcaccgaacgctttgccttctaccgcgacagcccgcgcaagtggcagaacagcatccgccacaatctcacgctcaacgactgcttcgtcaaggtgccccg

SEQ ID NO: 69637 - DNA, 100 bp, Homo sapiens
  chr1:47882747-47882847
  hyper
ctgccgccgcctccccgccactctactcgcaggtccccgaccgcctggtactgcccgcgacgcgccccggccccggcccgctgcccgctgagcccctcct

SEQ ID NO: 69638 - DNA, 83 bp, Homo sapiens
  chr1:47904375-47904458
  hyper
gcgagccgggcaacccgggcaagggcaactactggacgctggacccggagtcggccgacatgttcgacaacggcagcttcctg

SEQ ID NO: 69639 - DNA, 113 bp, Homo sapiens
  chr1:47904617-47904730
  hyper
gggctggctctcccggcctacggcgcacccccgccggggccggccccgcatccgcacccgcacccgcacgccttcgctttcgccgcggcagccgccgccgctccttgccagct

SEQ ID NO: 69640 - DNA, 718 bp, Homo sapiens
  chr1:47909442-47910160
  hyper
gcagcccaattaaagcggttaattcttttcaccgcttattcctccccatctttctttctttctcctggggctcctcggaccacccaggagccggagttgaggtgggggcggacacttcccctccatatccaatttgctcttgccacagcgggcgcgtcttcgtggttacaaagcgctttttccctgatgacttttttccccttttcaaaaacacttctttctccccccttcaactagcaaccctccccaggcccacccctcctccctctccgctccggtttatttaaacttcgcctcctccagcgccgccgcagcgcgcacttaatgaagttgaaggctcggtgagcccgggtgaagagggtttggaatctgttgaaaggggcgttttgtgacactgattggggcgggggcgggggcagtcgcggaccagacaatgaccgaccaggcgggttttcctgcgcacagggtcaggcgaataaaggcgccgacgctgtttaaacgaaggaccttgtaagagaaagggagaaaagattttgtgtgtggagcgtgcctcgtaaggtttcgtgcttaggagaagttgggaggaggcagctcgcctagagtctttacggaccgaattcggagtttatttcgaacactatgcatcaagccaaagaaaagcggggccagtttgggtttgcgcctaacttaattccgatacgcgcgtcaaaatgttgtg

SEQ ID NO: 69641 - DNA, 191 bp, Homo sapiens
  chr1:47910434-47910625
  hyper
ttccagctctagtttcgggaacggatttttccgcgggctagtgggcgcggcgcggcgcagggcggagcgggcaccgcctccttccgtagcggagcgagagctgccgctcgaggctgaggccgctccggaggcctggaggcttcggactgctggactagtggggaaggaaggcggtttcctccgcagcgccc

SEQ ID NO: 69642 - DNA, 285 bp, Homo sapiens
  chr1:47910748-47911033
  hyper
cgctcgctgtccgcgactttgcatttctcctgcagcaggggtctctacccggtgccttcctcccggcacgctagcctcctcgccgaaatttcgtcgtcccggagtcggtaaccgagtcccaggctttactgccactccactccctgctgggttatttaagagatacgcggcttccgaggggttttcatcagaccccgcaagtgcgctcggctgggaaggatgcgctccgatgccgctacaggggttccgcgcgtttcaccgcgggaagcccgggcattggagatc

SEQ ID NO: 69643 - DNA, 30 bp, Homo sapiens
  chr1:47911260-47911290
  hyper
gtgtgtgtgtggtggcggagggtggggtaa

SEQ ID NO: 69644 - DNA, 15 bp, Homo sapiens
  chr1:47911816-47911831
  hyper
cagttcactgggtgc

SEQ ID NO: 69645 - DNA, 30 bp, Homo sapiens
  chr1:47944568-47944598
  hypo
ctgaaaaactttgcacgaaactgttctctc

SEQ ID NO: 69646 - DNA, 360 bp, Homo sapiens; identical to SEQ ID NO: 26274
  chr1:48058946-48059306
  hyper

SEQ ID NO: 69647 - DNA, 51 bp, Homo sapiens
  chr1:48175121-48175172
  hyper
aaggtcccggggactcggatggagccgcagtgtccccggcccgggcggaga

SEQ ID NO: 69648 - DNA, 304 bp, Homo sapiens
  chr1:48190874-48191178
  hyper
gcccagcggccggagcgcgcggcgcagccatcgatcgcggctaatggcctcgtctaaatgcggagccgctgcctccgccccccgggtcagggcgcccccgccctcgccccccgctccgtgcaaaatggtgtttaccaaagtcaatattggccgcggcgcccgcccggggcacccgggagcccctctggcctcccccagcccaaggctggatctgggccaccagagcctcatcttggtgtcccaactagccccggccctgacaaggagtcttttgagggctagacacaggcgggtctcgcccagg

SEQ ID NO: 69649 - DNA, 154 bp, Homo sapiens
  chr1:48247049-48247203
  hypo
ctgctccaagaggagcgtttctgggactgagtagaggagacacttagagggcccaggcctcagcccggccgatggtgcaggcctcaccggatgcccactggatcctgagcactgcgcggcaatggtccacgtgtctggccggcgttcctatcca

SEQ ID NO: 69650 - DNA, 338 bp, Homo sapiens
  chr1:48462159-48462497
  hyper
gggagcgccccttctcgctcctggctgggagctggagccgggacaggcaggagcgaaggaagggcgcccgaggctgcgcccggggggtggaggtggagcgggcgggctaaggtgggtgcggaagcaggacccaaaccatggtcccacgggactagaatacccaggcaggcgggagagtggccgggcaggcgctcgctcaccgatccgggcggccggcactgtcctccgtccgggggctgcgggcgggcgcgagcggtggcgaggagggcggcgagcagcggccccgccagggcggcgtgcatcctgccagggcccgcggggcgcgggggaccctcctg

SEQ ID NO: 69651 - DNA, 60 bp, Homo sapiens
  chr1:49242299-49242359
  hyper
cttgtggagcaacagcgcgccccagtcgcggggggcgcgcggggggctctcgggcccggc

SEQ ID NO: 69652 - DNA, 153 bp, Homo sapiens; identical to SEQ ID NO: 26278
  chr1:49242360-49242513
  hyper

SEQ ID NO: 69653 - DNA, 499 bp, Homo sapiens
  chr1:49242514-49243013
  hyper
ggggcgggccccggtcgggcagctcagcccgcggggcgggcgcggaggtggggatccggcggggggcgcgagtctcgctacggtgctggggggggcgggggcggctccccaggacccaggctccccccactgttattgttcctgaaagcaccgttctgccaatcggctgctttcgcctgggcgcggaaaagggagggagggggggaaagggggacgaggggcggatgaggggggtttggaagcgcactgccacttgcaaagtcagacccgagcaatcacagccggagcgcgattcgaatggggagggaaaagggttcagagattcagttgcaataaaaataataacaagagcattgcaggaaaaaaatgcattgattaaaaggtgcgctgcgtgcaggattatattgcttcaacaatcgcgctgccaaattgcattgcaacaaaactgcattgccaagtagagaagtgtatgagtgagtgaatgcgggataggggtggg

SEQ ID NO: 69654 - DNA, 225 bp, Homo sapiens
  chr1:50489447-50489672
  hyper
cgactggctcccctccgccatttttgttgtccctcagtctccgagctcacgcgaagaccgcggggcagtagggagcgggtggtgggatcagtgggctgacaggagctacctcaggaagacgcggcacgacggttgcctgggcaacgggcggcaggcgcgcgggtggccggcgcgcggctgagggcgggagggacgcctgggaggagcgtgcgtccaaggccccgc

SEQ ID NO: 69655 - DNA, 601 bp, Homo sapiens
  chr1:50513629-50514230
  hyper
cacaggaacctgactcgcaggagtcgtcctccgtctctacgcgaagcgccccctcgaggtgggcagggggtggcggcggcgacggtggcggagccgcagagcgagctagagagcgagagcggtgagactctgcggacgtcttcccgcccgccgcgctccgccccacccagcctccgcagcctcgggccggatcgcccggcggggaagatgcgcctcaagaaccaggtagaagcgcctcggcgcaggccccgcacccccgactctgcccgccctctgttacggacacccgctgggccacgtggtcgcgactggcttctcccagcggccagcctggccaccccgactcccagggagggggagagggcccttgcaagaggatcctgcccccgcgctgcccagacctgagggctcctggcgaccccacccgcagcccatctggcggctctggccccgcaggtcagggtcacacccctgccggcctcctgagacttcccggccccaggggagagagctgaaacttgggttgacgcgcgccccctccccagcgacaggcgaccccgcagcagccccgcgccactcctctctgcgcctttccgtagtt

SEQ ID NO: 69656 - DNA, 665 bp, Homo sapiens; identical to SEQ ID NO: 1710
  chr1:50798652-50799317
  hyper

SEQ ID NO: 69657 - DNA, 243 bp, Homo sapiens
  chr1:50799393-50799636
  hyper
cggcggcagccgcggctgccccctactggcggaaggaagagtcgccgctccggggcccttggcggccgccgctcttcgcgcctccttggcctggctgccacccttccaccctcgggggagaccccgcgctctgtgctcactcggggaagagaggctcaatcacggcctggaccagcactagggacctaaacgctcttctcagtgtgcgtgaagccaggtcctcaaatccgccttcagtaagag

SEQ ID NO: 69658 - DNA, 386 bp, Homo sapiens; identical to SEQ ID NO: 26285
  chr1:50880931-50881317
  hyper

SEQ ID NO: 69659 - DNA, 531 bp, Homo sapiens; identical to SEQ ID NO: 26286
  chr1:50881426-50881957
  hyper

SEQ ID NO: 69660 - DNA, 1834 bp, Homo sapiens
  chr1:50882143-50883977
  hyper
cgctttctcccgcctgcctcttttctttctaactcttccctctcctgtctcctctcgccctcttttttctccttttttatccccttttcgtccatcgctcttgccggcatctttcttctctgggtccttctcccccactttcatctcatcgcgctcgcacttcatcaccagacagccaaaccccctttccaattaaagtggaattaggcaactcaatcaaattagttccccattaaagcccttctttattaaaccgttttcttgtcctgctattaagtttcactgcctggcggaactcgagccggccccagaagtttaccttgggatgtcgccggacccagccgaggggaggagtcattcttttcctggagcgggggagtcaccctgcggggagcgggagggactggaggttgaaggagagggtcggcccaggagcggctaatttgctcagctcggcgtgaggagggaaggtgaaaagggtgagagacgaggtctggctcgaagtcgcgtgctcacggcccctctcccaaattacactttttcaaggaaggcagcatgccacccccaactccccagaaccccataactcccaggctgtagcccttgtcagaagaatggtagcagccaccctgcccagccgtcgccttcgttgcctgtggttccaaatctgagatggggagcgcgcagtgtgtacatccaaatctacacctcggaaagagcagggactgggcccccagccttgcaagatccctgtgaagactggggccgacgatccaaaaactaagagccggggcaaggtgacccctccgcaagggtgcccaagctggggtacacactgtgttccctctgctcagcggtcgcgggtccttcgggagttgtgagccccgcgccactctggtgggataggtcttccgagtaccacaggaagtctcctctcccagtagccccgagggtcggagatcccacgggacctcggacaagcgtctccttagcgccgcggcctgagtgggaaatcacgaccttccccagcgccccacccccaccccctatttctcgaggagcgggacgggattcggcattgttttcttagaaaataacatttatttctagctcatatctatgcaaaggaaagcacaaagtgctgctctgcagcagcgttttccgctgcgggcccttcagtcagggcgtttggcgagtcccgggaggcgaggatgggcccgcgagcgggcggttctggctcagtcacacgtcgctctgttcctgcttcagtgcgcaccttgacggctccttagggacagaccagccgcaggcaagaggggcaggtgggcaggattcatcccgagtttccaatatatttaatctctaaacctgataagtacaatgcgcgcatagtctaatttttttccattttgtccctttttttgcttgttttgaatgtttttcacgttaataccgaggtcacctacagattacaattaataacttagaattccattttataacattatacactggcttgtatatatatatgtatagattatatatagatttatacatatataaaaacacactgcaccaaggaaacccatgcttatcggcataagcaacaaagagagcgacaaataccgcaacgaggaaagtgcaccttaaaacttgtttcctttttttttttttacaattgtatcgatatatatgtgtgtcccaaagactcagtgccaagagatttatacatcctaaatttatatttgttagagcgaatatttaaattttttaaaagtgagggctggggagacacagaaaagactctcggattatcctgccatccactgagagc

SEQ ID NO: 69661 - DNA, 333 bp, Homo sapiens; identical to SEQ ID NO: 46
  chr1:50884020-50884353
  hyper

SEQ ID NO: 69662 - DNA, 198 bp, Homo sapiens; identical to SEQ ID NO: 47
  chr1:50884690-50884888
  hyper

SEQ ID NO: 69663 - DNA, 330 bp, Homo sapiens
  chr1:50885248-50885578
  hyper
cgagcctgagccgggccgcacctctggggacgacgtcccgggccccgagtctgcgccgtcgggtgataagggcttcaccggcggcggcagcgggctgcccgggcggcctgcctgcagcagcgtcttaggaaacaggtcaaacttctgcaacttggcctctgggaggggagaaaacgtgtcgtgaggagcggttagctagaagacagcagtcacagcacctcggccctttggatctcagtttcctctccctcagccccacagcccttattcactaggctccagtgcccctctttctttttgctctagcattccttccgctctgagccccta

SEQ ID NO: 69664 - DNA, 1135 bp, Homo sapiens
  chr1:50885950-50887085
  hyper
ctcccaagtttagagcggatccctcctttccctcaacggctctggcctaatttcttccctccccacaaaaagccacgggggtccagaaaaagagggtggtgctaggcaggcagtaggaagcgaagaggaaaagacataggaaagcagacctgagaaaccagggagggtgcggaagaaactagaaggagggagggcgcagcaagcggttgtccagagggcgttaggaacgcgagaaggggaaaagaaactagggcgtctcagaacctagggcgtctcaaaacctagggtgtcagttaaagggggggggattccttaagggagttgggaaggagcagagggaaagggcctgtggagaagcgcagagcgaacgaagatgcgcaggtttccacctggggagaagacgaagcaaagaagcagggacctgcctgcgtttgggtagaggcgagtaaaaaaattaaagcgtgtacatttcggcccgatgcaggagaaaggggtaaagtgcaaatgctccagaagcgggagaaaggagagtttctgtacccacgctccatacccgaggctgggcgagcggtgaaccctagcagtcgcggcgactggacacgggggttctactctttctgaaccgagacaagcccctgggccccgtgccccagagctacgatcctgctgcccctacctgcggcctggccgcgctctcacctgagccccctgcgccagctgctccgcctccggtccccgcgggcgctcccgctccaggtcccccgccgtcggcggcgcacactgaaccgaagacctcgtaggcgggcctcggggggatgatgccgttggcggcggccagcgccagcccctcggcagtgccgtagagcagctgcagctcgcgcgcctcgttctcctcctgcgcctgctgcctgcgcagcgccacctgcgccgccatgacacgctggcgctccgcgatgagcgtgcacttggcgcacaggcagtccttccagcgacagtagcgtttgtggcccttgagggccgacaccacgccatggttgcgacagcgcgcgcacttgggggtccgcgggtacttctcggctgcccgcagcaacagtggcggcccccgcagcaagccgcctgccacgctcaccggtag

SEQ ID NO: 69665 - DNA, 125 bp, Homo sapiens
  chr1:50887175-50887300
  hyper
gggcacgctgggcagctccgagcgcagctccatgacaggacctgacgggaaagaaggtgggagaggggagagacctggtgaggagcacaccgcgcgctaggccaaagcgccgccttgaggaaccc

SEQ ID NO: 69666 - DNA, 30 bp, Homo sapiens; identical to SEQ ID NO: 26294
  chr1:50887723-50887753
  hyper

SEQ ID NO: 69667 - DNA, 570 bp, Homo sapiens
  chr1:50888226-50888796
  hyper
gtctggagtagtagtcggggcggaagacgtatcctgcgaaaagttaggcatttcgggagggggatctttctcgaagaccacctcacactgccctcccctcccctccgggtttagggacagagtcgtcagacacgccctccccgtcttggggtcccaggggacccctctcgagcgcaggctcctgcgttctgatctcagagttggggtcctaggacacggatggcccagcaggccgcaccaagccaggggagtcgccttcgcaactggccataaacggacaccagagtccctcccacgccgcagccccataaggcccaagcaggcccagctccccgcttctgccgcggtctcctctgcttcccgcgttccccgtccctgccagagcccgcgacagagtccttgtgtctccgtccgagagtcccagacctcctctctatgagcgttgcctcctctcccagacccttcgggcgtccctaaggcccacggggcccaggcctcctcaacaggggccgcagaccaggtctccacccactgctctccctgcggccctcaactacctgccttgggctc

SEQ ID NO: 69668 - DNA, 1526 bp, Homo sapiens
  chr1:50889123-50890649
  hyper
cgcccgctctattgttggtccttagggctccattagacagaattggacaacaatgtggcgcctgccattggccaggggaggcagacggcgctctgattggccgggcccgcgcccggggagccccgcattctgcagtgtccgaaagattcgaaactccaaaagctccactgcgtgcctctgggaggggagggggcgcgccaggaaaggagtggaaaaaagtgggcgaggaggagcgttgaaaatttcctgacaagtagtttccgtgcgcccgagagcgtgtgaattgctcctaattaccgtgtccggtgcgcctctctgcgtagacttgtgtaacctctcggcttctggggcgccggctcggctgcaccgctcttactggcctggggcgcttggcaaagccgagcttcccaagtggctctggagccctgaggcgggatggggggcaggtgacaattcaattactgcggtcggggtaggggcgggacaagggtgcgggggtggggaagggagggtgttcaaggcataaatgccaggacgatttttcctgccttcttcctgctatgtttcggcgcgctcccaaatccgacgagtttggggtagttgggggctgctttggttttttcctcctgtctccttaaagctcagttactttattttaaaagtcctgatacgatagtcatcctggagggtaagtgtggtttatgaagattttcgtgtttaaagagaagctcagcgaagagaaatgagattgcacttcctgtcggtgcccgccacgtccctcgcgccctgagcctttcctctccccgcccctcttttcgcgtccctcagccccttttgagctctcttttcctcacttttcagcatctcgatttcttttccgtggtggtgggattctttttgtcgttattgcaaatgaacaaatagcccccccccctttttttttcttttctaaacgaaagtaaaaagtggcctctgtgtctccgcagattctcttaaactcaggacgcgcatcggtctgtccgaccttcccggcaagagacaaagtcactgctgggaggccccctcggacagttttcagttttaactttcgccttattctcgtcttgtcttgatgtcacggccctgaggaacagctcgttctgcagaagaggtaacaggtttcagattttgtttcctttttgaaaggctgttgcctttcaaacatctggaattaatgccgcggccctcgggcgagtcgccctcggtttctgtagctctgattttatctctgtgtcttttcccctctaatttctaaagttctgtttttccctctaattctgtttttccctctaatttctaatgttctgtcactctcgtttttgttctctacttttctctctctccttcagaataaagaaaattcgtttaaataatgaggaaaatgagcgttcctgtcgttctccctccactcttgaccgtgcgtctctgcgttgctctttcgaacctccaggccggcgggaatctgggcgcgcagactcggcccgggt

SEQ ID NO: 69669 - DNA, 689 bp, Homo sapiens; identical to SEQ ID NO: 26299
  chr1:50890795-50891484
  hyper

SEQ ID NO: 69670 - DNA, 131 bp, Homo sapiens; identical to SEQ ID NO: 1725
  chr1:50892153-50892284
  hyper

SEQ ID NO: 69671 - DNA, 813 bp, Homo sapiens; identical to SEQ ID NO: 26301
  chr1:50892336-50893149
  hyper

SEQ ID NO: 69672 - DNA, 273 bp, Homo sapiens; identical to SEQ ID NO: 5498
  chr1:50893150-50893423
  hyper

SEQ ID NO: 69673 - DNA, 359 bp, Homo sapiens; identical to SEQ ID NO: 26303
  chr1:50893518-50893877
  hyper

SEQ ID NO: 69674 - DNA, 379 bp, Homo sapiens
  chr1:50896073-50896452
  hyper
cttcctggggcattgcggatggtgtgcaccggctacgtggtcttctttgggccatccttctcctggtttccatctcccaagaggaccccttgaaatagcgattccgagaatcggctccggggctgatgagccatccagatacggagcttccgccgcactgtgtgaccgtgagcgagtcgccagccctctctgggctcgcctcccggctaccccggagtcagactgcctggaggataggcagccaggccactacttgtggagaaaggagactgtagagaggaggggcattcgggctggttcctgggccgggtcagcctgggtttgagtccagactccctccctccgtagtgcggcgagtgaccttcggcagccaagtagt

SEQ ID NO: 69675 - DNA, 30 bp, Homo sapiens; identical to SEQ ID NO: 38979
  chr1:50918985-50919015
  hypo

SEQ ID NO: 69676 - DNA, 225 bp, Homo sapiens
  chr1:51099269-51099494
  hypo
tgagctctgtcactacggcaaccagcagggaataagtatctgtgggtctatgaatttcagaatcccataaaagccagggctaaaaaggcatgtgcagcctctcagagattgactgcattaatacattagcaaatactgtgaaacactggataaatgtcagcaattatggaaaaagcgtctaataacgatattcgttgcctgtcaaacccccgtgaggtttgatat

SEQ ID NO: 69677 - DNA, 20 bp, Homo sapiens
  chr1:51176289-51176309
  hypo
ttcgagacagagtctcgctc

SEQ ID NO: 69678 - DNA, 30 bp, Homo sapiens
  chr1:51439947-51439977
  hypo
gggagggctcccccacgttgcctctacttt

SEQ ID NO: 69679 - DNA, 481 bp, Homo sapiens
  chr1:51442325-51442806
  hyper
aattcagttcttcaccgctgcgtccacattcacgtcgggaaacttggtctcagcctttgcccaggaagctgaagccaggcttacacctgggggtggagggcactaacatgacctcggttcaagttctggtccccgaactgctaaacaaagtgtcttttatcacattttggtagtgaattaagttttctgataaacattatgcatcttgcaacggtgtgatgagttcatgtacacacacaccacaatgggcgactgatcaataagtaggttaagtattctgtcccgagaaagcaatatgatgtatttcccttatcgtattgatcaaaagaacgttgtggatggagtccgtggcccaggactggtttcgaaatctcagttcccaaaaaggtgctttcggcttttgccgggggtagaagtaaatagtccataggcgccgggcagtcacagtgctggagcaagaaaaggtcgtgctcacagcctt

SEQ ID NO: 69680 - DNA, 35 bp, Homo sapiens
  chr1:51727596-51727631
  hypo
gctcactgcaacctccgtctctccggttcaagcga

SEQ ID NO: 69681 - DNA, 159 bp, Homo sapiens
  chr1:51761751-51761910
  hypo
gaaataattccacttcgtcgtccccgaacggcttgtggtcctccttcccaaacatgctgaggtaggcggccttcatgtaaatgtaggtggcctgtgcgagacagagcaacagccaggtgtgagcagccctcctccagccccagccgggctggaatctgc

SEQ ID NO: 69682 - DNA, 209 bp, Homo sapiens
  chr1:51763180-51763389
  hypo
gcgtctggccccggtcccatctttaacctcccgggtcacccttgtcctctccctttcccctgcccctgacgtggagacaccaagtcccggtgactttacctcccgtctcactctaggatcctgctggccttgccctacggctctcattatcggactgccaccatctccacaccgtctccctgttccaggctacccgggatgtctttctg

SEQ ID NO: 69683 - DNA, 213 bp, Homo sapiens; identical to SEQ ID NO: 38985
  chr1:51795524-51795737
  hypo

SEQ ID NO: 69684 - DNA, 17 bp, Homo sapiens
  chr1:51810611-51810628
  hyper
ccccttggtcccgtccg

SEQ ID NO: 69685 - DNA, 30 bp, Homo sapiens
  chr1:52068030-52068060
  hypo
gtatggtaatttattcgtatactttcataa

SEQ ID NO: 69686 - DNA, 37 bp, Homo sapiens
  chr1:52084092-52084129
  hypo
atggtgtatagttgacgatagccgatatgagggaaga

SEQ ID NO: 69687 - DNA, 37 bp, Homo sapiens
  chr1:52094622-52094659
  hypo
tacaggcctgagctaccatgcccggccttagcttaac

SEQ ID NO: 69688 - DNA, 28 bp, Homo sapiens
  chr1:52194940-52194968
  hyper
cgacacaactttccggaagtaagcaaaa

SEQ ID NO: 69689 - DNA, 30 bp, Homo sapiens
  chr1:5220720-5220750
  hypo
accgtggcgatgcctcggtgtgttgcaatg

SEQ ID NO: 69690 - DNA, 128 bp, Homo sapiens; identical to SEQ ID NO: 38986
  chr1:52455042-52455170
  hypo

SEQ ID NO: 69691 - DNA, 117 bp, Homo sapiens
  chr1:52456223-52456340
  hyper
cgcggactccgagtgcgggacgacgggttcgctcccggacggtcggcgggacggcaggacctggcgtcgggagggcgcggagggggccggggcggggcgctgcgggatggtctggtc

SEQ ID NO: 69692 - DNA, 39 bp, Homo sapiens
  chr1:52524541-52524580
  hypo
gattacaggcgtgagccaccgtgccgggcctgaatttgg

SEQ ID NO: 69693 - DNA, 80 bp, Homo sapiens
  chr1:52832632-52832712
  hypo
tttctaaggaaagcacgtttctccctgcggcttgcagagtccagttaacaagagattgagctcaggagtccgagaccagc

SEQ ID NO: 69694 - DNA, 316 bp, Homo sapiens
  chr1:53067865-53068181
  hyper
cctggctctggggtccggggcaggggtgcgctgcctcaggacagacggtgaaactgaggtccagagccggacatccaccgcctgcggagggaacgagaacgcggcgcgtcctgccttgcgggccgagcggcgccagagccgcctcctcccgccccccgcgctagatccccccgccccgtctttgccctcgcgacgccgccacctccggaacaagccatggtggcggcgacggtggcagcggcgtggctgctcctgtgggctgcggcctgcgcgcagcaggagcaggacttctacgacttcaaggcggtcaacatcc

SEQ ID NO: 69695 - DNA, 479 bp, Homo sapiens
  chr1:53068182-53068661
  hyper
gggcaaactggtgtcgctggagaagtaccgcggatcggtgagtgcgcggggtctggcggcgccgctgggcccggcctcgccctggcggggcctgctggggacgccccgcagcccggtcccccgcgcggtgtggctccgaggacgctccagccgcgcggccgccaaaccccggcccccgccccgctcggccgtgacctctggcgcggcgcccccatcccgcgcccggcccggcccggcccgcggctacgtggcacggccttggcgcggaggaacccgaagcgctcgcagtcggcgcccacttcgctaccggcacctttgggcagcggggtccagaccttcgccgggaggccgggcaccactgcccagcctttgccattcacgggtgaaaaaagtaaccgtagcatcgtgcggcctttccctctcccgtcctcattttctgcatctggaacggggagtggctgattcggagtccagtgaag

SEQ ID NO: 69696 - DNA, 394 bp, Homo sapiens
  chr1:53098659-53099053
  hyper
tgtctgccccagccccgaatgccccgagactcccggcgccggctcggtgcaggtaaggcgcccgcgccctggcctcgaattcccgccccgccactctggccgcgtcgtgctgtcgttgcgcacccagcgccctcgtgcaggcagggggagcgcagtggggagggggcaggaagcgcaggcagagccaggcgagcacgcggctcccggcccagctccccgcgtccgctccggctcctgccgcgttccagcagccgtcactcccgccgccggcccccgccgcccgccccgcctgcccctacccctccgcgcgggccgggcacctggccgccgctcggtcctcggggccccgcgctgctgtctctgtctcggcttctctcggcccctgggtctcttc

SEQ ID NO: 69697 - DNA, 312 bp, Homo sapiens; identical to SEQ ID NO: 5502
  chr1:53099054-53099366
  hyper

SEQ ID NO: 69698 - DNA, 32 bp, Homo sapiens
  chr1:53129138-53129170
  hypo
atcagaacatgtggccgggcgcggtggctcac

SEQ ID NO: 69699 - DNA, 368 bp, Homo sapiens
  chr1:53168827-53169195
  hyper
tccaggtggcttgctcgggggctgcccagctcgccgtcctctgcagatcccctcgggactctcagcattttgtgggttagccgtggagacgccctgcccttcctgctttggccagtcaaccccctcaagcccgtgcccgtagagcctgcagcccttcctcacctcatcactccccatccccccaagatatagaaaggccgtgacagctgccagccctgcacatgctcttgtttcaacagcggcgattgcacatcacgtagtccccacgtgacctgtcgggcctagggcaagcgcaaagctttcggaaacccgaattattgcaaccttgacttcctgcctgtctctgaggctcccgggctgtgctttaa

SEQ ID NO: 69700 - DNA, 340 bp, Homo sapiens
  chr1:53308268-53308608
  hyper
gggaggctggggaggcgggaggagaacggttggccccggcagcggcgtgtcggagggcggatggggctaggaggccgcccggggggtggggtctgcggcgggccggcccccgcgtgcgcgtcgcctcgccgggcatttcaaaagctcgccggcagggcgcggcgctagctccgtgtgcctcgcaggcgtggtgggcgcgtcctggcagccgcccgcttggttctcgcgggatccgggctccggctcgacgccggctctctttttgacgccccgccgccggggttgccatggttcatttcttgcacccgggccacacgccccggaacatcgtccctcctga

SEQ ID NO: 69701 - DNA, 368 bp, Homo sapiens; identical to SEQ ID NO: 1728
  chr1:53308907-53309275
  hyper

SEQ ID NO: 69702 - DNA, 30 bp, Homo sapiens
  chr1:53392828-53392858
  hyper
tcccatgcccaagtccgcaaattagggatt

SEQ ID NO: 69703 - DNA, 39 bp, Homo sapiens
  chr1:53479895-53479934
  hypo
ccagctctccttcaatagctggtccgatagaaaggcaaa

SEQ ID NO: 69704 - DNA, 136 bp, Homo sapiens
  chr1:53527470-53527606
  hyper
tcagaggcactgggtcgaaggacccctctccccagccctcctttcaggtgtcggggcctaaagggggtccagttccagtgcggaaggctgggaactaggaagcgtcgcggaccagacagcccgccttcccggtctc

SEQ ID NO: 69705 - DNA, 317 bp, Homo sapiens
  chr1:53527817-53528134
  hyper
ggggcgggagagaggcggggaggagaaaacccacaacaaaacttgcgtcgcggagagcgcccagcttgacttgaatggaaggagcccgagcccgcggagcgcagctgagactgggggagcgcgttcggcctgtggggcgccgctcggcgccggggcgcagcaggtacagggcgctggcagccggggtgggccgaggggccgggggctgagcccgggcagcgcactcagacgtccccgcctctccggatggctccagcagctgcctggggcgggcccgccgcatctcaccccctctgtaggaccctgcacccagggca

SEQ ID NO: 69706 - DNA, 617 bp, Homo sapiens
  chr1:53528170-53528787
  hyper
cgcagtcaggacccaggcaggggccttctcctctctgagcagaggctggtccccgtccccaggcccctcccgctgcgcacatctggaaagaatctgagggcggttgggggcgggggctggagtgggaggacgccggcgggcgacagggaatgtggggggcaggtggaactgcgtaggggcggggacccctgtcatgagagcctgggcccgaagtatccccgcgtctttccacgtcaactcatcaggccccctagcgactccaacctccacctctttatagatagagaaactgaggcccagagaggggcagaggtctggccccagggcgcgtcggacgccgggtgggtcccctccggggctcggcttccccggccactgtgccgccccagcttagtgccaaccactagttgagctaaaggtctcagctggcggtctggagtccgtctatctgtctacgcggctgcttcccagccgggacagctggagggaggaaggggtgggggtccgcgaagcgcgaggagcgagatccgcgccttcctgcgaatgaggcagaagccccaggttccaggtccccgagccacagcccggcctggggcgggggacgagatcttggcgtt

SEQ ID NO: 69707 - DNA, 30 bp, Homo sapiens
  chr1:53561195-53561225
  hypo
acactcacaccgcctcggtacactcaactc

SEQ ID NO: 69708 - DNA, 30 bp, Homo sapiens
  chr1:53573022-53573052
  hypo
gagaaaaaggacattcgtggaaaaactgat

SEQ ID NO: 69709 - DNA, 24 bp, Homo sapiens
  chr1:53703048-53703072
  hypo
aaaaccttccaagcccggccgggc

SEQ ID NO: 69710 - DNA, 27 bp, Homo sapiens
  chr1:53705674-53705701
  hypo
tcagtcttaacacggagtccttttctc

SEQ ID NO: 69711 - DNA, 102 bp, Homo sapiens
  chr1:53990535-53990637
  hypo
cagggatctgacaggcgtacggcttctgtaacatggggggcacgggtggggtgagtgaggcccatccctacgggacacgcgcctccgcgtgacctgctgtgg

SEQ ID NO: 69712 - DNA, 38 bp, Homo sapiens
  chr1:54142594-54142632
  hypo
tcaaatcccacttaccggtcctgcgggccctctggcct

SEQ ID NO: 69713 - DNA, 876 bp, Homo sapiens
  chr1:54203828-54204704
  hyper
gtattgtcccggggccgagtttgagcaggtcactgccccttcggtggattgcgcgtctttaacataggttagcaccacgacacctagcccaatcagaggtcaaacccacctgattccacgcaaaagccccctcgctcaggagcggttcgcccttccctggtgtggggaggaccccaggcccccgcgccgcggcgcattaccgcgaagtcccacccaaatcctcctccaccgaaaccagcctcctttgcacgaatggtgaaactgaggcctggagcgggtaaggcgcctgttccgcgtcccccagtggaacacggagccggcggcaacgaggattcccagagcagggctcgggcgaagccccggagacggctccgggtaggtcacgggctgcgcgcttcgtcgactctccggggccgagctgcgcgcagaagctggggacccgaacccaaaggcccgagggaaacccccagagactcacccgcgaccacccgaacctggaaaacaggagtcccaagctgggcgctgaatcctgcgacgcgaacccatcacgcgcagccgggacacccacattcctatgcgcagcggaggaatcgagcccgtcgcgcgcgcaaaccggcacagtgggcaatgcccacgcggccgccgccacacacccgcacacccgccgaggcacgcccggggacggacacgccacccacactgccgctggtcagacgctcagcagcgcacaaccacacagtcccacgctctcgccacacgcgcgtgcgatgggggccgcgacagagcctccctcagcccttccatcaggggcccccaaactctccgttcccctccgcgctccctgcgccatccccaagctgccggggttcgagcgtc

SEQ ID NO: 69714 - DNA, 43 bp, Homo sapiens
  chr1:54530324-54530367
  hypo
gactaggcaagcgaccggttttgttggttgtgcatttttcctt

SEQ ID NO: 69715 - DNA, 407 bp, Homo sapiens; identical to SEQ ID NO: 14242
  chr1:54586590-54586997
  hypo

SEQ ID NO: 69716 - DNA, 2 bp, Homo sapiens
  chr1:54587510-54587512
  hyper
ga

SEQ ID NO: 69717 - DNA, 95 bp, Homo sapiens
  chr1:54587534-54587629
  hyper
cgcctctttctccaggcatagtcgtactcacacgcactctcccgcccacccagaccccagatcccccgacactcacagcacggcaggagcatagg

SEQ ID NO: 69718 - DNA, 30 bp, Homo sapiens
  chr1:5463052-5463082
  hypo
aaatgccagactgagcggctaaatacaggc

SEQ ID NO: 69719 - DNA, 30 bp, Homo sapiens
  chr1:54683784-54683814
  hypo
tgttttaattgctgccgttaaacctagtag

SEQ ID NO: 69720 - DNA, 30 bp, Homo sapiens
  chr1:54712302-54712332
  hypo
agcctctccaagaaccggcatggcagcttc

SEQ ID NO: 69721 - DNA, 186 bp, Homo sapiens
  chr1:54722666-54722852
  hypo
gtaagctaccagccacgttaaacctgcccctccacccctcaatcctttccctcaactttcattttgtgtcaaagtccacctagggccaaggatggctgagggaggggagagagaacatgaaaaggtacagtacctggtttcccattctgatcgggggcctggggccgcctgcgtatcgcggtgaca

SEQ ID NO: 69722 - DNA, 30 bp, Homo sapiens
  chr1:54757013-54757043
  hypo
atgccagggaaggggcgcataattcaaacc

SEQ ID NO: 69723 - DNA, 35 bp, Homo sapiens
  chr1:54757429-54757464
  hypo
gacccaacaacactacgaagcgctgggcacttatt

SEQ ID NO: 69724 - DNA, 52 bp, Homo sapiens
  chr1:54766254-54766306
  hypo
aaggattatttctgccggagggtggggcttcacagagcggtgacatctgatc

SEQ ID NO: 69725 - DNA, 30 bp, Homo sapiens
  chr1:54808954-54808984
  hypo
ctggatctaactgtacggccctggacaagt

SEQ ID NO: 69726 - DNA, 30 bp, Homo sapiens
  chr1:54814665-54814695
  hypo
tgctcttcacccattcgacaagaaacaggt

SEQ ID NO: 69727 - DNA, 33 bp, Homo sapiens; identical to SEQ ID NO: 38995
  chr1:54839900-54839933
  hypo

SEQ ID NO: 69728 - DNA, 20 bp, Homo sapiens
  chr1:54849481-54849501
  hypo
ataaaaagcaagaaccggcc

SEQ ID NO: 69729 - DNA, 17 bp, Homo sapiens
  chr1:54880702-54880719
  hypo
cccggccacgtagagca

SEQ ID NO: 69730 - DNA, 373 bp, Homo sapiens
  chr1:54940331-54940704
  hyper
gctagaatgtgagatcgcggagggttgagtggcttttgccccacatcctgcggccagcagccggccatggctaggagaggcgcccgacgcctggcgctccccgtccgggtctccggccgctgcggggctgtgagggcccccggcggtaccggccgggggtggcccagctggggtgggcttggggccagatgggctgcgcagcggcggggaggcagggccggcaggcaggggccgcgcgttgccatggggacgggggtgggggcggcagccccgcccgggcgcagggggagcaggtggcgggtcggtgagcaggctgggggaggggccggaaggggcccgcggggtcggggcgcgcccccggctcctccgccgc

SEQ ID NO: 69731 - DNA, 23 bp, Homo sapiens
  chr1:55231044-55231067
  hypo
tttgtttttttgagacggagttt

SEQ ID NO: 69732 - DNA, 65 bp, Homo sapiens
  chr1:55446357-55446422
  hyper
caccggagtggagggcgaggcccgggtcccgcgctcccctgggcgccccacggcagcctcagagc

SEQ ID NO: 69733 - DNA, 30 bp, Homo sapiens
  chr1:5544893-5544923
  hypo
gatagaaggatgagtcggctgcctggtgag

SEQ ID NO: 69734 - DNA, 63 bp, Homo sapiens
  chr1:55462125-55462188
  hyper
cgctcgccttgcctgcgtggacctcgatgcttacctctgtcaaatgggcgtgctctttccctc

SEQ ID NO: 69735 - DNA, 261 bp, Homo sapiens
  chr1:55462673-55462934
  hyper
ctgggaggggaggtgcggtcaccgctcagccgccgactcagccgagggagaccttggccagcccctgccactccgcaggctcggtttcctcgcctgtgaaatgcgggcgatgactcccctccccgccgcgactgctcatcaccgggtccgagcccagccgctgaccccgggggaagcgccttgctcagcgccgggcggcccacgaggccctgcaggaccgcggctgcggagaccgttcccgccacccgcctgggctccagg

SEQ ID NO: 69736 - DNA, 117 bp, Homo sapiens
  chr1:55505045-55505162
  hyper
tttttcttccctctgcgcgtaatctgacgctgtttggggagggcgaggccgaaacctgatcctccagtccgggggttccgttaatgtttaatcagataggatcgtccgatggggctc

SEQ ID NO: 69737 - DNA, 43 bp, Homo sapiens
  chr1:55505516-55505559
  hyper
accgtcagctccaggcggtcctggtggccgctgccactgctgc

SEQ ID NO: 69738 - DNA, 155 bp, Homo sapiens
  chr1:55529091-55529246
  hypo
ccctgggacctcccacgtcctgggggcctacgccgtagacaacacgtgtgtagtcaggagccgggacgtcagcactacaggcagcaccagcgaaggggccgtgacagccgttgccatctgctgccggagccggcacctggcgcaggcctcccagg

SEQ ID NO: 69739 - DNA, 32 bp, Homo sapiens
  chr1:55731721-55731753
  hypo
ttctgatcagcaatacgtgagtgactcggttt

SEQ ID NO: 69740 - DNA, 52 bp, Homo sapiens
  chr1:5661868-5661920
  hypo
atggggtgtgggagacgcggcatggggtgtggggacgcggcatggggtgtgg

SEQ ID NO: 69741 - DNA, 184 bp, Homo sapiens
  chr1:56943121-56943305
  hyper
ccgggaggtcttctgcgcccagcgctcctccagcttcttttgctctccccagaagaatttaaaaagccaaacaaaacccttttgctgtgatctcaccccagacaaacgcacggctcccagacaaacgcacagctacaaaagcagcccgcatttgcattctaaaccgtcccggcctgggatgaaa

SEQ ID NO: 69742 - DNA, 15 bp, Homo sapiens
  chr1:57110648-57110663
  hyper
gcctcctgcctccct

SEQ ID NO: 69743 - DNA, 616 bp, Homo sapiens
  chr1:57110882-57111498
  hyper
cttcccacctgggcccgaagcgcccagcgccctctcccgggaccccgcgcccgccccgcgcccctcgcggctcggggtccgccccctcgcccgcagggcccgctgcactgtgggtaggcggcggcggcggcggctacgcggagcggcaggcggtggagcgaggccgcgcgcgccgaagatggctgagaagcagaagcacgacgggcgggtgaagatcggacactacgtgctgggcgacacgctgggcgtcggcaccttcggcaaagtgaagagttgagtacgcgctccggaccgctgtgcggggctgcctgacttgcgggaggccgaggggagaggcgggagccccgggcctccggcgggcgcggggctcggcggcaggtggagcggtcccgggtcgcgcggagctggggccccgggagggtggcgcgcaccgcctcgcctggcaccggcgcccgggccccacagggtccagggaagagggcgggggtgtgagctgaggatgggcgtcctgggttccaggttccgcgcccatctgcctttctggaggtcggagcaaggcacttctgtgttctctggacctcagtgtcctcctctgcaaaatcgggagaactggact

SEQ ID NO: 69744 - DNA, 221 bp, Homo sapiens
  chr1:57224849-57225070
  hypo
tacagtttgaaaacacgagcacaccaactaaggctgacccaccttttgacttttccaatagttctgtggattttatttaatgacatgatgccaatcttaattacagtcatgcatcgcttaacaatggggatctgttctgagaaatgcatccttaggtgatttcatcatcacgtgaataccatagaacatacttatacaaacctagacggtatagcctacta

SEQ ID NO: 69745 - DNA, 30 bp, Homo sapiens
  chr1:57687138-57687168
  hypo
aaggtcacctgatagcgacatttcttttac

SEQ ID NO: 69746 - DNA, 30 bp, Homo sapiens
  chr1:5777938-5777968
  hyper
tgggcaatttcaaagcggaaaggtcagcta

SEQ ID NO: 69747 - DNA, 303 bp, Homo sapiens
  chr1:57887764-57888067
  hyper
acataaatgtaccaacgtgaactggataattaggcggttctgaacgtaagccacctttaatttaattgatatgattacttgaaaacgttaagtgttgtaaagtgtagtggaacccccacacagcctttattcaaaactatcaacactgttaaagtgtatttaaccggccagcaggaagggagcaggaaggaggaagaaacgacggcgcggattctcgccccggtccccgccggctggctaggagctgcactggagcatccagctcgcaggagggctcgcccccgggctcgcccccgtccagct

SEQ ID NO: 69748 - DNA, 738 bp, Homo sapiens
  chr1:57888297-57889035
  hyper
gcctccccacccccacgccattccttcagactctcccagcctaagcggaagtgccccagcagacccccaacaatgaggatttgtgcgatgcagttgggggttgggggtagttcacacggagtgaaacgtacacagtctggcgggtctgggagcagccaagtggcgtccgcctctccaggcagcgatcccttgtgcccactgccccccatcaggcccaccagcaccaccaaaaaacaaaaacagagaaaagaaaaagcgccttaaaaagtgcagagaaaagatgcgccctcccaccaggggtcacaataatactcctcgggacgcagccagcggaggcagggtcctggctgcagcagccaccctggttttgaaatttactttgtacactcacccagtggcccctttcagacgccgcgacacgacctccccccatctcggactccctgcctctgggttctctcggcggttgacaccctcttgtgtgcctgctttatgagccgaaccacagagatttaaagtttccttggtagaaaaaaaaactgagctctctgcatccaagtcagagcgtcgagtctggagcagagagaaggaagaggggcgggctggggaggcgactagctgggcgtggggggagggggtgctggggagtggatggagggggacgagcggcagagaacagagtccacagaggatccgaagaaaggccggggtccgaggaacgcgggatccagttctcac

SEQ ID NO: 69749 - DNA, 568 bp, Homo sapiens; identical to SEQ ID NO: 26327
  chr1:57889036-57889604
  hyper

SEQ ID NO: 69750 - DNA, 980 bp, Homo sapiens
  chr1:57889605-57890585
  hyper
cctagcccagagcatcctcctccgctgccgcagccgcccaggaagcggctccccatgcccggcgggcggcggcactcaggcgcgctctgcagcccggggaagcccgggcgagcgccgagctgggtccatcctccccgggagccaccggccccgcgtcagagtagggggaggagaccgccacccgcgcggacccgcctcctcccgcggccccccgccccgccgccccccgcgcccgcccggcgccccgcggcaccgctcacctgctagctccccggccgccgccgccgggccgtgagcccctcgccccggcctcgcggctccctccggggcgctctctgcgcagccggagcgcgctccgagagcttagccgagtggcggtggcgacgaggaggtggaagaacgagcgagcgagcgagcgagcgagcgggggcgccgcggcttgcagtcgcgcctctggagcccctgcactctctctccatcccagcgtggaagggggagagacgagccgagagcgaggggtccccgccccagccgcgccagcgtggagagggtaagggaggggggttgtcacaaagtatccagtgttttctcccccatcaccaccactggacgcagctccgcctggcctctctcatttttctctaagatctacccttttatccaagcctcgaaaacatatgcatacccaaatatatggagtgccaggaagggcgaaaccacgaggggagtctccgcgagggcatgttgcccccacgccccttggcaggagggggcgctcgctcccagccgccagtgcaggttcggcggctcctgttttgactgaggtttcccaggcaaagttcggcaagttgggagggagaaggctggcacgtgtcaagtttccgtcagtcctcaggagagacccgtgcccctgagagcacgcagaccacggttaactccggcttactccccgcgactcccctactcggctcttagaatga

SEQ ID NO: 69751 - DNA, 30 bp, Homo sapiens
  chr1:5816415-5816445
  hypo
gacacccagagagtccgtgctcacatccct

SEQ ID NO: 69752 - DNA, 174 bp, Homo sapiens; identical to SEQ ID NO: 26330
  chr1:58715153-58715327
  hyper

SEQ ID NO: 69753 - DNA, 173 bp, Homo sapiens; identical to SEQ ID NO: 26331
  chr1:58715359-58715532
  hyper

SEQ ID NO: 69754 - DNA, 322 bp, Homo sapiens; identical to SEQ ID NO: 53
  chr1:58715533-58715855
  hyper

SEQ ID NO: 69755 - DNA, 293 bp, Homo sapiens
  chr1:58715978-58716271
  hyper
cgagcgggctccgcttttgttccctggggctggcaggtccgtgtggggccagggcgcgcgggagacgccgcggagctgggtatcccggagaggggatgctcactcctagcggctccgctggcagcagtagtggcggtggcagcagaggcagcggtagcaacagcagcagtagcagcagcagcagcagtagagatagtgccggctctctgcaggccacatctttcataccttatacatcactaccgcattcccccgaataggggagcccctcagcatttcgccacctagcgcgg

SEQ ID NO: 69756 - DNA, 30 bp, Homo sapiens
  chr1:58721839-58721869
  hypo
gcaagtttaagagaacgctcttcactatca

SEQ ID NO: 69757 - DNA, 93 bp, Homo sapiens
  chr1:5890942-5891035
  hyper
cgctggcccaggaggcggcagagcctgtgcttgcctgggccctggcgtgagccaacagcgccaccatcagctgccagccgggaagtcctccca

SEQ ID NO: 69758 - DNA, 43 bp, Homo sapiens; identical to SEQ ID NO: 38828
  chr1:5893925-5893968
  hypo

SEQ ID NO: 69759 - DNA, 49 bp, Homo sapiens
  chr1:5894998-5895047
  hypo
cagatgatgagtgcacgtgggtgcgatgctgctgcgggagcagcgaggg

SEQ ID NO: 69760 - DNA, 492 bp, Homo sapiens
  chr1:59042065-59042557
  hyper
gctccacctgcaggggttctccgcgcacgcgcaagtccaggccgccgcggccctggaatagagactcgcccttgatgtccctctcgaagtagtaggcggcatcgccgatatccacgtcaccggcggccttctgagacgtgttctgccgcagctcgatctggatggtgggctgctcgtagtgcacggccgccacgaacttggggtgcagccgatagcgctcgcggaagagccgcctcagctcggcgtccaggtctgagtggttgaaggcgccggcggtggggcggtggcgcaggtcaatgaggatgtggtgggtgcgcaccagctcatcgcagcgtaggctcaggtcgcccttgtccgtgcggcgcacgcccaccgagttcacgcaccagcacaccgacgtctggttgcactggcgcgccttgaagcggccctcggggtcgcagtcggggtcgtagaggccatcgttgtccacgagcgcgtgctcactcggcc

SEQ ID NO: 69761 - DNA, 51 bp, Homo sapiens
  chr1:59348317-59348368
  hypo
gggtgggagctcagccgtccaaatgcagagccagaacgagtctcctgtaaa

SEQ ID NO: 69762 - DNA, 455 bp, Homo sapiens
  chr1:59612368-59612823
  hyper
agggcacacagtgggcgcttagtaactgtagaaagaagtcgaacgaaatcggaagggggagaggcagaggccacaatcaagacacggaaacgacagtcagtcgaggcagcagagagggtttcacgcgggccagcggaggcgcagggcagttgagaagggaacttgccacggggcggaggggccgcgctccccaccagcgcggcgcgggggcgctaggccagggaccgccgggccagggaccgccggctgcgagcagcgggaacggacctgccccgggtcgcagcggtttttcccgggcggggctgaggctgcagggaggcgggcgttccggcggagggtcacggcctcgccgccgggactttcctggggtggaggtgtgagcacgtaggagccctggcctttccaacttcccaggtcagactggggctgggaccaccctgcgcggccttggatgc

SEQ ID NO: 69763 - DNA, 66 bp, Homo sapiens
  chr1:6046211-6046277
  hypo
tacctgcctaattaccggtccgtccagccacttgaggacacactggaatgccgtggattccttcca

SEQ ID NO: 69764 - DNA, 90 bp, Homo sapiens
  chr1:6053472-6053562
  hyper
ttacagcacacacaccgccacttctgaccctgagcccctactcctatcttaagcttctccctcctgccaggccttggcacaaagcacttc

SEQ ID NO: 69765 - DNA, 31 bp, Homo sapiens
  chr1:6053624-6053655
  hyper
cggcattagcagcagccggggtacctgccca

SEQ ID NO: 69766 - DNA, 209 bp, Homo sapiens
  chr1:60662398-60662607
  hypo
agcaccagaggcaagcgttggatatattactgaatatgaatcatctgccttaaaaaaatagactaattagttgttcactgccgtataaaccttaggtaattataggacccagagttctgagaaattaaaataaacatcattttaaaacggagaaaagtaatgagagctatttgtagggctcctgaagtgcttttcggcagagcggtcta

SEQ ID NO: 69767 - DNA, 188 bp, Homo sapiens
  chr1:6071300-6071488
  hypo
caagtgtgcaggaggcgaggcaggcagctgtgcccagggccaggtgtgcgggagacaggcaggcggctgtgcccagggccaagtgtgcgggagacaggcaggcggctgtgcccagggccaggtgtgcgggaggcgaggcaggcagctgtgcccagggccaggtgtgcgggaggcgaggcaggcagctg

SEQ ID NO: 69768 - DNA, 32 bp, Homo sapiens
  chr1:6086259-6086291
  hyper
ctcccacctgggtcacgcgctaggcatgcctg

SEQ ID NO: 69769 - DNA, 171 bp, Homo sapiens
  chr1:6131714-6131885
  hypo
taggactcctgccaccgcgtagggctctgctgcgtaggactcctgccgccgcatagggctctgctgcgtaggactcctgcggcgagggctccctcctgccgcgtgggctcctcctgccgcgtgggctcctcctgccacatagggcacctcctgccgcgagggcacctcctg

SEQ ID NO: 69770 - DNA, 37 bp, Homo sapiens
  chr1:61339518-61339555
  hypo
gaaaaatggcaacttcagttctcgtttttgtaagtat

SEQ ID NO: 69771 - DNA, 30 bp, Homo sapiens
  chr1:6149015-6149045
  hypo
ccagggtgccaaaaccgctggtgacatcac

SEQ ID NO: 69772 - DNA, 267 bp, Homo sapiens
  chr1:61508687-61508954
  hyper
ccctaggggagagggcgccgcagcgagtcccgagatccgagcccggcctcgacgccggagcgctcccggagctggtccttgcccgaagcgcattaaaacggcgccctctggtgtcagctcgcggcggccgggtaaaagcagtggcgctgggggtagagttctactcgccaccctgttcgcaaactgaaagatccccgagtttagaaagtgtcttgccgctctgcggacgctgtgtccgcggccccgctgtcgcgcagagctgggctg

SEQ ID NO: 69773 - DNA, 41 bp, Homo sapiens
  chr1:61519364-61519405
  hyper
gagaacgaggccgtccgggctaggttcccggggctcaaaga

SEQ ID NO: 69774 - DNA, 232 bp, Homo sapiens
  chr1:61519472-61519704
  hyper
cgtttatttaaagttcagttgtgttgggcatctgatccaggacaactcgcccaggagcccggcgggtttcagctgccaccacgaaagtaaggatcggttctgccgcgtcgccccctccttccccttgggatgtgccaggcgggcgacagataagggggcgcggcgcggggtcagccaccgagccagagggcggcgcccggttgcagcgctccacagccgcctcctgcagcct

SEQ ID NO: 69775 - DNA, 77 bp, Homo sapiens
  chr1:61541784-61541861
  hypo
attacaggcgtgagcgaccgtgcccagccagcaatcacatttttaaaaacaacaacgaaaaccgcagtagcctggtt

SEQ ID NO: 69776 - DNA, 102 bp, Homo sapiens; identical to SEQ ID NO: 26338
  chr1:61549208-61549310
  hyper

SEQ ID NO: 69777 - DNA, 48 bp, Homo sapiens
  chr1:61555978-61556026
  hypo
acctataaattatcccgaatagatgaccaacatcgaaacttgaaagtg

SEQ ID NO: 69778 - DNA, 16 bp, Homo sapiens
  chr1:61653734-61653750
  hypo
gttgagacagagtctc

SEQ ID NO: 69779 - DNA, 203 bp, Homo sapiens
  chr1:6166315-6166518
  hypo
aacacagggaagtctcgaggacggctagatatctgtcaaaaaaagaggagagccgggcttgcctgacgttggcagcagcaggcaggccgggcccggcgggcacccgtgtgcatgctgcccggagcggacgggcacctaccggtcacatagggccccaggggcatctggttgtagttgacaatccctcccggtccagggccccg

SEQ ID NO: 69780 - DNA, 317 bp, Homo sapiens
  chr1:6171630-6171947
  hypo
gacagagacacataaggaagaagccgggatgacagcggcggggagcgggcgacacagcaatgccgaggatttctagccaccgccagaagtgaggaagattgaggaagaacgaggaaggcttcccccggagctctcagagggctctccccgaggtccacggaggaacgggcaagtccctgcccagcccggcctggccaaggatacgtcacgatgcccgccagcagccagtagtcatggcgccggtgccagatgtcgtagattttcccagaggatacagcagcccgctcctcgttctgccacagcgtgtgcaactctgg

SEQ ID NO: 69781 - DNA, 269 bp, Homo sapiens
  chr1:6186398-6186667
  hypo
ctcgcccagctctcccggcccgcacctcccgggggttctgcacagggatgccctgacagaatcctgccccaccctccgcctctgggtatgggacacccatccctcctggcacactcgcccagctctcccggcccgcacctcccgggggttctgcacagggatgccctgacagaatcctgccccaccctccgcctctgggtgaggggcaccagtccctccctcccggcacgcaccctggtcctcctgggaggcatcgttgtagttgacct

SEQ ID NO: 69782 - DNA, 30 bp, Homo sapiens
  chr1:6189031-6189061
  hypo
gccacctgcgtgatgcgctcctccaccgag

SEQ ID NO: 69783 - DNA, 311 bp, Homo sapiens
  chr1:6208626-6208937
  hyper
tcactgaacagtggtcgcggtgttggcatgatcaccacacctgtctgcctttccctaacactcatgcctcccgtctctaggggagtcagacgcggagaagggcgcgaggaagctattgtggacggggtctcgagcagcgcgggcgaagctttgcgggatcggctaccgaggcggggcaggagccggcaggggcggggccttttgaggagggcaggccttcccctgggggcggggcctgttcctggggtggggcggggcgtccggcgcggggcgggcggaacactcacagtacagcgcgggcagagccattc

SEQ ID NO: 69784 - DNA, 147 bp, Homo sapiens
  chr1:62189753-62189900
  hypo
ccccataattatccacgtttttactcatgagaaaacagagttcaaataggtcacccaaggttgcaaagtgcaacagaaatttatccactgagtccccacgcggtggttcatggtgagggggatgcggatcgcttgagaccaggagtt

SEQ ID NO: 69785 - DNA, 73 bp, Homo sapiens
  chr1:62207769-62207842
  hyper
agcggattgacccaacgctttcatcgatatcctcctcaatttccttgatcttgggtctcgctctacacgcagg

SEQ ID NO: 69786 - DNA, 30 bp, Homo sapiens; identical to SEQ ID NO: 26021
  chr1:6221982-6222012
  hyper

SEQ ID NO: 69787 - DNA, 921 bp, Homo sapiens
  chr1:6239141-6240062
  hyper
actaaagaactgtcccgcaaggcaacccctggcgcacagccctgtgtatactaaattctgagagagataaaaggagagagatggtaggggcaggggcggtggccctggggcgtcaggcccgtagccaaggcagggtgggctgggaacggccaccaccctgggcgatggtgaggctggagacagcggcgggcgctaggtcgcgccagaaggacgccggcggcccgggtaaagtgcttgggagcggcggtcacagcgcacagaggccaggaaagaggagcaggggtccgagcccgtgcgtcccagagcggagtcctcctgggccgggagggaagccgccccatcctgggcgctcaacgcgtccccaagcaccgccggtcctcgcccctctctgggccccacccagcccgccccgcggccgacatgggccaggggccgggtcccgcctgcccgcagcgaggccagaggcgcacggcggcgggacgcgagcgcggggtgcgccgctccgggagctagcgcgattcccgcccccttcaagggcacgcgggctgaccctgacagcgccgcgccccccagcgcaggccccggcccgcggtcctctggcccgcctggcccgcgtcgccgcccggggggcccggatcgcaccccgcccttagccgccctcacgccggcccgggcgctcacccagccttcgcccttggccgcgcggcgccagcagggcgggagcgcagccccgcaacccgggtgcccctcctgcgaggcgccagcccggccgcgccgcccccgccgcccgcgctccgccctgggcccggcccgtctcggcgcccccgccgctctggccccaggcgcacccgcgccccgctcacctgacatctcgtcctcattctccatctcctcggcgaacagccgcggcagctcctcctc

SEQ ID NO: 69788 - DNA, 436 bp, Homo sapiens
  chr1:6240272-6240708
  hyper
ccttagcctgctccccgcaaagcccgggcgctcctcccaccgcgccccgcagcccgagtcccgcagccggccgagggtggcggcggcagcgccagaggcacggcggcacggcgggggggcggcacacatgcccggattgtgacgtccagtctggttgctgtggcaaccccatcccatcgttccggcagcgcgactagttaacagcagagaacaagttgggggactagtcctgagccgccgggtgagggtggggaccggggggcgccccggcagggggagccgtcgaggcgtccgcgcgcccgcggacccgacggccgagcgggcagtcggggcttggcgagcccgggcgcagggggaggcgaggaaacaccgcccccgcgcaccccgggcagagccagccgccgccgctcgcctgcgaaggcgctgggccccgagc

SEQ ID NO: 69789 - DNA, 333 bp, Homo sapiens
  chr1:6240931-6241264
  hyper
cctcacctgcttccccgctcccaccgcccacgtgcccccttccaaaaagcccctccaggctgggtgcagctgaaacccatgcagacccctaggggtggtgcggatctgcgatgtctgtgcccaaaactcccgctcagaagcgacacctgtcgcagagcaggaaggagccgccgccaccagccctcggtcgttaaaggtgaagatggaggccaaagccctcgggagcaagactggaattttaaatgagcgcctccagtctccgcggcggcaagtcttaaagctaccttaagaacgcaaaagttccaggggctggccgaccgccagctctctaac

SEQ ID NO: 69790 - DNA, 22 bp, Homo sapiens
  chr1:62657668-62657690
  hypo
attctttttctttttcgagacg

SEQ ID NO: 69791 - DNA, 229 bp, Homo sapiens
  chr1:6266484-6266713
  hyper
agtcgggtccaggcgcgatagggagggcgcgggcgcccgggcagaggggccgcgggagctcaagcggggctccgtgcgtgccccagccgcccgcttgcgctgtcgctgcagatgtcgggagctatcttcgggcccctggagggcccgagctccctggatgccccgagcatccacccgctggtgtgcccgctgtgccacgtgcagtacgagcgcccgtgtcttctggact

SEQ ID NO: 69792 - DNA, 291 bp, Homo sapiens
  chr1:62784355-62784646
  hyper
ggctgcatcccagaccgcagcgcctagctcggaaaagctgggcgggggctgcaccacctgagtcgcaaggacagcacggcctccccctcctcaccagtgttctccacccccagaattggggcgcggagagccaatctgggctggaaagggagcggcgcccacctttgggcagcccgagcagccccgctccttttctgtcgcagaccccaggctgggaggcgggggcgccaggtcggcccaagctgccgcagccactgctttaaagggagccggggacgcggcgctggggac

SEQ ID NO: 69793 - DNA, 308 bp, Homo sapiens
  chr1:62784870-62785178
  hyper
tccgggtgcactgtccgcgtcccaggcgcgcaccccggggctggcgcaccctggtcgtccgcggcgcgcacaccctccaggcgccctctggccgacggtctcggccctggccccggcgcacccctgcgggcacacccaccgcggcggatgcgggactggccaggcgccgccagccgcggcttcgccccgcgtcgccagctgccaacagcgcccgagtccccgccttcgctaggggagaaaaaaaagactcctgacgcggcgcggactttggtgtgtaggaaggggcagaattgcgaaaccgaggggag

SEQ ID NO: 69794 - DNA, 30 bp, Homo sapiens
  chr1:62793243-62793273
  hypo
tgccattcacggactcgaggctcagcccca

SEQ ID NO: 69795 - DNA, 502 bp, Homo sapiens
  chr1:6280243-6280745
  hypo
agttttgattttccccgtgtttgcatggcatgaagtcttcgtccttgtcacagtagcttgggatgactcccagtccacatggaaaacatcagggagtgacaatccagcaagaaatccctcgctagttccacacctacgcaccgagcgtcggtgtgccaggccctgtgctgggcagagtgtggtatgtcagggtgtgccggttttaggtaacaagactccaccactgagtggcacctgccctattgcaaaggaatccagttcctccggaataacagtcccactgttaacctggtgctactgggaagttccacacagtaatctgagcagtgactcatggaaggatgaggaacgtttgctccagcttctctccctttccagcaagggcagagctcctaaagccaggggttagcacctggccagcttatgtggcagatggtctcagttacaacttcgctgctttcccaaactcctgcagccctcctgagtccgacttccgttgata

SEQ ID NO: 69796 - DNA, 49 bp, Homo sapiens
  chr1:6281776-6281825
  hypo
gctcaaggagcagctcgtgaaggggtggcaggtgcgctgctgccttgtt

SEQ ID NO: 69797 - DNA, 45 bp, Homo sapiens
  chr1:6294199-6294244
  hypo
gctgggattacaggcgtgagccaccgcgcccggcaagggactgtt

SEQ ID NO: 69798 - DNA, 321 bp, Homo sapiens
  chr1:6301689-6302010
  hyper
atcctgcgcgaccctcggccagtgtaaggcgagtagcgggccaaggaggctgtttgtgatggaggagccacgggtgggggcgtcagaaagtagggggatcattccaggtggggagaccactgaccgaaaacgggccacaggacagggggcgcggcgggcagtgtcggggttggggtcggggggcaacggaggcggaagtccattcagtggaccagggcggagcgacgcctgagaattccgcccaggccttgaggcgggcctcgcctcccgcagccaaagcagaacattgcgaattagagcattttgcggtcaattttccac

SEQ ID NO: 69799 - DNA, 548 bp, Homo sapiens
  chr1:6304118-6304666
  hyper
gggagcttcccagtgcgtcctccctcggtcccctcctcctcaaggtttctagagtccagagggcctcattgacatgtaaacgagggtccctataaaggcggcgctgcctcgcactggtgcatggactgcaacatgggcacggagcctgctgcccggggcagcctccccggcaacttccgaaaggtctggggtcttgagggactaggggcaggcacccttccccgggaggtgtgggggggtgccgagggcaggagggtggcagtcctgcactctaaaggctgttcatctgcagatttccaagccgctgatggagaaaaagcgccgggcacgcatcaatgtgtcactggagcagctcaagtcgctgctggagaaacactactcgcaccaggtgagactcaggcggggtgggggtgggtgggtgatacgatcccaacctccctctctccacctcgggaggccggtctaatagacctttccatggtcgggtagatccggaagcgcaaattggagaaggccgacatcctggagttgagcgtgaagtacatgag

SEQ ID NO: 69800 - DNA, 907 bp, Homo sapiens
  chr1:6309182-6310089
  hyper
acatgcggtgcccagcgcagtcgtccggggcagccgtcgcccctgggacaaggccagctgggaggagccggaagacaaacgctgaggccaacgccccctcacccctgggaggggtggcgcatgtctgcgcgcggggcggaggcgggcgtctttggtgctgcggccccggagagcggcctggcctgcctggcgtccgtggggaggcgccggcggtcctaggacgcggagcccagcgagtccgagtgcagcgtggcgtagcccgaggactcggagggggaactcaggaagctgctggtgctgccgccgccgcccgccgcgcgcagccccccgggctcgccccacgacgcgctcaggccggggcgcagagagccggcgtgcgagtgcgcagaggggcgtggccctgggctccgctgggcgctgcttgggggcgtcggggcctctccgggatctgcgccgtcgggggcggcgggcgcagcggggaagggcccgggcgggcggcgcagggcctgtggctcgcactcgaaggcggtcagggcgaaggcgtcgggcagcagcgaggccgaggcggagcgggggccgggcccggggcggcggcgcgggctgccggggggcgagtcgcgggctccccgcgggccgctatccagggccgagggccgcagcgacagcaggctctcggccgagcggcggcgcgcgcgggacggtggtgcgtcctccgcgaaggccaggaggctggcgcggcgccgctcgggcccggcaggcagcaccaggtgcgccagggcggccaggtcctcgccggagccccagcgcggcaggaaggcgggcagcgggacggcggcccacacgtccgcatcgtcgtgggagaagcgccgcgtgggcgggacctgtcaggacgcggctggcttttacc

SEQ ID NO: 69801 - DNA, 32 bp, Homo sapiens
  chr1:6332155-6332187
  hypo
gcctgggccagaagccgcgtgctcatggcaca

SEQ ID NO: 69802 - DNA, 553 bp, Homo sapiens
  chr1:63539428-63539981
  hyper
tctaaagggggataacgcggaagagtgggggagggggtagatttgaggtgtgcaattcttaccacatctggggaaaaaaacaaaaacaaagccaagcgaagtgggcctgccagagttaactatgttcacagagtgcaattaagtgtttggaaggttctgtgccgtgtgctctgatttacggccgcgttcctgggacgcccctttagccgggcgaacgtggagggggccaggcccggccgtgcgcaccctgggagcggagccgggccgctggcgctccgggtcttgggcttggcaccgcggcgcaccgggtggcaagcacagcgcttagcggaggccacacctgcacctcatttgcttctgagcagtgccatgacccgcctgctgatggggcgccttccctttcatcctcgggattatgacaagttattaattgccaccattagccgcagcagcctgcccgagatctctgctgctctctggaggtgagaaaccgcgcatctgaatgccgagggaagaggcgctgagcagccagggcaaacggagcaacaatctg

SEQ ID NO: 69803 - DNA, 30 bp, Homo sapiens; identical to SEQ ID NO: 14204
  chr1:6360980-6361010
  hypo

SEQ ID NO: 69804 - DNA, 30 bp, Homo sapiens
  chr1:63783677-63783707
  hyper
ttcgagagaaaggctcgtttttattaaatc

SEQ ID NO: 69805 - DNA, 325 bp, Homo sapiens
  chr1:63784115-63784440
  hyper
gagttgaaaatcccccgctttgggaaatggaagtaatctgggtgggttggggccttgggtaccacctctgccctttcccaccttccttggtggcggccatccagacaaagaggccggtaatagtttaacaaatctatgaagattttcaagaagcagcagactttgattgttgcgggcgcgggggtgttggggagaaaggaggggaatttttctaatagtcccacccacgttttgctccctcttggacaaagagtaactactcttggtgggggacgcgcccttcactccgcggaacctggtcccaactccccgtattgtaagaaaa

SEQ ID NO: 69806 - DNA, 86 bp, Homo sapiens
  chr1:63784701-63784787
  hyper
catccccccactggacgcacacactaaatctcccctcccctggagacgtctcaatttccttcctatcgatccggactccattcttc

SEQ ID NO: 69807 - DNA, 306 bp, Homo sapiens; identical to SEQ ID NO: 56
  chr1:63784987-63785293
  hyper

SEQ ID NO: 69808 - DNA, 149 bp, Homo sapiens; identical to SEQ ID NO: 57
  chr1:63785618-63785767
  hyper

SEQ ID NO: 69809 - DNA, 317 bp, Homo sapiens
  chr1:63786078-63786395
  hyper
gccccgggcccctgcctttagggctgggcaacccaagcagagcaaaggaggttcctgaatgtgtaaatttccgctttttagctttttttttttttttttttggaccttccgacacttcggttgctgaggcagttgcagacgcgacctctgcagtcctgggcgatggccagccagctcagctcgggtcggtttcgcggaaagctgtctagacggcattgtaaacggttcggagcctgcgggccacaaagctgtggagctacggaaatcaactctgagatgcgttttagggccgtgtgcaacctcgggatcatttagat

SEQ ID NO: 69810 - DNA, 593 bp, Homo sapiens; identical to SEQ ID NO: 26347
  chr1:63786656-63787249
  hyper

SEQ ID NO: 69811 - DNA, 1485 bp, Homo sapiens
  chr1:63787282-63788767
  hyper
cgctgcgtctaacctgaagacaccaggcctcttcccggatccactcgacttacccaggccgctgccaatcccagctccttccccagcgcctcatttccgattttttcatatgctaagtcgtttaacaactccaagtagccagttatggcttctttatttataggttccctgctattttacgtcgtttttatttctctcggcaactattctagtagattaatcaatagccattttctgaccttcgggaaccccagctgatgctttttgtggccgcacgaaaaaatacatacaggaaaacacgcccgcatcaagccgggaaagagcaggtaggacctgagtggtttggttgggggagggggaaaaagacatctcagcaggtgtcttccccggaatgagcactgaggccagaggggaatctgaaatctaattagcaggagggagccgggtgcgctgctcttactctttaaagctaaaaacaatgaaacaaaaagcaaaacagagactaagttttgctttttaaaacacgatatgggaacctcgttctaggtcgcccagtccctgtctaaggagtgtgacaaagtgggggggagaagggcggaagggagagggggcggggaaggcagggcagcgacagtcgcacagtcccgcggacgctcccaggcccacgccctgactcgctcacacccacccacactcacacccacccgctccctgggccccagggcccggatccagcctgggtgggggggtctccgggcgggccgcagcgccctccgtgccccggggatgctggcgcacagtgcggagcggagttgcgcgtctctcgtccctttgttgacaattccctgaaccaacttgagtttggccggctcggccgcggccctgacgtcacgcacggtcacgtggccccgcctcccgctggatctttaagtagaaagtaatctatcaggccagtccttaaaacgggactttcgactaccggggcttcggcgtccctgacacccagccccctgcccccccgctactgtccctgcccgcgccctcccgagctgctcggcgcccggcgtcccgcgcccgcctggaccgctcctgcgccccacgccagggccagaggccgaggaaggcgggctaagtgagggggcgcggcgtggagaaccgccggggccgggagcggtagcgagcgcctagtaccgagcgccagggacggcaggagttcgcggagcgcggccgctgggggcggacggcagagcccgcgccacgcgatgcggggccgccgagtgtgagctgagcccagcgggccccaagccacctgcggccccctcccctctccctgccccccatctttcgggggcactcaaaccctcttcccctgagctccgtggcagcccccgaacaccctcatcgcccgctgccccctccccgccgccgctaccaaccccgaggagggatgaccctctccggcggcggcagcgccagcgacatgtc

SEQ ID NO: 69812 - DNA, 578 bp, Homo sapiens; identical to SEQ ID NO: 26350
  chr1:63788919-63789497
  hyper

SEQ ID NO: 69813 - DNA, 64 bp, Homo sapiens; identical to SEQ ID NO: 26351
  chr1:63789728-63789792
  hyper

SEQ ID NO: 69814 - DNA, 64 bp, Homo sapiens; identical to SEQ ID NO: 26352
  chr1:63789849-63789913
  hyper

SEQ ID NO: 69815 - DNA, 216 bp, Homo sapiens
  chr1:63790252-63790468
  hyper
ggtcccggtcccgctgcccaatcctggactctgcctctccccaatttcctttcccctgagcccccaacgcctaccttccgcggcctccatcccctcgcgcacacctaagctggtcgagcaaactcaccgcgcgcccgccggggatagctttccatacaggtaaaaccgaaaaccgaattttccaaaaatgcaccccgacggcgcctgctcttagta

SEQ ID NO: 69816 - DNA, 39 bp, Homo sapiens
  chr1:63791977-63792016
  hyper
cccacctcatttctccgctgtcgacgtgggctgggggtc

SEQ ID NO: 69817 - DNA, 100 bp, Homo sapiens; identical to SEQ ID NO: 26354
  chr1:63792549-63792649
  hyper

SEQ ID NO: 69818 - DNA, 275 bp, Homo sapiens
  chr1:63792797-63793072
  hyper
cggacccagaccctcaagctgccagcggttgtttaaagtcctggcagatgtcaggaagatgggcccggccgtcgcaccctcaaaagctctttttcgtttaagctttttaaacctcgaagatttagcacaaaatgggaaatgcaaatatcatagacaatgatcgcaagcacttagtggtggggctgggggaagcctgaaacccttgtttgatgttatggaacgcaggcacctgcgacaaacggcactggaaacagctctctcgttgagatttaaag

SEQ ID NO: 69819 - DNA, 26 bp, Homo sapiens
  chr1:63793338-63793364
  hyper
gtggatctggatgtccggggaaaggc

SEQ ID NO: 69820 - DNA, 280 bp, Homo sapiens
  chr1:63793365-63793645
  hyper
aatgaagagtagagcaaaacatgtgccggctgttgagggctgtcgatgcgatggcagatgtggcctgtagggggcgacgagcagacggaaaacttcgcggtttgtctggaatggtccagccccagccccggacgcctctccttccctcccaggctctgagcctcctgacatccttgcttattctcaggccccggaagcctaggtcgaatctcgagaagctgatttcctcctttcccccgcctgtgtcctgggaggaacagagtcccgaggggagtttgtc

SEQ ID NO: 69821 - DNA, 586 bp, Homo sapiens; identical to SEQ ID NO: 26357
  chr1:63795348-63795934
  hyper

SEQ ID NO: 69822 - DNA, 565 bp, Homo sapiens; identical to SEQ ID NO: 26358
  chr1:63795935-63796500
  hyper

SEQ ID NO: 69823 - DNA, 111 bp, Homo sapiens; identical to SEQ ID NO: 38837
  chr1:6391430-6391541
  hypo

SEQ ID NO: 69824 - DNA, 29 bp, Homo sapiens
  chr1:6422825-6422854
  hypo
ttggctaggcgcggtcgtgcacgcctgta

SEQ ID NO: 69825 - DNA, 336 bp, Homo sapiens
  chr1:64240116-64240452
  hyper
gcccgccgctcctggcgctgctggccgcgctgctgctggccgcacgcggggctgctgcccaaggtaagaggcgcccgccggcccccgcccgcccagaccccctgacccgtggccacccttccgccgtccagccgggcgcgggacacgcaggaagcgccgcgctggctccggggcgcgtccggccacccgccacggggctcgccggcgccgccaggccagggtttgccccggagccccgccaggccagggtttgccccggagccccgcggcgggccggggcgcgcccagggactcgttcctcggtgcgcagcagcgattgtcagcgctgacaggaag

SEQ ID NO: 69826 - DNA, 251 bp, Homo sapiens
  chr1:64240532-64240783
  hyper
cgcgccccagccggtgttcaggcaagtctatcctgcccccaagttgcgagccggcccggaaggcgcggtccaggagggagtttggattttcagtggtgctcgccagagcccaggcggctcgcggatcgacgcaaacaaaagccctgtcctcctggggctccggcggcctcgcatcgccaccgcccccggccctccggccctcccgagagtcatcatagaggccaaaacttgtgcgccgctgcagccgctgc

SEQ ID NO: 69827 - DNA, 39 bp, Homo sapiens
  chr1:64240997-64241036
  hyper
ctggggtccttgctgcgtctgagccggtacacaatgaga

SEQ ID NO: 69828 - DNA, 274 bp, Homo sapiens
  chr1:6446079-6446353
  hypo
caggaccttaaacctcgcaccactcaggctggccctcaggcaagtagaagaatgagttccacctgggcggagttccacctgggcagagaggtcttggctcacaggcaccgggagagctggaaggctgcggggaagccgaggaaggccaacacaccgcacaacacggcaggtgcctggccctcctctgacagtggccctcaagctccaggagggccgaggaaaatgcagattcctgggcctacccctccctgaccttccccgcccctggagttag

SEQ ID NO: 69829 - DNA, 30 bp, Homo sapiens
  chr1:6446992-6447022
  hypo
tagcaagtgacttcacgtttctgtcctaaa

SEQ ID NO: 69830 - DNA, 17 bp, Homo sapiens
  chr1:64734652-64734669
  hypo
atgttctgaattagccg

SEQ ID NO: 69831 - DNA, 16 bp, Homo sapiens
  chr1:64734789-64734805
  hypo
gcgacaaagcaggact

SEQ ID NO: 69832 - DNA, 59 bp, Homo sapiens
  chr1:6479255-6479314
  hyper
gtgcggggtgcagagcgcgcggcagggcagggagggctcactcacggggcgctgccgtg

SEQ ID NO: 69833 - DNA, 735 bp, Homo sapiens
  chr1:6480216-6480951
  hyper
cgggggccttcgctgcgtgaccccgagggcaggagggccaggtggggccaggccttgcctgactggagctacggtccctcctctccaatgctgcccttcattcattccccaggctcgggttcagcgtcttctctgagccccgccctgggccgcagcaggggacccagcggttacgggagctcccatgagggacagcagcgggagggacttgcacccccagctgctttatcgggtgaagggctgagctggacgggaaatccgagttccggagaaaggtcgtgacttgctccagtcctcgacgctgggaacaggccgagcctggacaagggccccagtcgctggacgcccggctctaaggagcccgtagaacccttcggcggcttgcctagttaagagtcttttggttaccccactccaggctttgggtggggaaacggaatcctagagaagcagaggcagccctggagccctcggagctcgttttcattcccaccggctaggggtccgggttctcgcccgcaagacagtcagggctcatgtgacgcgcgggcaggacagttttgggtgcgggccccagtggcccgcccaggaccgccttcgcgccgcgtggccgttgctgcggcaaactggctggcgtcccccgcccatctgctccgggctcccctcccccgaccggctggcggggcaacggccacgcccgcgaaccacactgcgaactgccgggcagagagatga

SEQ ID NO: 69834 - DNA, 49 bp, Homo sapiens
  chr1:6484931-6484980
  hyper
cgggctcctctggcccgcaagaacacgtgcatggcgtcctggggaaggc

SEQ ID NO: 69835 - DNA, 359 bp, Homo sapiens
  chr1:6484981-6485340
  hyper
ctgagtgcggagtcgcggcgccgcacgcggcaccatggccctggagcaggcgctgcaggcggcgcggcagggcgagctggacgtgctgaggtcgctgcacgccgcaggcctcctggggccctcgctgcgcgacccgctggacgcgctgcccgtgcaccacgcggcccgcgctgggaagctgcactgtctgcgcttcctggtggaggaagccgccctccccgccgcggcccgcgcccgcaacggcgccacaccggcccacgacgcctccgccaccggccacctcgcctgcctgcagtggctgctgtcgcagggcggctgcagagtgcaggtgggtccgcgcggttcgccaggggcactga

SEQ ID NO: 69836 - DNA, 89 bp, Homo sapiens
  chr1:6488312-6488401
  hypo
ttgcatctggctgcccgcttcggccaccccgaggtggtgaactggctcttgcatcatggcggtggggaccccaccgcggccacagacat

SEQ ID NO: 69837 - DNA, 96 bp, Homo sapiens
  chr1:64937203-64937299
  hyper
cctccgagtgggctccgcgctcctttcccctcccgggagcatggggggaggggctggcctggtagattctgggtagactcccgactctaatcctgc

SEQ ID NO: 69838 - DNA, 244 bp, Homo sapiens
  chr1:6500744-6500988
  hyper
cttcgcggcgagccgcggccacaccaaggtgctcagctggctgctgctgcacggcggggagatctcggctgacctgtggggcgggaccccgctgcacgacgccgccgagaacggggagctagaggtcagcgcgggcccggggtgggggcgcgcgccctctgctggcaccgcgctttcagcacggccctgcccgggcgcgggggtcccagctcgcggccgcggccgggtcctcactgcgtgcccc

SEQ ID NO: 69839 - DNA, 125 bp, Homo sapiens; identical to SEQ ID NO: 8
  chr1:6501054-6501179
  hyper

SEQ ID NO: 69840 - DNA, 130 bp, Homo sapiens
  chr1:6507126-6507256
  hyper
gcccagccagtgccccgtctccaccgttgagcccaagtgccaggtctgcgtggtcccctcctggctgtgtgagccccctcccggctgtgtgcgtccctccgggctgtgtgcgcccctcccggctgtgtgc

SEQ ID NO: 69841 - DNA, 1654 bp, Homo sapiens
  chr1:6507490-6509144
  hyper
ggtgtcgcatttcctgcaacgtgagccaggtcgggcggggtgaagggtctgaggccaccgcagggacgcatgggctggagagtggggcagaggacagcccccacccggtcactcagtctttggcccggccgcctcactctccctcactgagctgggcctagttgggggcagctgcgatggggtgggaagccacgctgtcacccgaccccgccttacggcccctgaaatccgaggcttgagcgcgggtgtcggtgtcgctttcgtggatggcgatggtttccagatgcaggaggggaagggtggggacgcgacccggagccgggggccaaatatgagaggcctcctctgcccacagtcagccctctcccctctcgggcggggatgaaggtgggggctcagctcccagcttagggagaggcgcagggggcggggtcacatctggccggggacgggtgcagagccgcggccaggtgtggcaaagtagttggcgccccctgtggcatccgcgacggctgggggggttcagcctgggattggcgggccccgggtgatgtcaggccgtcggagcccataggctggctgtgcgcgggtggctgtaacctgagaggaagtatcaggtaacgcaggtgtcgggtcctgccgcccccacagccaggtgcacagcgggggccaccagcaccgtggcaggtaggagcagcccccggacgggcaaccggggtccgtggcaagccggagcctccgagagcacaggctctggagggggctccctccggccccggacccccgaaagacagggctccgcggagccctggggacccgcagtccttctgacagccgagagcggagtgcggccgagggcctagtgagggctaagctgggaggtgccccttcgccagctccccctggcgtcggggctgggccaccccgcccctgggcccgcctcttctggcctcagtgggggcccctgtgccccttggccggtgcccagaacccctccctgtaaggcgggcggagcctgcccttccaccgaggcccccatgaccctcgcccgctgcccactgtgagaaccagggggtctaggaagtcagctgctgcacccctcgacggccgctggccgcgagtccccaggaggtgaagagctgggtggggaggcgtggggggcgcctaccgggcaggtgcccgagccccaccggtcactgtcttcccgcagctgagctcctgtgacggccacgacgggctgcggaggcaggactccagccgcaagccccgcgccttcagcaagcagcccagcacgggggactactaccggcagctgggccgctgccccggcgagacgctggccgcacgcccgggcatggcgcacagcgaggaggtgcgtgcccgccagcccgcgcgcgccggctgcccgcgcctcggccctgccgcccgcggctcactcgaaggcccctccgctcccccgcaggcggcgctgcttcctgggaaccatgttcctaacggctgcgccgcggaccccaaggcgtccagggagctgccaccgccgcccccaccgccgccgccgcccctgccggaggccgcgagttcgccaccgccggccccgcctctgcccctcgagagcgctggccctggctgcgggcagcgccgctcctcctcgtcc

SEQ ID NO: 69842 - DNA, 34 bp, Homo sapiens
  chr1:6533352-6533386
  hypo
gctgaagcgactggccgcccggttcttccagctg

SEQ ID NO: 69843 - DNA, 36 bp, Homo sapiens
  chr1:6537501-6537537
  hypo
tatgacgccctagcacgtttccgacagttactgaaa

SEQ ID NO: 69844 - DNA, 30 bp, Homo sapiens
  chr1:6542460-6542490
  hypo
ccgatgagagatttccgagataggcgtggt

SEQ ID NO: 69845 - DNA, 260 bp, Homo sapiens
  chr1:6545379-6545639
  hyper
gtacctggctatcaccgtcgcgggcacgacccccggcccaggagggctccgagtcccggaggggcagccccgggcccggcctggaggctgctaggcgtccggagacaccgggtcctgtccccatggcggccggaggaagccgcggtctgcgccgcccgccggacaaagcgcggagccccgcttcctgccattgtgcggccgcgcccgcccccgccgagcgcggggaccccggggagggccgggcccggaacagcccccag

SEQ ID NO: 69846 - DNA, 46 bp, Homo sapiens
  chr1:6545885-6545931
  hyper
gtacccccacctctgcgcctctgcgcggccccgggcccctctcttc

SEQ ID NO: 69847 - DNA, 358 bp, Homo sapiens
  chr1:65468302-65468660
  hyper
ggctccaggtttcagcgcaggcttccgcggagccagctggatgcgtcaccatccgaaagtgcgagcctggccggcggcggcggaggcgggggcaccgcgcagttggaagcccgggcgctcttaccgaaagcgcgagcccggacttccccgccacgatcgatgtggccagtctgcgcctgccgcagttcccgctcgcaccccggcccctcgcagagtcccaggaaagcgctgtggcgggcgggcagtctctgcccccgggaggggacgcacgcacgcgctgctccttccaggtcccggcggggaagcgatgctttcttggcccgggcttggggccagcgggaaccgggctgtccggccg

SEQ ID NO: 69848 - DNA, 275 bp, Homo sapiens; identical to SEQ ID NO: 5540
  chr1:65731231-65731506
  hyper

SEQ ID NO: 69849 - DNA, 69 bp, Homo sapiens
  chr1:65731781-65731850
  hyper
ggagctaagttctttgggtgagacgtgcaacaacgcaggccccaaagctctctgcgcgcagcgccgcgg

SEQ ID NO: 69850 - DNA, 69 bp, Homo sapiens
  chr1:65774834-65774903
  hyper
tggtcctcaaagcttcgcaggccgagatacctcgcccctttcttctctgtcacacgcgtgcgaacacac

SEQ ID NO: 69851 - DNA, 30 bp, Homo sapiens
  chr1:65775296-65775326
  hyper
tttccctcctctttgcgtcatgtcgggcac

SEQ ID NO: 69852 - DNA, 30 bp, Homo sapiens
  chr1:65775826-65775856
  hyper
gcccagagactgtagcgagctcctcctaat

SEQ ID NO: 69853 - DNA, 21 bp, Homo sapiens
  chr1:65940402-65940423
  hypo
agaaaaggccaggtgcggtgg

SEQ ID NO: 69854 - DNA, 64 bp, Homo sapiens; identical to SEQ ID NO: 26365
  chr1:65990955-65991019
  hyper

SEQ ID NO: 69855 - DNA, 442 bp, Homo sapiens; identical to SEQ ID NO: 26366
  chr1:65991119-65991561
  hyper

SEQ ID NO: 69856 - DNA, 153 bp, Homo sapiens
  chr1:65991605-65991758
  hyper
cgggccgcttagggactgggagtccggggcagcttagcgggaccaccagaggggccagcgcccggcgggcggcgggggtggggtgggtgcgacgccgggcgactctcggctcccgtggggcgaggaagatctggacacacggctgacagcagc

SEQ ID NO: 69857 - DNA, 64 bp, Homo sapiens
  chr1:65991783-65991847
  hyper
cgggaccaccgagagagcatgccacccggccaacttcttttccaggcttcgtgcctactttgga

SEQ ID NO: 69858 - DNA, 23 bp, Homo sapiens
  chr1:66030258-66030281
  hypo
cgtgaatccgtttcttaatgttt

SEQ ID NO: 69859 - DNA, 20 bp, Homo sapiens
  chr1:6621025-6621045
  hypo
agagtcggaagactctgtct

SEQ ID NO: 69860 - DNA, 506 bp, Homo sapiens
  chr1:66258145-66258651
  hyper
tcaaaccaggattttcggtctctggctttggataggcacgcagggctgtgcgtaatccttcagctctggtggtaagggagatgcagtgagctcccggctgggagagagggttattttgcaaaactcccctggtaccgtgcccgcggaatattgcaggaggtctgtgaggtaggtgggggaaaaaataacctgggagggcaatcagggagaggccagacgactggggacggcgtgctttgcaccctagaattgacaggtggtggcctcagcagttacaacctactacacagcatctcgtccgtgcgatacggtcacattgttattccccgcacccggctgaggagcgcagcgcggcagaccaagtggcaccggcgagctgtctctcttccggggggcgggggtggacagtagggagagggggtttaaagggccagaggacgagagaagagctgaggggcgcgtcgccagcgcctgtgtctccctggcgcgggttccccaggctagcc

SEQ ID NO: 69861 - DNA, 89 bp, Homo sapiens; identical to SEQ ID NO: 26369
  chr1:66258671-66258760
  hyper

SEQ ID NO: 69862 - DNA, 86 bp, Homo sapiens
  chr1:66258761-66258847
  hyper
ccctccgggcagactttcgtcccccacccccgggagcgcggaaggctcactcgcagcgcatggtctacccgcgccgggcggagccc

SEQ ID NO: 69863 - DNA, 354 bp, Homo sapiens
  chr1:66259077-66259431
  hyper
tgacggcgtcattgtcgccccttgtaggaaatccgccaaccggcccctagcctttcgccctcatcttctctgcttcggcttccgcccttggacctcttgacaagtcactggggaggagaggatggagagaggctaagggagaatggagagaggcagaaggattcagggcttggaagccctggagtaggtgacggatgggcgcgcggtgcccagtgattgactgcaggcagcgggcgcggaagggaacctgaactacccaagagtttgctgggctgaggctccaggatgctcctgcgtgccctggtggctggggcaccaaggaggggcgcactcaagcctcggcatcaccaaggc

SEQ ID NO: 69864 - DNA, 139 bp, Homo sapiens
  chr1:6627618-6627757
  hypo
caaagaaaaaaaaaaaaaagaggagatcggcttacctgatactagcagagttaccctgggctctgctgcattgatggcagtttggcagttggggcctggggccctgggcctcgttcatcttcagcggctaggtcaagga

SEQ ID NO: 69865 - DNA, 30 bp, Homo sapiens; identical to SEQ ID NO: 38839
  chr1:6635034-6635064
  hypo

SEQ ID NO: 69866 - DNA, 171 bp, Homo sapiens; identical to SEQ ID NO: 26038
  chr1:6663729-6663900
  hyper

SEQ ID NO: 69867 - DNA, 622 bp, Homo sapiens
  chr1:66998790-66999412
  hyper
agctgcagccccagtcggttgcgagaaaagctccccacctggggaagcgaggccgctcccgtgtgcgctcggcggggaggacgcggtggcggcgggactcgaactcggtcgtcgaagggcgccccgcagggtcccgtctgtagcccggacggcgagcccaggttggagtgggagggagccggcgtgcacagctgtctttggtcgggctcaggcttccgctccctgcctgctcccctttccagcctcccgccccagaaacgatctcgagcgttgccagtttgattccagagccccactcgggtgggttcttttgtttctttgttttaatgacagttcccagcccttcagcatgtcatgcgcaattaattccctggctctcacgaaggcagctggggtgaaatttcttctgcatcatccttttggggatgtttatgatgtgacgtcagtcggattgatttttctctcttgaatgaaggatgggaggggagaaagagagacggagagagagagagacgcacagatgtgcacggaggccacagacactgacatttggaattccttcagggtaaaaggacaccggaatgggagcttagaagtgtgttgctaagatttccggctgcac

SEQ ID NO: 69868 - DNA, 201 bp, Homo sapiens
  chr1:66999472-66999673
  hyper
accccctccgcagcgagccacttaggtgctgctttcacgccagagtcccctgttaaggtggcagcccttgataactaatctcgggcacccagccgcttctgtaagcttaaggagacgacgaggaggggcgggggaagtgcgtcaccaggtggggaaggggctgtgtatttggtgacaagcgggaggcgatgggggtggagg

SEQ ID NO: 69869 - DNA, 378 bp, Homo sapiens; identical to SEQ ID NO: 64
  chr1:67217965-67218343
  hyper

SEQ ID NO: 69870 - DNA, 30 bp, Homo sapiens
  chr1:6765811-6765841
  hypo
ttgagctagcatacccggccccatctttaa

SEQ ID NO: 69871 - DNA, 23 bp, Homo sapiens
  chr1:6776365-6776388
  hypo
agggagaccgtggggagagggag

SEQ ID NO: 69872 - DNA, 648 bp, Homo sapiens
  chr1:67773132-67773780
  hyper
agcacacgattttatcgcgcctatcatatcttggtgcataaacgcacctcacctcggtcaacccttgctccgtcttatgagacaggctttattatccgcattttatatgaggggaaactgacggtggagagagaattatcttgctcaaggcgacacagcagagcccacaggtggcagaatcccacccgagcccgcttcgacccgcggggtggaaaccacgggcgcccgcccggctgcgcttccagagctgaactgagaagcgagtcctctccgccctgcggccaccgcccagccccgacccccgccccggcccgatcctcactcgccgccagctccccgcgcccaccccggagttggtggcgcagaggcgggaggcggaggcgggagggcgggcgctggcaccgggaacgcccgagcgccggcagagagcgcggagagcgcgacacgtgcggcccagagcaccggggccacccggtccccgcaggcccgggaccgcgcccgctggcaggcgacacgtggtgagtgaccagtgactcggggtcggggacagagagagccccaggatcccggaccagcggggtgtctgcgtgcccgggattccgtgtctcgcgtctcccgagggggcttcggcgacggcttctctcttta

SEQ ID NO: 69873 - DNA, 183 bp, Homo sapiens
  chr1:6801549-6801732
  hypo
aatgaaggcattggccgagctgtgttcctgctctaggctctgcaggagaatccctttccttgccttttccagctccctcaggctgcccacatcccttggtttgtggtcccctcctcctcctcttcaaagccagcagtgctgcctcttcacatctcgctctgaccttggcggttgtgatcccat

SEQ ID NO: 69874 - DNA, 17 bp, Homo sapiens
  chr1:6811500-6811517
  hypo
cgcgcctggcctataat

SEQ ID NO: 69875 - DNA, 86 bp, Homo sapiens
  chr1:68297687-68297773
  hyper
tagagaaggcacagacgcagaccctgcctctgacgacatccaaaagattcattatacacagcctattcaggcgaagctacaaccgc

SEQ ID NO: 69876 - DNA, 4 bp, Homo sapiens
  chr1:68298379-68298383
  hyper
cact

SEQ ID NO: 69877 - DNA, 198 bp, Homo sapiens
  chr1:68298403-68298601
  hyper
cgtcatatgggctctcccctctgcgacccgctatttccctgctagacccccagcgcccagcggattccaaggctgcgctcccgccggctggtcccgggaggtagaaagtaggcagaggggcgtggcgtccctgtcgcccccacatgccagccctcctccaacgcctgacaccaccacaagccacggctgggaacactg

SEQ ID NO: 69878 - DNA, 262 bp, Homo sapiens
  chr1:68696775-68697037
  hyper
cattgaagtttgtgccgggatgtcccaaatcttgagggggcggggggcgcgagtgtgcagagaggcgggaggatggatgcagatggggagacagtgaggggaagggagtttttccgagtggacggtccgtgaggcggttttcttcacccggaagcctgtttgactcagagaggtccgggaggtgcacgccaggggaggtctcccggggcgggcgctgtcgccgaggaggccggcgagctgtcacctgcggggggctgtggtg

SEQ ID NO: 69879 - DNA, 30 bp, Homo sapiens
  chr1:68698056-68698086
  hyper
cactccctccttcctcgcctcctttctggg

SEQ ID NO: 69880 - DNA, 30 bp, Homo sapiens
  chr1:68698513-68698543
  hyper
aaatcaccggtggaccgccttgcagacctt

SEQ ID NO: 69881 - DNA, 123 bp, Homo sapiens
  chr1:68703942-68704065
  hypo
atatctgcttctctccgcgcagagtggcaataggtggaaaacccgggaaggcccagaaacacctgccccggacagtgattcctgtgatatgcagacaacacccagtaccgtggcagacttggc

SEQ ID NO: 69882 - DNA, 30 bp, Homo sapiens
  chr1:68761411-68761441
  hypo
gcgtgctcgcctcgacgtccgctcaaagtc

SEQ ID NO: 69883 - DNA, 30 bp, Homo sapiens
  chr1:6964959-6964989
  hypo
ttgtttcgtattgcacgctgaacactccga

SEQ ID NO: 69884 - DNA, 195 bp, Homo sapiens; identical to SEQ ID NO: 38841
  chr1:6984148-6984343
  hypo

SEQ ID NO: 69885 - DNA, 301 bp, Homo sapiens
  chr1:70032971-70033272
  hyper
cgggggaggaaaccccgaggaggcgctcccggccgcctctttgctgagatagcaggagcagcagcctgaggagccacgagctcagcgtcactgagctagtgcgggtgcaggggcgctcaggcaggcgcacaggccgggagccgcttctgccgctcaggcggccgcgctgcagaaagccgcgccgcgctgcccgagcgcccggggctggcccgcgagcgggaggagccggcagccgcgctccgccccgcgctgagattcgtgccacctgcctcgaacaccacggaggcgagaggaacccaga

SEQ ID NO: 69886 - DNA, 111 bp, Homo sapiens; identical to SEQ ID NO: 26378
  chr1:70033503-70033614
  hyper

SEQ ID NO: 69887 - DNA, 569 bp, Homo sapiens
  chr1:70033922-70034491
  hyper
ggagccttctgggggcggggagggagctgcgcctccgccaccgccgccgccgccgccgctgctgctgcggtcgctagcgcggcgcgctgggcaggctgaggctggggagtggacgcgctcctgcctcccccgccggcgcttcgggcttcccctcagccgcttcccgcgggaacctctccagccgtccacctgaagggcactggcatcatggtctaacgtggcaccttcctggattcccctctatctcctgttcttcctaccttctactccttccctcctcttctcctccgaagaccctggcgcccactccactgcggacccctgaacacttaaggaataacccttggcagctgcacgactacgctctccgaaacctcatgggcagtttctcccgccggcgatgtgagtaaggcacgctcgctccgtggcggagggtgctgcgggggcccggccgcggcgaccgtaggcgcgcgaggtgtgggaccccagaggccggccgggggcgggggtggcagggcgggaggcttcggcgctcgcggggagctgcttgtgcggtggccgagggaggc

SEQ ID NO: 69888 - DNA, 82 bp, Homo sapiens; identical to SEQ ID NO: 26380
  chr1:70034492-70034574
  hyper

SEQ ID NO: 69889 - DNA, 120 bp, Homo sapiens
  chr1:70035088-70035208
  hyper
cccttgaggatcttgcgtcctcctctccgagttattaaggatgcaggacgtgtttcggattcgacgtggaaagagggagggaagcacattagcattaaggtaatcatggcaccctggctc

SEQ ID NO: 69890 - DNA, 215 bp, Homo sapiens
  chr1:70035209-70035424
  hyper
tggactattagattggctaccagtggtctctaatcttactgtttgcagagtcaagaatgggggcgggggttgggggactgtatagattgccttttaaaatagtgtgacttcataataacggagatggctgaaagattgcttccttacactacttctcggccatcagggctgaataaaggacccgcctccgccctctactccggctcttctctggc

SEQ ID NO: 69891 - DNA, 112 bp, Homo sapiens
  chr1:7023766-7023878
  hyper
acctggctgggggggcgcgctcccggggcctgggggctgggcgcggctcggggagctgcgctttgcggactggaggtggcgaccgtgcgagcagagacgcccctcaccatgg

SEQ ID NO: 69892 - DNA, 29 bp, Homo sapiens
  chr1:70599140-70599169
  hypo
cgatccgaccgcctcggcctcccaaagtg

SEQ ID NO: 69893 - DNA, 75 bp, Homo sapiens
  chr1:70672852-70672927
  hypo
gtgtcagtcgccgtgcccagcctgagttttaaaggaaaacgaccgtagcagcttttgcaacgttattaatgaggt

SEQ ID NO: 69894 - DNA, 35 bp, Homo sapiens
  chr1:7067754-7067789
  hypo
cccctgtggggctcccggggcgtcgcttctgcctc

SEQ ID NO: 69895 - DNA, 38 bp, Homo sapiens
  chr1:70710368-70710406
  hypo
ggtcaagaagcagatcgagacggcggtcacattctaag

SEQ ID NO: 69896 - DNA, 32 bp, Homo sapiens
  chr1:70793696-70793728
  hypo
gagactgtaccactgagcgagactccgactca

SEQ ID NO: 69897 - DNA, 30 bp, Homo sapiens
  chr1:70859409-70859439
  hypo
cagcagagagaatatcgtagggcaattaaa

SEQ ID NO: 69898 - DNA, 30 bp, Homo sapiens; identical to SEQ ID NO: 26040
  chr1:7130249-7130279
  hyper

SEQ ID NO: 69899 - DNA, 54 bp, Homo sapiens
  chr1:713277-713331
  hypo
ctaacccaggtgggtcgctgtccctcacgcctgtaatcccgacaactctgatgg

SEQ ID NO: 69900 - DNA, 885 bp, Homo sapiens
  chr1:71512862-71513747
  hyper
aaaaaggtgcagagccgccccgacgggtcgatgtgctcccaacgctgcttggacaggtacacgacgatgacgaccggggtggtgagaagctgcccgaccaggtcggtgagcgccagccagccgatgcacagcaggaaggacttcttgcgcttgctctcccggcgccggtagctgcgcgacacgagcagcatggccagtgcgttgcccacgaaaccagtgagcagcatggtgatcgggaaggccacggacaccgatccgcaatcctcgccagaccctggagggcgcgtgaggttgccccgcgcctcggcggaacgctcgggcgcccacatgcctgtgtaggagtggttgaggcgggtgcagaagggggcatcccctccgtagccccgggtctccttcatgttggcttcgaggtgaggaggggatggcgtccagagagccgcagcgggagggggcagacgcggcgcgggcggcggcggaggtcggcgtttaccgcggctggggctgggctgccccccatggtgcggggcgcagccgccgccctactccgctgctgggaccgcggccgcggcggcgccagggctcactggcccgggagggagccacgccttcctctctgggaaacctctggtggcgaggcgcgcggaggtgccgagtcccctttataaggccgagggggcggggcgcccgtgggtgtggacagaaccgaggtgggaggagggtgcaaagcaactgagcgcctctcttggctgttgcctatcctgatcgcctgggttgggaagccccagacggtctcctctgaaacgccctgctcctggccggaccgggagcccactggggtctcctccagttctccgctaaagtgtcggtggacggcaagcagctaat

SEQ ID NO: 69901 - DNA, 30 bp, Homo sapiens
  chr1:71520000-71520030
  hypo
gtggcagctgggttccgggcaggtggagcc

SEQ ID NO: 69902 - DNA, 30 bp, Homo sapiens
  chr1:71532563-71532593
  hypo
gaataagatctttttcgtggggaagaagag

SEQ ID NO: 69903 - DNA, 30 bp, Homo sapiens; identical to SEQ ID NO: 38843
  chr1:7162881-7162911
  hypo

SEQ ID NO: 69904 - DNA, 194 bp, Homo sapiens
  chr1:72118097-72118291
  hypo
aaatctagccatctacgtttataaataaagttatatggaaacgcagcacagccattttttatagacatatatggctacttatatactacaatattagcattgagtagttactacagacaccatagggccaacaaagcctaaaatatttactattttgcccattatagaaaaagctggcccggtgtggtggctca

SEQ ID NO: 69905 - DNA, 153 bp, Homo sapiens
  chr1:72383459-72383612
  hypo
cttaaaaaaaaaaaaaaaaaaagtaagtcatatatattttggaagcggccaaattgaacagcaaaccactcttcaaaaagcacaaattgagttaggttgcctttaagaacgacctcactgctgtgtgctctactgcaacgttaaaagaagaac

SEQ ID NO: 69906 - DNA, 436 bp, Homo sapiens
  chr1:72747831-72748267
  hyper
aacgggccggggctccgggaagaatctgcacctggaattcttgggatgtggtctttccatgatgagcaccaccagcattattgcttgtgttataaagaaggcaaagagggttcaaagagagacagaaagatagaccgaaacaagtacgaaaagcacgccgttcttcctacctaagcaccgccgtgtccccttttctgaccatcatgttgtccacggccgcccaggggaagtccacactctgtccagccgggaggcaggagggtagcaggcagcacaggctgaggagcaccgccgccagccactggttcgagcaacaagcaccctgcaccaacagcatcatgtccatccctgctagggctgctcactctccagcagctttcagctcgcactcccccaccccctggtgctggcgagtcttcccgggaaccaggcggcg

SEQ ID NO: 69907 - DNA, 379 bp, Homo sapiens
  chr1:72748650-72749029
  hyper
gcagcagaagcagcgcggagcgctgcgccggccgccggctcccgggctcgcgcgcgttgccaagcggccgtttccttagcaaccccgccaggggactggggatggagaagggagggggattaaaaaaataataaaaaaagaaagaaaaaagatagcaagaaaaaaaaaagaaaagcaagacaacgaaaaaaaaaataggaggaactgtatcacaattatgcaaactaagggggaaagagaggcaccttagaatgaaggctctccttactgtcgtaagcgctagagggattctttgctagaaaagtctccgtgtcagggctggggtgaagagagctgaggggcgctttgccttccctcaccggtgcgttttacctctcga

SEQ ID NO: 69908 - DNA, 847 bp, Homo sapiens
  chr1:72749731-72750578
  hyper
cgccgggctgttttcagccctgccctggcccaaggcagaaggagatactaggcgtggggccacccctactcttttttcttctttccttcttgaactcatttccagattcaagatccttaagcttttccgggccatttgcaaatcaatgcgagaaccgaggctgagtcgttagcagttacaccaatcaatcttgttcagcgaggagtttgggaagcagagcggggaagtgaaaatggaaaataagtaattaaaaaataagctccctccccctcacacactttttcccttcctccaccccatccccctttagcagtgtttgaagaagatattctttgccagatcccagttcttcttttggaggaaatgaagcaaaacctcacacgtccgtaactcgttttccataatgctagcagggtcatttggcaaagcgcaccgaagcaagactctctgcaggggtcagcatccggctgcctccgcagactgagctctttacgaggcaggcagggagtcgttttgcttggtggtagcagtgttcagagtgatttttatcgccatgcacggggatatatggggaaagggaagggttcccatcacctgtgaccacccagactggcttacagacgaatccttaactagcaacacctccctgctgaactggcactccaaggctgggcagctaacggagacatttgcgtcaggagtcactgatgttagtattctgccttaactctcaaaaccgactcggaaactgagagtgcaatagtttcaaccgcattttgaaacatcaataaaatgttagtcatttgcggatgaatgaaaacattttctttaccgtctggtatgctag

SEQ ID NO: 69909 - DNA, 30 bp, Homo sapiens
  chr1:7315042-7315072
  hypo
gtttcacatacaatacgtatttctactttt

SEQ ID NO: 69910 - DNA, 30 bp, Homo sapiens
  chr1:7445788-7445818
  hypo
tgattctggggtgcccgctccccagcactt

SEQ ID NO: 69911 - DNA, 30 bp, Homo sapiens
  chr1:7500700-7500730
  hypo
tgaaggtgtggtccccggatcccagcacct

SEQ ID NO: 69912 - DNA, 15 bp, Homo sapiens
  chr1:75594000-75594015
  hyper
cgtggccgttttatt

SEQ ID NO: 69913 - DNA, 164 bp, Homo sapiens
  chr1:75595334-75595498
  hyper
cctatccccagaaaccgagaaaaccatctggtttttgcacttagataaagtttaactttcctgccacactggccgagttgggctttcagacatccctggggaagtgggaaaacggggatgtggaaggggaggagaagcctgaagggcctcggttccatcctctt

SEQ ID NO: 69914 - DNA, 26 bp, Homo sapiens
  chr1:75595733-75595759
  hyper
cctccaaaccacaggcgtgcttaagg

SEQ ID NO: 69915 - DNA, 173 bp, Homo sapiens; identical to SEQ ID NO: 26389
  chr1:75595818-75595991
  hyper

SEQ ID NO: 69916 - DNA, 249 bp, Homo sapiens; identical to SEQ ID NO: 26390
  chr1:75596135-75596384
  hyper

SEQ ID NO: 69917 - DNA, 248 bp, Homo sapiens
  chr1:75596611-75596859
  hyper
aattctgccagaatccgcaccttcttatgatcgcgaaagtctccccatcctccaccgcctcctacagtcctatggcccactgtacccttggcgctggagccctggaggtgggcggtgagggccgcgggccagggaaagctcgggtccgcaagagcagggctctgtttctgcgcctgcaggccgcccgggagtcctggatgcgcctcctttgaccacgttttctctcaggctccagctgtgcctcgccc

SEQ ID NO: 69918 - DNA, 655 bp, Homo sapiens
  chr1:75596929-75597584
  hyper
cgggaatccgagtttccggagattgcctgagcaccgcagaacctccaggttaagttctctcaaacgtgtggttactcaccccgaggagctcagaggcaaagggttcaatagtcaagttggtggggactttccctacttaaagttataatttgctaattcggatctattgcttttaaatatcgagttccagagacctctgtcaatgcaggcttaatttcatcccactgatgaaggatgtttataaacggcgcctgcagtgcgagctgagtgtgaaaatatcagttttatgccttttgataagaattaccgaggcggaaggctcattagacgattacaaatttcgcagctgctcgcagcccaattaggcagctcttcgggtgagtggaagctgtgggggtcagggcgggttgatgttccctctctccagcccggacctccaatcaaggcctggctccacgggatctagaccccttccctgcccccatctgtttttagggagatacactcaaggcttcccttaagcaggagaggcacagcctgggacaggacgcactccgaagtctctcaggctgtctttcccatgggcttgcaaaaagccctgtggtccacggatgttggtagacaccttgggtgggcctgccgcctctgattttca

SEQ ID NO: 69919 - DNA, 981 bp, Homo sapiens
  chr1:75597825-75598806
  hyper
gtaagaggcgtgacgcgagctccagggaaccgggccaccaggaagaagctataccttcgtacgcccacccctgacaaaaggtcagaaggtcgttggaccccagaccgacaggacgatcagccctgggattcatagcaaacacattcccctcttcttgcacactcgacccccagccaaaggcttataccgcccaggacatagaaattgactcaccgcccagaggcttacagctcaaggaggggtgcgcgcagctgcaccccgggacaggtcagcatcccacaaggcgcctggagtaaagcgaggccagaccaatctttcacgtcttctgctcctgtctgacgaccattcttcttccccaagcccagaaacctctaaaaatgaatcattttctccacttatgcagagatagacgctcttagatcaaggttagtattttgaaaacctgactgagagccgcctgattaggcgagggtgggtggaaagaccgcataaatgcccgcacccccgccctgcttccctaacacagctccagctctctctggatctccaaatgacccgcgcgataaattctcctcgatagtagccagacagtaccccagattcactttaaaccctaacacacacacacacacacacacacacacacactgtaattaaatatccaaaccggacctttatgtttaattccactttcaacgaaatcctgctctatacacgacctgatggcgccaatgttctgcacgactctgactttccattcggaagagcggtctccacaacgatgctatttcatggaaaatgcattatgtgaatttctccaccacccccaataccgatttctgcatttgatgaaaaacacaagtctttctggttcccacgcacaagttagctttttgaaaagtcagtccaccccaatctttcaattttctaagagggcacagattaattatatcgtcctcctcccttcgctcagtaaattta

SEQ ID NO: 69920 - DNA, 315 bp, Homo sapiens
  chr1:75599376-75599691
  hyper
ctgaatacctccctccgccgcttccccgccccgcagtcagaacttgaggcagaagacaaggctgctcgggcttacattttgtctaggagatgaaagagcaatactcattagcaacatacttttgtctttcttgtagccttgatttcaaatctagtcgcaaatcataagcttttgtgttgctcagatgttccttctttatcttaatgagaaaacttttcggaaagggagcgcgaactgctagataagtcagctcccaggctgccaggagcggtggcattcctcggctacaccggacagctgcgagtttcaagagaa

SEQ ID NO: 69921 - DNA, 577 bp, Homo sapiens
  chr1:75600108-75600685
  hyper
aaggaattttaagaacggttcatcagaaagtggtcaggccacagcggcctctttggacgaagacacacttgtagcattatccttctcggcatcagcttttattagtggatcggggcgggggaggggggagatcggcagacacggacagcctctgaccctctggagttggtatgtgataagcagccctagcagtgccatgtattggaagaacgatcagatgtttgtgtgtaaactagtagcaaaggacgtgccggagctggcagttccccctgagaaggtgagcgagccgacgcctggccagaccagctgaatcgcagtgtccttgaaactcgagttgtttgggctcctaaacaaggttcagaaactacctgtaacggcctcatcttcagacctggcaattttttttttttattacgtagtagcgttagtcagtaatcattgcactccctccccaaaagctcacttaacctgagacatggagactgtaatttgggagatgaagcctcgagcctaaggcgctctcaggtccatgtgagtcgtgcttttgttctatttgctgtggtgatcgtggcggtcc

SEQ ID NO: 69922 - DNA, 433 bp, Homo sapiens; identical to SEQ ID NO: 5565
  chr1:75600686-75601119
  hyper

SEQ ID NO: 69923 - DNA, 89 bp, Homo sapiens; identical to SEQ ID NO: 5566
  chr1:75601187-75601276
  hyper

SEQ ID NO: 69924 - DNA, 151 bp, Homo sapiens; identical to SEQ ID NO: 5567
  chr1:75601277-75601428
  hyper

SEQ ID NO: 69925 - DNA, 1526 bp, Homo sapiens
  chr1:75601633-75603159
  hyper
aaagagctgctggctcggtttaatctgaagcattttcattcaaattgtcatcggaacaaacaccaggcttcttaaatcccgctgtaattagctttcaagtatcctattaaacctcttcacctttcgggctatcctattcaaaaagccccctttttaaaatatatatgtgtcttgctcttttaattgaggttattaaagaaatctagtttcttctcccaccccctcctcaatcctcttttcttctctcgcactccacctcccactgccccgcaccccctttagcccggtgttccccgctccgctatgattgacgtctggaaagaaagagctttgtgaggggatgattgttattaacttgttatccccggcgggggggcggggaaccgacgtgcccgggtgagcgccggagacccggagcccggggagcgcgggacgagctaccagcgctcgggtggcggccgccagcggccagcgaaggaggctgcgcgccagcccgcccgcggcgcccgggctcaggcgccgtgacggctgcacgcgctgccccgcactctgagggccttcattagctcgctccccgcgccgaggctggggcgggcagcacgctcggaacttctgatctgtttctccatactttctccccctcctactccgcagtgtcaggggctcatgtcagaggagtgcgggcggactacagccctggcggccgggaggactcgcaaaggcgccggggaagagggactggtgagtgcggaggggctcgcgtgctggcaagactggccgtggggaggcggcgcaggacgaagggccgctgtccccgcgctccttccagggcccagctggcccctcctgcagcagacagaggacggggcggagagggtctgggtggggtgggaagcttagctggcccgcgaggagggcagggccgcaagacttctggggtccgaataggtcaggggtcggcagccccagcgggtgcgtagccagagcttggactcggggaagagggcgagaatcgtgacctcaagaagctgggggtggggtggggtggccagggggaagggaggggaggcggtgggggcgcccttgtgggtaggtgggatgcgaaggggaggaggggtctagaaccgcctgcgcctcgcggtttcctgcaggtgagccccgagggagcgggggacgaggactcgtgctcctcctcggccccgctgtccccgtcgtcctcgccccggtccatggcctcgggctccggctgccctcctggcaagtgtgtgtgcaacagttgcggcctggagatcgtggacaaataccttctcaaggtaggatagggcctcgggtgcgaggcccaaggggagcgggcttagcgtgggagctctgggaaaagagtaatgttcctcccaccaacctttccgttcaagttctgggtgaaggttgtaggcttttgcagaaaatcagcccagtttagggcaactcatgcggtgggataaagtgagaagaaatcccagactcttctatgtcgttgcaaaacagct

SEQ ID NO: 69926 - DNA, 449 bp, Homo sapiens; identical to SEQ ID NO: 5570
  chr1:76080278-76080727
  hyper

SEQ ID NO: 69927 - DNA, 325 bp, Homo sapiens; identical to SEQ ID NO: 26402
  chr1:76080728-76081053
  hyper

SEQ ID NO: 69928 - DNA, 484 bp, Homo sapiens
  chr1:76081342-76081826
  hyper
tcctgtcagtgtccccggaggccaggggaggtgcagcggcgccgcggtttcccccaccccctccccggacacggcaaactcttccccggcaggagccttccacttggccgcgcctggatgtaaacaggccggcccgaggggcagagggcgggtgagagaggggaggcggcgaggggaggagggagcgggactcacccttgatgctggggggctttctcttcttggccatcttctgtccccttccctcccccggaccccccacgcgcttcctccggctgccgcgcagctcccaggcgagccctcgccgcggctctcagctcagcgagctctttgttgctgtgatggcatctgcgagcagcagcggcggccgggctgcgcgctcagctcggctcggctcggctggggcgggcgccgccgcccctctgctctcggccgcgccgctggcccccctcttgcgctgctgtggacgcggtggctgctgcgg

SEQ ID NO: 69929 - DNA, 341 bp, Homo sapiens
  chr1:76082037-76082378
  hyper
ggagctgctggggggcgcggagagaccgcggccatctggggccgggaaggagaaagccaggcagagtctgatggagtctgcctccggcctgccttcctctgggccttcgaagccccctctcaaaaggccaggacgcgctgggcccaagaaagacacccgtcttcacaggccaaccagaactctggccacctgcgggaggacggcactgtcccttgcgacccggcccaggagccgtcctcctccacagcctcctcgaggatagcgagcccgaattccacgcgggcgatgagccccgaagcgcgcggttgcctctgcccctcccgaaccgagaaggaaagagg

SEQ ID NO: 69930 - DNA, 30 bp, Homo sapiens; identical to SEQ ID NO: 39004
  chr1:76259201-76259231
  hypo

SEQ ID NO: 69931 - DNA, 24 bp, Homo sapiens
  chr1:76354586-76354610
  hypo
tttttttttttgagacggagtctc

SEQ ID NO: 69932 - DNA, 24 bp, Homo sapiens
  chr1:76354730-76354754
  hypo
caacacgcccggctaggactggga

SEQ ID NO: 69933 - DNA, 44 bp, Homo sapiens
  chr1:76540206-76540250
  hyper
gcagagcgcactctgcgcacgtcgagccgcgaaaggttcacaga

SEQ ID NO: 69934 - DNA, 78 bp, Homo sapiens
  chr1:76540496-76540574
  hyper
tgcccctgacccaggcgcgcccgctgctcggtggcaggagggccggcggagcgccatggcctgcatcctgaaggtaac

SEQ ID NO: 69935 - DNA, 82 bp, Homo sapiens
  chr1:76540575-76540657
  hyper
acttggatctgtggctcggacgcgtggttggccagccccttgctgctcagaggcacggagtcagccgcggtcccaccgcatc

SEQ ID NO: 69936 - DNA, 170 bp, Homo sapiens
  chr1:76955378-76955548
  hypo
cacgggacttaggtgcgttctccgccctctccatgctgacctcttttctcacctgatctgcccagctcagggctggacaagaggtgggagggaagaaaagtggataggaccttagtctcactagttcttactcgctgttagttctctgagcctggcgtatagttccagtt

SEQ ID NO: 69937 - DNA, 221 bp, Homo sapiens
  chr1:7728823-7729044
  hypo
gcagttctttgttcccggcagcagccccagcctcatgctagcagctgttgattgcggttattattttttccctttttctcacatggtaactgtctgtggccttttgaagtcactgctcttccacttcccaggatcctgggggatggtgccctgagctggccttctggtgcttccagacatcccaaagtcaggctccacctgtccgccggcactcttctcag

SEQ ID NO: 69938 - DNA, 293 bp, Homo sapiens
  chr1:77332866-77333159
  hyper
tgtttttatcaacatcgcaaaacagaaaatttaggttgcagattttcacatggctatcacgttcagaatccaatcaggttctccttctttactacttgatgacttctttaaagataaataagcccgcggaccaagaagtgggtacactggctcggttaactctctctccccagaaatttcactactgaaaagattattatttgggggcggggaaggggatgtagaggtctttaggacccagcaggcggcggcaggcggcagttgtgtagatcgctgagagactacgagggtcc

SEQ ID NO: 69939 - DNA, 274 bp, Homo sapiens
  chr1:77333160-77333434
  hyper
gttcagttttaattctgtctctaatctctgcaacagccgcgcttcccgggtcccgcggctcccgcgcgcgatctgccgcggccggctgctgggcaaaaatcagagccgcctccgccccattacccatcatggaaaccctccaggaaaaagtggccccggacgcgcgagcctgaggattctgcacaaaagaggtgcccaaaatgaagaccctgatggtgagtcagttgtggcaactccaccgggcaaagagggggatccccgggctcagggtcca

SEQ ID NO: 69940 - DNA, 161 bp, Homo sapiens
  chr1:77333763-77333924
  hyper
caaacttgcaaggatcgcaaggatccagggccccaggaaaggaggggtgtgaaggactcaaaattccagcagcttggctggggtggctgcgccagacgggcccttccccaaagtgcaaacccacccctgtcctcggccccggcgcgctccctccctcagcc

SEQ ID NO: 69941 - DNA, 218 bp, Homo sapiens; identical to SEQ ID NO: 67
  chr1:77334168-77334386
  hyper

SEQ ID NO: 69942 - DNA, 349 bp, Homo sapiens
  chr1:77334408-77334757
  hyper
cggagtggcggaccacaaggtgacagcatgcccgccagcccgctcgccactcagcctggggatcccgcacacctgagccttccccctttcccggggctgggaggcgctgtgagtaggtgccgttcgaaggctggaggggagtggacccgctggggtagggtgggctagttccaacttggtatgaattcttatttggagaaagacacaaagttttgtagaaaataggggtgaggtgcgtggaccccaaagcctaatttcccagcagaaatcggccctggaactagaactccctgatccccagaattgcagctgcggatggaggtccggttcctgaagcctcgggtttggc

SEQ ID NO: 69943 - DNA, 119 bp, Homo sapiens
  chr1:77334795-77334914
  hyper
cgcgggtaccagcctgagcgttcctctgacccggaaccggagggtgagcgcagccagcccgcggccactgctcgggatccagcgttcccctctgatctctccagcgcattgctttgggc

SEQ ID NO: 69944 - DNA, 44 bp, Homo sapiens
  chr1:7740637-7740681
  hyper
aggaaggcctgagcccggccacccgcctccgagtgcgccgcacc

SEQ ID NO: 69945 - DNA, 201 bp, Homo sapiens
  chr1:7750833-7751034
  hypo
acagtgagtgggtggcgcagagagtcacacacagcagtgcgaccccatcatccgctcttgacctctatgccatgtgaggcttctggagcctcttcctgttgcacctgcactactttggagctgcctcccagggctagagcctgtccttgcttcccggttattcacgacaaccgtcagtggagtacccgttaggtgccaggc

SEQ ID NO: 69946 - DNA, 39 bp, Homo sapiens
  chr1:7764052-7764091
  hyper
ccccctccccaaagccggagccgccgccaccgtccccgc

SEQ ID NO: 69947 - DNA, 137 bp, Homo sapiens
  chr1:7764556-7764693
  hyper
tccgcccgcaacctccggccgggcccccgccgtccagcgcggctcgggcgcagttccggcgcagtccccgcgccgagcggctccgcgccccgcaccagcctctgcccggctccgggtgacgtcgcatcctccgattg

SEQ ID NO: 69948 - DNA, 139 bp, Homo sapiens
  chr1:7765187-7765326
  hyper
cgcgcgtttctggcgcgagtgggaagtgtggggatccggcgggcccggtgtgaggggcgtgtttctggggcgagagtggggagtgagtgtgaggagcaagggtgaggggctgcagggaggggtgcgtttggccgaggag

SEQ ID NO: 69949 - DNA, 83 bp, Homo sapiens; identical to SEQ ID NO: 26415
  chr1:77747299-77747382
  hyper

SEQ ID NO: 69950 - DNA, 1443 bp, Homo sapiens
  chr1:77747383-77748826
  hyper
aaacggtcgcaggttcctacagaccccgaccctgttcccttggccacctggtccccggtagctgcatccctgggcggcgcacgcagtgaagcgtcgcgctctggcgccggtgccgcaccgaggggtatgactacgaccccttgcgcgtgcccgcccccacctccgcacctcgcgccagcccgcgcagcgtgaccggcagccgccgcagacccggctcggggaggcgcggagcgcggcgcgctgaaccggagaggcgggccggctgctgccttgcgttcgccacgctgtcctccctcctccgctccctgcgccccacccctggcggccgcgctgcctggcagcccgggaagccgcggcacagctgctcggcgcctgcagctccggctcgggggctggaaccgaagcgggggcggcgggagcgcggagaccacagcccccggggagaggcggagggggtccctggcctgggcggagaggctgagctgagtgcgcgtgagaaagagggctgcaccgctgctcggcgcggactctgccagccccagcttcagccccggctcaggtcgccgcagcccgggagcctccccgcttgcgccccaaggcacgcgcggcacagccatgaacaccaacgatgccaaggagtatctggcccggagggaaatccctcagctttttgaggtagggctagagctggccgacgggcggtagcatccggggactgcatctcaggggttcgggttgaggcagccgcgccccgtcccaccttccccacacggggcatgtaatgaaggggcttgtagaagcgcactcgcccgctcccccgagggtagtcgcctttcccgcgggttgccagggtccttgtcagaaggctgggcttagaagcctgcatctcacagatcaagtttcagtcttccagcagggttctgaaagcagcctgctcccatcgcgcccctcggatgtggacacccagggtgggctgcagaccgcggccgggccgcactctctgggggcgagggccaggtcaggtggctgcactgtcgcccagcagcgagtaaagactcgaaactgagggagccagagccctagtcactctgctggtcgagggtcggaacccctgggggaaagaggaaatgtggacgaaggcagcccttcctggagacagcttggaagagagggatgaagatgcaaaaagcaaaacccaacctatcaagtgccacctccccggtgacaggcccccagccttgctctgcgctttcgctgaatgaactcctgagcacgtttttcccgttgcctaggaagggttgggccgcaggtttcgccagtgctcgacaacccacctggagatagcgggtcggggagggagctgcgaggggggcggactcctgttgctcagtcttcagaccgcagcacagcatcatctgcaccgggacccgggaatggggggac

SEQ ID NO: 69951 - DNA, 22 bp, Homo sapiens
  chr1:78122948-78122970
  hypo
gagccaccgcacccagcctaaa

SEQ ID NO: 69952 - DNA, 158 bp, Homo sapiens
  chr1:78244687-78244845
  hypo
tgactgaagactgaacgtagaaacagtaccttgggttttgttgttgttattttttcctaacccggccccctattagtttactatgtattagaacctgagagaggtgactactctgccaataaattgccacattcaatattcttcggttgcctaattca

SEQ ID NO: 69953 - DNA, 927 bp, Homo sapiens
  chr1:78354035-78354962
  hyper
gttagggggtcagctcgcgcacctagggccgggagacagacaaattctggcggaaagttggcagccacggtccccctcccctgcttttctcctcaactctccacccccactccgggtgataacggcggaggtggggggttgggggaactggccttgtgttttggaacagctgcagccggcgctgggcccgcctggaatgcgggaacaggctgcacaccaggacttttatggaaacttgctgctggagacggcggcggcggcggcggcagcggcagccagaggactcccagcggctggagcagaagtgttagcggccagagctcccagacccctacccacagccaggcgggacgcgcacagtccctccacgcggaaagaagtaccttcgccggtcaccggctcctgcagggtgagaagagttgggggaacgtgggctggggggagtggagacggaggtgtcgggtcccctggtgggggcgggggcgggaacggcggctgcagagaggcgctcggggtctgcggcttctggccgtgctccgctgcagctccggagggcgccgggcgccatacagctgtggtccgcgctggccccggcccgggcgaaccctgccttggagccgcatcctgcgggctcggcggggtgcctaccaggggctgccccagggtctgaaagtgtcggccggccttgggcttctggttgcaatgtctttgccctgctcccctgcgccttgtcggctgagtttcgggtgcgttccctactgtagggagggagccctctgtgagcggagtgggtgccgatccctcggctgaacccttggggtccttagggaagttcagtgccgtcccccaccacttgccccagccgcggtctccgtctctgccagcagtgccagttaagaaatcctttctgatcggtctctgtggaag

SEQ ID NO: 69954 - DNA, 40 bp, Homo sapiens
  chr1:7842867-7842907
  hypo
ttctgtaccaggcagcgaagaggggcggcactctgcactg

SEQ ID NO: 69955 - DNA, 421 bp, Homo sapiens
  chr1:78511435-78511856
  hyper
gtttgccttctaaggcgtattgttctgtagcgtcggcatcctcaggcgttcacgtaaatagagccattttttacaaggagtagggataaacctggtgataggatgagggactacgtaactttctttctctccagatccatcccgggggaggctgggcgggcgggcggctgctccggtccaggggtggaggtcggggccctgacccgacgcagccaggcggaagcgcggctgccattggaggctgcttttacctgcgcggggcccggggcgcaaagtccgaggcgccggggggaggaggcggcggacggcagcgcaggtgggcccgcgctctcggccctgcaagatgcccctgaagctgcgggggaagaagaaggccaagtccaaggagaccgccgggctggtggagggcgagccgacgggc

SEQ ID NO: 69956 - DNA, 527 bp, Homo sapiens; identical to SEQ ID NO: 26420
  chr1:78511857-78512384
  hyper

SEQ ID NO: 69957 - DNA, 679 bp, Homo sapiens
  chr1:78956874-78957553
  hyper
cgtcttctgctcctcagagagcccggctggcggcctgggatgacaaggtaccatccctccagaggctgatcccaatgcatcggcttcgcttatctagacccagatttaatcaactcaccccctgagacacccagccacagcttctgctggctgagcctgacactgagtttggaccagattccccaagctagggagacgcatagagaaagaagggtactcgagctaacccatccccattctgagctgctctgcgggggattgggtagaaagggtctcagaagagggaaatcggcacagattccgcttctcgccgttgcggggttccctgcgggcggcactgcgagttcctcacccgggcacgtcctcactccccgtgcccgggatgagggagaaaacagccctttggcgtttgagcaattgcagaaagtttcagcgagttcgttagtttggagggaatgttgcgaggccaggccgaagggcgggggggatagtaacgggcgaaagtcgaactgtgagtaagacctggagaaggcgaccgtcctgggggtagcctaggcagttccactcgggctgggcgcaggaaaggctggctccggaattcccagcctccgggaaagctagctgctcgggaaacgccaatcgaattagctcagagaagagtggccgtggccttgtgtat

SEQ ID NO: 69958 - DNA, 25 bp, Homo sapiens
  chr1:7908876-7908901
  hypo
ttctgtacatcgttcaggtcaatgt

SEQ ID NO: 69959 - DNA, 222 bp, Homo sapiens
  chr1:79294494-79294716
  hypo
tatagaatagaattccggaaggaatggaaattacctcaggtaaagggacagtggatttaagatattataataatgtaaacataaatataaatgactcctcacttttgccattgggttagcgaagcatgaggaagttttcagtgtcaacaacgtgtattaagccagtgtcaaggtggataaatagctcagaagttggagtcaggcttgcggtttaaggcctgg

SEQ ID NO: 69960 - DNA, 36 bp, Homo sapiens
  chr1:79472423-79472459
  hyper
ggcgcggcagggtcccggatccgtcctccgtgacgc

SEQ ID NO: 69961 - DNA, 465 bp, Homo sapiens
  chr1:8002286-8002751
  hyper
aggaggaggaggaggcggctgctccaggctgtagatgaacctgcccatcattgagcagctggagaacctcaggaaaaccaggggaactgtggctggggcaggcgtgggctggggaaggacatcgagagtagcttgggccgtcctcctgccccgcggttcccagcacgagctctcccgacagaagaggaaaacgcggcgcgactcggttgggggacagcgctgagatgcggacagatgcggacgttctgccgccgcctgcaggcagagggactcggagatcaggccgcagaagcagaagaaggcagacgggaaggaggaggaaggaaaggagccttgtggcttcgtgtccgaccctcccgcccttggcccgcgtgcctggagccagccccaccgcgcccgcgtttcctcccgcgggacttcccttggccctgggtctgcagcgggtcctgccgagcttccttccct

SEQ ID NO: 69962 - DNA, 30 bp, Homo sapiens
  chr1:8044661-8044691
  hypo
gtaactgtcattcaccgacatctcccccaa

SEQ ID NO: 69963 - DNA, 77 bp, Homo sapiens
  chr1:80515982-80516059
  hypo
acaggtgcacaactccgcttagcacaactccgcttattatgtaactacgccacgtgaggcgcattaggtgatcaccc

SEQ ID NO: 69964 - DNA, 309 bp, Homo sapiens
  chr1:8086092-8086401
  hyper
cgccctccacgcccccgccctcgcgtcggggagccgcctggatcccggcgcccggcgcggggccccctgagggaacggagcgctgcgtggccctccccaccccctcagcgcgccaggccccttaccccggaggagcggcggctgccccgcggcgccctcccgcgcatgtccgtcccggctggctcagcgccgcgggctcaggggcccggacatcgcgcaggcgcctcttgctggctcgcgctcccgctagcactctgcctcgcaccggaccgccgtcgccgcggctgccgccgccgcctctatatatag

SEQ ID NO: 69965 - DNA, 30 bp, Homo sapiens
  chr1:8152862-8152892
  hypo
tgtgaccgcacgtgccgtctttccaccccg

SEQ ID NO: 69966 - DNA, 35 bp, Homo sapiens; identical to SEQ ID NO: 26422
  chr1:82266147-82266182
  hyper

SEQ ID NO: 69967 - DNA, 89 bp, Homo sapiens
  chr1:82266766-82266855
  hyper
ttcgctcctcctccccgccgcttgggcgcacagccgcagcagctgctcaaatggagtggaaaacggccattgggcgacaatgagttata

SEQ ID NO: 69968 - DNA, 44 bp, Homo sapiens
  chr1:82267616-82267660
  hyper
tctctcgaagagcggcgtgtgggaaactgcgggaaaatgttgac

SEQ ID NO: 69969 - DNA, 491 bp, Homo sapiens
  chr1:82267888-82268379
  hyper
ccctcggggcgcgctcgcagacggaggtaagagccgcaggagcgaacaatgtgcctctgtgcccagcttcggagacctgtttgctttgcgcctccagtccgggggtggatgctggaggcgcagggagccgcgggttaatggggctcggctgttgctgttcggctggcccagggggagacccgcgctcgctcgggctgctcgctccctccccccaatctcctcttggaaatcgatccgcagaactctcagtccggtccagccggcttctccttttctcgtggagccattgtaacgctctccaggcatcagtctagttgccgggggcgctggcaagggggttaggatgaggctcccgtagccatgcattttttaatttcataaaagcttggggtcgcaaggttccgcccgtcctttcactgggggcctggggaggaggagtgtgaagcgcgtcctcggcggagcttatttgctccgggcgctggggcccgggg

SEQ ID NO: 69970 - DNA, 271 bp, Homo sapiens
  chr1:82268689-82268960
  hyper
gggcagagagcctcccggagccgcagtgagagggcagcagcgggccgcgttgggcctgcgggagaagttacggagtgtatgctgctggagtggctgtggggcagggagcctcgggagcttggtttgtgggatgggggtgccactggggagtggcgacgagagaaaggcgtgggaggagcgcgagggaaggggagacccccgcgctgcccgagcgtgggctccttgattggctggggcgaccctcaggcagagggggcgagggcgagccaaa

SEQ ID NO: 69971 - DNA, 34 bp, Homo sapiens
  chr1:82269276-82269310
  hyper
tgttgtctcagattccgaccgagggaatgttttc

SEQ ID NO: 69972 - DNA, 30 bp, Homo sapiens; identical to SEQ ID NO: 9
  chr1:8277113-8277143
  hyper

SEQ ID NO: 69973 - DNA, 60 bp, Homo sapiens; identical to SEQ ID NO: 26045
  chr1:8277775-8277835
  hyper

SEQ ID NO: 69974 - DNA, 30 bp, Homo sapiens
  chr1:834881-834911
  hypo
cgtggcatggagccccgtggcagatatggg

SEQ ID NO: 69975 - DNA, 315 bp, Homo sapiens
  chr1:840707-841022
  hyper
ggcgttggaccccctcgcgcattgtcggggcgggtgcagccgcggtgcaaaaggaccttcctcagaaagttgagcacgaagttcccacaggcccggaagttcccctcccgggcgctccccagagagctgaagactgggcgcgtgccggcggcaaatgttcacagcaaagggcggcccagtgcgcagctggaacatcagccccaggcggtcgctgcgacagggacgagcctgggaaacgtgaaaatgtccagaacagggaatccacagataaagaaaagacatcgtggttgccagagctcgcgggagggggcaaca

SEQ ID NO: 69976 - DNA, 30 bp, Homo sapiens; identical to SEQ ID NO: 26428
  chr1:84158496-84158526
  hyper

SEQ ID NO: 69977 - DNA, 465 bp, Homo sapiens
  chr1:84464413-84464878
  hyper
aaacctctcagggcacgaatggtgctgaatcatttgcacgaacgcagcagctccccgttccgcggctcccagcggggacggtgtccccagagcagtgacagtccggggatgggggcccggaaagagggccagggcggagcctttggggacgtggggacatggaagggggtcgggggaggatggcggcagcaggtactcacccgggtgaggaaagcccagcccgggtcctcgcgtccccgctgcaagcggtcccccaggtgctcccgcgcctcgcagcttccccgtgggcggccgccccgactcggcagcctgcactggtggtccggtgctctcctccgcccgcccaccgcccgtggcagccacggctcgggactccggtgctcgacgcggagtgcctggaacagctgtcgctgcccaagcgggtggcggctaccgacgggccagaccattcgcctgctgcggccg

SEQ ID NO: 69978 - DNA, 35 bp, Homo sapiens
  chr1:84543374-84543409
  hyper
gcaaggaaaaccacccgagccgctgaacagtattc

SEQ ID NO: 69979 - DNA, 293 bp, Homo sapiens
  chr1:84544218-84544511
  hyper
ccgaccccccagctccgcgttgagagctgaacgcgaagggccggatgtggggatcctgggaagagcgttccctgggattccctttctcactctagcgaggaggacttgcacacgttctggaacacttccccaaatatggtccgaggaaagaagtccctagtgccatcccacccctgctttcccccctcgccgactctttgggagctacaggtagtgctgtgggtaaggttggctcttctccctccatcacttgggtccgacccaaccttatcacaaggcgggggctgctagtc

SEQ ID NO: 69980 - DNA, 38 bp, Homo sapiens
  chr1:84944530-84944568
  hypo
gcctgggcattaaagcaaggctccgtctcaaaaagatg

SEQ ID NO: 69981 - DNA, 282 bp, Homo sapiens
  chr1:85358311-85358593
  hyper
tttcctaatcaccatcgatggcaatgagactgagtttggaaagaaccacgtgtgcaaaggcagacgcaacccgtgcggcgctctcctggcctctgcgcccagcccgccagccctcagcagcggacgcaacgccgattttgcatctagattgctttttgctcctagcggggaaaaaggtgggaaaagagcaagttgtgccatacacccgccgggagagtcttgtcccggggtttggagtgggtctggagcccaggcttgcacgccaggcaaccccgaaaagcc

SEQ ID NO: 69982 - DNA, 218 bp, Homo sapiens; identical to SEQ ID NO: 26431
  chr1:85358751-85358969
  hyper

SEQ ID NO: 69983 - DNA, 178 bp, Homo sapiens
  chr1:85359170-85359348
  hyper
agctccgtattagaacgcagtccctctgcccctctgtcctcagagatttgtttgaagtggctgcgggaagtgcagcccacacccaccacccccgtgggaggcaggctctactccaagcccgacctaacgctggaaacctcaaccccaaagctacccgagggtgcggacagcccccaga

SEQ ID NO: 69984 - DNA, 256 bp, Homo sapiens
  chr1:85463282-85463538
  hyper
cacccaagtgcccaacgctgcggtacggcccgctttggctcggggtgtctgccggagaagcgccttacagagggacccgggcggtgggccctgcggcaaagtggcccacgcaccctccacaccgctcccgggcggccgcacctggcactcccggccctctggggttcctgcctttttcgggggggtggtggtgagaccgggtctcactctgtcgcctgacctgcgatcactgctgactgcagtcttgaactcctgg

SEQ ID NO: 69985 - DNA, 16 bp, Homo sapiens
  chr1:85463598-85463614
  hyper
gcgcctggccccttct

SEQ ID NO: 69986 - DNA, 78 bp, Homo sapiens
  chr1:85463869-85463947
  hyper
agatgttagaaagtgcgaccggcgcgcaaggaataggaaaagcgagttgccctgcgcccgcgtcgggatgaaaggcag

SEQ ID NO: 69987 - DNA, 37 bp, Homo sapiens
  chr1:85513662-85513699
  hyper
ttgaaaggggccagccgagccgcgtcaaggccatctg

SEQ ID NO: 69988 - DNA, 30 bp, Homo sapiens; identical to SEQ ID NO: 26435
  chr1:85527927-85527957
  hyper

SEQ ID NO: 69989 - DNA, 62 bp, Homo sapiens
  chr1:85774021-85774083
  hyper
tccgcgctcaaaggccggctgagaaaacgcgagtgactacccgagggcgctgttactccaca

SEQ ID NO: 69990 - DNA, 49 bp, Homo sapiens
  chr1:860840-860889
  hyper
gggacacagggggtgcggtgagcgccaggcgccgcggggagttaaaaag

SEQ ID NO: 69991 - DNA, 224 bp, Homo sapiens
  chr1:865391-865615
  hypo
gccgtgcttggggctcggcctggggtgcgagaccagggcagacccccgggagatggaacggcccggtccagccccaccttcctctcctcctgccccaccttcctctcctcctgccccaccttcctctcctcctgccccaccagaaccgggggcggctggcagacaagaggacagtcgccctgcctgccgcccggaacctgaagaaggagcgaactcccagcttc

SEQ ID NO: 69992 - DNA, 682 bp, Homo sapiens
  chr1:86621263-86621945
  hyper
gggaggtggggtgcccgtcaggacccgcccaaaacctccgcaggaggggcaggcccgcccccgtgtcctgctcccctccccagtccccgccgcgagtgccacttccccagtgacagggcaatgatcagggcgcagcctcggctcggatgggcaacgtttgttggccttctaaccagaggggattgcctctgagcccgtgggtaaaacaaccccccgacgcccgaggttctgcagccacccccttccccccgctggcgacccttcctcacgcctgagtccagtggtccaggctgcgcacactgaccctgggggacctctagcgtcacagcaatcgccaggctggacgccctgagaagcacctcggggaagcaggacctcgacagggccctgcgggaggagaaggggaggagggcgcgagggcggcgggagctggagccagagagatcgtcggagcccagctctggagcttagggagccgctgccctggacctcgggactcgcgccagcgagcttttcctctcgagccaaaagatcgctttagcataaactgtctgagatctgctggcacgaggcatcctttcaaacacggtattttgcaagctgagaagacaaggggaagataccgcgggtactcggccgctcctaaagccaaaaagtgccaaggagccggacttcagatctc

SEQ ID NO: 69993 - DNA, 362 bp, Homo sapiens
  chr1:86622190-86622552
  hyper
accatgcttcaaacccgcaacaagaaaaaaaggaggggagggggtgaagtcgggaggaggtaggaaatagcacccgaaggggaggacaggcttcctagctctctggctcggtaacgaacgagcccagggttgcgctccccggggagggcgggcgaggaggtaaacctcactgggaggcctcggggcgccggcggcagcgggagccgggctgctagtgcagcactcaagttcacttgcggttcaaaggcgactctgtgactccagtggagtcctctgctttgggcctgggaggagaaaggggtgggggtagggaaggagatgaagtgggggaggaagtccttggaaacagcccgcgcccgaac

SEQ ID NO: 69994 - DNA, 221 bp, Homo sapiens
  chr1:86860814-86861035
  hypo
cgcgcccggcccggtttgtttctttaaccttaactcagttgcacttaaaactccaagaacctcattcattcaaaaacacttgaaaccgtactatgcgttgcgtgatgaggaaactgtcttcgaaatagattttatccccaacagcagccccagtatggttattctcagtaaacaacaagcaccaccactcactaaccacctacattcggtgccaccttaat

SEQ ID NO: 69995 - DNA, 30 bp, Homo sapiens
  chr1:87229260-87229290
  hypo
atatactaagtattccgtagtgaactcacg

SEQ ID NO: 69996 - DNA, 150 bp, Homo sapiens
  chr1:8742771-8742921
  hypo
tttaacaagaaatgccggctctagtactataatgcagaataaaaattaggcaagtgatgactcatacttcacaggtatgccagcctcaatcaggttttcaacccagtctttattagaaatgacaagtgattctttcgcatgccttaattt

SEQ ID NO: 69997 - DNA, 30 bp, Homo sapiens
  chr1:87617400-87617430
  hyper
ggggcagggaggatgcggggacccccagaa

SEQ ID NO: 69998 - DNA, 174 bp, Homo sapiens
  chr1:87617684-87617858
  hyper
cctcagggcggtgctcgcctctgcccggcagcgagagagggacccggtgcgggcccgatgacagggtcgaccgctgggggtcaggataagcttgcagagtggccccgccgccgtcctgaactttctcgggaggggaaggcggctgtgtacagaacagcacgccctgggaagcaa

SEQ ID NO: 69999 - DNA, 30 bp, Homo sapiens
  chr1:885425-885455
  hypo
tgagtggcatgtgcacgtgcaaagatgcat

SEQ ID NO: 70000 - DNA, 187 bp, Homo sapiens
  chr1:88928315-88928502
  hyper
gactgcagcaggcggcggcgctgccctttctctgcgtgtctctgggcgcgtcctgcccgctccccgcgccgcccgcgctcctctcgccgcagctgccgctggggctgccgcgggcgccgctcagccggagcgcgcctccgcccggcccgcccgcgccccgcagcagcgcgctcgctccttaaccact

SEQ ID NO: 70001 - DNA, 53 bp, Homo sapiens
  chr1:895125-895178
  hyper
accgggccagcgccacgaacaccacgcagggcgctccccgtccatggccctct

SEQ ID NO: 70002 - DNA, 30 bp, Homo sapiens
  chr1:89664391-89664421
  hyper
cccgtgtgcagtctgcgcttgggaatttgt

SEQ ID NO: 70003 - DNA, 48 bp, Homo sapiens; identical to SEQ ID NO: 38688
  chr1:898728-898776
  hypo

SEQ ID NO: 70004 - DNA, 62 bp, Homo sapiens
  chr1:90292117-90292179
  hypo
aattttatagttgagcgtatccaggcacagggaggtgatgtgcttagcgtaagtttacacat

SEQ ID NO: 70005 - DNA, 55 bp, Homo sapiens
  chr1:90309435-90309490
  hyper
gcagcttcacttgcccgccccccaccactggcttctcacccggggtctctgccaa

SEQ ID NO: 70006 - DNA, 124 bp, Homo sapiens
  chr1:90847612-90847736
  hypo
atattcataatttagcgtacacctgaaaaatatgctgtgaaatatcggggggatcctttaatactggtgttccatttacagactgtcacatttataatgcgtctttaatcgtctagggtctgct

SEQ ID NO: 70007 - DNA, 30 bp, Homo sapiens
  chr1:908640-908670
  hypo
cccgggagcaaggcccgggcagagggccgc

SEQ ID NO: 70008 - DNA, 748 bp, Homo sapiens
  chr1:91171967-91172715
  hyper
ccctccagagccccccgagatgtgagagaagggccctgctctgtaggccatcccaagtaccgtccttgaaagcgtctggattcccgtcccaggcctatagagcccctgtcctgatgcgcccatgcctccctgaagcgctgtctgtacccgggcgcaggaactcgtggcggccgggcggtcctgaaggtggaggagcgcggggcccagctggggtacgcgccgagcaagaacccgcacggagccggcgcgccgcggctgggcttcaaggccgccgcgccaaatccctggctgcgacgtgtatgcgaatcgttaggaggaggcgggaggacagccacactgagggcctcttcactaaagaatgaagtctgacggcgggaatgggggtgggtgggggcgggaatccatcagctccacaaagtgacagggcccttttatcgtaaatcaagttcaatctcgctctcgcgaaggtcctcttttttcggcggagctcccgcaggggcgactcgctgtcccagaccagatagtagcaagagctgggagagacccaaatctgcagggagagggcgcgggctgagagccgcggtggggagcagggcctgggcccagcgcgacctgcagggctgctgcctcgggagcgcttctgctctgcctgcggtggccgaggcggcggctcgccgagcgcgctccgagctgtgcgaacagaggaagtatgtgccagttagaagggttccgccggccacctcgtcgc

SEQ ID NO: 70009 - DNA, 161 bp, Homo sapiens
  chr1:91172920-91173081
  hyper
atcaggaaacgctgccggggaggttgctttgtaatcactttgcttacctccccccgggcgccgccgacccttcctagacgcctccgctgcggccgcctaggcttttacccggaacccgccagcccaggttacctagctccacccggcgccctgggagctgt

SEQ ID NO: 70010 - DNA, 208 bp, Homo sapiens
  chr1:91176389-91176597
  hyper
aggaactccaggcatcgcagcacaacgaactcactaggacaagcggctccgcatggggctgggggctggacgcccgccgccagggactgagaaggcaacgatcaaagccgccacaagggtttgttagctggccctctccaagtcccccgggggcgtcctaattgctcgtcccacagcctcccgctcacaggctgtccgacctcgccgg

SEQ ID NO: 70011 - DNA, 262 bp, Homo sapiens; identical to SEQ ID NO: 26444
  chr1:91176691-91176953
  hyper

SEQ ID NO: 70012 - DNA, 112 bp, Homo sapiens
  chr1:91177380-91177492
  hyper
tttctctggggcagacggaatgtcctcggcaacgccctttgcctcagcacttgaggctgtccatatatagttcactctgcctgtgctgtttccgctccgtgcccttctttct

SEQ ID NO: 70013 - DNA, 417 bp, Homo sapiens; identical to SEQ ID NO: 69
  chr1:91177840-91178257
  hyper

SEQ ID NO: 70014 - DNA, 90 bp, Homo sapiens
  chr1:91178931-91179021
  hyper
gtctcctccctcccccgctgcacaccctgctaggaagaagagagcgggcgtttgctcaaataccttatgaaggaacgcagggctggtggg

SEQ ID NO: 70015 - DNA, 64 bp, Homo sapiens
  chr1:91179460-91179524
  hyper
ttccttctccctgtccggatgcttggccagccgccgattctccaggctgcggctgccaaaccta

SEQ ID NO: 70016 - DNA, 231 bp, Homo sapiens
  chr1:91180075-91180306
  hyper
tgcctcccttacctgcggttctggtaccaggtcttgacttgggtgtcagtgaggttgagcgctgcagccaggtccatgcgatcctgcacgctcaggtacttctgccgctcaaagctacgctccagttgattgagctggtggtcggaaaaagctgtccttgcttttcgaggcttcttggctctcacagggggactctcacggctactcgtaatctcccggtctccttcctcc

SEQ ID NO: 70017 - DNA, 1063 bp, Homo sapiens
  chr1:91181807-91182870
  hyper
catcccttttatcaacgaaaagtatttcctgtcggatgccctccgccgcccctcaacccccagtagattaaaattaaataaaacaaaggaaggagctggatggccgtgaaggttgtggggtagaacaataaacagaacttcgaggagtccccacatcgcacgcccaggcctcccttcagctgcagtcttttgaccgtcgcccagtcgcccgagaagctcctggaatcgctccccagcagagatctgctgaaggctgaaggggagattgggaaccaggaggacaagctagacggccgagagcgccgggtggcgggactcaccgtggcatttgatgtcgctctgggaatcctcccgcttgtcgagtttggtcttgctgtcctcctgctcgagctttggcctgaagctctcgtgcactgcgttgctctcctgcttcggggtgtggtggggagaggatacgctggtgctgtagggtgcacatgccgccagaggtttgctgtcgcccaagatgtccttaattaaaaaagaagacgtggaagtcctgggggccgaggcggccgagcccagctgctgggggggcggcggcggcggctgctgtggcggcagcggctgctgctgttggggcaaaggctgcaaactttgcgtcggggccgcggccggcggcggcggctgctggctgtggtggaggtggtgatgatgctgggtcgcgtctgctaccagatgcggctccgggggctccatggtgactgagataggagaagaaggcgccgtccctacggtatcaatctccgaacagggagatggggtggcctgactcctaaaatccgcggtcctggcctcaccgagcgggcggaaatctccattcatcatgcctgggctgcctgaactggcactggacaaaatcgtgtctattccaaaactcgacccgctggccccttccattgtcattgctacatgaggtccacgccactccgccgttcagcagccgccccgaaccagcgaagaaagctatcgatcgtaaaacaaaataaacaccaaacaatgttgccgccgcttaaaaaaaaaa

SEQ ID NO: 70018 - DNA, 109 bp, Homo sapiens
  chr1:91183087-91183196
  hyper
aggcgaaggcgaaggcgaaggcgcaggcgaaggcgaaggcgcaggcggcgggaagctacgccaaagccgccgccgccgccgctgccggggtctgcccacagcctggcac

SEQ ID NO: 70019 - DNA, 269 bp, Homo sapiens
  chr1:91183250-91183519
  hyper
gggcggccgcgcgccctcggaactcccccgcggctcccgaggtggcagccgcgcgccactcggcagccccgtagccgagtttctgaactttcttggaaagttgcggggcagacacggccgcagcggttgcggcaacccgaggaggaggaggaagaggaggacgacgagaaggagcaggcacagaaggaggaagcggcggagacgcgatgccgggcgactccggccgctgccgggcgcgttcgcttgtaatccggctgctggcgggcggc

SEQ ID NO: 70020 - DNA, 91 bp, Homo sapiens; identical to SEQ ID NO: 26451
  chr1:91183520-91183611
  hyper

SEQ ID NO: 70021 - DNA, 218 bp, Homo sapiens
  chr1:91183775-91183993
  hyper
cgagtccagtggtcccggtgtccacaatcacgagtgcgaggcaaagggagagggaggaagagatcagagggagaccagagaaagggaaccaaaggggagaaagaaaaaaaaaagtagcaaggattcgcccgttttcttaagtcagaagagagagagaagaggacgggaagggacttacctttaggctccagcgcggcggccctcgcagcctccccaaa

SEQ ID NO: 70022 - DNA, 219 bp, Homo sapiens
  chr1:91184194-91184413
  hyper
tccgcgtccaccaggcgctctcggggaggacgaggcctgaggctccaagctggggaaccagcctggtctccagctggaaaaaatgcctggccagacgctttctcccgaacgggggagctaatgcccgaggcgttctctggtggcgagggcagccacggttcactgcggtgtcgggcgggcgcggggctcaggacccatagcggctggtctgcagcccgc

SEQ ID NO: 70023 - DNA, 651 bp, Homo sapiens
  chr1:91184414-91185065
  hyper
cccctgccgcgccccgcggcagtccgtccacctctgtcccccggcccctttcggcgagcgctcatttggaaaggaaacagtcactgcggatccacttgggacccggagcatgactgtaacgcctcgttggagtgtatcaacttgcattattttctctaggacgtctccaacctgtctcatgttgaatgtcagagtaatgggaagtgccagtgacaagacggcgtattactcctgattaagtgccgtgtcaacctaattagcagagtaattataaggtgctaatgaatgattcaaagttctttgagttacattttactccaaattaccattttaagaaccctatgaatctgcgaggcgggcatcgcttccgtggctaggtctggaatgatgttcgagtggcctttaatgtctccaaaggctgggccgaaatctggagtttagttgcagttctggaggtcactttctgggccacagcttttatctgttgaggacgaagggaggggtgtcagggaggcaaatgacctcctgggacaagctcttgcctttcggtcggaactgcttctgtgtgagccctgggtccggaagcgggtagctgggcgactcatcctgcctgcgttttcctagggaaatcggtgtgtttgacccagaaaa

SEQ ID NO: 70024 - DNA, 184 bp, Homo sapiens
  chr1:91185125-91185309
  hyper
cgtctcagtggcatttttcctagggctgttccgagagaacagcggggattgaagggacggaggcaaggagatgcacaatccgggcagctctcgctcttctcggaaggcgaagggagtttggcggagaagacggggttggtgagccgaggcggggactccggacgtgctccatcccggcaggggc

SEQ ID NO: 70025 - DNA, 649 bp, Homo sapiens
  chr1:91185347-91185996
  hyper
cgggtgactgggccccgccgggtggggtcgggccactgtaggctggagcggggttggatcaaatgcctttggcgcgggaactgagtgctggcccgggagaccctccggagagctcgcgggctcggcctcggcctcggcctcggccttcggccgcggttaccgaaacacagacggtagacttgtggaggtggcttatccgaggccgcagggcccgacgctgcacagcttcgcagcctaaatatcctgcgcctctgtcacagttgaccgctgtggggaggacaggaagggctctagggctgcccgagactgcaggctgaccctacctactctaccctcttcaaatatcgattagggttcttcccattccaacatcatcatccaccaacttcccgaatatggtgcgttttctcctagccctgggaggttccaactcgaactcccctcgctgcatattcagggtgggaagtagggagggggagaaaacaaatttaaaatccagaactgacggcactgcacaaatcaattattctcgaccttgataaataattcatttaagcctgtttttgttttgttccgacgcctaaaatgactcaagagctcaaaaggctgatcgcacagcttgtgttgggcggttcgacagggtcttttt

SEQ ID NO: 70026 - DNA, 1966 bp, Homo sapiens
  chr1:91188983-91190949
  hyper
accaaaacctcagagcgctgagcaaagatgccaatcagagaaagagaaattcatttgcgatgttaattaacaagcggctaattaaaacggcactttgagtgctaatcaatcgccttattaagttacagccatcactggaacaaattgaaacctccccgccccgttttctgcctttggtgcaggcggggccgcgttcccagataccgtgagaggccttggggcgcggaggttgggggcagcctcggtcagctttctcagtctctcccaggtctacagaatacgccactggacaagtgcctaagcagcgacttctggtccagacacaccgcccggggagtaagtagttgcgtcgaagaacaactcattcagcagcagttaacaccgacgtttcctcctagaaagagctcccgcaaagcggggggatgtgacctgtgggcccccagcaggggtaggaggcagttcagcccgagagggggcgctctagggcctggatcctgcatccctatttcctggaacacacccaacgcctcattctgaaaaccctgcttaggccctggccctggtgccgctcagcaaccaggaaagagctggacctgccttcaggcagcaagaacaggactgccagcctcctgtggctctgtctcccgaggctccatgagaaggggatgggggtgcaagaagggaagagtgaggtggtgtgctgggcgtcggggacgaggacgcacgccagccaagacgtgcctcccacccagcccacgcgcgcttccccacccccctggccctccaaaatcggtaagagaattaagatttcgaatccctattttgaggagccttccgcatttcctaattgttaaattcctgcttttcaccaaattcccgggggagaaacatttggcaataagaagggactgtgaatttaaatgctaattgagtgggtcctttttccgcagctccacctgcctggcagcctctgttgaaaccaaacacactcggagcgcccagtgcaacattcttggggtgccgagtagaagcgcagtaaagagagaccctagcggactcctgtctggtttgctttttaccgactcttacagaaaaaaagagaatgccattggaagaagctcttttgcgtggtgggcgatgtgtgggtgggggacttgtggcatggcccacggtgttgtttctgtgcctgcgatgacacacgtatgtcttgagctgtgggctcgccttcctggaggtgcgcccgaccgcatctgctggtgggtctgagcgtgcttggggtgtcccaggagaactgagagaacggctcccacgtgcaaagttccaaagcattaatattttcatcatattatcattattcaatataataatatttgttcggttagcggcactaattaggccacattaaaaccgtagtgtgtccctaatggtgcgtaatgtgctcacactcacatttttctctctgaggatgggcggctgcaggctggtaggggaggagagacaggcaagcggcgggctggattagggcgtgacgccccccaccacgcacacaaacatacacagcccactggatgtctgccgggtgggagccgcaatctccgcgcggtcgatggggccctccgctgcgcactcggccctgcgccgagcaccctgcagcctcctcccgcgacacggcgctttgaactcggcggattgattttgcttcccttcccccttttgtgtgtgtttgcgttcaattggttaggtttttaagatttgggagggctggtgtgaaagaattaaaatactcttaactggagcccctccgccgagaactggaggtcccgcctcctagttcggcgctttcaggaccctcttcccagagggaatttctttcagaaattccagggtgggcttgtaaaagacgcttccgcagagcaggtcccgtcagggtctttttcctgttcctggtgccagcggtcggcccggg

SEQ ID NO: 70027 - DNA, 17 bp, Homo sapiens
  chr1:91190984-91191001
  hyper
cggagagtgcccctccc

SEQ ID NO: 70028 - DNA, 233 bp, Homo sapiens; identical to SEQ ID NO: 1767
  chr1:91191002-91191235
  hyper

SEQ ID NO: 70029 - DNA, 1288 bp, Homo sapiens
  chr1:91191289-91192577
  hyper
cgcggccggacagagcccatcagctacaacgcggaaggcctctgcacccccttgggggcgggaggaaagtactgccagtcctgcctgggggccgagggtaacaagcaccgagcctctcgctccacgcagggccagctgcccagctcagcgaagctcttgtgatctggtgcgtgtctctcgctcttccctccccatcaaagaagtaaactttctacctactccccctaatccgatcgtttagagctgctgttttccttttgtcagattcctcctccccgatcagtctgagtacacgatcagaactgctcagagagcaggaagcacattgatttcagcttgttctgtccacagacaggccctgacaaggttgttagaacagccggagaggtctatacaatcacttaattaccaaaactgtcagtcaggcgggacgcggatccgcgtcccgggctgcgctaggcattccagcactgggccgcgcgcgtgattgatcggtgctgatagcaccgcaaaataattacggcgaattttctgatgtgtgattttatcccaagttcatgcttcagagaggtaatcggagaatgagaagggtcagtgccatttcggattacctggaatctgcgagaaagggtaaaatgggggaaggagctccgaggaaaacgggagagatgggggtgcagagagagagggaagaagaaagcgagttatggattgctggagggactgcaagcaattcgtcaaactgtgcaagtgatttccttcagagccagcatatggcagattgattttgtccaacgtcggttttagccacatttaaaatgatccagcggttattactgcgattggcttaggaactgacaggcagttttaggcgcaaggagtatagatcctgtttaccggagatgtgttcgtaactgctgtcaaatacagttaagtaaatatcattagcgaagagctctgttaagagaaatgccaatccaataaatatgcttttcctccccgccctccgcatggctgcctgcgcttcctccagaggttctccttcctgctcctttgctgcttgggtcagacgtcccaggcatggtgctgactcccgccaccttggagccccgagctgagcctcgggcagaagatgacaggccagccgtggggcaaggaggccgcggaaacgcggaacggcttcggggagacggaagcgcccaatgagattcaccctgcagcccgggtccagcccaccttcctcggagattgccgcggccctcgaacccgggcctaggtcttcatgtcc

SEQ ID NO: 70030 - DNA, 136 bp, Homo sapiens; identical to SEQ ID NO: 26466
  chr1:91192681-91192817
  hyper

SEQ ID NO: 70031 - DNA, 952 bp, Homo sapiens
  chr1:91194539-91195491
  hyper
aaatgcttaaagttgcggatgtaatttcacatgcgtccgggttgatgtgatatgaccgtatcagggaaacaaagctaagtgcagtcaggatctgttagtacagtggcttttgatggaacagctgaggcacacatcgcccgtggcatggactccggggccgaacgctcacgaccaagacttttgcccttttgaaatgaaatagaaataggggagctgcaggaaaaccgaatcgcgcttagggtcaggagcaagacaggagctttcagcgaagatctgaacattcagaactggaacgggtaattagcagatagccaggaaaaaataaataaataaataaaaaagcctggatggacctctgtaaacaatcattaagaaaaataaaaatgaaccttcttattagcctgccttggaggtagtcagaaacaaacaaccaaagcaagagaggatgaagatttaaataaaataattatgtgcatcattaaaataatcatatatgtttgtacagacacgtatacaccaaggaacgtaatgggggctcctcgcacagtcccaggagatgcaggagcccaattggtgcccaggagctgcaggctcgggtccccagccaggcgggggactgcgggccgcccgcgctgcagggccgcgggtcaccgcagggggcgccggggcgctacgggtcctcgggcctggtcttttccggtccctgcccgagcccgcgcctttcccgcctttcgggggagaaacctgcctggacactggaactgggagaaagcagcagcctaattgctcttccgatcgtcgcttgggaaaggggggcttcacatttagaaacttctcgcacctttctctctcggtctctgccttttggtgcctgaaaaaccttcaaagatttgcttattttgattcctcgggcgttggagctgtattaggcagcactcgtagataatattga

SEQ ID NO: 70032 - DNA, 316 bp, Homo sapiens; identical to SEQ ID NO: 5622
  chr1:91195879-91196195
  hyper

SEQ ID NO: 70033 - DNA, 295 bp, Homo sapiens
  chr1:91196225-91196520
  hyper
cgcttaaagattttcgcaaaaagtgcactggggccaaaaatcaatcactctccctagcctgacccggtgaaaacagatgcataacatattcatgcgctgagcacgccgagcagcccagcgcggaacttttttttttttcttcttcttcttcttcttttaaataaagcgaggaggacttccgcggctcggcagtcctgctaaagctggcagatgcagcaaaactaatatgtgtaaatgctttaaagcaataatctgcttacagcgacacttccccgaacggcggcaggactgaggg

SEQ ID NO: 70034 - DNA, 1125 bp, Homo sapiens
  chr1:91316237-91317362
  hyper
aaagctaagaaccgccgtgcgatggccggctttgggcaccgggggtgggggctacgctacgcgtgaagggcctcagtcctcgggctttagttcaggaagaaaatgaaagctggaggtctcgtgggcgggactggaggcggccagataggcaagaacccgcaacaggagtagggacattttttcttcaaattccaatcccatccagcgatagacaggcgcgtgggtctccctcctccacgaccaccacacaatggcacacacttttgctggaaactgaaatcgaagtctctgaggcaggctggggcccaggccggcagcggggaggggcagggtccagccacctcggcgtggccttggcgagcgctccggggtcagaggccgtcgttctcgccgcgctccacagcgcgtcacccgctgccctagcgacccccgggcgaccccggcatcgcctggctgcgccgtcccggcgggccggccctctccacgccctctcctggggtttgcggtgggcacagctccctccagactgggtctctccactagcctcctccccaactgcaacgtgggaaccagagctatccgagtcacgagccccaagtgcacacaaagcccccaacggggccacggcgcctccacgcctcgctacctccagctccaggagcgcagaacgcagcgccctgggtcaccgcgtctgccctgcggagcagccccactgaggggaagcctcgggcaggaggtgagaccccgcgcacgcaagcacccccgccccaagcagggccctctgcccgagggagactctcacctcaaataaacgggcgctgccgcctccagggggaggacagcgggcggagaatactcacgctgggcccagccgcgcggggacttcgctgggaaccacgcgcgggctcccgccggggagcggagccccagcctgcagtcctgcgcccgccccagcaccgcctcctcggaagggaggcctctaccgtccggcggcggacctgcagccgccgcgggagacgctgccccgccccccggccccgcccttcggcccatccccgccccgctggcctccttttcccctgccccctccctccgctcctcaacgcccgccgggtgcaatctgct

SEQ ID NO: 70035 - DNA, 1282 bp, Homo sapiens
  chr1:913503-914785
  hypo
ggccgccccgggaaccgcctgcctccccctccaaccccaggaaccgcctgccccaccctaaccctgcacactcttggcctgggaactgcctgccccgcacacgcccgccccgggaaccgcctgccccagatacatccatcatgggacatgtctgtcctaagatacatttgtgctggacacgtctaccctggacacgtcttcccgaaacccctctgtcatggacacgtcttcctgagaactggttgccccgggaaccgcctgccccgggaaccgcccgccctggacgcgtctgtcggagtcacatcgcccccgtgcttcttctgcctgagatttgggtgacctggttgagttgggccagtttgggggaactgccagtggaggccccgtgttctggtctgtaaagcatctcccagaggacatcagtgtgagatgggcctcgtagagtgcctgaccctgaaggtagccaggcctgggcgggaaccctgccagaggctgggggagggacgccgccgtcacatgggcccgaacacagggcaacggcggcgcagagccaaccccctgaacaacccgggtgcttggactgggccgccccatctggactgtgtgctgggatgactgggggctggtccccaggctcccctgctaggggatgacccaagcccggcctgcccggcccctgcggccccctgcttggccaagatccctggacagtgtgtgcctgggatctggacgggctgtgggatccgagagcacgtacctgcccgtctaagagccaggtggagccgctctaccacggctggcttgaggggggtcccaggccccgccccctcggaggccgaccggggaggctccagggcctgcagtgggagcgggacagccggccccagcacgccctcaagcctgtcctccccgaagaagaagtgttcatagacctcagggatggagatgggcacggggtctccaggtatgggggccggcacaggatcagctctcgggagcggctccggggacccccgccgcctcgacctctgggctccaacgtctgggaagaagaactcgcacatgtccggccactggacgcctgccggatcctgaccggccgctgccgcctcagcctcttcgttctcctcgatggtgtcacagaagaagaactcgtaggcctccgggagggtcacggcaaagctgctcccgggcccgaccctcgtcacggcagagggaggggggcgaggcaggtgcttgaggatccgaggctggtggggccggggcccgacagccacagcct

SEQ ID NO: 70036 - DNA, 30 bp, Homo sapiens
  chr1:9174714-9174744
  hypo
actaaagctacaaggcggtagatttcttct

SEQ ID NO: 70037 - DNA, 210 bp, Homo sapiens
  chr1:918367-918577
  hypo
gtgtcctcgggcccacgccgtgctctggagacagctgccatgagggccgcgggcgactgcccgggcgggtgaggctgtcctgtgtgaacgtgccacgcggctgtgccgtttcccgtgggtggcgatgtgggtcgtttccagtttgcagctaccacacacggtgcggctgtgaatatctgggaacattcctttcggcgaacctctcacatt

SEQ ID NO: 70038 - DNA, 515 bp, Homo sapiens
  chr1:91869861-91870376
  hyper
gaggccttagggccccgagagtggcacaagaacggggcgctggggcgcgtcactccaccccccgggtcccgtttcctcccaccgctgtgaaacccgcggctcagacagatgggtacgtcccccccagcgctcgctcagggggcgccacacaccggaacacaagacacaggaaccgaacaccaatcagccgactttaggggcgggccggacgcccagccggtcccacctcgcggggagctgggcccgccctgcgcccgagcgcgccgcaggcctcaccgctttctgactggaaatgcggctgaggcgctggcgcgggccggcggcctggagacgcctggtgaccaacaactcgccgcgcccgtccgctgcctgcccggcagacggctctagagatcgaccgctgcccggacggctcggctgggtccccacttccccgcgggcgtcgggcccccgtccccaccttccccgcgggcgtccgggcccctctcctcacctccctgcggacagctcctagg

SEQ ID NO: 70039 - DNA, 55 bp, Homo sapiens
  chr1:92048970-92049025
  hypo
tgttttgacaaatagcgattccctagattattaaacagtgcgtaatctgagagaa

SEQ ID NO: 70040 - DNA, 130 bp, Homo sapiens
  chr1:9243203-9243333
  hyper
aggctggggaccttgcgtggggcagggcttggctcagccgaggggccgcggctcagcccccctcaccggccttaaaggttcccagagacgcaaagtcggacgcgggtcctgagcgcggagctacaggggg

SEQ ID NO: 70041 - DNA, 48 bp, Homo sapiens
  chr1:92494924-92494972
  hypo
ggactgtcactctcacggcttccagcccttcgacgaactctcaggtgt

SEQ ID NO: 70042 - DNA, 128 bp, Homo sapiens; identical to SEQ ID NO: 26473
  chr1:92495704-92495832
  hyper

SEQ ID NO: 70043 - DNA, 1142 bp, Homo sapiens
  chr1:92948324-92949466
  hyper
ccgttagcatttctacgcccaaggtcgcgccaattcccccccagcactgccgggtccctgcagctcccgcccaagaggttcccagtgggttcctacctggagacgcggagggtgacgggggcctccagaagtcctcaaactccgagctccgttcgcagacgctgccttcgcagctgtctggggatgcggaggctctgtctggggcttcggtcagctgcgattcgggggacaaacggtcccggggctccgccttcgccccgcctgcatttgaagtgctgtctgcaaagaggaggcaggtgaggggctcaggctgggaccggttgagtctgagggtgctgaaggctcccccaatcccccgaccagggcagccgagcgtcttcccctctccacccagaccccggccgggaaccctctcggatccgagggcaggcgcagagaggccatggcacctaggagacaaacccggaggaaccaggacagtaggaaacaaaaacagcagcaaaagggacgttggggcagcccctcccagctccggactaatggtgtgccgaggtgcagtaggcatccgggggagcagccccgcctggcccgcgcgcgcctcgcacctgctcggctaggcgccggtacattctctaaacggagggaatagtctggtcctggggagcgcggctggtggtagctgtgagccttcttgcttttgacgagaaatgagcgcggcatggtggtccggcactttccccactgcgccccaagagtccctggagccgctgtcacccacggtcactccgagggcttgctcagccccagcccggaggagacctgagagggaaagaaaaccaggtggagacgtgggtcagtactctccggtgcggcggactgggcacccaggcggagggagagcgcgggccagggaggcgcgcagagggcccacgggaggaggggcttgaccctgctgcgccgcgcttaccaggtggcacttggacaggtggcgcgaacccgccgtcgttgccgccgccgccactgacacagctcagcggtaaaacctgtcccggggccctgtctcaggcccctttcctcctccctgcccacgccccccagctcctcccctttcctagcgaagctcgctccggcaatcaaactcc

SEQ ID NO: 70044 - DNA, 516 bp, Homo sapiens
  chr1:92949691-92950207
  hyper
gataaaactgtggggcggcgggaggacagcagcagagggattggggacagcagaggccagagaaaggaggtgggagagcaaagggacaggaaagtgaggggaacaacagacgaccaacccccgccccaggagaaactcgcatctgggtgatcccactcgcccctcactagtgccccacgtaggagaaactttgcccttggactcccggctgcggcgggcaccggtcgaggctgcggcgagccatcccagaccatggagacctaacctcgggaatcaggtcccgggaaaaaagcactttccgttctgctcaccaaaaaatcttgtcctagggaggtggagcccgatccacgaacgttgactgggaaatgctaggtgtcccgagtcggtagtgcaccgacaatttagcagacaaaaaagacaggacgccagagcgcgcaggctgcattagcagagagcgggggtcgggcccgggcccgggagggaactagctgcccggggcgtcgctctcattaaccc

SEQ ID NO: 70045 - DNA, 2116 bp, Homo sapiens
  chr1:92950434-92952550
  hyper
ctgggaactctgggccggggcaggacctgcagtcctccggcttcgcgctgtttccactgccggactaggagcccctcggcttcctaggcaagatgcaggccacacagtctacgtctgtccgttggcgctctcagctcaaacgagtcctacaggccttggtccctgtagggtgcaggccccctgctccagatccccagccccattgtgtccccttctccggaggaatgggaatagacctgggagaaaagacgcctgggacgtgtcgcggggctcccgcgaagtttcccgctacccaagcgccagaatgcccctaggggtgagagtgccatccgcctccctccggggtggctcctagggctagagctttgtcgcttcctgcacttctcgtccgtacaattagacgccacaaaccccaaacccaattctttaaacagccacgaaactcggaagaaaagaaaaacggagtggcgttgtcccgagggtcccgctgcagcttggacccacgttggctgggagcgggacagatgggggcggggtaactgtcagcgccggagctgggtctgggctggcgccaccagagaccaggcggacgcggaggccgcctccccacccgggctgtaagcccacgcctctctcgcaccccggcccgctttgctggttcctgtggggagcgacagagtttggaggagataggggccccggggcctgggccgagcgcgtgggaaggcaaccccgcgctgcagctggcgcgggaggtggggcggcccctccgcgcgctcaggcctctcctcaccgtccgggcccaggaaggagggagccgagggcgctaagggggcgtcctcccgagcgcagctgccgccgcctccccaccagatgtttccttccctggtggatttggctcccctgccgaaccaccagaccgcctgctgcgcgcccccagctccagatttccagtcacactgcgcgggtcgcgccctaacccagctgccggagctctctgggctcccgcacggcggtccgcagcaggtgggaaaccgcccgcgccctctgatcgcccccgcagtgccagtgctctgcgagtccccgcggccgcccccaccagggcaggaggcgcagaacaggctcggcggacctacctgcggagtcacggcgcgggcaccgcgctaggagagttttcaaacggaatcttgctttcgggagagaccgctctatctctctgacttaaaaaaaaaaaaaattctccttccgagctcagcccccaaaaccacaagcttcacttcctgagcgttactgagtcgctcgcatagccctcccagacctgctcccaacccccgtcgggcggccgggcgcgctcctttgcgcaagtggccaggcggtggggggcctggcctttccagcccgtcccgcgcgccccttagtagtcctcccagttctctccctgtgggtcggcaggggatgggggaaattggaggtccggacacttaggcactagaaatgacttgaaagaaaatgaactattcttggctccagggagacttccgcagcgagagaagccacagattgaggacacagattgactggcgagagaggggtggggggcgccccgctccgaggaccctccccgcccctcaggcctcggtcacccgccccccccacccccgaccccgccgcctcctagggctgcaccacccccgggtcgggaccgtgaatcaccggcccgcggtgccgccggcctggagcccggcgagtggccacggcgtccgcagagcgaaacctgccccgcaggccccgaaatagcttgttgtggaaacacttggggataaatacgcccaacgaggctgaaaataccttgacacccaatccgagaggtttgctcatttcccttcggatttaggtaatggttaaatttggaagaggtgggcgagcgccgagcccccggcggagagggccctggcggcgcgtcccgcgggcgcccggcgggaccggtgggcgcaccctccctgcgcggagctcgccggctctcgaccgggtccgctcagccttcgactaatttccggtggtcggagctgcaaaattaaaggccgcgcgggggcagcgccggcggctgctaggctga

SEQ ID NO: 70046 - DNA, 156 bp, Homo sapiens; identical to SEQ ID NO: 39010
  chr1:93222691-93222847
  hypo

SEQ ID NO: 70047 - DNA, 57 bp, Homo sapiens
  chr1:935070-935127
  hyper
cctcttttctgagggcgtccaggatgagggttttgagctgagcgaggctctcgttaa

SEQ ID NO: 70048 - DNA, 18 bp, Homo sapiens
  chr1:93543647-93543665
  hypo
gcccggctgcatctgctt

SEQ ID NO: 70049 - DNA, 105 bp, Homo sapiens
  chr1:936563-936668
  hyper
agcctggcctgggcccgggtgtggagaccctcccgggctttcaatccgggcaggaggcagatggcagactcagcagtcacgtaagagaaccgaattaggtgggtg

SEQ ID NO: 70050 - DNA, 30 bp, Homo sapiens
  chr1:9379709-9379739
  hypo
gtgcagaggatgctgcgggaggccaagcct

SEQ ID NO: 70051 - DNA, 19 bp, Homo sapiens
  chr1:9391674-9391693
  hypo
tcaccgtgcctagccggca

SEQ ID NO: 70052 - DNA, 30 bp, Homo sapiens
  chr1:94045521-94045551
  hypo
cctgtgagcactgcccgaggccatctggcc

SEQ ID NO: 70053 - DNA, 30 bp, Homo sapiens; identical to SEQ ID NO: 39011
  chr1:94048058-94048088
  hypo

SEQ ID NO: 70054 - DNA, 82 bp, Homo sapiens
  chr1:94048417-94048499
  hypo
ggctcagggcaggctcgcttcccgtcctgaacacaggtgagtttgggcaggggcttgtgtccacacccgaggactgaggtgg

SEQ ID NO: 70055 - DNA, 365 bp, Homo sapiens
  chr1:942313-942678
  hypo
cctgagagtccagggcgccaagtcagccctgcacctggcccgggcctcggaccccgacggggctcacccacctgagatcaccctggctctgcgggaaggcaggaagctttggcatgatcctccacgggcgaggatcacgtagagacgtgtagagacgcgacgaagcacgaagacccgtgtttgacgggttgccaggtgcctacatcagagctcattaaattacacattaaatagatgcacgtgtgtgtgtcaagctcccctaattcaagttgtagaaaatcagactcagagttcttacactcgggggtgttttagcagctgcgcctcaagattctaaattcaaacgcacacggaataaaacattt

SEQ ID NO: 70056 - DNA, 37 bp, Homo sapiens
  chr1:94343568-94343605
  hypo
aaatcaaaatttggccgggcgcggtggcttacggctg

SEQ ID NO: 70057 - DNA, 41 bp, Homo sapiens
  chr1:94345747-94345788
  hypo
ttttttttttggagacggagtcttgctctgtcgcccagggt

SEQ ID NO: 70058 - DNA, 30 bp, Homo sapiens
  chr1:94490609-94490639
  hypo
gcaatgagacacccacgttaattaccttgg

SEQ ID NO: 70059 - DNA, 30 bp, Homo sapiens
  chr1:94701656-94701686
  hyper
gagctcatcctaaaacgatgattaaatctt

SEQ ID NO: 70060 - DNA, 55 bp, Homo sapiens
  chr1:94702935-94702990
  hyper
cgcggccggagcaagcgccacctcctcacactcaccacggcgctccatctcgcgt

SEQ ID NO: 70061 - DNA, 33 bp, Homo sapiens
  chr1:94703324-94703357
  hyper
cagcatcacgggctgcgtcggctgcccttttgg

SEQ ID NO: 70062 - DNA, 229 bp, Homo sapiens
  chr1:95007667-95007896
  hyper
gcaggaaagggagggcgccttggaagaattcttcccttccatttggtgataaagtgggagaggcggcatttacaacatttaatagaaagcacgggctctgggctcccctcgggcagcggagggcatttcccggatgctttgcccacctggggcagaagctcgggacctgcagcgaagtaaacgtgtggctgtgagcagggccctctcccagccacggtggcttcttcta

SEQ ID NO: 70063 - DNA, 154 bp, Homo sapiens
  chr1:95071346-95071500
  hypo
ttcttggatgtatgaaccatataattccttcttcaaaagtcataaaggcgagactccagccaacaattccacataaaaagagagcgccattttctcgctctcaggcttggtaatgattcctgctgtgaggcagtcattacggaaatgactcagt

SEQ ID NO: 70064 - DNA, 884 bp, Homo sapiens
  chr1:95391740-95392624
  hyper
actcgcacagtggcgcgctcaggctttgtctccatttcccgcaaaagcaacagcagaagcagcagcagcaatctgcctccaaatgcctcccaggcaccgagatcggagactgtgatgggtcccggaccggcttccgttcctcggggcccctggggtcggcgggacattaggcggtctctctccccgtggggaggcgcggagtccgccagcacccggggcccgggcagatggcgggggctgcggcagcggctcgccgggtccctggccgcgcagacgggctccgcctaagggcgagtggccacgcaggagcgcccccttcccggagggcgcgttctgcagtcaccaaacggcccccgagacccccgcagccggaaaggctggcgccgcgggactccaggcgcccgggaacccaccgccagccactagtcctgtcccacggcgcgggaacaaagccaggcgggtgcccgggagccggccccgcaagcccggggactggacgcgaccgggacaggcagagacgctcgcgccgcctcgacggcccctctccaggaaaacggtgagccacagcgcgaagagcaaacgaagcacggcccagcgccaggccagcccaagggtgccccgggggcccccgcgcccgcccgagccaggcgtaccttgttcttgacttcggccgagagcccataggaagggcccttgttgaagtgggtcatggtggttcgggcggcgggaagagacagcgctggggtccggggtctctcgcacttcgcttccccgctcctggccccgaggagtggccgccgcgggggatgctcgaactccctcctctgggaggcgcaggagacggccgcggggcgcgggcggtgcctgggcgactgggtccaact

SEQ ID NO: 70065 - DNA, 72 bp, Homo sapiens
  chr1:95392995-95393067
  hyper
gccggcggaggggagcggaagcccaccggggctggcccgccgctgacccgccgcctccgtctgcctcctccc

SEQ ID NO: 70066 - DNA, 151 bp, Homo sapiens
  chr1:95428423-95428574
  hyper
gattttacaggttttcgatttatctcctcctctttttttttttttttccccatgcagagcaaagggaaaaacagctaagtgtttcctggctgaattttattttgctttcagtttctgccatttcagttcctgttatcgtgctttgaggtgc

SEQ ID NO: 70067 - DNA, 30 bp, Homo sapiens; identical to SEQ ID NO: 38692
  chr1:957607-957637
  hypo

SEQ ID NO: 70068 - DNA, 30 bp, Homo sapiens
  chr1:9580479-9580509
  hypo
tgaacaggtcagactcgtcagggacccacc

SEQ ID NO: 70069 - DNA, 83 bp, Homo sapiens
  chr1:9648276-9648359
  hypo
ggattacaggcgtgagccaccgcgccctgcctggatctggcattctttctaatggttgcattatgttccgaactatggctgtc

SEQ ID NO: 70070 - DNA, 55 bp, Homo sapiens
  chr1:9661692-9661747
  hypo
cctctgagccagccccgtgcacacccgctgtgggctgggccgggttgcctcctct

SEQ ID NO: 70071 - DNA, 67 bp, Homo sapiens
  chr1:9711452-9711519
  hyper
tctcagcctttctcccgctcctgctgaaattctttcctgcgtgaaggcggagcgcttaaaggcgcct

SEQ ID NO: 70072 - DNA, 916 bp, Homo sapiens
  chr1:9712098-9713014
  hyper
cccccgtgggcccgccgagaggggcgtgcgcagctccccggcgcctgcactgcgcgccttgcccgcctggcccggcagcggggtttcagctgcgctcacagcggcggtgcggcctccggtgcgccggctgaggcgcgaggatactggaagcgctcagcgcgtgcgcccgctccgagcgctgactagaggaccaggggcctcctctgtacggcagcggggtccacagagagcgcgctggtgatgtcgcccgagtgccctggcgcggagagagggctgcgcacagttcgccggcgcccgggtcctgtgcgcccttcccagcctgggcaagtggggagcggggctgcagaggggccggggtggaagttttcggggcttcctcccggctcgtggacccgcgccccgcctcccagtcccgggcctcccgcgttgctcgccgcgtttgctgcagcggcgcaggcgagatcagctccggatctgcggccgagccggggttacgccggcaaaaccgcccccagctttgcatttccggactttttaaaaaaatactcttacccgtaattcagcctgaatgaggctttttaaaaaaatcgagtttcctgtttttatttaggcttcctcatttgcacctcctcctttgaggtagagaagaggggaactgggacgacctttcgtgggcaccaggatgggggcgttgcagggcggggagacgggggtccagagaaccggggaagggccgctgggaggtcccgaaaagtgcgctgtgggtggggcgagggtgaagcaggtaggggcgagatttccggggtcgcgggtggggggcgccctggagcggccaaggtgcagggtcctcgcgtggcacccttgggatctgcccagtttgcggatggagcgcggggctgatcgggcaggtctcact

SEQ ID NO: 70073 - DNA, 34 bp, Homo sapiens
  chr1:97185220-97185254
  hypo
tcaatcaatatcgatcgagcgaatgtggggaata

SEQ ID NO: 70074 - DNA, 30 bp, Homo sapiens
  chr1:9740821-9740851
  hypo
gccccacagcaggaacgcggcagccatggg

SEQ ID NO: 70075 - DNA, 90 bp, Homo sapiens
  chr1:975817-975907
  hyper
atccctggagaggcccggggctggcgggaatcctcggcgggcggggtctgcgaggggcagggccggtcctgtgagcgcacgcacgcgtgt

SEQ ID NO: 70076 - DNA, 30 bp, Homo sapiens
  chr1:979970-980000
  hypo
acatttgtgcagctgcgtgtgtgggcgtgt

SEQ ID NO: 70077 - DNA, 30 bp, Homo sapiens
  chr1:9828369-9828399
  hypo
gcggcaccatgggggcggagttctatgttg

SEQ ID NO: 70078 - DNA, 193 bp, Homo sapiens
  chr1:98338299-98338492
  hypo
gactatagaacttttcgagaaaaaaatatttatcatcatcatcattgtcactactctgtggagaggtcctcagcatcatctcttggtacttttcttcatgctccagtctacgacttcagccatgcagtactgacaccgtttcaatcccttaacttcaatcagtatgctcccccatcttcggactttcagatac

SEQ ID NO: 70079 - DNA, 34 bp, Homo sapiens
  chr1:984367-984401
  hypo
gctgtacaatggcaacgcccggggcaaggacttc

SEQ ID NO: 70080 - DNA, 70 bp, Homo sapiens
  chr1:984667-984737
  hypo
ccgggccagtggcaccgcctggagctgtcccggcactggcgccggggcaccctctcggtggatggtgaga

SEQ ID NO: 70081 - DNA, 299 bp, Homo sapiens; identical to SEQ ID NO: 26480
  chr1:98510732-98511031
  hyper

SEQ ID NO: 70082 - DNA, 836 bp, Homo sapiens
  chr1:98511032-98511868
  hyper
cggggacccagcccccgggcccccgccccctccccatctcggccgccaagtctggttgcggagcagcgcggccggccgggggtggggctccggcaccgccccgggctcgggattcgcgaagtcacgcgcttccgcaggcttgcgggggcaccttcgcccacggacacgccctttctgcggaggcagcccccagcgaccctctgcccagcttcggcgcctcactcgcgacgctcccaaactgctcaaggcctttcagtcgttcccaactttagaaaatcgccccgtccgcgtctctccctccagccgcaccccaccgtggagaggagaggagcggactgggaacgccgaaccgccccgcaggctcggggaaacggacccccttccgctccccgcccatccccttcacctcgccccccgccccctgcgcgaacccattttccagtcctggtcaccagaggcgcagcgcacagcctttccggtggaaccagtgcgaaaacacccgaggaaatgaaaagaacaagaaagtgctaccttggcaaccacgggcgtttagtggccagctggtgggctggggagggcggccgctgcccccctgccgctggtactctcctcgactacgcgtattcttaagcaataacaacgtaatccgtattatccacccaagaatacccgtcaccgaagagagtcagaggaccaagctgccgctgccgctgctaccgctgccgctgctaccgctgccgctgctactgccgccgccgccgccaccagaactcttgctgctcgctgagcccgcccctgcctggggatgggctgagcttgaccgggaccataaatcc

SEQ ID NO: 70083 - DNA, 315 bp, Homo sapiens; identical to SEQ ID NO: 26483
  chr1:98513940-98514255
  hyper

SEQ ID NO: 70084 - DNA, 247 bp, Homo sapiens
  chr1:98514484-98514731
  hyper
cccatcccagttaatcgcttcgcaatttgcaaccaaaaatacataaagaaacgcgacaaagcaatgggtttgaggaaataagccaattaagctaaagctgaaatgcctctctctctctctctctctctctcccccccttctccctctttctcttcccccttgactccctccctctccctctctccttccctctcaagtagaaagggggaaacaccaaggagagagaaaaaatcgggaggagggtggt

SEQ ID NO: 70085 - DNA, 43 bp, Homo sapiens
  chr1:985145-985188
  hypo
tccattgccagtgcccgcccggccgcgtcggtgagggtggggc

SEQ ID NO: 70086 - DNA, 19 bp, Homo sapiens
  chr1:98515068-98515087
  hyper
cttgggaagggacctcggc

SEQ ID NO: 70087 - DNA, 289 bp, Homo sapiens
  chr1:98515088-98515377
  hyper
cctcgcgctggctgtgccccagtgccttcgcgtggtggcggcttgctcatgcttccgaggagtcccaggcgatagccttcagctgatgcgagcttccagaaaggagtggggaagggaaaaaatcatctaatgcaatcaaatcgatctgatctacaccatctgtcgcctgccactatacacaaacgttaaaataggaaaacggaaaacactgacagccgagagggttggtctgcaaagagttcatttttagcagagcataattcgatatggtcggcgtacagttacaaaa

SEQ ID NO: 70088 - DNA, 675 bp, Homo sapiens
  chr1:98518986-98519661
  hyper
ataccagagtgatctcggcgctcgcgcagttttgagagagggtcccgaaaaccgccggaggccaggtgtcgcggacgggccccgggctaaactctcgtctggcgaagtgaagagcgcaaagtctccaggcccagcgcgccttcgcggggcaggccggacaccctagccccgggccgggctcgctcttctctgaagccctggagcgggcaaggggcaccattctggccacaggaactctagtttcagcagccgcagcccgccagcgctggctcggaccggggcctcctctgggagagtaggagagcgaaaaaatcaaccaccaccttggatttcagatcgaggaaaggaagccaaagcaaaggtgtggttacacaggacatccatagacaaatcgttgcctctctaagtgggcctgagctttgcggctccagaagcgcgaggcgcggttggtgcggacgcgggggcgtgggagtcatcgctctccccgcagccctggccgagctctctgctgtcctcccgagtttgggccagagaccacggctcactccctaacgccctcgcaaggacggctgcccgtcgggccaagggcgccccgggctggaggccggagcaagacggccccgcgggactcgggagccttggtaaggcggaggctcagaccccgttcacgaaaac

SEQ ID NO: 70089 - DNA, 375 bp, Homo sapiens
  chr1:98519662-98520037
  hyper
cctggctcctccaggatttgtcaggtcttaagcagctccgagaaggctccgctggctcttggggaaccccgctgtgcggctcacccccgtttgtctctctcaagctctcgccctcctcccctggtcctcccttctccagatcccctgccctgcccgaggtccgggccgcgcgggctgagcccaatacgcccggagaagagcgccggagccccctgctggccggacgcggcaggcgcggcggcccgctcggtcccctccgccccgcgggctctgcccagcccggacccgcctccaccctccagtgccctggcgctgggggcgtgctaaaagcaacagaaaacaaaacaaaaacaaacaaagcgccaaaccccactc

SEQ ID NO: 70090 - DNA, 404 bp, Homo sapiens
  chr1:986504-986908
  hypo
tttctgtgtgattaacgctgccccctagataggcaatgggcgggtggggcgggtgcgtgcaggtgcctgggccctgggtctgcaccgtgggtgggctctgcacagccacttacctggcgtccccgcaggttccgcacaccgtcctcaacctgaaggagccgctctacgtagggggcgctcccgacttcagcaagctggcccgtgctgctgccgtgtcctctggcttcgacggtgccatccagctggtatgtgggggcggggcgtcccagcagggcctccggggcgggcggggtggcaggcgggacaaggccctcaccctgccctgcaggtctccctcggaggccgccagctgctgaccccggagcacgtgctgcggcaggtggacgtcacgtcctttgcaggtc

SEQ ID NO: 70091 - DNA, 30 bp, Homo sapiens
  chr1:9877098-9877128
  hypo
gagaatcagacagaacgaaacagatggctg

SEQ ID NO: 70092 - DNA, 30 bp, Homo sapiens
  chr1:9897055-9897085
  hypo
aggtccaattatgtgcgattagtggatttg

SEQ ID NO: 70093 - DNA, 32 bp, Homo sapiens
  chr1:9899160-9899192
  hypo
gcaggggtggggccccgcgttgctgtctgtct

SEQ ID NO: 70094 - DNA, 30 bp, Homo sapiens
  chr1:9907045-9907075
  hypo
ctgctgaagtgtccccgactcatttacgtg

SEQ ID NO: 70095 - DNA, 40 bp, Homo sapiens
  chr1:99127631-99127671
  hyper
ggccgcacccggggccgcgtcgcctcggggcctcaaaccg

SEQ ID NO: 70096 - DNA, 136 bp, Homo sapiens
  chr1:99469561-99469697
  hyper
gatcccctctctcctcgccggcccgcccgccgctgctcttcttccaggcacaatcgaagaggaggcagtgagcgagtcaaggccacagagtggatggaatcaaggttcacccccaaagctcacctcctttgcaacc

SEQ ID NO: 70097 - DNA, 303 bp, Homo sapiens
  chr1:99469759-99470062
  hyper
cgctgaagccaccgcggggtgtgggggggtgacgtgtgggaagagctgggggcttccttcgcacccaccctcacgcgccctagaatgtcctctggggaaggggctgcccataacttggaggaacttagaaggcaaaacctactgcgccccaacccttagaggggcctcaaccccgaaggcgaggggcgagatcagggactcggcgacgagggcgagcgcccccgggcttaccacgagcacggggaccccggcggccagcgagtagaggagcacggggggcacggcgctgctgtcctccgggcc

SEQ ID NO: 70098 - DNA, 319 bp, Homo sapiens
  chr1:99470211-99470530
  hyper
cgggcagcaggggcatgcacgcctcccgggccgggccgagccgagccgagcgggcggtcgacgcggtgggccccctccccggtccgccgaggcagccaccgggggcgcggcggcggaggcggcgggaggacgaggcacgggaggcgggatggagccgctggaggaagaggcggaggcaggtccgggcttcgaggcgccggcaggctgcagaggaggcggctacccccggacgagccccctctcccctgcccgccccctgcccgccgcaagcgccgcccgccccggcgcggggtcgcgagggagggcggggagtcccggg

SEQ ID NO: 70099 - DNA, 36 bp, Homo sapiens; identical to SEQ ID NO: 5642
  chr1:99470582-99470618
  hyper

SEQ ID NO: 70100 - DNA, 228 bp, Homo sapiens
  chr1:99470619-99470847
  hyper
ctgcgtgggcggacggggcggcagccggcgggacagcggcacctgtacccctcacagggcggacgctgtggggctggagaagctcctggcgggggtaaaatcaaaagggggggaggggaggcagtagagatggagcttccagaaactcttccgaggcaccagctgagaggtttaagaaacccgcacaacgcctgggaaaatggtgcgtggacgcgtcttccgagcgca

SEQ ID NO: 70101 - DNA, 89 bp, Homo sapiens
  chr1:99611990-99612079
  hypo
gagccctgccctcctcggaagggctgcagctgcccaaattgcagttgtggatccagcctctctgtgctcttgggggcctgggggaacct

SEQ ID NO: 70102 - DNA, 88 bp, Homo sapiens
  chr1:99612139-99612227
  hypo
cctgctggatcttagggcattgtcctgctgcgcgttgggggtgatgaacagcagcaggaggcagacagatttccggacagaaggggcg

SEQ ID NO: 70103 - DNA, 52 bp, Homo sapiens
  chr10:100027893-100027945
  hyper
ggagcgcggacagtccggggctgggcgggcgccgcggcggagcagcgctaac

SEQ ID NO: 70104 - DNA, 30 bp, Homo sapiens
  chr10:100171013-100171043
  hypo
ccattgcttgggaggcgcaagtgatggtgt

SEQ ID NO: 70105 - DNA, 84 bp, Homo sapiens
  chr10:100217160-100217244
  hypo
atcctctccatgcctcgtaggaaaaatggggataacagtagtacccctttatcatggggttactaaggacgcaaagcaaaccat

SEQ ID NO: 70106 - DNA, 45 bp, Homo sapiens
  chr10:100504665-100504710
  hypo
aaatacgttcattgccgggcgtggtggctcacgcctgtaattcca

SEQ ID NO: 70107 - DNA, 39 bp, Homo sapiens
  chr10:100991943-100991982
  hyper
aaatctgccccaacgcgcgcgcgcgcatacacacacaca

SEQ ID NO: 70108 - DNA, 149 bp, Homo sapiens
  chr10:100992042-100992191
  hyper
cacaaacacagcgggtgcttgcttccgctccccaaataaagaatggtaatcaagtttctcaccatcctcatagtttttgagatagtaatccgggcccgggcccccgcggcttttcgccgggttcctcaggttctggaactgcaggaagt

SEQ ID NO: 70109 - DNA, 426 bp, Homo sapiens; identical to SEQ ID NO: 33216
  chr10:100992221-100992647
  hyper

SEQ ID NO: 70110 - DNA, 59 bp, Homo sapiens
  chr10:100992681-100992740
  hyper
cgaccgttgccaaaaacttgtatgctgaaagccggcattgcctccgcagccccaggggc

SEQ ID NO: 70111 - DNA, 451 bp, Homo sapiens; identical to SEQ ID NO: 906
  chr10:100993487-100993938
  hyper

SEQ ID NO: 70112 - DNA, 756 bp, Homo sapiens; identical to SEQ ID NO: 33219
  chr10:100993939-100994695
  hyper

SEQ ID NO: 70113 - DNA, 980 bp, Homo sapiens
  chr10:100995730-100996710
  hyper
gctcgctcgctcgttttgtttttttcttttttttttttaattttttttaattttttttttcagtgttttggtgctggtggagcgaactcacgcccctagccagccttccccgtgactcttgccaagagaactcgtacaccggcaccgcccctttaagagatttctactgcagacattttttaactttttaaaggtaaggggaggggagcaggcgggaaggaggagaaaagggtggcgttgtaccctcctaatttaaccctctagggtcaggaagcagagggaggaatccaaaccatgccgttgtaccgtctgggtacagagcaaagggtctcgtttttacgtccttccctgagaggctctggagggcggttcaagctccgactccgacccgaaagccccagcgccaacccgggacgcgctgggatagagttcccaccgacagcacgcttgtttctcctgacagcgtcaggcacttcgtccgctcagggcccttttctggttgaagcagcaataccaagggcggttaagttgcagaggggtcttgaggcggtgattcctgtcaaagcatagagccctgaaggacattccccgaagaggagccctgatctctgtgacgcgttggatagccacaccgaagcatcctctgacctccatagggcaaagagtagcaagaaggaaaaacatagtgacctggtcaagcagcttttccgatccgagggccaaaagggacatgcgccctcgctctgctctgctcttcccgcaaccgaggaataagcgtcttgggagcgtcaatacatgctggctttggccaagtcgaagctacctgagctgtgcttggatagtcagggcggctctgcgtccaactgtgccacttcttggccactctattctgctgcacaggtagagtcccccctccagaccctcctggaggtcaatcctatacttagccctcctgcagggaagtgcgcctttacagtgcc

SEQ ID NO: 70114 - DNA, 562 bp, Homo sapiens
  chr10:101088914-101089476
  hyper
accgaagtgtgtacccgctacgcacagtgcggtgatgcctggccacctccagcctccagcggggacctcctgcccaggtggagtctgaatgcccaccgccaccagcccacgcgcgcagtgggcgtacacgtggtgacctgcctgcggctgggttcccagctccggctcctcctccctccagctctcgctcggcttcctgcagtatcacgtgcagctgcgctgggtgcaggatggcggcggccgcggcggcggcagcagcggtgggtgtcaggctccgggactgctgcagccgaggcgctgtgctcctgctcttcttttccctgtctcctcggcccccggccgccgccgcctggctgctgggcctgcggcccgaggacactgctggaggccgcgtgtccctggaggggggcaccctgcgcgccgccgaaggcaccagcttcctcctgcgtgtctatttccagccaggaccgccggccaccgccgcaccggtgccctcaccgaccctcaactcgggggagaatggcaccggcgactgggctccgcggctcgtgttcatcgagga

SEQ ID NO: 70115 - DNA, 561 bp, Homo sapiens
  chr10:101089801-101090362
  hyper
ccccctgcgtggctgcgggcgctcggggcgctcctgctgctagccttgtcggccctgttcagcggcctgcgcctgagcctgctgtcgctggacccggtggagttacgggtgctgcggaacagcggctcggccgccgagcaggagcaggcgcgccgcgtgcaggccgttcgcggcagggggacccatctgctctgcaccctactcctgggccaagccggagccaacgcggccctggctggctggctgtacacctcgctgccgccgggcttcgggggcaccggggaagactacagcgaagaggggatccacttcccgtggctgccggcgctcgtgtgcaccggcgcggtattcctgggcgccgaaatctgcccctactcagtgtgttcgcggcacgggctggccatcgcctcgcacagcgtgtgcctgacccggcttctgatggcagccgccttccccgtgtgctacccgctgggccgcctgctggactgggcgctgcgccaggagataagcaccttctacacgcgggagaagttgctggagacgttgcgggccgcagacccc

SEQ ID NO: 70116 - DNA, 313 bp, Homo sapiens
  chr10:101280172-101280485
  hyper
ctggcgggcgagcaccgttcccacataaatcaccagcgccagagtctcgggaaaaggcgcatttttcattgctggctgcagggcgactccagaccgcgaacgagaaacagaagttgtctttagataaaccgttcaccggagcgcgcgttgtggcagcagggtccgcagagcacagggcaacctgggtctggcgctgcgcccccgccaccgatcacctcccagaggccccgcaagaaacccagatcctctcaagggctggtaccacgtcctcctgccagagaggagatagggagccaagcgggaaggaaaagga

SEQ ID NO: 70117 - DNA, 312 bp, Homo sapiens
  chr10:101283181-101283493
  hyper
atactgaatagaaagcgaaggacggaggtagggagaaaggaaactgctctggggggcggaggtgggggtacacgtaggagggaaggggagggggctagaggaggctccgccccaccgtccggcagtgtttattttcaaggcagcttcccgtcaatcctgtcaccggggcacattcttttcgggggctgtgaaccaccgtcagggctctgcaggaagatttgaggagggggagggctgtcgagtagggagcaggaattcgcagagtagagagaactgcgtctgggcaggcagtccctgcgtggcgcgggggaa

SEQ ID NO: 70118 - DNA, 44 bp, Homo sapiens; identical to SEQ ID NO: 33226
  chr10:101290117-101290161
  hyper

SEQ ID NO: 70119 - DNA, 520 bp, Homo sapiens; identical to SEQ ID NO: 33227
  chr10:101290179-101290699
  hyper

SEQ ID NO: 70120 - DNA, 443 bp, Homo sapiens; identical to SEQ ID NO: 910
  chr10:101290700-101291143
  hyper

SEQ ID NO: 70121 - DNA, 27 bp, Homo sapiens
  chr10:101291230-101291257
  hyper
cgccatcctgaccgccaaaaaatgctt

SEQ ID NO: 70122 - DNA, 1639 bp, Homo sapiens
  chr10:101292333-101293972
  hyper
gaagttttcctgccccgcgcagcagctgaaaaaaacacactcctggggcatccttccctggcgttggttcgtggacagcaagcctcccagaactggcctaggtcgggaaggtgcagccacgcgggaatcaatggttcaggaaccggatctgtgcagcctcgcccgcagcgtctcggacttcaggactctatactagtccttgtctatttctggtagagccgcaacatcccactcgcagagagcagggggcgtggcccacatgagccagaacctatagggagggaggttggggcgccagccccgcccccccaacgtgacgcaaatctcccggacagaggcttaggagcccgggccccagtccctgcagtggctgtaacaaaacccagacccccaggtcccggccaatggaggcgatttagactggagtgggaccgcgtctgtcaaaagcccgactcggcagcagcggcggagtccaggaggagagctggagccgccgcgctgcctccccgcccccgccgggatttattatttggactggacaattaagtggccctgatgatgttaccaagcccggtcacctccacccctttctcagtcaaagacattttgaatctggagcagcagcaccagcacttccatggtgcgcacttgcaggcggacttggagcaccacttccactctgcgccctgcatgctggccgccgctgaggggacgcaattttctgacggaggggaggaggacgaggaagacgagggcgagaaattgtcctatttgaactcactagccgcagcagacggccacggggattcagggctgtgtccccagggctatgtccacacggtcctgcgagactcgtgcagcgagcccaaggaacatgaagaggagcccgaggtcgtgagggaccggagccaaagtgagtagagggggaaagaaaacgcacccgcacacctggagcaatggcagagcgcacacaaacagcccacagaccttgccagcgcagctgcccatccctttaccctttggctggggccatgcctccgccctggtcaccgacagctccacaaagcgcaggtacctgcaagggagccggggtggagagacaaggacgaggtgaccctgacaactactccccccaaaagggggaaatgagggaagggaaggtggttactgctgccctgatgctgagaggcgacgtgggctcagcgcctgggtcctcataactggcagtatttttgctcttccccccgccccaaaaggctcttcccccaaaaagggcaggagcctggacctttttcgttttccctctagggtgagatgagttctcttagcccagggcagccaccccttcttctccgaaaagacagcccaagcagcctgtgtctctcgcacccgcaggggcaggaactttggtggaggccagctgggcggtttcctcccttctctgcttggagctcagcgtccttgaacccgtggcactcggtagagagagaggagatgatcggaaagtgcgtgggaacaatgtctattccgcgcgaccatagctctcacatccctaaggcgccagccttttttgaaaatccgtaacgttttgctttgtgtcccaggctgcgggcctaatagaaaacgcgccgaacttgag

SEQ ID NO: 70123 - DNA, 872 bp, Homo sapiens
  chr10:101294528-101295400
  hyper
cacgaaacgcgcctccgcctgctaagggcgttctttgggtactggggctgtctcagggtcccacagcgccaggagccacaaacgttcccaaaagtccagccatttactaccgcacgctctgcgcagccaccaaaaagggtcacggtgctccaggacaggagccgcggtgcggccgggaacagctaaggacgctgttgtttgcttcttccgcagaaagctgccagctgaagaagtctctagagacggccggagactgcaaggcggcggaggagagcgagaggccgaagccacgcagccgccggaagccccgggtcctcttctcgcaagcccaggtcttcgagctggaacgcaggttcaagcagcagcggtacctgtcggcacccgagcgcgagcacctcgccagcagcctgaagctcacatccactcaggtgaaaatctggttccagaatcgcaggtacaagtgcaagagacagcggcaggacaagtctctggagcttggcgcacacgcgcccccgccgccgccgcgccgcgtggctgtcccggtgctggtgcgggacggcaagccgtgcgtcacgcccagcgcgcaggcctacggcgcgccctacagcgtgggcgccagcgcctactcctacaacagcttccccgcctacggctatgggaactcggccgcggccgccgccgccgccgccgccgccgccgcagcagcggcggcctacagcagcagctatggctgtgcgtacccggcgggcggcggcggcggcggcggcgggacctccgcggcgaccactgccatgcagcccgcctgcagcgcggccggaggcggcccctttgtgaacgtgagcaacctaggaggcttcggcagcggcggcagc

SEQ ID NO: 70124 - DNA, 202 bp, Homo sapiens
  chr10:101295401-101295603
  hyper
cacagccgttgcaccagggtactgcagccggggccgcgtgcgctcagggcaccttgcagggcatccgggcctggtagggacggggcgggtcacgcggcgggcaccccagcgcagcctggcgccgcgggactgaagctcgagaagggcctgacctaaaggtcaggtcccctcgttaaaaaaatatgtacgtctagctcctcag

SEQ ID NO: 70125 - DNA, 153 bp, Homo sapiens
  chr10:101296564-101296717
  hyper
agctgtatagacctgcgttcggtcaagtcttgcactctgccccacctcgagggtcgccagggaaaaggaagcctcgctcgcagtcccagctgttggccgcgcgaaggcggctccttccctggctgcagccagggctaccaacgcgcccggggg

SEQ ID NO: 70126 - DNA, 63 bp, Homo sapiens
  chr10:101296737-101296800
  hyper
cggccgagctctcccccttggccgccctcccttctcccccggcggccgcggctttatgcggct

SEQ ID NO: 70127 - DNA, 66 bp, Homo sapiens
  chr10:101297064-101297130
  hyper
cattgcttctcagagcgggggctttgtgcagcagtctgctcaacagagggacggagaaatgtgcgg

SEQ ID NO: 70128 - DNA, 30 bp, Homo sapiens
  chr10:101297437-101297467
  hyper
ccgaagccctctgaccgcccaggatgcgac

SEQ ID NO: 70129 - DNA, 499 bp, Homo sapiens
  chr10:101300095-101300594
  hyper
gggcgcggggggggtcgtgggaaacagggcggcacaaggaccgaaaaccccagctccgcgggcgcgtgtcaccacagagatccggcagagccattgcgggtaaacctgggacaggtggcgcccggcggggtctgcagggctttgatttcggctgcatctgggacattcgacagaaggggaaggtggaaggacgtttcctgggggaggttcgagtcctctctagcccaccactgcagggaggaaagggtaaggagtggaaacccggcccctctccgcggggcttctcccgggcccgcgcgcgccgccggagtgacttggggccgcgcctctgccagggtggggccgggtgggcaggggcttccctggagactcgcgcgggagaccgggaggtccaaggccccagtcgcagccgcccagttcctcgctttctggttcaggacgccagtggggacttcccgggcgcctcctcccaactccaggggcccgagccctggaagga

SEQ ID NO: 70130 - DNA, 30 bp, Homo sapiens
  chr10:101363437-101363467
  hypo
aggcgtgagccaccacgcctggccgagaaa

SEQ ID NO: 70131 - DNA, 23 bp, Homo sapiens
  chr10:101493051-101493074
  hypo
cgagactccgtctcaaaaaaata

SEQ ID NO: 70132 - DNA, 30 bp, Homo sapiens
  chr10:101780649-101780679
  hypo
gcccctgcctgatcccgggccccaagagga

SEQ ID NO: 70133 - DNA, 175 bp, Homo sapiens
  chr10:101874977-101875152
  hyper
ctgcggcgggcgccccggacccggccgggttcggacgacagctgcacggccgcgcctcggcccctgaacttttgcctgcaccggggccgccccgcaccccccgccaacccccagccccggcccggctgccgtcggggcgatgaggtcacccgcccttgcacgatatctgttgatt

SEQ ID NO: 70134 - DNA, 77 bp, Homo sapiens
  chr10:101988087-101988164
  hypo
gttcacagcttttatcggtatatcaaaaaatacatgtcccaggcctggtgccgtggctcacgcctataatctctgca

SEQ ID NO: 70135 - DNA, 16 bp, Homo sapiens
  chr10:101988404-101988420
  hypo
ccgtctcaaaaacaaa

SEQ ID NO: 70136 - DNA, 30 bp, Homo sapiens
  chr10:102282456-102282486
  hypo
ggaatattcttataacggaaataagatcag

SEQ ID NO: 70137 - DNA, 270 bp, Homo sapiens
  chr10:102322032-102322302
  hyper
tgggtggcaagaagacgcctgtggtgtggaagaacctcgcccgcagcccagcacgtgtagaatccagatgtggcttctgctggagccacgtgttccggcctgagcgacgtcgcacgtggcctcctggccgcagagcccatggcgcggggggccactcttctgacgcaagggtctgtggggccgcgcaagagcctggggcccccgaccttccgccgactggccgtgggctggccgcagcccagctcggctctgtctcgagttccttcgctg

SEQ ID NO: 70138 - DNA, 33 bp, Homo sapiens
  chr10:102332594-102332627
  hypo
agatgtgcttttgaacgacgctggcttaagtgc

SEQ ID NO: 70139 - DNA, 64 bp, Homo sapiens
  chr10:102413884-102413948
  hyper
ccttgatgaatgagccgcccggcccggccccgtccgtcaccgtcaccctcgcctcggcccgggc

SEQ ID NO: 70140 - DNA, 528 bp, Homo sapiens
  chr10:102414410-102414938
  hyper
tgcataagattaagccgaggctctcagctgcgcagcgactcccctccggttcccatgttgtcgaggcatgctgggagtacaagttccgagcgcacggccaggtgaacgcgccgccgccgccgtcgccgcgcgactccccaccccccctagccccctcccgcgggtcccgactggcccaccccggcgggactggtgacgccggcgcggcctgcgcctcccggaaacccaggcagatagcccgggtggaagcggcccggccctggggtcaccatcgcccctcaccccggggttcgacggcggccctggacgtccccgggcccccgtcttcctcctgggccttctctctagtccctggcagctgggagcggccctcccgcccctgcactccttcctgtcgcgctgtggttctgccctctggttgtcgctcccctagccctcccctctttctctctgcagtgtttcttggggctgttgtctttctgtctgtcactctgcgtctcggtctctctggagtccttctgcctctgt

SEQ ID NO: 70141 - DNA, 594 bp, Homo sapiens
  chr10:102415092-102415686
  hyper
cgcactgcagcgcggcaccagcagtctatgacaaaaacattatccttctgctgctaaacaatccaataaacctctccacagggagaaagttaacctcttgtctcttcggctgatgccttcccgcccacgtgactgctgccacagtaaattcaaatcattagtctcctcaccccatcaaaaaacttctattagtaatggagacctcgccggagaccttccgcggagagcgctgccttcccaattcccagtggaaaaattctgcgcgaaaaactaattctacttttaataatctgtcatcaggaccagaggcagtcataaattatatgggagcgcgtgcgagagcgcgccacaagagggaaatcagggcgaaaaatcaaagcccaagtttgacaaactttcctgaagataaataataacttacaaacaggattagttgtaaagtcacgctccggcgcgcagccaccgcggcaatcacgtctgccgagggccgccaccgcgaggcacctgtcaccggccgccaccgcttccgagccttcctcctcgtcctcctccttgcctgcctcccctcctcctcttcctcgccctccagccttc

SEQ ID NO: 70142 - DNA, 135 bp, Homo sapiens; identical to SEQ ID NO: 33243
  chr10:102419132-102419267
  hyper

SEQ ID NO: 70143 - DNA, 448 bp, Homo sapiens; identical to SEQ ID NO: 10431
  chr10:102419399-102419847
  hyper

SEQ ID NO: 70144 - DNA, 468 bp, Homo sapiens
  chr10:102430682-102431150
  hyper
tactcctgacaggatcgccgggggcacggctgcgagataaccattagcgcagccgccgataaagcggggaggctgcatttccaaaggctccgcggccattacgggaaagttagtgtgaaacatgttaaattatccccaaagtggagggagcgggggaggcggcgggggagcgggcgcccgagagagccacgagacccgccgcctccgccggggccgggtgactgcgccgtgcccgacacgccgacgtccaccagggggcggccgcgtgcggcccgagcctcggtctgcgggtccggaggatgggctggcggcccgagccttcctcgcacctgcgggcgcggacccacccgaggccgccggctccggctccggctccctgcctggcccctctgcccagcaggagcagcccggcacccccggagagcgatagagaggcgggggcctgggtggggtcgccaagatcagccc

SEQ ID NO: 70145 - DNA, 163 bp, Homo sapiens
  chr10:102440854-102441017
  hyper
gcggagacaattactcggatacgctccggctggccttcccgaggccccaggtcatttcagatctgggccccggtccttgggcagaagctgggccgagaagatctggagccggtgcctcagtttcccggatttccgcgagggaggaccgcggaaatcgccacag

SEQ ID NO: 70146 - DNA, 238 bp, Homo sapiens
  chr10:102470039-102470277
  hyper
gcgcctgatgggaagcgacagctccgccccgcctccctccactcctgccctcccgcggctcctcccgggcgccgcgtcccgcgctcctgctgccagcccagccggcctggggcgccctagccgctggtcctggcccaacaagtagccaccgacccctcccatgtggcctaggacgggaggagcttctgcccggcagttgggggtgacaaggatggggtaaagaggggcgccgggcagg

SEQ ID NO: 70147 - DNA, 107 bp, Homo sapiens
  chr10:102470339-102470446
  hyper
cgtgttgacatagaaatcagactggaaagaaagcaacatgtagaggggcttccccgggtgtgaggtgacaggtgggttttcctgtctttttgcggatctgtgtctcc

SEQ ID NO: 70148 - DNA, 433 bp, Homo sapiens
  chr10:102473283-102473716
  hyper
tagaggcgggaactccggatgagaaagagacgagggggccaggatcccagggctggcagcgacaggaaggatgggaagaggtccgcaggcccgacgggtgcgggccagcctggccgcgcagggggagctgggagctgggtgggcggggtggggcggacgccaccaggcgtggcgcggggaacagagcagaatgaaatgcagatgcaaaacgtgctcataagagtttcctctctctccccatctgccaaagccgagattttaatctttaatccatgagcaatcagcgagcagcggcgaatggcacattacagatgttttactgtcgcgggcgctcgcagctttcgcgctcggcacaggcgcgccgggcgcccccgctccgcccgccccctcttctccccctctggttcttcttcctctcccctccccaggtccc

SEQ ID NO: 70149 - DNA, 250 bp, Homo sapiens; identical to SEQ ID NO: 10436
  chr10:102473759-102474009
  hyper

SEQ ID NO: 70150 - DNA, 148 bp, Homo sapiens
  chr10:102475261-102475409
  hyper
gagagagtgaatggccgcgtcagccgcaaagaggcccagacagatggacgcaggcaggaagacggacaggagagagagagagacaacgtgcgcccgaggctgaagagctgggtcaagaagagattcggcttccgggagcaggggcgtc

SEQ ID NO: 70151 - DNA, 23 bp, Homo sapiens
  chr10:102475555-102475578
  hyper
ggagcgagaggcagcggagccgc

SEQ ID NO: 70152 - DNA, 381 bp, Homo sapiens
  chr10:102475579-102475960
  hyper
tgtgtgtttttattattattatttctgattaaagaggaattcatctcgtatctgcctcctgccaggggccgaggctccgccattggggttaacggtgcggaagaatacaaaaaaatttcattgaggaggattataaaagttactagctggaacattaacagaagagtaacttgtaaaaaatgcaatattacaatattcacaaggacggcagagcgtggtaaagctataaaattcaacattaaaaccttccacagcctagataacctagttaacaaacatgggattggaactacttttctgtggagacaggaatacgcgccggggctggtcacacctcttccgcgggaggggcggggtcggcggccacggcctagccgcgcc

SEQ ID NO: 70153 - DNA, 46 bp, Homo sapiens; identical to SEQ ID NO: 33253
  chr10:102483750-102483796
  hyper

SEQ ID NO: 70154 - DNA, 362 bp, Homo sapiens; identical to SEQ ID NO: 33254
  chr10:102483870-102484232
  hyper

SEQ ID NO: 70155 - DNA, 13 bp, Homo sapiens
  chr10:102484233-102484246
  hyper
ggccgcgggctag

SEQ ID NO: 70156 - DNA, 285 bp, Homo sapiens; identical to SEQ ID NO: 33256
  chr10:102484269-102484554
  hyper

SEQ ID NO: 70157 - DNA, 30 bp, Homo sapiens; identical to SEQ ID NO: 33257
  chr10:102489083-102489113
  hyper

SEQ ID NO: 70158 - DNA, 336 bp, Homo sapiens; identical to SEQ ID NO: 33258
  chr10:102489328-102489664
  hyper

SEQ ID NO: 70159 - DNA, 164 bp, Homo sapiens; identical to SEQ ID NO: 33259
  chr10:102489700-102489864
  hyper

SEQ ID NO: 70160 - DNA, 67 bp, Homo sapiens
  chr10:102490249-102490316
  hyper
tctttctcactttttcgttctcccggcggccaccgtctggcgggcttgggtccggctcccccgccgc

SEQ ID NO: 70161 - DNA, 69 bp, Homo sapiens
  chr10:102490646-102490715
  hyper
ggactcagattagcacgcaaacagtgagatgctcggcttgagtctacgcgcgggcgaagatgcctctgt

SEQ ID NO: 70162 - DNA, 113 bp, Homo sapiens
  chr10:102495028-102495141
  hyper
aagttgggaagtaggcgagaagccaggctgtgggtctggaggggggcgtgtgacagtgaagaagagggggttgggtgagagggtgtgccggcgtctaggctgggctgcggtcc

SEQ ID NO: 70163 - DNA, 484 bp, Homo sapiens
  chr10:102495142-102495626
  hyper
tgggcgcctcaggcagcgagggtggctgcttgcctgcggctggctggggcctcggtgcgtgtgcacgcgtgtgcgcggggcggagaacccgggctcctcggggtgccggagcctctgcgcggccgggagtgagagagcgggcgcgggcggagcacacagccgtggcggcgggcggctcgggttatctgagccgcttggtgttgggtggctgcgcccagatctccgggcggcggcggcggcgaaggcgagacgcgttgtcgggccgcggaggagcgggacagccagacccagccccaggacgcggcggccgcggggagcctagcatggaagagcgcgcgggtccggcaggtaagagcggcagagacccgtccgcgccgcaggcgaggactaggggagagggatgggggcggccatggccggggcgggctcctctcctctttcatccctgtgctcagtacccggcgggcgacgtgaaggctgggga

SEQ ID NO: 70164 - DNA, 27 bp, Homo sapiens
  chr10:102497149-102497176
  hyper
cctgacgggttagggcggccgcttacc

SEQ ID NO: 70165 - DNA, 46 bp, Homo sapiens; identical to SEQ ID NO: 3599
  chr10:102497252-102497298
  hyper

SEQ ID NO: 70166 - DNA, 510 bp, Homo sapiens; identical to SEQ ID NO: 33265
  chr10:102497299-102497809
  hyper

SEQ ID NO: 70167 - DNA, 275 bp, Homo sapiens
  chr10:102498176-102498451
  hyper
ctcccatctcagccccgcctggaacacagctgtctgcctatactaccttcgccaccccctggcactttttacacaccctcacaacactcaagcacactcctacgatcccctcatccagacgctcagcccccaaagagacacatcagaaattctccttaattgattcagaaattgaaaggggcttcctccctccatcagtttcttcaatgtattcgttatccgcgggtctagacctcccagcccgtctagacctagcggagcgaactcctggaacc

SEQ ID NO: 70168 - DNA, 41 bp, Homo sapiens
  chr10:102498723-102498764
  hyper
ccttccccctttccccgagggcctaatccgtcgcgcgcgcg

SEQ ID NO: 70169 - DNA, 340 bp, Homo sapiens
  chr10:102498824-102499164
  hyper
caactctcagcagcagccctagccccgacccgaggccccaagacggcgggccaggaacccctgggacgtcctggctccaggctggacgtaggcggaggtggcaggagtggacaaacccaggcgggtcccacgacgcccctttcctcgggtctctccttgtttcagccagccgctctcgcccctggtcccctctcccctgcgttcgggtcctttgtctccagccacctcgcagcctgtccccgcctcggcggccctgccctttgggcctcccagtctctctggcgggtccccctgccttaccagctcccggctgtggcgcgctctccgcctgctcctcaca

SEQ ID NO: 70170 - DNA, 39 bp, Homo sapiens; identical to SEQ ID NO: 33269
  chr10:102499518-102499557
  hyper

SEQ ID NO: 70171 - DNA, 30 bp, Homo sapiens
  chr10:102500820-102500850
  hyper
aagggctgggcaggtcgcaaagacctcttg

SEQ ID NO: 70172 - DNA, 174 bp, Homo sapiens; identical to SEQ ID NO: 33270
  chr10:102501247-102501421
  hyper

SEQ ID NO: 70173 - DNA, 743 bp, Homo sapiens; identical to SEQ ID NO: 33271
  chr10:102501726-102502469
  hyper

SEQ ID NO: 70174 - DNA, 739 bp, Homo sapiens
  chr10:102503828-102504567
  hyper
ggcatcccaaaaacccgggtacaagacgcccagtagtagtagttaggctgagtcaggcaggtgcatctctccccatggtatctgccgcccaggctccggccagagggaggggagcgcgagtccgccgcgcttccgcggggcgcccggagctgcagacgggggctggaggaatctcggattcgggctgcaagagcgctgcgcaagcttcgccgagccgccctttcgcagacccagggaagcggggggagggagcgaaggagggagagagagttaaaacatcagctgaagtgccaagatgatttatgagacgagggaaaatatttcatgaagatctcccggatattctgtacttaaccagttaggagacaaagggcttcttctgcctggtgcgtgcgagcggaccccagcgagcaagggagctagtgccagagagagctgcggaggctccggcaggagtggggacgtccccgtggttgcgcctcctgcgctcgccccggatccaccgagctagcagcgggcggcgctcagccgcgtccgcagcctcctcttctccccagccggggagagccagcctcgtctcccacatcctctgccgccagcgacctgcagctccgcactgtttccctcccctgtacccccttcccagtcacccgagggttcagaaaccaagtcccccggctctcccgccatccgctgggtcccaccgaggcaggtgggtactcgccggaggtcttcagct

SEQ ID NO: 70175 - DNA, 42 bp, Homo sapiens
  chr10:102504907-102504949
  hyper
agcccggcttcacagcgcagcgcgctccgaggccctctgtcg

SEQ ID NO: 70176 - DNA, 156 bp, Homo sapiens
  chr10:102505693-102505849
  hyper
tggctgcagctgcagcgcgagccatgcgcccccagtgcaccccggcccggcccaccgccccggggccattctgctgaccgcccagccccgagccccgacagtggcaagttgcggctactgcagttgcaagctccggccaacccggaggagccccag

SEQ ID NO: 70177 - DNA, 43 bp, Homo sapiens; identical to SEQ ID NO: 33275
  chr10:102505873-102505916
  hyper

SEQ ID NO: 70178 - DNA, 141 bp, Homo sapiens; identical to SEQ ID NO: 33276
  chr10:102507395-102507536
  hyper

SEQ ID NO: 70179 - DNA, 226 bp, Homo sapiens
  chr10:102507767-102507993
  hyper
ggtggactggtgggtgagacaccgcagcccgagtcggtgctggcggccgtggcgcattccaggcccgactcagcgccgactcgctgcagtcccccagccctggactcccgccgtgtccccttcccatccccaccccttagactggggctgaggggccgggccctgagcccggggaggctgaattattcatctttaatctgcccgcagctgccgccttttcataccg

SEQ ID NO: 70180 - DNA, 10 bp, Homo sapiens
  chr10:102508280-102508290
  hyper
cagtccgggc

SEQ ID NO: 70181 - DNA, 1298 bp, Homo sapiens
  chr10:102508341-102509639
  hyper
cggctacgggttgatcgctctgggtgcaggatttctagactgctgtaggccagggagaatggggcacaggaagcaccctcaggcctggcacccagtggccgcctcggttccgagatcgggagcccgcgctggagccgggttggaaaccccgtgcccttctcttggccgaaagagcaaaagcccgagccgctcggtttcctgggggggctgccgaggtctgaggggtcaaagggactcgagtcgggtttgggtcggctacacagggcgccccgagagttattaactcgccagcgaggcctatgccgtgccacctgggcgagacggtgggccccaaccaggctctgcgaggcgcggcaggcaggcgagcccaagcagccggcattctctgcctgctgcctggagccgctctgcctccctgtctctgagcgcagcagaccccgggcccctgcctcatccgccttccttgctctacttcagatactaaggaggtgaaagagagatacggtccccctacagataaataacattagaaaaacttcccatcaaaaacaaacaacacaggaaagaggtagaaaaattccgattacaatttaatactttttaaagaagaggcagagagcaaaggggggtgtgtgtgtcaggcacttatcccctgtctgtgctaggagctcggataaacagtcagccgagcctcgacgcccccaaatcgtccgcctccaagccccgcacgcgcggacagctcccgggttgcctgcggcgcaggcgggatgctgcttcgcactagtccagtcctctgccaggcccttcctctcctcgctttcttacgccctttccgctggcatgaattcccctttggcattttctcccctctcccctcttttctgtcatctggtttctctccagtcccccctttgctttctaccttgcgtcgcaaggcctgagtcgccctctcgcccagcccccagtcttcagcccagcgtctgtgcttccagtccccactcctccgcgtggtcgtggaggtccaccacctttcttctcaagctcgggaacatgcccttccgccctgcctgcttccttcgcccgtcccgggccgcggaccctgactaatggccggtccctgctgtgtgtggggtgttgtgtttttttcttgtctctccccagcagggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtc

SEQ ID NO: 70182 - DNA, 38 bp, Homo sapiens
  chr10:102585759-102585797
  hyper
gagccgcagagagctcgtggtgtcgaggggggagtcgt

SEQ ID NO: 70183 - DNA, 352 bp, Homo sapiens
  chr10:102586054-102586406
  hyper
acacaggagaaagggcgagggggaaacctggaggcctggcctttctcccgcagagggagggaggtagcttccgacgacggctcccaacccacgggccctccgctcaccgctagcggaccagcgggcagtccacctgcgccgcctccatcccctgccgcgtagcccacgcatccaacctcttgagggaaaggcgggagggcggtgtctcccaaaagagctcccacctcttgtgttggcactgcacattgatgccattcttaggactttctgggagaaaaatgtcccgaaggcctttcttcgccaccgccccccactcccatttccacccattaggggccatgcctcctagaac

SEQ ID NO: 70184 - DNA, 175 bp, Homo sapiens
  chr10:102588252-102588427
  hyper
tcgcctgtcccttgacgccctgcatcctcctccctgactcgcagccccatcggacgctctcccgggaccgccgcaggaccagtttccatagactgcggactggggtcttcctccagcagttacttgatgccccctcccccgacacagactctcaatctgccggtggtaagaaccg

SEQ ID NO: 70185 - DNA, 1207 bp, Homo sapiens
  chr10:102589250-102590457
  hyper
gccctgcatgtctcctcacccgtggatcgtgacgactcgaaataacagaaacaaagtcaataaagtgaaaataaataaaaatccttgaacaaatccgaaaaggcttggagtcctcgcccagatctctctcccctgcgagccctttttatttgagaaggaaaaagagaaaagagaatcgtttaagggaacccggcgcccagccaggctccagtggcccgaacggggcggcgagggcggcgagggcgccgaggtccggcccatcccagtcctgtggggctggccgggcagagaccccggacccaggcccaggcctaacctgctaaatgtccccggacggttctggtctcctcggccactttcagtgcgtcggttcgttttgattctttttcttttgtgcacataagaaataaataataataataaataaagaataaaattttgtatgtcactccccatggctccaagtttgtctctccctgtctctgagatgggcctcccctccattggtcgatccccaaaagccccttcaatgatcctcccaactacactcccgctgccacctccaactcctttgccgagacccccttggcggcagctgaaccacggcgaaggccgagactagcctgccctttagtagccaccctcccccacgcaccccggccctggggacaggaagttcttactctccgaaacttcagaataactcctagttaggcgcctatactaggccaactctgtggtcctaccagtacacccgcacccagatttagggtgctggctctcagaacccgaagtctgaggccttctccacgtgggtggaggggtggtcgtctgtcctatctcctccctccgttccctatccagtgcagttgcgcgtgggcgcagcagcaattttatccccgaagtctgcaatgaaacgcgaagaccgcagacgcttgccgcaagtttcctcgctctgcgtttacttctgggcccgaagaatgccccgcagaggccctaggagctggttcatgggacttcacgcgcctccagtgtcttgcggagccccagccccagcaagcagcggctgaaattggtgcgccttgtgctgtggtctgggtgtgtcccggagagggcgcgcaggcgcctatgtctgtcgcggggcggtcggcgggttcctgcataggtatggctttctgttcatctatgtgttcgtctgtatgtccct

SEQ ID NO: 70186 - DNA, 149 bp, Homo sapiens
  chr10:102890870-102891019
  hyper
ccgagtcttggtctccgtccctctatctctggctcctgcatctgtctcggcttctggccttcctctccccctcccctcccctccctcgcgctgtcattcaccccgctcctctccgcgcacagccaatggagagacccagtcgaaaccgc

SEQ ID NO: 70187 - DNA, 936 bp, Homo sapiens; identical to SEQ ID NO: 33284
  chr10:102891020-102891956
  hyper

SEQ ID NO: 70188 - DNA, 159 bp, Homo sapiens; identical to SEQ ID NO: 33285
  chr10:102892090-102892249
  hyper

SEQ ID NO: 70189 - DNA, 369 bp, Homo sapiens; identical to SEQ ID NO: 915
  chr10:102893583-102893952
  hyper

SEQ ID NO: 70190 - DNA, 1199 bp, Homo sapiens; identical to SEQ ID NO: 33287
  chr10:102894090-102895289
  hyper

SEQ ID NO: 70191 - DNA, 716 bp, Homo sapiens; identical to SEQ ID NO: 33288
  chr10:102899140-102899856
  hyper

SEQ ID NO: 70192 - DNA, 434 bp, Homo sapiens
  chr10:102900262-102900696
  hyper
ggaggctggaggggaggggggctgcgagggtcacagtcaaggccaactactcacaacagaaagctcgaaactctccctctacctcccctgccggaaatgacccgtctctgttcaaaaatagaaaaagaacgatcggaataattgttcgcagaggtgccgggagagaaggggaattaacaaacctgcctgcgcggagaggtctgcttccttctttggcttcagaaccgacggcaatcaccaaattcctgcggccagcgagccctgcccctcagatctggccctctggttgagtgggtggcggcctgaggggccccaggaacccaggcagggatggggtcctagaggccctgtgcagtgcggtgggtggcacacagagaatctggctcaacctgttaactataatagcggctttgtgtggccgcatctgtgcttgg

SEQ ID NO: 70193 - DNA, 119 bp, Homo sapiens
  chr10:102905699-102905818
  hyper
ccacaaggacttgtccgggccgggccgggctagatgccgagatgtaattcaccagatttgtgaaaagacgagaaatctgctctcattttgaagcgcagccccgccggcatccaggaggc

SEQ ID NO: 70194 - DNA, 138 bp, Homo sapiens
  chr10:102906332-102906470
  hyper
accccttgcttttcccgacgggctcccggagtctcatttctagaatgaggtgggagacctcgtgactacgcggaggccgccccagggctccgagggcaccgcacagggcaccaggcccttcccagctcaacccgggcc

SEQ ID NO: 70195 - DNA, 57 bp, Homo sapiens
  chr10:102906524-102906581
  hyper
cgctgggctgaagccgacccggcaccgcgcggcgcccggatccggagctgccagcag

SEQ ID NO: 70196 - DNA, 191 bp, Homo sapiens; identical to SEQ ID NO: 33291
  chr10:102975143-102975334
  hyper

SEQ ID NO: 70197 - DNA, 325 bp, Homo sapiens
  chr10:102975555-102975880
  hyper
tggctgcactgccaccgcgcaggcatggatcctgcctggccgccgtctgggaactcgagatccgaggaggggcaaaagccgccggcgccggggtcaggcctggtggacccgagctccttggtgagacctggacccaccgtcttctccttcaaaagcacagggtggcagcggggaaaggatacgttcccattgaaggggcgatggaaaactggaatcagagactgaaggaggcggggcatgggaccccggaagatgcctcccagacgttccaggcctgcttgcccggctccggaggtcttagcagcatcctcggaggttgccaaac

SEQ ID NO: 70198 - DNA, 255 bp, Homo sapiens
  chr10:102976414-102976669
  hyper
gcaggatggattagccgagcaacgacctagagtctgagaaacgggcaggcacaaacgcttactcagaccaagggacccagaagtcccggacttccacaccagccccgcatccaagcgcgcgcctttgaaaccttcggcctctcctgccagccagagacccgccctgccgttgccatcgggacacgcgggatctttatttatacgctggggtgggtcttttccttcctcgcagaggaggagcgtcctctaaggcaa

SEQ ID NO: 70199 - DNA, 1297 bp, Homo sapiens
  chr10:102976994-102978291
  hyper
caaagccagatgcctcgggcccgcgaaccaaaagccttctttccaggaaatttcacaattaaaaatatttatcgggagcagatttacgtttctgggtttccagtctcggggcgtctgggtaggctattaagagtaattagcatcttttgcgcatgcagatttacttcgctcattgccacataactcatccctaaaagccggcgcaggcgaaagcaggcgccgccggcggagccgctgccacagctaccgccgctgcccgcccgagcccccctcccctcctgcgctgcccgctcccagtctctccggcccgaattgtccgctccaggccccagacgctgaacacggaacgaaaaggcttccatcctggagacctggagacgagtgacgccagagcgacctcgtgcggttggggaaggcccagactaggctctccaggctggggccgcgccgtctggaccccaggcattgcgaccacgcatgtgtgtgcaccaccgagtgggcgcttgtgtgtgtgcacgctcacgtgcgcgcgagtgcacaggagtatggttgctagtgcgcgttcctgagagggcgaaggggcgcgtggaaaacgagctgatcaccatcctccccttccctgcagcccaccggttcccaggacgacgctcaaacgtcagtcctaggccacccacctagggcactgagtttcagagggagactcgggcccctaccttgcctcgaattcccttctacagagccagttccatccagccaaacggcctggagcactcagcgcccagccgggggaactgggaggcccaacacccggctgcagccgagcgcatggctggcctggtaccggtgagaggccgccagagaaagcgcaggcggagccgggggtcactgaacagagactttcagggtcgctggggggcggctggagacgatgaggccacgcgactgaagggattggggggtgaggagtggtggtgggggcggacaaagggacaacgtggcggtggacgaaccagggccagagagggccgctgtggctcccgctcttcgggccgaagcacccaccacgggttcgttattaacgcgctgggaagtccgcaatccgcccaactttcttctctttaatgagcctagaagaggctgccctgaaggggtttgttcattaaagatgtagctggaggaatattgtctcattaattatctggttttaattacactcctaccctttgaatccagagatgggaaaagttgatttggtggcgccgcccccttgagcttaaagggtcggcctggctagggg

SEQ ID NO: 70200 - DNA, 433 bp, Homo sapiens
  chr10:102978742-102979175
  hyper
tccaaggacatggctcggtttccagggtccccagagctgggacgccgccgggaaaccatggtcctggaggggagggagttatttgagggggtgcttgtccctgcctcgtcccttgtcaggccccgcgcggcgctaaagcgggggccgttttccctttaaatcgcggacactttgacaggggacattaaggacccggctgctcaggctgagcagatcataaaaccggacaggcaatttctgctcccgccaaatagccgggcaaactcgttctgcatctttggttttaatgcactaaactggcagctaagcagggagcgagcaaaaggggggtgggaagcccccccccccacatacacgggcgcacacaccggcacaggcgcaaacactccttcacacctttggaccccacaccccgccccggccctccaacacc

SEQ ID NO: 70201 - DNA, 863 bp, Homo sapiens
  chr10:102982194-102983057
  hyper
aagcccaggtgcctccgggttcaggtgactggaaaagccagggcagggtgagtggacttccccggacttggcggctcagagggatggagaggtgggggggggggtccccgcggcgacgggaaggggcggagggtaggcgcgcggccccagctcgtccctttcaggggggactcatgcatcaaacttcaattttccggacgattgaattagtgattttttttctcctgaactaaaatacacttaagtctttgggattaattaccacgttctggtccctcagactggagtattacttatcggagctgcgtctgacaccggcccgacacctcgtaaaatagggaactgcgcctctctgcctcaccccgcgccgctcgccaggccaccaagccgggaaaggcggagcgaggggaagccgaacaagcgggatcggccgtccgcgcgcggaggggttcctagactggagagcagaaactacccgcgtcccgggacttggcaagccccgtcgagccccgggacacaacggggaagggagagacaaagccgagccgcctctcctggccagcccggaaccgaaagtgggtccgtagagagcccagagtcctgggggaacagatgggcaaagggctctaggaggtgatggaactcaggcccgaagggcaggcagcccacaggataccaagccttaacgaactacgccagaagaatgggcgtagggcccacagcccctcacacaacccaggccaagctccctcgtacactcagaccaggagaagaaacagacacgcaatacacaagccccgctcccttggagcctacacttgggcgaacacaccactgctgtttgcagtatcccgagacaggcc

SEQ ID NO: 70202 - DNA, 293 bp, Homo sapiens; identical to SEQ ID NO: 33297
  chr10:102983087-102983380
  hyper

SEQ ID NO: 70203 - DNA, 533 bp, Homo sapiens
  chr10:102983434-102983967
  hyper
cggctgggctccggaagcccacccggaacctgatggaggcagcgaattcctcagagcagaggacactgcggagaggctcgaatccacttcccacattgtgcgggaccgagcgcgcagggcgctctcgcgtggcctccttagctcgggttcagccgaggctctcacgtacacttcgttaccccttccccccgccgcagctctggtccttccttccactggctctcttctctggcctatggaaacaacgaactacttttcgcctttcaaggcccgggtcccaagccacctcctctgtgaagccgccaacaccctggtagctgcctctcagtgttttgcaactggcacggccctgtccctcggtccgcttctactagcgctgggggtgctgcgagtcttgcccactagactaggagctccttgagggcaggaaccgaatctgattcgtttccattttcccagcccccctgcgcggcctggcgcagaaaagacgcgcaataaacatttgctgaattgaattgcgttttctccttatt

SEQ ID NO: 70204 - DNA, 66 bp, Homo sapiens
  chr10:102984305-102984371
  hyper
cccaaagggacccagcggggccaggcccagggccgcgaagcagagagcggccggaggtgccagggc

SEQ ID NO: 70205 - DNA, 29 bp, Homo sapiens
  chr10:102984512-102984541
  hyper
cgaggaggcgcgcgcggggacctaatcca

SEQ ID NO: 70206 - DNA, 1857 bp, Homo sapiens
  chr10:102985096-102986953
  hyper
ctcacatcaattttgcggagaaagagagcccagcggcccggaggcgggaccccactccggtgacagcggctactcgccagcccagcgacaacaaaagcccggagagaaacccgctctgtccaggaaagtgaaagcggcctcagcccccgccccagccggccttggggcgccgcagacccgagagagtccttgcaagatccatacctctgcccccagcggtgtgccggggtgtggaggcagaattggttaatgttgccagaaattcacaccagctcccagacgcttgggcttacagttccaggtgcccacattgaaattcagcctggccttgatgcctttagcctttggcccccgactccccaaggatgaggccctcggggctagaatcgaaacttgggaacccaaggctccaccccgcgtctgactgagtgatacctgcagcgctcccggggctcagccctgttttcggggagtgcagggagaatgcccttgggtctggggtgggatgcaggaaatgcagggcaagaccccctcccaccctttgttcaacacaaattaatgttgtactgtggtgtgcccccacatacacaggcattttctcccagcatttcacggctcgttttttaccccgacctggcgaagcccgcttctctcccgatttagcagctgcctcaggtttatgggcaagaggcgcctcctcctgctgcttccccctcgcccttcactcttaagcctgtcctgaaaatcccccccaaatctccaaggctagggcgaccggcacgaagagcggcaagaagcccagcctgccgctgcttctcggaaacgggcccaccactcagacacggtcgccgccggttctagtaaaatggcaaagactttatttattggagaaagaggccttgggtacagtctagggaggagaggggaagggaggagcagggaaggggcactcgcagcccactcacatccagccaccctcctctggccaagtcgggtaggagtggggtgttcgaagtggcaagagagacccagagctgtggaggaggtgaggtgagggcttgggtcggcctcctctctgtctctgtcacatgcaaaaaaattctaaaaagagtacaaaataattatagggctttgggttctgttttcgatagttggttggttggatttccccctgcattgtccctaagagccggactccaacagtcagtccgaggaaatgcgggagggagggaggaatcttaaaaacagcattagtgggcattaggaggcagaaatggcatcgaaaacagacttttctctcagagggtggggaggaaagatcgattttgaaacttgcaagtcaggacctgactgcccacctcttcccctcccacatgaggaaaaaaggcccgaggaaatagaagtcaactgcaataaggccgagggaggcgaggaaggagcgggccggtgcattcgccacatgcagagaaaaatcaaaacagccggagctgccactcccctagaccgcagggttagtgttccccgccctggtttctgtctcgccctcagcaaacccggcagcccgagagctttgaaaacatcgaaatctccgagatttaaaaaataataataaaagaaaggaaaaatcaggctgcggtgggaagaacccgctatataggtttaaatatttatatagaagccatacagaattgcacggcgagggcttccggggcggcggaggccgctggtggcggccggcccggccggccagcctgggtttattgcttcgagagggaagaggcggctgccaggagccgagtccggggccggggacaggggaggaggcgggagttggcagaggaggtcccagctcccctc

SEQ ID NO: 70207 - DNA, 449 bp, Homo sapiens
  chr10:102987206-102987655
  hyper
gccaccgccggctgtggcctccgagttctgctcgagttcggccagcgccacgatgtccatctgcccgctggggcccagtttcttggcggactctacgtcggccttcatctcctccaggtcccgcttgagcttagcgcgccgattctggaaccaggtgatgacttgcgcgttggtgaggcccagctgctgcgcgatttggtcgcgatcggcgggggacaggtacttctggtatagaaagcgcttttccaattcatagatctggtggttggtgaaggccgtgcgcgactttcgccgcttcttaggggtctgccgctgcccaaagatggtcataccgtcgcggcctgggaggaaaggacagtgtaggctcgcgttgggagagaggaagcccaccctggctctcgcccccgtaactccgtaacccacccaggcctgtccggcctgcagtctac

SEQ ID NO: 70208 - DNA, 418 bp, Homo sapiens
  chr10:102987947-102988365
  hyper
tagccgggctaagagcgcccaggacactgggaacgcaagggagcccggcaaagcaagcagactgcggaaagagcttggccacccttctcctgccaccccccagctctggcctacccagaggtccctgggaaataaggattgggtcccgtcccacatatcttcactcccataagcagctgctcaggctggaaggccctggcggccggagagggcagaggcgagcagaggcataggggacgaagcgcgcagggcacagggcgcgaggcgctgggtgcaggggaacccagcagctgcgcctaccttcggctgcctgcagaacgctgacctccagccccttaaacgtcttgctggcgagctcctccagcgcgcacagcggcgaggtctgcgagagcagcgcgcggcccgccaggggcaagcc

SEQ ID NO: 70209 - DNA, 325 bp, Homo sapiens
  chr10:102988611-102988936
  hyper
cgcggggacccagcccgcgggcagctcgggcgccggacggcgcgggcaggcagcggcgggtggaaaggaggccgcactgggcagggcgcgggccgggcgcggggccgattagcgcggcggctgaggaggggagaacagcgcggggccccgggaagagggcgctgacgcgggcgccgctgctgctggggcttccagcaatccggggccggagccggggcgcgctgcgcggggctccagtttcgccaaccccggtgctatttaaaggtgtcaggtggctcggcagtggctcctggccccgggtcctggcggccgcagttggaagagc

SEQ ID NO: 70210 - DNA, 1125 bp, Homo sapiens; identical to SEQ ID NO: 33305
  chr10:102989172-102990297
  hyper

SEQ ID NO: 70211 - DNA, 462 bp, Homo sapiens; identical to SEQ ID NO: 33306
  chr10:102996019-102996481
  hyper

SEQ ID NO: 70212 - DNA, 231 bp, Homo sapiens
  chr10:102996596-102996827
  hyper
cgccaggctcggatctgtgctcagagccgggatccctccgggctgcttcgtcctggccaggactttccttgccctgaagtgaggcgccagggaagctgcagggccctccgccctctctgaactcccacgtacttgggcctctcccagcctttcttggacctgtggaagcaattcctgcaggaccagactcccctgtctccccgcggccccctaggtacactccgtaacttc

SEQ ID NO: 70213 - DNA, 329 bp, Homo sapiens
  chr10:102996899-102997228
  hyper
cgatcctgagggattgcattcatcccatctcacacccaccaacgctcaatccctccagttcctccccagccccttcacttccattaattaggtcgactcccttccttcgccgctccctcctgtccccactcagcctccctacacctatgcggcgagcctcgggccaagacctccgccctggctccgccagtcctgcgggggccggcatgcaccagacctcaaaagggatcttcacgggaattccgcatagccagatcccaagcctccagggaggccaccagccctcccccatcttcttcttcctcctccgtctcctttcctcttccctc

SEQ ID NO: 70214 - DNA, 303 bp, Homo sapiens; identical to SEQ ID NO: 3619
  chr10:102997281-102997584
  hyper

SEQ ID NO: 70215 - DNA, 624 bp, Homo sapiens
  chr10:102998278-102998902
  hyper
gcctctctctgagatcgggtcctcctcctgcagggcagcagagtggaagccagggcctgggaccctctggctgggcaaggagggactggagtccggctcccggtgaccccgtccccagtgccagcggtggggtcgcctgtggcggcccggacaggccacgggtccctctccccaagtcccattacgttgtatttatgtttcattttatagtttttttttcctcctcccttattattgtctcactctgggggaggcaaaggatataatatattcatctttattataccaaatctgtgtgaagcatttaataaaacgctgtttccacacagccagggatattagtgtgagctatccttaagttaatgctcctggactgagggcgccgctgccacagcgcctgctgccggcgggtcgcgggaagcgtaggccctggccgccgcgctccccgcgcgggtccaacgccctgggtgcccttctcgcctgcgccttgaagcccccacgcccatcctagcgcgtctctctgtgacctctcggccgccagcctgggaggaggggtttggaagagccgaattcaagcacccttcctctcccctgccacaccctgcatttcgaatccgctgtggg

SEQ ID NO: 70216 - DNA, 8 bp, Homo sapiens
  chr10:103043857-103043865
  hyper
gaggggag

SEQ ID NO: 70217 - DNA, 304 bp, Homo sapiens; identical to SEQ ID NO: 924
  chr10:103043924-103044228
  hyper

SEQ ID NO: 70218 - DNA, 114 bp, Homo sapiens
  chr10:103044300-103044414
  hyper
cgtgcctgcctcgcctccagcccggggtaaggagatccacggaggcctctgcgcctaaactcaggtggccagacagagttggggcgggaggcgggtatacggaaaggacaccct

SEQ ID NO: 70219 - DNA, 482 bp, Homo sapiens
  chr10:103051132-103051614
  hyper
agcgcccgcgcagcacgcacagaaggacccttcgcgcaggatgtcccggagactcgtccacgctccctagccgggctgcgaaggcccagatctcccagcgcctccatgccgcgtcggccgcggccttgggggtcttccggggacagtggccagccctgggccggtgacctagcctttgggcgcttccccggggctctagggtcccagggcgccagggccaacaccaggaaagccagaaggttccttcctttggggcaggagttggggggagtcgccgtacgcccaccctgccacgcgggaggcctccgggagagggcagagggcgccgggcagggaccaatcatcggcggcgaccggtcactcgcgccccagcgaggagaccctgagatccgcggggagagcacagggtcgcgccgccccctggcggctcaatgacagagttgaggcccggcggctggcgactgcggcgtctggcagctcca

SEQ ID NO: 70220 - DNA, 129 bp, Homo sapiens
  chr10:103052311-103052440
  hyper
ggaaatcattcagctcggcggcgcgccccagaaccaccccctacccccgctccggcccgcggccgcgcccgcgcccgccgcgcacacgcacgcgcgcacacggaaggcaggcgccgggtatataaatat

SEQ ID NO: 70221 - DNA, 95 bp, Homo sapiens
  chr10:103052659-103052754
  hyper
ggcaggagctgtgaccgcatcactctgcctcccgtttccacggattgacacaggagcctcttgttggctccatccacgctcgcctcccctccccc

SEQ ID NO: 70222 - DNA, 144 bp, Homo sapiens
  chr10:103106119-103106263
  hypo
gaatggataaatgaacgatgactcataattactcgttttattacttaaagtcacctagggcatgaacagagttatatttgagttccaatatacgattaataatattttggacagccttggtttagaacagggtttctcaacttc

SEQ ID NO: 70223 - DNA, 147 bp, Homo sapiens
  chr10:103198991-103199138
  hypo
ggatgtgtgcctgagcgcttcatcctgggctgtaatttcatcttttagctaagaaccacaaggtacacgagcaaagcaccctgtaaacaataatactgtggaaaaaaaataaacaaggtcgtgtttctggtacgttgatccgatggt

SEQ ID NO: 70224 - DNA, 199 bp, Homo sapiens
  chr10:103326517-103326716
  hyper
cgtcggggcccaagacgcccagaccgaggagccgtgaaaccacgcggcccttctcggcggaggaacaaagccctgcgctcagcggccgcagggggctcaccgggcgtctggcctgcctgcggccaggacgtgcagctgtgcacacacatggcctgcacacgcgccaggcgcctatatccttgtacggtgcacccgcagc

SEQ ID NO: 70225 - DNA, 30 bp, Homo sapiens
  chr10:103533282-103533312
  hyper
ttacggcagctctcccgaccgggcttttgg

SEQ ID NO: 70226 - DNA, 15 bp, Homo sapiens
  chr10:103534562-103534577
  hyper
cggctgtagagttgg

SEQ ID NO: 70227 - DNA, 600 bp, Homo sapiens; identical to SEQ ID NO: 33318
  chr10:103534896-103535496
  hyper

SEQ ID NO: 70228 - DNA, 61 bp, Homo sapiens
  chr10:103535710-103535771
  hyper
cgccgcgggaggacgcgctgagcagggcgcgagcggagagggtgcgggtgcgggaggccgg

SEQ ID NO: 70229 - DNA, 75 bp, Homo sapiens
  chr10:103535841-103535916
  hyper
cgccgctgccggagccggtggccgctggctgctcgggagccggagcgggcgggagggtcacgggctggcggggtg

SEQ ID NO: 70230 - DNA, 130 bp, Homo sapiens
  chr10:103536127-103536257
  hyper
cgggaggggcgggggcggccggtctgggcgcctccccctatccccggcctgtcccctcgcgcgctccccggtcccggacgcgcggggatgggggcgcctagggctgcaaactctgcgggccgggagaccc

SEQ ID NO: 70231 - DNA, 219 bp, Homo sapiens
  chr10:103536299-103536518
  hyper
cgggtctgggtctccgcctccgggcccagccgcttccgccgccggctacgcagtggtctccgagccacctactgtgtgtcccgccgggcccctgggagcggccgctaaccatgcagcgaatggctgcgcacccggccctcgcgcagtgcgtgccggtgccacccggaccccgctcccctgtttcggccgcgtgccccgtcctgtcggtctctccagtct

SEQ ID NO: 70232 - DNA, 21 bp, Homo sapiens
  chr10:103548965-103548986
  hypo
gaaaatgaggccaggcgcggt

SEQ ID NO: 70233 - DNA, 30 bp, Homo sapiens
  chr10:1035526-1035556
  hypo
ttcaggtctcaaggacgggatgagcttgcc

SEQ ID NO: 70234 - DNA, 79 bp, Homo sapiens
  chr10:103579758-103579837
  hypo
ctggatattgtggtccgttggggttgagaacacaattttttttttttttttttttttgtaagagaagaggtctcatttt

SEQ ID NO: 70235 - DNA, 90 bp, Homo sapiens
  chr10:103599532-103599622
  hyper
agctggtagagggatcgcgctgcctgccccagcgggctccggcacctgcgggggcatcggttcatggtttggcggcgagctcggcgtcta

SEQ ID NO: 70236 - DNA, 35 bp, Homo sapiens
  chr10:103603249-103603284
  hyper
cacccgtgagctggtcgtaggagccgtccaggtct

SEQ ID NO: 70237 - DNA, 30 bp, Homo sapiens; identical to SEQ ID NO: 42637
  chr10:103814237-103814267
  hypo

SEQ ID NO: 70238 - DNA, 18 bp, Homo sapiens
  chr10:103818196-103818214
  hypo
acacgaagagaaaaccca

SEQ ID NO: 70239 - DNA, 24 bp, Homo sapiens
  chr10:103897018-103897042
  hypo
ccaggagaccgaacccatgagtgt

SEQ ID NO: 70240 - DNA, 139 bp, Homo sapiens
  chr10:103930132-103930271
  hypo
gcaccgcgcccggccgagaagggaggttttctggtctctggtctgtactggttatccatgagaggttacctgatacctgaaagccagtggcaggcaacatggcttgtagaagattaatgttccccgtggaaccccaacc

SEQ ID NO: 70241 - DNA, 213 bp, Homo sapiens
  chr10:103986007-103986220
  hyper
ggggcggagcagaggcgtatcttggtcgagattggatagcggcggggcgcaggaaagaggtcgcgccagcccgggcaggcagctttgcaagtccgcgttatatatcgcagtggctgcgcccgggatagctggctgcgccgccgcgcacatgcctaggttcgacgccctcctccctttgcccaggagttccttctgtcccggctctgttccgtc

SEQ ID NO: 70242 - DNA, 43 bp, Homo sapiens
  chr10:103991502-103991545
  hyper
cctctggggagccgccgggcagcgaagccgaggccttttctga

SEQ ID NO: 70243 - DNA, 191 bp, Homo sapiens
  chr10:104000813-104001004
  hyper
ccctactccctgcctcgcgaagcccctatcctggtttcaagtctccggcttcgttccggatcctctgagtctcccccttccctatcccctggttcttaccctgagtttcccttttcccaagtcctggccccaggtctgcagtccgccctcccattctcgacctgttcccaaggcaccggagttcagctgcc

SEQ ID NO: 70244 - DNA, 587 bp, Homo sapiens
  chr10:104001210-104001797
  hyper
gcctctccgctcgggcgctcctggactctcggagggagtgagcctcaccgcgtactgccacccccagccggcgcccattcactttatggcagaccagggcgcccccagcccgccgcggcgagccgcgcgcgtcaggccccgcccctttccagctgccctgctggggctccgccctttccagctgtggatctccaggccccgcctttgagggaggggtctggccggcgagacgccaagaaccccgccctctggccaatcagaagcgctcttcagcaactcggccgcgcccctccccacgtggcagagaccgcgctccggctaggacgcttaggcagagccaagtgggcgagagtagagtggtcccggtagccacgggtaaaagggatcggctggcagcgaagtgggttgggccgctaccccgaggaaagtggatcggcgccaggtgggaaggcgcacggggccgccgggtctcagcgctcagacttctctgccactcaagtttcgccgattttctccacttgtcgctgtccgtctctcctcccttttgtctctgttccaatcctcccacgtctcgcctttctttcctc

SEQ ID NO: 70245 - DNA, 30 bp, Homo sapiens
  chr10:104086676-104086706
  hypo
ggctttcatctggcacgtagcctgactacc

SEQ ID NO: 70246 - DNA, 83 bp, Homo sapiens
  chr10:104160053-104160136
  hypo
tgatcacggggcagacgagtgtggtgagctttctgctgcgggtaggtgcagacccagctctgctggatcggcatggagactca

SEQ ID NO: 70247 - DNA, 114 bp, Homo sapiens
  chr10:104161655-104161769
  hypo
cctcctgcgcagctacgaggtgggttggcctgtgccctgccccctccccagcctcctttcccgatctgagtccaggtgcctccttggccccagggctcccgagcacatgcccta

SEQ ID NO: 70248 - DNA, 276 bp, Homo sapiens
  chr10:104168609-104168885
  hyper
cgccccgcaacctggcgtgggccgcggccccaacgccctcaccgcctttttcttcttgcggctctgcaggcggctgaccaccaggtcggtgtagagcacgggcttgaggctgcgcgagcgctgcggccagccgtagcacagggtctccgcgccgcggtgggtgcgcccgtagcgcacggagcacagcgagcgcgagcgcagccgcccggcgctgctgtggatgctgttgacgccgatcatgctggcccggccggcgcgccgcggcccccggccatg

SEQ ID NO: 70249 - DNA, 83 bp, Homo sapiens
  chr10:104169160-104169243
  hyper
gcctggggaggccagcgtgggtggcagctccagggaggctgagagcaccgctaggcctggggctgtgacgctgggcggacccg

SEQ ID NO: 70250 - DNA, 226 bp, Homo sapiens
  chr10:104170037-104170263
  hyper
gggccatggagctggcgcctgggaacgggacctgctcacagggagccagaaagcagtttctagctccagctttgcgctaactcgctgccagaccttggaaaagcttagtccctctcaggcccctctccctccgggttcctgcagcgcagcagcaccgggaaggtctttttggctgtccacgcggcgggggagcagtgtggagtgtacccccatccaatccctgtcc

SEQ ID NO: 70251 - DNA, 106 bp, Homo sapiens; identical to SEQ ID NO: 3625
  chr10:104170407-104170513
  hyper

SEQ ID NO: 70252 - DNA, 287 bp, Homo sapiens; identical to SEQ ID NO: 3626
  chr10:104170514-104170801
  hyper

SEQ ID NO: 70253 - DNA, 64 bp, Homo sapiens
  chr10:104416998-104417062
  hypo
cccttcccagcctggcggtcagagactggcttgacgcctcccagcagcccggccaccaggattt

SEQ ID NO: 70254 - DNA, 115 bp, Homo sapiens
  chr10:104629233-104629348
  hyper
ctggctgcgggagcccgccgtcctgagtcgcaggccgaggagacagtgagtgcgcgccctgagtcgcaggccgaggagacagtgagtgcgcgccctgagtcgcaggccgaggaga

SEQ ID NO: 70255 - DNA, 167 bp, Homo sapiens
  chr10:104679009-104679176
  hyper
aggtgatcttcatttcgctgctgctgtgcctgtcgggcatgttcagcggcctcaacctggggctcatggccctggacccgatggagctgcgcatcgtgcagaactgcggcacggagaaggagaagaattacgccaagcgcatcgagccggtgcgcaggcagggcaac

SEQ ID NO: 70256 - DNA, 213 bp, Homo sapiens
  chr10:104758202-104758415
  hypo
gttacagatccttcacgtatatatgcgaacttaaagtaaacaaatctaaggaactagaaaaacacaggcttgtctctgggcaaggtctttaaaattatcaatgtgattataatgaatgaataacatatagcccttcgaagggataaggtaaacaccaagattggaaaggcagacataaaactttattcacaggtgacacgatcttctatatag

SEQ ID NO: 70257 - DNA, 81 bp, Homo sapiens
  chr10:104812055-104812136
  hypo
aaaaaacccaaaccgagtgtgtctgtatttctgtttgcccaggggtagtacttaccattaggaaggcgatttaccatttag

SEQ ID NO: 70258 - DNA, 124 bp, Homo sapiens
  chr10:104823124-104823248
  hypo
aatactttgtgatggcgatttaaaaaacaagaaggtgagcgggagaccaggtggctgctcagcatgtggcgcatggggaagtcccgccttgagccgcatgcactgatcccgggttggcactgtt

SEQ ID NO: 70259 - DNA, 30 bp, Homo sapiens
  chr10:104835453-104835483
  hypo
aagtgctgtcctctgcgtagcctacctttg

SEQ ID NO: 70260 - DNA, 30 bp, Homo sapiens
  chr10:104953416-104953446
  hypo
cccccatggcaccctcgaatccccttgatg

SEQ ID NO: 70261 - DNA, 209 bp, Homo sapiens; identical to SEQ ID NO: 3627
  chr10:105036450-105036659
  hyper

SEQ ID NO: 70262 - DNA, 163 bp, Homo sapiens; identical to SEQ ID NO: 3628
  chr10:105036700-105036863
  hyper

SEQ ID NO: 70263 - DNA, 19 bp, Homo sapiens
  chr10:105036864-105036883
  hyper
ccttaaaagccgggcgcac

SEQ ID NO: 70264 - DNA, 999 bp, Homo sapiens
  chr10:105036893-105037892
  hyper
cgccctgcctgccgcacctctcctttcttctgtagctcgcgttgaagccgcacgtccggccccgatcccggcaccatgagcttcggctcggagcactacctgtgctcctcctcctcctaccgcaaggtgttcggggatggctctcgcctgtccgcccgcctctctggggccggcggcgcgggcggcttccgctcgcagtcgctgtcccgcagcaatgtggcctcctcggccgcctgctcctcggcctcgtcgctcggcctcggcctggcctatcgccggccgccggcgtccgacgggctggacctgagccaggcggcggcgcgcaccaacgagtacaagatcatccgcaccaacgagaaggagcagctgcagggcctcaacgaccgcttcgccgtgttcatcgagaaggtgcatcagctggagacgcagaaccgcgcgttggaggccgagctggccgcgctgcgacagcgccacgctgagccgtcgcgcgtcggcgagctcttccagcgcgagctgcgcgacctgcgcgcgcagctggaggaggccagctcggctcgctcgcaggccctgctggagcgcgacgggctggcggaggaggtgcagcggctgcgggcgcgctgcgaggaggagagccgcggacgcgaaggcgccgagcgcgccctgaaggcgcagcagcgcgacgtggacggcgccacgctggcccgcctggacctggagaagaaggtggagtcgctgctggacgagctggccttcgtacgccaggtgcacgacgaggaggtagccgagctgctggccacgctgcaggcgtcgtcgcaggccgcggccgaggtggacgtgactgtggctaaaccagacctgacctcggctctgagggagatccgcgcccagtatgagtccctggccgctaagaacctgcagtccgcggaagaatggtacaagtccaagtttgccaacctgaacgagcaggcggcgcgcagcaccgaggccatccgggccagc

SEQ ID NO: 70265 - DNA, 111 bp, Homo sapiens
  chr10:105037955-105038066
  hyper
cgcggggccaacgagtccttggagaggcagatcctggagctggaggagcggcacagtgccgaggtagctggctaccaggtaagggccggggctgggcgtggggaggggtgc

SEQ ID NO: 70266 - DNA, 37 bp, Homo sapiens
  chr10:105038717-105038754
  hyper
tcctccttaagaaagcgttcgccggttggcaaaacgt

SEQ ID NO: 70267 - DNA, 171 bp, Homo sapiens
  chr10:105041598-105041769
  hyper
tcagacgagctaagacgatgctcagcgtttgtcttagctcctccaggagagaccccagctggagctgggcgtgccgctctccggttccctcaggctaagccggcagcagctgcgtggttgggggaggggacagactgcagcgctctgctcagatctcgagctggaggccat

SEQ ID NO: 70268 - DNA, 28 bp, Homo sapiens
  chr10:105119651-105119679
  hypo
aaaattgaacacagccgggcgtggtggc

SEQ ID NO: 70269 - DNA, 40 bp, Homo sapiens
  chr10:105127036-105127076
  hypo
taaatgtaatgtaatgcatgcagctcgattaacttttaca

SEQ ID NO: 70270 - DNA, 157 bp, Homo sapiens
  chr10:105155377-105155534
  hypo
aatccttccgtgcctctctccacctgtgagatgggcactttattaaaggtccaaagtgaccagtagctcttgttactttctctgttcctcgatattgctattttcctttctaacttaacacctacctggaatggtgagatcacgaggtaaggaaggc

SEQ ID NO: 70271 - DNA, 332 bp, Homo sapiens
  chr10:105413585-105413917
  hypo
cctccccacacagcccggagggcttgcctcaaggctcacccttctcagggagttctccggctcaccagcttcccgaggccccaccctcccacctcctgctgcccagctcccgcttttcttctgcttggggcacatagatgcatgcctgctttgcagtcgcagccccaccacgccctgtactcctcgctctgcctgtctaatcccttcattctcccagccctgctcaatgcctccaggaagccttctcgactatgcttgtcttcacccctgacacttcagctctgcaccatgcaacagggctactgagggaccatcagcgtggggttgtcatg

SEQ ID NO: 70272 - DNA, 56 bp, Homo sapiens
  chr10:105615662-105615718
  hyper
ccagcgcgcagccagcggcctggcgcagcaccgggctagttcgctaggcacaaaaa

SEQ ID NO: 70273 - DNA, 30 bp, Homo sapiens
  chr10:105632567-105632597
  hypo
agggcatggggagcacgaccttaacgttca

SEQ ID NO: 70274 - DNA, 38 bp, Homo sapiens
  chr10:105725883-105725921
  hypo
tgagaagtgggggcccggcgcggtggctcacgccagta

SEQ ID NO: 70275 - DNA, 30 bp, Homo sapiens; identical to SEQ ID NO: 42647
  chr10:105796706-105796736
  hypo

SEQ ID NO: 70276 - DNA, 30 bp, Homo sapiens
  chr10:105993190-105993220
  hypo
tgagtgggacttaaacgcaggtctagctaa

SEQ ID NO: 70277 - DNA, 44 bp, Homo sapiens
  chr10:106014312-106014356
  hyper
gagcgggtggtgcttcgaggtcagtgtcacgggagggaggtcag

SEQ ID NO: 70278 - DNA, 30 bp, Homo sapiens
  chr10:106030700-106030730
  hypo
ttttcaaagcagatccgatcatatttcagg

SEQ ID NO: 70279 - DNA, 55 bp, Homo sapiens
  chr10:106034596-106034651
  hyper
tggagcctgcggcagcggtggcgagccacagggcggcgaccgtgagctccgggag

SEQ ID NO: 70280 - DNA, 15 bp, Homo sapiens
  chr10:106113431-106113446
  hyper
tgcccaggtgccagc

SEQ ID NO: 70281 - DNA, 30 bp, Homo sapiens
  chr10:106160593-106160623
  hypo
gagatcaagaagcttcgccgggaaaagggg

SEQ ID NO: 70282 - DNA, 80 bp, Homo sapiens
  chr10:106348683-106348763
  hypo
gattctttttgttcccggctcatgtgtgaggtctgggatggatacatctcactgtgggcctaggtcgtggtccaaggcct

SEQ ID NO: 70283 - DNA, 136 bp, Homo sapiens
  chr10:106398552-106398688
  hyper
ctcctgctcagaggccgcgggaagctgcggggactggatggtgcacctccccagtgcgcataggacttgggagaccacactcctccgggctgtgtgagcctcgggtccgcccagatctcttatactgtggcacctc

SEQ ID NO: 70284 - DNA, 157 bp, Homo sapiens
  chr10:106398825-106398982
  hyper
cgcgcccacctgggcctgcggcgctggaacttttcttaggaatacccgctactccctgtctttggaaacccacagatgccaggacccgcaccattctgggccggacgttgtcgctggcttggttctttggcccagcctcccccgctgctaattgcca

SEQ ID NO: 70285 - DNA, 1259 bp, Homo sapiens; identical to SEQ ID NO: 33338
  chr10:106399306-106400565
  hyper

SEQ ID NO: 70286 - DNA, 136 bp, Homo sapiens; identical to SEQ ID NO: 33339
  chr10:106400566-106400702
  hyper

SEQ ID NO: 70287 - DNA, 215 bp, Homo sapiens; identical to SEQ ID NO: 33340
  chr10:106400703-106400918
  hyper

SEQ ID NO: 70288 - DNA, 111 bp, Homo sapiens; identical to SEQ ID NO: 3633
  chr10:106401322-106401433
  hyper

SEQ ID NO: 70289 - DNA, 681 bp, Homo sapiens; identical to SEQ ID NO: 3634
  chr10:106401510-106402191
  hyper

SEQ ID NO: 70290 - DNA, 554 bp, Homo sapiens; identical to SEQ ID NO: 33343
  chr10:106402271-106402825
  hyper

SEQ ID NO: 70291 - DNA, 61 bp, Homo sapiens
  chr10:106440762-106440823
  hyper
taggaccccaccttccgcagagctccgcctcggttcccctctctcccgggaagaggaccag

SEQ ID NO: 70292 - DNA, 182 bp, Homo sapiens
  chr10:10767560-10767742
  hypo
aggctgagagccagacggacttgttttctaatcccatttcttcctcatgggagcttgtcaacttgggccaataataccagctctgtgagcagcattttctaggtgtagtaaatacaggctatgatgatgactctcttggcgacgtgttataatcactaaatgcagaacgatattcgggttgc

SEQ ID NO: 70293 - DNA, 40 bp, Homo sapiens
  chr10:10769445-10769485
  hypo
aaagaaaaacagggccgggcgcggtggctcatgcctgtaa

SEQ ID NO: 70294 - DNA, 30 bp, Homo sapiens; identical to SEQ ID NO: 42513
  chr10:10770967-10770997
  hypo

SEQ ID NO: 70295 - DNA, 21 bp, Homo sapiens
  chr10:108522437-108522458
  hypo
agccaccgtgcccagcctatt

SEQ ID NO: 70296 - DNA, 196 bp, Homo sapiens
  chr10:10854925-10855121
  hypo
ataaaattgtatgatcgatgtaagatagaacagagaagtaccttcccatcggatcccgaatcccacctctgagtgataccatgaatccatctcctatactgcccagtttttctcacagcacagcaattctctttatattgatcctcattttctttcaaggctcttttattcccactccttccgtagagctgatgga

SEQ ID NO: 70297 - DNA, 27 bp, Homo sapiens
  chr10:108561564-108561591
  hypo
ggcgtgagccaccgtgcccagctagta

SEQ ID NO: 70298 - DNA, 143 bp, Homo sapiens; identical to SEQ ID NO: 42649
  chr10:108578381-108578524
  hypo

SEQ ID NO: 70299 - DNA, 36 bp, Homo sapiens
  chr10:10867457-10867493
  hypo
ccaccgcgcccagctggataccgatgttttaagtgt

SEQ ID NO: 70300 - DNA, 20 bp, Homo sapiens
  chr10:108755052-108755072
  hypo
cagagcgagactccatctca

SEQ ID NO: 70301 - DNA, 127 bp, Homo sapiens; identical to SEQ ID NO: 33344
  chr10:108923771-108923898
  hyper

SEQ ID NO: 70302 - DNA, 115 bp, Homo sapiens; identical to SEQ ID NO: 33345
  chr10:108923945-108924060
  hyper

SEQ ID NO: 70303 - DNA, 21 bp, Homo sapiens
  chr10:108924345-108924366
  hyper
cgctggcggctgtggggggcc

SEQ ID NO: 70304 - DNA, 34 bp, Homo sapiens; identical to SEQ ID NO: 33347
  chr10:108924367-108924401
  hyper

SEQ ID NO: 70305 - DNA, 41 bp, Homo sapiens
  chr10:108924769-108924810
  hyper
ggtcgaccccgggctcccggagcagtcgatgtgtcgggagc

SEQ ID NO: 70306 - DNA, 30 bp, Homo sapiens
  chr10:10910269-10910299
  hypo
aaagttggaagttgacgctggctgggagct

SEQ ID NO: 70307 - DNA, 27 bp, Homo sapiens
  chr10:109674181-109674208
  hyper
ttcacactccctccccgcttcgctccc

SEQ ID NO: 70308 - DNA, 118 bp, Homo sapiens
  chr10:109674377-109674495
  hyper
cgcccccagtcttcagggactttgcgctcccgcaggctcctgctcacctctcccatcgttgggcgctggtggcaccccaggaggagagaggagcagcaggagcccggtctcgcagtgc

SEQ ID NO: 70309 - DNA, 1 bp, Homo sapiens
  chr10:109674853-109674854
  hyper
c

SEQ ID NO: 70310 - DNA, 117 bp, Homo sapiens; identical to SEQ ID NO: 33352
  chr10:109674855-109674972
  hyper

SEQ ID NO: 70311 - DNA, 30 bp, Homo sapiens
  chr10:109675175-109675205
  hyper
gattgtgagcgtcagcgtatgtgtgtttag

SEQ ID NO: 70312 - DNA, 22 bp, Homo sapiens
  chr10:110168394-110168416
  hypo
tttgtataaaattaacgggcgg

SEQ ID NO: 70313 - DNA, 22 bp, Homo sapiens
  chr10:110168716-110168738
  hypo
aaattaacgggcaaaagtgcaa

SEQ ID NO: 70314 - DNA, 257 bp, Homo sapiens; identical to SEQ ID NO: 10516
  chr10:110225912-110226169
  hyper

SEQ ID NO: 70315 - DNA, 233 bp, Homo sapiens
  chr10:110408434-110408667
  hypo
gagaggggatattagcgtagaagggaactgatcagaaaaataagaggcagagtagcctcccaggtgtcctctttagtgatcactactccatttggtaagccattcaattctaattaagtaaatataaatacatatacacagaaacaaacaatattggtttaaataatctcttcttatgatcgggtcctttcacctatctgcctaggtctggcccttctcgcttttgctctgaa

SEQ ID NO: 70316 - DNA, 342 bp, Homo sapiens
  chr10:11059322-11059664
  hyper
aaaaggcagtgccatcgtgcagagacaggtttgtcttccttagggcactgcgataagtccctaaatgtcacttgggtcatagatctgatctttattttgcctaaacctcctatatcctttcggtgatcgcccttagttcctgcccgggcaagcacaccacaccgaggagcatcgaagcgaaccctcgggctgctcgcctcccgcggctgggctctgggagcgcggctcgggtatggaagtggagcgggctttggcgcctgggtggccctaaacctactccgagcggccacggcggcctcttgccagggacccccgggcgggggagcagagccaggcggggag

SEQ ID NO: 70317 - DNA, 226 bp, Homo sapiens; identical to SEQ ID NO: 32886
  chr10:11059932-11060158
  hyper

SEQ ID NO: 70318 - DNA, 121 bp, Homo sapiens; identical to SEQ ID NO: 10180
  chr10:11060314-11060435
  hyper

SEQ ID NO: 70319 - DNA, 117 bp, Homo sapiens; identical to SEQ ID NO: 32888
  chr10:11060512-11060629
  hyper

SEQ ID NO: 70320 - DNA, 5 bp, Homo sapiens
  chr10:11060741-11060746
  hyper
ggagc

SEQ ID NO: 70321 - DNA, 237 bp, Homo sapiens
  chr10:110671647-110671884
  hyper
gtgtcttactccttccgtccagggcattccgcagactcctgctcccttcttcctctccacttgctctcaatagagggcgcgctgggcgaagtaggggcgtggcaggagccccgctccgcggatccaggttgaaattcctccctcctggaatccgaccgtgagcatttctgagcggtggtgaggaggaggccaccaagacacctccctcccgctgtgcaaaggaacgcaggagcccgg

SEQ ID NO: 70322 - DNA, 504 bp, Homo sapiens
  chr10:110671929-110672433
  hyper
cgccgctgtctgccaacctttcccagcttttcccacgattggagccaagagaggtccccggggatctcagttgggcaattgtaagggaaggagctcaggacactgacttcaagatgaagggggaggtcagcgaagacagttctagggtgggcggcggccgctgacagagcaggagccacagccaccggggcttggagataggagcaagtcgcaggcggagggggctgcgggctggctgcctgggcagcacaggacttgagggagctgcggggactcctggagtctcatcaggccttccagtcgctgtggggaccccggctgcgcgcggatcgcctgcgccactgtccccactgacccgcccgccgggtttgccaattaccagcgccacctggtcccgcacccaaccccacattttctctgtcaagggcttgtttccagggctccaggaactttcaaaatgttattggtgtgtgtcgggggggtggggggcgggggggttgtgtg

SEQ ID NO: 70323 - DNA, 228 bp, Homo sapiens
  chr10:111216345-111216573
  hyper
agatgtgcagagagtcgcctgtcggagcaaatgtgacgctgattggcttcagctccccagctgcaaatgggtagctttgccggggtttctctcttgagctccaggcactctcaaggatccggttcatgtcttcgccctggcccgcttggtatagggggcgcacaggaagaggccaagaagtggaaagaacctcatctcgatgtcccaagtgacaaagcccccggggct

SEQ ID NO: 70324 - DNA, 194 bp, Homo sapiens
  chr10:111216610-111216804
  hyper
cgcagacgcccggatgcggaggacccagagcgctgcgcagctgaggagcacctggggagccaccgccggcgccaacttttgccatcccgggagccatagcggcagagagggggtcccggacccgaggtggcagcgaggggctctgctttggcagctgtcggggctggagctcaggaccccaactccagccaagt

SEQ ID NO: 70325 - DNA, 74 bp, Homo sapiens; identical to SEQ ID NO: 33358
  chr10:111217161-111217235
  hyper

SEQ ID NO: 70326 - DNA, 30 bp, Homo sapiens
  chr10:111610387-111610417
  hypo
caagggggctgggtgcggtggctcaagctt

SEQ ID NO: 70327 - DNA, 23 bp, Homo sapiens
  chr10:111674541-111674564
  hypo
cgagactccgtctcaaaaaaaaa

SEQ ID NO: 70328 - DNA, 143 bp, Homo sapiens
  chr10:111902760-111902903
  hypo
ggttgtggcaatagccgtttgccactgagtcagaggcctctctgatttgtcttgccacatccacccaaataatgacctctcagttcactcctccaacctgcttccggagagaatggcttccttaggaccgtacctgtagcagc

SEQ ID NO: 70329 - DNA, 30 bp, Homo sapiens
  chr10:111912926-111912956
  hypo
caggtgcatccttgccgaggtgttgtgagg

SEQ ID NO: 70330 - DNA, 30 bp, Homo sapiens
  chr10:111921592-111921622
  hypo
gcctgtgctttgacccggcaattccacttc

SEQ ID NO: 70331 - DNA, 33 bp, Homo sapiens; identical to SEQ ID NO: 42652
  chr10:111946090-111946123
  hypo

SEQ ID NO: 70332 - DNA, 23 bp, Homo sapiens
  chr10:111954352-111954375
  hypo
tgttgtacttttggccgggcgcg

SEQ ID NO: 70333 - DNA, 32 bp, Homo sapiens; identical to SEQ ID NO: 42653
  chr10:111979836-111979868
  hypo

SEQ ID NO: 70334 - DNA, 30 bp, Homo sapiens
  chr10:111988079-111988109
  hypo
gtagcaagctgggaacgcttagaagaggga

SEQ ID NO: 70335 - DNA, 30 bp, Homo sapiens
  chr10:11201306-11201336
  hypo
caaactctgccctgccgaaaggcagtcatg

SEQ ID NO: 70336 - DNA, 18 bp, Homo sapiens
  chr10:112030553-112030571
  hypo
aaaaaaggtgttggccgg

SEQ ID NO: 70337 - DNA, 308 bp, Homo sapiens
  chr10:11207022-11207330
  hyper
ggagagggagagaaatccagcagacatctagctctgcctttctttcccagccacagccagggtagggctgataaggcgctgatgcgttgatggcagccttgcagagctagacctgcacttaacttgcagctgcctcccgagcctccaagatgtccacgccctgggtgacaggcggcagggcgctgccccgtgctcccccggctctgctcgacagcagcacgcagtgagagcctcgccgccgccgaggagcaactcatggtgcctccgctttgttttagttcatcaaatttctacgactcattaggcac

SEQ ID NO: 70338 - DNA, 15 bp, Homo sapiens
  chr10:11207709-11207724
  hyper
cgagcccccagcctg

SEQ ID NO: 70339 - DNA, 39 bp, Homo sapiens
  chr10:112079204-112079243
  hypo
aaaaaaaagaaaaaagccgggggtcggaaagaaaactcc

SEQ ID NO: 70340 - DNA, 15 bp, Homo sapiens
  chr10:112257148-112257163
  hyper
ctataccccacccct

SEQ ID NO: 70341 - DNA, 37 bp, Homo sapiens
  chr10:112257205-112257242
  hyper
cggtagcgacgggaatccgttccggactcctctgggg

SEQ ID NO: 70342 - DNA, 169 bp, Homo sapiens
  chr10:112257809-112257978
  hyper
cgtggacaccctggccgtgggcacccgcggggcgcgcggcgcggggccgctggccggcggcggcggcggcatgaaggtcacgtcgctcgacgggcgccagctgcgcaagatgctccgcaaggaggcggcggcgcgctgcgtggtgctcgactgccggccctatctggcc

SEQ ID NO: 70343 - DNA, 77 bp, Homo sapiens
  chr10:112258331-112258408
  hyper
cctacaccctgggaccgggagagtcaccacctgcaggagtctgcaccctgtggcttgttgtgcgcttgggagggcac

SEQ ID NO: 70344 - DNA, 1047 bp, Homo sapiens
  chr10:112402947-112403994
  hyper
caggcacgcaaggcacgcttttctctacttcccggggacgctggcctcaggacttagaactcctgtatgccggacagccggtaaggtctactgggcggccgctttctctggtctttctctgctccgtagacatttctgtgtcaggtgcctcgcatattcgcacccacgcgccagggcattaagccgaaccttgcttggtggctctcagccttgaaaggccgcaggatgtccgcgtccacagctgtgaaccggtgagtgcaggtggacgggcgcacgcgggcgccagggtaattaacagggcttcagagggcgtgacggtgaccgtacgttgtcggcgaactctcttttcatcctttacatttccacggagatttggccaataaataacaagaataaaatgtacgcatggttttgtctttgcgctcgtggggtcgtggcggggtcttttaagtgaagagaaaaagaaaccagaaacccacggtggccccaccggctgcttccggggacacctgaaatcagcagctggaactgacaatttggagagccccggggatggtcatctgagacctgggttacaatacaagtctgacctcggggcgagtccaggctttcttcccctcagggtcgggtgcctcaagagccagtggcgctggccgggctccagccgcgagcagatgccaggcccggcacactttgcacgggcgatgcgcgcggacgtcccgggcgcgctcggtccgcccggcttggcaggagctgcgagaggccgcgcgcaccgtccccagggacagccggaggactcagggctcccgggtggagcgagagcgcggcggccgaccgcgggctgcgtgtgtcgccttcctcacgcggtatgctgcgccgtggaacgctgggctacggaccctgagggtgcactgtggcgggtggcgtacgccgcgctccctccccgcttcctgcgcccagggtcggcgggcagagttcctgggtccagcttggcgctgagcagcccccggccgcagagcagctcccgccggtcgggagacgccccct

SEQ ID NO: 70345 - DNA, 338 bp, Homo sapiens
  chr10:112404226-112404564
  hyper
agccatgagccaggacgcggaccccagcggtccggagcagccggacagagttgcctgcagtgtgcctggtgcccgggcgtccccggcaccctccggcccgcgagggatgcagcagccgccgccgccgccccagccaccgcccccgccccaagccggcctaccccagatcatccaaaagtaagaagggagaagggaacagggaccacgggtgcgcctggggacacgccccgagagccccctttgtggcttcatttcccgtccctgctgaacttcgctcgccccccttgggtttgaagttttctcgtaccccctctgggcagagtcggtgtccttctggc

SEQ ID NO: 70346 - DNA, 253 bp, Homo sapiens; identical to SEQ ID NO: 33363
  chr10:112431872-112432125
  hyper

SEQ ID NO: 70347 - DNA, 79 bp, Homo sapiens; identical to SEQ ID NO: 33364
  chr10:112432360-112432439
  hyper

SEQ ID NO: 70348 - DNA, 30 bp, Homo sapiens
  chr10:112440386-112440416
  hypo
tgtggtgcgctgtcacgcaatgcgtgtcac

SEQ ID NO: 70349 - DNA, 79 bp, Homo sapiens; identical to SEQ ID NO: 42655
  chr10:112524488-112524567
  hypo

SEQ ID NO: 70350 - DNA, 161 bp, Homo sapiens
  chr10:112553605-112553766
  hypo
aagaaattcaaagtacgatctcaactcgcatttttcaatgtaaagaataatgtttagccccctgcttcctgtggtattattacctttgaagacctttaagggcttataagagagcccgggttgggaattactgcgtagcatggtgacgcttgctcaagagc

SEQ ID NO: 70351 - DNA, 88 bp, Homo sapiens
  chr10:112582575-112582663
  hypo
tgttttttacctgcacggatctgagtttccatggaaaccccgccgtgaaatgccttcttgttgctagagaaaccgtgaggcccaggct

SEQ ID NO: 70352 - DNA, 63 bp, Homo sapiens
  chr10:112590867-112590930
  hypo
gctgttctacacgagcgaggagacagcaaagatgagccactgccgcagcgctgtccactacag

SEQ ID NO: 70353 - DNA, 77 bp, Homo sapiens
  chr10:112836722-112836799
  hyper
ccggctgctcagcaacgcttgcttgatcctggggctataaaacgagtccaccgtgagcgcagcggagcagcagcagc

SEQ ID NO: 70354 - DNA, 32 bp, Homo sapiens
  chr10:112837138-112837170
  hyper
agaggcggcagagtccgcgccccagccccggg

SEQ ID NO: 70355 - DNA, 30 bp, Homo sapiens
  chr10:11343824-11343854
  hypo
gcgggaggtggagtgcgaggcccttgtcca

SEQ ID NO: 70356 - DNA, 30 bp, Homo sapiens; identical to SEQ ID NO: 42515
  chr10:11344374-11344404
  hypo

SEQ ID NO: 70357 - DNA, 30 bp, Homo sapiens
  chr10:11344756-11344786
  hypo
attttcacattgttccgctgtgctgcggac

SEQ ID NO: 70358 - DNA, 155 bp, Homo sapiens
  chr10:11357627-11357782
  hypo
gattagcgtggagcccgtgaagtggtagctgtgccgcggcctcattgttttattccagttagaaccgcctccagctttgacttttccagcagccaagtaggagcctcactgccttgacccccatttccggtacagctcctcgctctgaccttgtc

SEQ ID NO: 70359 - DNA, 83 bp, Homo sapiens; identical to SEQ ID NO: 15387
  chr10:113623006-113623089
  hypo

SEQ ID NO: 70360 - DNA, 30 bp, Homo sapiens
  chr10:11367015-11367045
  hypo
ggcagcttaggagcacgcacctctccagcc

SEQ ID NO: 70361 - DNA, 45 bp, Homo sapiens
  chr10:113748400-113748445
  hypo
aaccgggacatctcacgtggccagagcagacggaaatgagcaaag

SEQ ID NO: 70362 - DNA, 30 bp, Homo sapiens
  chr10:11381701-11381731
  hypo
ggacatagaactaagcgcacatgaacagaa

SEQ ID NO: 70363 - DNA, 30 bp, Homo sapiens
  chr10:11405472-11405502
  hypo
ggttacagatacagccggggctggtggtca

SEQ ID NO: 70364 - DNA, 30 bp, Homo sapiens
  chr10:11429024-11429054
  hypo
gccaacgctcccggccgagaaacaaaacat

SEQ ID NO: 70365 - DNA, 57 bp, Homo sapiens
  chr10:11436196-11436253
  hypo
ttctcgttctagtaacgtcttcccgcctcccatatttcccaccgtaaagagcttaaa

SEQ ID NO: 70366 - DNA, 39 bp, Homo sapiens
  chr10:114571159-114571198
  hypo
aaggtgagtgcagaccgggcgcggtggctcacgcctgta

SEQ ID NO: 70367 - DNA, 39 bp, Homo sapiens
  chr10:114571498-114571537
  hypo
gagaactggctattggagaacactcgtaatgcctgttcc

SEQ ID NO: 70368 - DNA, 346 bp, Homo sapiens
  chr10:114712100-114712446
  hyper
ttttctttggcaacccgcagggccgcgagcgccctgggcgccgtggcgggctccgctgcccggcgcactggctgcgggctctcccgggccgcgcagggcagcagggctgagtggggcggggaggcccctgcggcccggattcttggtttgtgtgcagccggaatggactcctccaagcggacttgtgtatttctagggaattttggcgccttgggatgtatggcggggtcggcgctcgccagcttccgtgtaggcccgtcgtgggccccaggggggccagagaccagggtgtgcgggctcaaggaggtgcgggggccgagggaggctggggcgcctctccttcaag

SEQ ID NO: 70369 - DNA, 151 bp, Homo sapiens; identical to SEQ ID NO: 42517
  chr10:11472842-11472993
  hypo

SEQ ID NO: 70370 - DNA, 43 bp, Homo sapiens
  chr10:114752064-114752107
  hypo
gcatagattccattccgcacgccaccctcgcctccgcccccca

SEQ ID NO: 70371 - DNA, 30 bp, Homo sapiens
  chr10:11480033-11480063
  hypo
tgggccagggatggccgtaccgcgcctggc

SEQ ID NO: 70372 - DNA, 213 bp, Homo sapiens; identical to SEQ ID NO: 42662
  chr10:114829478-114829691
  hypo

SEQ ID NO: 70373 - DNA, 30 bp, Homo sapiens; identical to SEQ ID NO: 42518
  chr10:11486576-11486606
  hypo

SEQ ID NO: 70374 - DNA, 30 bp, Homo sapiens; identical to SEQ ID NO: 42663
  chr10:115479125-115479155
  hypo

SEQ ID NO: 70375 - DNA, 43 bp, Homo sapiens
  chr10:115585285-115585328
  hypo
atagagtttgggggccgggcacacgcctgtaatcccagcactt

SEQ ID NO: 70376 - DNA, 165 bp, Homo sapiens
  chr10:1156723-1156888
  hypo
atcgccaaggacatccgtgagcctccgatgggtgtccagcgtgttagcgcccagacccacagggcctggcaccctgataggtgggaatgttggcccagggccgggcctgaggcctgcaggactgcctgctcatccgggaagtagctctgccggttttacagggtg

SEQ ID NO: 70377 - DNA, 54 bp, Homo sapiens
  chr10:115803627-115803681
  hyper
aacatgctgaagtcccggcggctcttccagcagcggcagcggctccagcagcag

SEQ ID NO: 70378 - DNA, 249 bp, Homo sapiens
  chr10:115804010-115804259
  hyper
ctcgttgctgcctcccgccagcgaaagccccgagccgctgtctcagcagtggacagcgggcatgggtctgctgatggcgctcatcgtgctgctcatcgtggcgggcaatgtgctggtgatcgtggccatcgccaagacgccgcggctgcagacgctcaccaacctcttcatcatgtccctggccagcgccgacctggtcatggggctgctggtggtgccgttcggggccaccatcgtggtgtggggccg

SEQ ID NO: 70379 - DNA, 23 bp, Homo sapiens
  chr10:115804539-115804562
  hyper
gacttcgtcaccaaccgggccta

SEQ ID NO: 70380 - DNA, 652 bp, Homo sapiens
  chr10:115804635-115805287
  hyper
cgcgaggcccagaagcaggtgaagaagatcgacagctgcgagcgccgtttcctcggcggcccagcgcggccgccctcgccctcgccctcgcccgtccccgcgcccgcgccgccgcccggacccccgcgccccgccgccgccgccgccaccgccccgctggccaacgggcgtgcgggtaagcggcggccctcgcgcctcgtggccctgcgcgagcagaaggcgctcaagacgctgggcatcatcatgggcgtcttcacgctctgctggctgcccttcttcctggccaacgtggtgaaggccttccaccgcgagctggtgcccgaccgcctcttcgtcttcttcaactggctgggctacgccaactcggccttcaaccccatcatctactgccgcagccccgacttccgcaaggccttccagggactgctctgctgcgcgcgcagggctgcccgccggcgccacgcgacccacggagaccggccgcgcgcctcgggctgtctggcccggcccggacccccgccatcgcccggggccgcctcggacgacgacgacgacgatgtcgtcggggccacgccgcccgcgcgcctgctggagccctgggccggctgcaacggcggggcggcggcggacagcgactcgagcctggacgagc

SEQ ID NO: 70381 - DNA, 34 bp, Homo sapiens; identical to SEQ ID NO: 15388
  chr10:115844821-115844855
  hypo

SEQ ID NO: 70382 - DNA, 147 bp, Homo sapiens
  chr10:115999036-115999183
  hyper
ggaggctgggtgacccgcgtagaagtgaagtacttttttatttgcagacctgggccgatgccgctttaaaaaacgcgaggggctctatgcacctccctggcggtagttcctccgacctcagccgggtcgggtcgtgccgccctctcc

SEQ ID NO: 70383 - DNA, 44 bp, Homo sapiens
  chr10:116045978-116046022
  hypo
cggcaggcggcagagcgtggcttcgggagcgccaccaggacagg

SEQ ID NO: 70384 - DNA, 162 bp, Homo sapiens
  chr10:116061168-116061330
  hypo
ggctaggcaggccatcgatgtaagtgttgggctctgagaactttctctgcatcagtctggaaacagggcgaggtggcacacatgaagcagccggggcagggtggtgaaagcaccagactccaaggattcccagtgaggagtggttgccgtgaaagtggtggc

SEQ ID NO: 70385 - DNA, 30 bp, Homo sapiens
  chr10:116064482-116064512
  hyper
gcttggccagctcctcgcccttgtggagga

SEQ ID NO: 70386 - DNA, 477 bp, Homo sapiens
  chr10:116163144-116163621
  hyper
gggatcagagccctccgggagtgagattcctgggaatctgagcgttctctttttattactctctcccaggggaaaacaaatatagaagcagcatttcctcccgcaggtttggcggagaccggtccagcaaaagagaaggcaagaggcttttccaaagggaaggggtctgcaggaggatgggggaggggggagcgcccgcagggttcctcttaaggggcaactccctgtactcccttttcaaaagaaccgcaatcgagacttgtagaccagctccgaggctccgagtgtgggtgctaagctgggcgtccggcgcacccgggacggcccgcccaccggggtttggcggagatcctggcccccgccaaacccaaagctcgcccagctgcgcactgagctaagccctcgggtccggacgcctccaggagctccacctgccgggcactccattcggcccccgaccctcgcatccctcctttc

SEQ ID NO: 70387 - DNA, 30 bp, Homo sapiens
  chr10:116163889-116163919
  hyper
ggtggagtggggtgccgggctcaccctctc

SEQ ID NO: 70388 - DNA, 238 bp, Homo sapiens
  chr10:116164126-116164364
  hyper
cctagccctgccctccgcgtcgctgggcgaaagggagtgggtgtgcgccgcgcgaggaacccgcgccctcacctttgtaccgctccatcggggccacggagtgcgctcctcgcggctcggcttctgcgctgctctcccggcgctcggctcagcgcccaggccgccgcgctggcccctccccgtgaggtcacgctcgcggccggacctcctggcggggccgccgcgcccagggtcctcg

SEQ ID NO: 70389 - DNA, 80 bp, Homo sapiens
  chr10:116164574-116164654
  hyper
ctctgggggaggctccgggaggccgggcttgggtgggcctccaagattgttcccacacccctgcccgctgcaaacccaat

SEQ ID NO: 70390 - DNA, 72 bp, Homo sapiens; identical to SEQ ID NO: 42665
  chr10:116331126-116331198
  hypo

SEQ ID NO: 70391 - DNA, 87 bp, Homo sapiens
  chr10:116391726-116391813
  hyper
ctctgggagtggaagcgcgcctcggcagacagatccgcgggcgctggggcagccaggagaagccccggcatccgcttgtgaggtccg

SEQ ID NO: 70392 - DNA, 41 bp, Homo sapiens
  chr10:116392017-116392058
  hyper
ccaccttgtattcctcgcaccgaggacgggctatgaaaagc

SEQ ID NO: 70393 - DNA, 205 bp, Homo sapiens
  chr10:116675455-116675660
  hypo
tctacaatggaaaagcgaaatgcagtatgatcaattacctgcttaatttgatgaatcaacaggccaggtttaaatattactttgaagcccgaaataacggattgggctgttattagcaggttaaagttcctaattctcccttcactgagtactgtttgactagtgcacagtttctcagcagtaacagtaccggtgttttggcctg

SEQ ID NO: 70394 - DNA, 195 bp, Homo sapiens; identical to SEQ ID NO: 33373
  chr10:116852246-116852441
  hyper

SEQ ID NO: 70395 - DNA, 975 bp, Homo sapiens
  chr10:116852647-116853622
  hyper
tttctgctgaagctgcgaagcctgtgtcgatctctcattcgtggggctcccggggcgcggggtgcgggtggggccggggtgcccgcaccggccggggggaagggcacgcgggccacacctggggggcctgtctccagtcagcgcgcgggccaggcggggtgggcgcgcgcgcgtgggggagtccccggtccctgtcaggggcggggcgagaccaaggcgccgggcctgtggggaggagtgtaggcgcgcgcgagggcggggggcggccccacgcatcgtgggctcccggcgctgccgctgcggccggctcgaggcaccggagacagaatggctgccggggcgcccttgaccgccgggcgggcgaggcggggctgaccgccgcctccttgatcgcccccttccacgttgggcgcgcccacttcggggcgcccgctcggcccccgccctcctgggcgcgcggcgctcggagccgaggcagttggcgcgggccgcgggcgaggcggggccgcgcgcggggtcccctcctcctcccggtcaggtcccctcaggagcgccgggcgcagtctgcgcctcccgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccggtgaggaggaggagaagcggcggcggagaggttttctgcggccggaattcccttcaacagcatccctgtcggcgcccgcgagcgcagtctcgccgggcaggggcgccggggaagatggagactgggggccgggcccgcactggtaccccgcagccagcggccccgggggtgtggagggctcggccggcgggcggcggcggcgggggcgcctcctcctggctgctgga

SEQ ID NO: 70396 - DNA, 353 bp, Homo sapiens
  chr10:116853672-116854025
  hyper
cgcaggtgtcccagtccaagccgtgcgagaggaccggctcctgcttctcgggccgctgtgtcaactccacctgcctctgcgacccgggctgggtgggggaccagtgccagcactgccagggcaggttcaagtaagtgccttcgccggaccccgaacctccagccctgcctcgctcccgtcgcggccttccccgcccccctcgcggcctcccccgcccccgtcgctgcctctgatcccccggccgtgagtgaacctcagcgcgcggcgggagcgggcgagagtggggcccgcgccgcgccccctccagccccggggcgccccgggagagctcgggcccgcgcggagccctgacc

SEQ ID NO: 70397 - DNA, 71 bp, Homo sapiens
  chr10:11700944-11701015
  hypo
gatgcatggctttgtcgccaggacctggcttcatcacccgggcagtcatacctgctcgtccagtatttgaa

SEQ ID NO: 70398 - DNA, 36 bp, Homo sapiens
  chr10:117011797-117011833
  hypo
aggtcttatagattctttggtcgtatactctctttc

SEQ ID NO: 70399 - DNA, 30 bp, Homo sapiens
  chr10:117628246-117628276
  hypo
gctcaaaagaggtttcggctccttttaaat

SEQ ID NO: 70400 - DNA, 97 bp, Homo sapiens
  chr10:11784135-11784232
  hyper
caaacgccacattcccggtgttggtgcaaaaagaaatcatcctactcctcccctcgcttaaactttcccacaggccttgtcaaacaacccctggagc

SEQ ID NO: 70401 - DNA, 101 bp, Homo sapiens
  chr10:11784285-11784386
  hyper
cggcgagccgggggcgggcctcgtgggggcggggcggggcgtgccggggcggggaggggcgtgccggggcggggcggggcgtgccggggcggggcgtagta

SEQ ID NO: 70402 - DNA, 108 bp, Homo sapiens
  chr10:118030598-118030706
  hyper
gccgctcacttcggccgacaggagcaagtctgcggggcagaggggagggagcctgagtgcggcgggcggggaccccggccgcccctgctccgggcgagggcgcgcgcc

SEQ ID NO: 70403 - DNA, 247 bp, Homo sapiens
  chr10:118031302-118031549
  hyper
aaaagcttcaggcagcgccgcgccgccaccgcctccctaacccggggattcgcgatcccattccccaaaaagacacttcttccttccacatccaccacacccgcgccccaattttggtgcggagggcggggtgggctgctgcaagcgaccctaggaaagactcagagggtaagaaagcccgcggcgggcctcgacttacccaagagcggcagcgcgaagtacagggtcgccaggaacatggtgccgg

SEQ ID NO: 70404 - DNA, 240 bp, Homo sapiens
  chr10:118031624-118031864
  hyper
cgatccccggacagctgtgctgctctggccgcccaaagttcagctccatccagtgaaagaggaaactccgggtctggcagcagccaccgccgccggcgactcagctccgggatggcgagggcgggaggcggttccgcttttaggggttcaggtccgacccaacctggaagggagggcgcgctttgagatgagagcggagagcgccggagactccccccacagaaccctctcccctccccc

SEQ ID NO: 70405 - DNA, 365 bp, Homo sapiens; identical to SEQ ID NO: 33378
  chr10:118031865-118032230
  hyper

SEQ ID NO: 70406 - DNA, 773 bp, Homo sapiens
  chr10:118032412-118033185
  hyper
cgctcctctcacactctcgcccggtgcccaggactcgggcgcttccgcaccccagcccagggcgagcgcgccggcccgcagtcccggcgtgccccggcaggtgcagcccggcgccacgagcgccccccgggccctaaagttgggagacgccagcaaaaagaaaggggtggccggaggaggggggaagaaggagtggggaagagggacgggaagcggcaatgggttcccaaacagaacgaaaaaaactccaaatgccaccaacctggactcaaccgaccgcgtccagctgcggcgaggagccagtttgtttatttacttatttattctttcagggcaatggtgtccccgccccctccttccctttccgggctcactttatctgcgctaggaaaagaaaaaaaagaaaaaaaaatagatgcggtaatcttcgagagctcgaagggccgagttgggccaggacgatttccgagcagagccctcggctcggatgctcgttagggatgttagtggttattggaagcggcgcggagaatggcgtgttccgaggccagatttcttctggccagaggaccctcggcctgctcctgttcccgccgctccgcagctccagctccctcctaagctcgcccgccaggcagccgcagctgcacacgcccgcttgcggtgggacccgcggccggacccgtactcgcgcacaggacacgcagtgttctgcagccggccgcgggtgctgccagacacacacactctctctctctctctctctctctgtc

SEQ ID NO: 70407 - DNA, 749 bp, Homo sapiens
  chr10:118033245-118033994
  hyper
acaagggctctttcttcttagggcaatcgagccagacccttcttcggaacacaaagttttcccccacgtcactagtggctgtgattcaagacttggtgctttcaagacacactcagacccaggacgctggagcggcgatcctgggatgcgcccatccgttcgtccacgccagcgcgtgcacactcacactcacacgcacacatgcacacgcagtctctacctctctcctggagctccgacaaggagacaaaagcggagcccccagcccactgcatttaaacccggccagacctggctttagaaaatttataagctgacctccattttggctgtttcgagagtaaattaacaacaacaaaaaaagcctaacatgtacacagcccttcgccccaacccctgggaccgctggttcccagtcgtgctgctcaccccccgccccccacgcctgacacacgctccccttcccgcacgccggggggcgcccggggcaccgaagtctacactgggtcgggagaccggtctaggagccagccggcagtgctcgggatctttgctgatgtccaagttcatctctcggggagaccgagtttgaatcaaatctgcgtgcgcccagctgtcaaatctgcaaacctatcacgccagacaatgggccgccgcggaggacagacaagaatggctcattttgatcgaggggggtaaattgaaaagggcacgggctttggttgaagtttgaggcccgggtgtcaggg

SEQ ID NO: 70408 - DNA, 26 bp, Homo sapiens
  chr10:118034142-118034168
  hyper
cgccccaaacccgggggacatcctac

SEQ ID NO: 70409 - DNA, 30 bp, Homo sapiens
  chr10:11825336-11825366
  hypo
taggatgctgagcagcgcccctgacctctc

SEQ ID NO: 70410 - DNA, 56 bp, Homo sapiens
  chr10:118547540-118547596
  hyper
ctcgtgccacctccacgcaacgccgttaaattcagatgctacgctaaaagcagagg

SEQ ID NO: 70411 - DNA, 261 bp, Homo sapiens
  chr10:118608457-118608718
  hyper
ggcccagccagcacacggctcggctcagagcaggtagttaataaacatgagccgaatgaaagaattcctgagatcgccaccgctcagtaaggatgccctgagcccctacatccctcccccaacagagtgggcctgcctggcacgggcggccttagcaacccggaggagctcactaacagcagagagcaagggggcgcgtggggagggcggggtggcccaagacgctgggccactgggacccgagcgcgcgaccccagccgg

SEQ ID NO: 70412 - DNA, 221 bp, Homo sapiens
  chr10:118890913-118891134
  hyper
tgaactgtctgtgggcggctgctgtgatctcagcaaaaagcggagctcaaggctcagggactccgccgcccacactgtgccccgccttattttggatgcctccaacttcagcttcaggcacagtacacgagtaggggcagtaaggcctggctagggccggtgccgcacgggagctgcgggtccctgcaacacccaggtgtgcaggcgctacaagaaggagc

SEQ ID NO: 70413 - DNA, 483 bp, Homo sapiens
  chr10:118891179-118891662
  hyper
cgctttagaagagcgtgtccggaagtgtcctccccggccctcctcgcttcccaagatttgtttgcaacgtctacacccgtcaccaccgcataagcaccagggtgaggaggtctctttgcaggaattaatatcgatttcagtctcctgctccttcaaagtttctctttgacgatggcgagacttatattctaagtcagaagaaaataaaaccttgcctattctgggcccatgattgcacaaaatccaaaatgctgccggcatgaagatgcagctggaagactctagaaacctagcattaggaggcagagactttatagtgcccagagatgagttcctaaataaactaagaattacgcagtgggaaattaaggaggagggtctgaggggccgacctcagagggacagatagagaaatcgagagcgaaacactcaaggaagtggaacaaatcgtcgtagccaggcgtctctgcctctccggaaacc

SEQ ID NO: 70414 - DNA, 59 bp, Homo sapiens; identical to SEQ ID NO: 930
  chr10:118891715-118891774
  hyper

SEQ ID NO: 70415 - DNA, 444 bp, Homo sapiens; identical to SEQ ID NO: 931
  chr10:118892013-118892457
  hyper

SEQ ID NO: 70416 - DNA, 1064 bp, Homo sapiens
  chr10:118892517-118893581
  hyper
cgccggctgcgcaggctaccgccggcagccgctttgctctttcctggaggagtgggaagctgtcggccaccgccccgaacaggctcggagaaaagattctgaatttcctttgattagcggcgttaccttttcctttgcttttcccccattaaattcctgtttaaagttacaacacccagaaccttaattttgcattgccctgtggggcattctgtatcctgaattttcttacaccttccaaatttcatcattggaagtatttaaaaactggttccacttcatctggttttacgtagcaattgcttttattgctgattagatcaaatttatcagtgtcgttgcctactacgacgtttgttactgtttcctggggtcgggggtggttgtgattggagttgccctaaaggggagaaaaaccgcaggatttgcccgccaggaagctgtgttgtgtaccgactatcccgagaggtccgcaaagcggggcccaggggctcccacaagccctggtttccctggcaagaggaaggaacgtcctccttttttggtctaaagaaacctggaagcccctggggtctgcgcgcagttttcctctttcaaatattcctaggaatagtcggcagcggcagcagccgcagcagccgcggatctagagcaaacgtcctgtgctttggagttagaaccagtcttttccctcctgggctgggcacggggtcagggcatcaggttgactaactcgggcatttttcccaattctttggatcgctcctggattcagaaggaagttgggggttggggaggaatctcagaggaaaggtagtagaaaaaaaaaatagcccgaatgagatgaaattggtagcagagtctagtgggaaaggagagctgtcagaggcctggtgggagccaggagcccagcgcaggagctctgggcacctaatgcgcgtgagtccataaatatcaccacaatagatactataaatataaatacagggaaacacttaaaatcagtccagcgcttttttctcggccccttctttattgttggtccgggagtaaggctcgaaggc

SEQ ID NO: 70417 - DNA, 147 bp, Homo sapiens
  chr10:118893679-118893826
  hyper
cgagcagcgagggcaccggcaggctgaagaggctgtggcccgcggccggggcgcctgcgtgcaatccccccggcccggcgggcccgggacctggagcaccgcccacagccggcgggtgcggggatgcagcgcccgctgggcccgggg

SEQ ID NO: 70418 - DNA, 38 bp, Homo sapiens; identical to SEQ ID NO: 33391
  chr10:118894034-118894072
  hyper

SEQ ID NO: 70419 - DNA, 23 bp, Homo sapiens
  chr10:118894477-118894500
  hyper
ggaatttccggtggagggtgtga

SEQ ID NO: 70420 - DNA, 1242 bp, Homo sapiens
  chr10:118896177-118897419
  hyper
aggggagatgtcagccgccagaaccctcccgtccccctccacctccttggcccgagctggatttggggacacagtccccagaagcgtgcagttttggggatggggggcggggtgcggagcgcgaccacaaccaggtagcaaagacactgtgtggagggcaaggggcctaactccataccgctgaccgaaggagggaccacactttgtctttttgtagagtcctccagacaggggagagaaaaaaatccaatcaattccacataggcggacgtttcttccggcctgggggggcctcggctgagccttccgggtcccctgtagcctgagggtacccttgtcgccccgcccgggtcctgcgggccccagctctgggcttgccgaccagaccgtgatccagacgtccccacccccaccctcgagtctccttccctccggagtccgcgcggcggaaggaggagggactgagtcggggccggccgggcccggagatctgctgctggctggggcggcgccgggccggggcccggcctcgcagcctccgccgccggggctaagtgcacgccgcgccatccgagagcggcagagcagagcaccaaagcggcaaccgcggctccgtaaccaagcccagctgcctctcccggcggcagcggtcgggcaccgatcgcggccgtggggtcctcggcccagtgcactaactggcagggccgtagcccgcgatcggcagctgttctccggggctcgcgttcccccttgggtgcgctcagccctccagagcgcgggagtcccctggccggctcccggcaggtcgtccggcccttggagcgcgcacacctcctcccggagttttctgctcctttcccgggtcggaggccgcagcccgatgcccggccgcacccgcgcagcccctcatctccccccgcagcccggtcagcggggcccctccgggcgtggagggccgaggcccctggagagcgcaccggagagtcccaggcgcttgtccccagccggactcggggcggggagggccaacaactttctcccaagtcccagccggcactccttcccaccggcctgtgtcggcggcagcgcgcagctccggccccggagtcgaccccaaagaacgcgcctggcagccctgcccatccctacctcggaccaggatccggcggcagtaatccgggtccgctgcggaattggatttacttttgttacaatcctcagcagcgcccgacgctgagaagg

SEQ ID NO: 70421 - DNA, 369 bp, Homo sapiens
  chr10:118897478-118897847
  hyper
cgactctccttgtgcgcgttcttcgagacccgggcagcctcggcgtccgagtggcatcgaacgtccattttgtctggtttcccgaacataggcaagaacaacaacaaaaacagaaaggaaaaaaaaagcaaaaaaaaaaaaaaggggggggggcggagaaggaaaaaaaaaagaggaaaaaggggacaaaacccccgacaacgcggcccgtacgcccggcccggcgacaggcaaggggcaagaatgaatgtccccgcggggaggcttcggcggccgcgcgcgggtcagcggcgacgggagagtggcgcgctcgccgagaggcggccagtctggtccaggatcctggtggagctgcggcgaggccgcctc

SEQ ID NO: 70422 - DNA, 307 bp, Homo sapiens; identical to SEQ ID NO: 33396
  chr10:118897848-118898155
  hyper

SEQ ID NO: 70423 - DNA, 541 bp, Homo sapiens
  chr10:118898853-118899394
  hyper
tgctccagcccttctcgtcaccttgccggggcagaagccctctccacgccgctctccccattcattcctttatgggaaatgcggagcaaaaggagtgaaagatggcaattatctaattggactattaacaaacagtcctctgagtgcggcggtctggcgtggctcctgggcgggggaagggccgtgttccctgccctcattcacaaagagtgcaggggccggggaggaaaggggttttttaaagggggtgggtggggggagaggagaggtgggaggtttggctgagaatttttccacacaattccaagaatggggcggaggcggggggaggggagggggttggggagggggtcgcggcgagcgggtgggaggaaggccgggagggggaggggtgcgagtgtgtgtggcgggcccctaggggctccagctcgcagcgacgcgcgcaccgtccgcacctcccgccccgccgccacctcccctgcctccgccgccaccccgcgggacccctctaccgtcccaagccaggagggggccccctgag

SEQ ID NO: 70424 - DNA, 21 bp, Homo sapiens
  chr10:118899582-118899603
  hyper
cgggctgatcgcccctcagcc

SEQ ID NO: 70425 - DNA, 353 bp, Homo sapiens; identical to SEQ ID NO: 935
  chr10:118899892-118900245
  hyper

SEQ ID NO: 70426 - DNA, 193 bp, Homo sapiens
  chr10:118900323-118900516
  hyper
cgcccggtcaaagacctggaagaaagctttttaaaaaataaaaatggcccaacccattacattttcttttaggtagatgggggagctggggggcggggcgggggcagtcagggaacaaacagctgcccttagaaatgacacgccctgtgggcaatggcggcgctgggacgtctgcagccgcattcactgccac

SEQ ID NO: 70427 - DNA, 674 bp, Homo sapiens
  chr10:118922143-118922817
  hyper
atttttgaaagctttcgggcctctctgagaaagccgttccaaatccaccccgtatcaatttgccttctagaagcggcaggataagcacacgggtttgggcagtgctcacattttgggtttattggcttgatggggttgtttggggcgctctcagttacaaactgcagaagagtgggggcgggggacaggatggggaggaaagggtgggcgaaggagccgagagtaagacaagccgaagggtggaaactgcgggagggagaggaaacgccgaaggcgatgtagagtcctgcgagggaccgggagaggtagggagggatccgagccgcagtcctgagggagagcgaccgcgcgccccgcagccgagctgggtcccttcgccccgcccggaatcccggcccccgcccgccccacgcaagtccccgtgccccctccgggaggtgggagtcgccgggactctgcgctccgccagcctccgtctgctggccgggtccgggatccgcacccggagaggctgaaccgaggctgaaccgaggcggacgcagccccgggtcggtggctcgcctggccgggtggggtgggagcgattttctggcggtggcgtttgcaggaggggaggagacagcgccacccagggcctccccgagcactgccggccaggccgggctcgggggccg

SEQ ID NO: 70428 - DNA, 544 bp, Homo sapiens
  chr10:118923031-118923575
  hyper
cgcctcaacttcctgcgccgacggctggggacgcggagaaccctctccgagctggggtccccgcctgctgggcaacctcacctcaacgtctggcctggcctggggccgcttggactcggcagcggctgcactcctacagagcccagacgcgccttctcgctttttcctttctgggccggggccctaaactcccggaactcgccgcaagaggagcgttgaaaacaaaagggacagcccaagctgtcccgcccgctgcgcccgaggagcatccccttggcgctgcaggctgtcgcctcccccagcacctggcggggcgggtgccaggctgggcctctagacggtttcaccgctgcttatcatttctccttcattttgcaggggcaggggagctgcccctcccttcggagaaaggccgcgcctgcacccaaaggtaaccctcgggtgaccccgggagcggggctgtctggccttggtgcgagaccccgggcggggggtcagaggtttctgttgcatcagagaaacacggcagcgtcaaaaagaaaaa

SEQ ID NO: 70429 - DNA, 1704 bp, Homo sapiens
  chr10:118924354-118926058
  hyper
gatgaaattagacagcgacaaaatcattaccttgacttcccacaataaagacaaccttaaaagggggctattgatggtttcaaattacataacggtggtttatatgttcttcctctgcgctcacagaaagcaattttaaagtgtgaattcttcaaagaacgggcaaagcattcacacacagacatgcgtttttattttatgtattgcaaagcgctatgagagagagagagagaaaccaaaaacaaaaatcccagcaaaaggaggccgagtccaaagagaatatgtccggtttctatttcaccaagctcctggactcacatttggccccggagccgagtgctcggtctctttccccgggacgggacagggagtggagttcctagccccttgggtgggaaaagccccgcgcacgtcaccgggtcccgtctgctcactgcttctgcatattttaagcctggacacagcctcctttaggatagaaaggcatttcccaaacaacaccgattctgggggtgtagtgggcctggcgctgggtcctggagagaaggttcagccccccttctcatccctgtactttggggatggctcgtacttggacaggggtgggcctccgccttctccgccttctatcggacctttcttcggatggatttctacgtaaactcggaaggcgatcaaatgcaggcggccaacctccagcgcttttttttttcctctcaaaggcggcgcctgcatttttgggggctccagcccaggctgagaaagtcccctcaaacctctactctgaggttgctcacacggcctgcaaaaacccgacggggcaccccgccaccccaccttacgtttccctagggccaagtcagtggtcaaaaaccaacccggtggtagctgcctttaccaaggaaagacagccaggacgcccgcaccgacggcaacgcgcggacagagaggaccgtgccctctttcgcatgttacggggcgagggggctgttggcgtcaggagcgccctgggaggaacttcgtagcggattcgagagacagagggaattcagcaaacttgctgccccgggctgccggctggagcccggcagattcgctgcgcagcactgccccctggtatccagcgccgaaagtgcccccctccgcagctgcaaggctcctccctgggctgcgcgggacagattttttctcctttcctggctacacgcctaacagagaagctatcccgagggacctcaagaagtccccccaagccgtactcaaaagcctttctccctcctcctcaagcgctcacttccccaaagaggacccggacccctgactgcctgagccaggtccccagcatggtccgcaacccttctcgactccggcatccacctccaggctgacgtctacccgggagggggctggggacccaaggagacttcgactacaggcccaggcgaacggaaggaagaggcttgcgttcagagagacacgtttggagctgggactgttcattctttaaggaacaccagcttccagggcatctttcgttggcaccttggctttccagagaagaaaggaagtgggtatcagggccagcccctcctcgcaccccaggctggagaggtgccgaggtgcttagtcactcagtccaagggcacctgagagatgggggcaaacttggcaggagcttgagcacggaggcgtgatccgcggggg

SEQ ID NO: 70430 - DNA, 588 bp, Homo sapiens
  chr10:118927006-118927594
  hyper
agagagccaagctctcgcccttcggtttccattcacgctaccctctctgagccgcaattctctctcctgcgttggcactggcagaagttgagacacgctcccaggaatcgcgggccgtggcgcgtacttccacgcaccccagctagttccagagactcagcttgttctgagatcctcttgtcgagcccccttggtcccggcgcccggcctgtgtggtgctcagatcagacttatccacccgagcaccacgcagaccagcgcctggaccaaggtcccgggaaggaagccctcctccccttctcctgtggcttagctcagcgatcagggaggagccagttaagaagtcacagtcgaagccatgactgctgtgtcccggggaggcagtggaaggcgaggagcacggagcggggataccgccggacaacccctccccgccgccccgtcggcgtcctcgctgcgcaggggctcccttgctgccccaatctaaaaggaagccgtcgcggcccagggcacggtaactaaaaggccgtcggggagggagacgggaatgagtgggcttggacttgaggtttccgagccagctgctcc

SEQ ID NO: 70431 - DNA, 74 bp, Homo sapiens
  chr10:118927889-118927963
  hyper
cccggcgcctctagccgctccacccgcacccccagttcgcgctgcggcggccagcctcttccccgacggccgac

SEQ ID NO: 70432 - DNA, 40 bp, Homo sapiens; identical to SEQ ID NO: 33405
  chr10:118927999-118928039
  hyper

SEQ ID NO: 70433 - DNA, 181 bp, Homo sapiens
  chr10:118928343-118928524
  hyper
gcgccgcaaccttctcggcagtcacacctgtgtccccgatgccatctgcccacgtctgtgtgtgaagcaaaccccgctggcagacgggatggagagagatggctcctccaaaccagaattaggaggaaaaccccgctgagggcgtttcaaaaacccaacaggcgagcggggaaacctgcat

SEQ ID NO: 70434 - DNA, 172 bp, Homo sapiens
  chr10:119000420-119000592
  hyper
ggtccccaaggcactcggccacgcgctgggtccggggaagaggcgcggccgcggccgaggcggggacagggaggcggcagcccctcctgcgcagcgacggcgcgggcgggcggaggccggggcgccccagccccccgcccccgctccctccggccgtgacgtcagagccgga

SEQ ID NO: 70435 - DNA, 466 bp, Homo sapiens; identical to SEQ ID NO: 33408
  chr10:119000689-119001155
  hyper

SEQ ID NO: 70436 - DNA, 215 bp, Homo sapiens
  chr10:119001328-119001543
  hyper
cgtgcggacagggcacccctgccccggcaccccagccccagcgccccttccccggcactccacttacccctgcgcggtcccggagctccgccaaggcccgggaaagttggagaactcgctttgcaaaaaagacatcccctccaggctgccgcgccggggctaggaggagccgcgttgtgtggcttcgctttcctgatgctcgggtcaaaaactgt

SEQ ID NO: 70437 - DNA, 30 bp, Homo sapiens
  chr10:119016775-119016805
  hypo
ggtgcccttatgtaccgctgaaccccgccc

SEQ ID NO: 70438 - DNA, 31 bp, Homo sapiens
  chr10:119136226-119136257
  hypo
tgaaaaccttcaagccggccgggcgtggtgg

SEQ ID NO: 70439 - DNA, 20 bp, Homo sapiens
  chr10:119292323-119292343
  hyper
cgcatcgggcacccaggctg

SEQ ID NO: 70440 - DNA, 617 bp, Homo sapiens
  chr10:119294281-119294898
  hyper
ggtgggaggacacttcgggcccagcgtagaggaggcctccgaggcccaagcgggcttcggctgctgcgagtccccagaggctccctcgggcctcactcgcggtgtctcctccagacgccaggggcaggccacgaagccgagggctccgcgtggccgtgggagaagcggggtgcacggagccttcccgcgcccagacgccgaggggatgcaaacaggggagccgggcctggtatggccaacctccaggatcgaggggccccagaatgtgcgtgtggccgggggcgggggcagctgcgggggccagaactagagtattccttcgctctcccctgggggccgggcccccacgagttgcagcagagcccgtctgtaattagggcctcctggtccggcaaagctgcggctgctcccagagagagttggggtcttctcagggcccgcgatgggggagtggtcgtggtcagacccccgtgagccccttcggaaggtcccagtccctgtccattcttctgtcccgcagctctctccgcgcaggcggggcagagccggggaagaagacgctggacgaggggtcttggggccgcctcgctggctgcggttggaagcacccgttttcc

SEQ ID NO: 70441 - DNA, 508 bp, Homo sapiens
  chr10:119294908-119295416
  hyper
cgcaggcgctgctctgtggccaccagcagaggtttcccggccgctgtgagtcgcccacgcgagcgacgtggggatacggggcgcacggagtctcagctgccgccacgcagcgcttgccctgcccgagcttcggctcactggcagcggcgaggccaccgaccaccctccgccttccagtcctaaactcggggctggagaccgcaggagctaaaccaggaagaagaaagagggcagggcctgaggccgggaagagcggcccgggggtcaacggtgagcgggtgcatacgaggcaagagccagagtgacattaagtggggccgcccgggcaaaccttgcgcgtgcaccccggcccacctgcagggcattctcccctgccttttctccttggcttgagtgcgggcggctgactcctgtgggcggggaggagagggtggtcttcccagggctccaagtggagtgatcactgcacccatggccaggaggtgggggtgcgcggagtgatttttgt

SEQ ID NO: 70442 - DNA, 15 bp, Homo sapiens
  chr10:119296629-119296644
  hyper
ggagccaggctgccc

SEQ ID NO: 70443 - DNA, 933 bp, Homo sapiens; identical to SEQ ID NO: 33412
  chr10:119296755-119297688
  hyper

SEQ ID NO: 70444 - DNA, 505 bp, Homo sapiens; identical to SEQ ID NO: 33413
  chr10:119300923-119301428
  hyper

SEQ ID NO: 70445 - DNA, 81 bp, Homo sapiens
  chr10:119301759-119301840
  hyper
cggcgccggccagggactctgcagggaccggggtgccccggagggagtggtgctggtggaggaggaggcggtggctgaggg

SEQ ID NO: 70446 - DNA, 77 bp, Homo sapiens
  chr10:119301900-119301977
  hyper
ggagaagaagaaactggaggaagaggaggaggcgaaggaggaggagaagccgcagcgggcgccgcaggagcgagtga

SEQ ID NO: 70447 - DNA, 1028 bp, Homo sapiens
  chr10:119302693-119303721
  hyper
cctcgccgcgggcagcgggcggcggaggcagcgtgcggcggtcgccaggagctgggagcccagggcgcccgctcctcggcgcagcatgttccagccggcgcccaagcgctgcttcaccatcgagtcgctggtggccaaggacagtcccctgcccgcctcgcgctccgaggaccccatccgtcccgcggcactcagctacgctaactccagccccataaatccgttcctcaacggcttccactcggccgccgccgccgccgccggtaggggcgtctactccaacccggacttggtgttcgccgaggcggtctcgcacccgcccaaccccgccgtgccagtgcacccggtgccgccgccgcacgccctggccgcccaccccctaccctcctcgcactcgccacaccccctattcgcctcgcagcagcgggatccgtccaccttctacccctggctcatccaccgctaccgatatctgggtcatcgcttccaaggtacgtgccacgtcgcggaactgcagcgcgccgctcccgccgcatccttcactgcccccggcctgctccgggtgggcgcttggcaaggcctgggcggaggttcctccggctcgcgggccagcgcgccctgttgggaaactaggcggcgcggggccgggcgtggtgtcgatccccagtctccgaagctacgactggtttggagtgatggcctgcgggccgcttgaccctttgggaaggggtgcgaacggagaagttgtcccccagtgcgctcgaatcagagcaggctgggctgtgcgtgcccggcgccgcggagcccagagcccgcgggatccccaggctcctggtaccctcggcaatgcccccaaccgtcctggctccgaggggcgcggacaggactcggccgccaggcttgctttcgactgcgttcgaccctgttcaccacccactttgcgccccttcagtccagacccgcggcttcttagtcttccaccctcttctggaggcgagaggatcctcgcgccccgggagaaaagtatg

SEQ ID NO: 70448 - DNA, 529 bp, Homo sapiens
  chr10:119303950-119304479
  hyper
tgttttcatttcttgcgatattttttatttgtttgtttttctctgggtacggggtgggaggaggagagttaaaacttcagaaaaaggagtaattagtttacggattggagtcagtaaaagacctacctccggcggcagccgatcaatactccgcggcttgtccattcattaacccattgcgttcctgccggagcctagaatcgggtagatgtcacccccctccccatattttaaaaaatcaaaccaaaggaaaaaaaacccaaaaagccttttacccttaatcccgaactggatttgcctgcatcctgcctggactgtcggcttgtttttctttgtttgggttttcggtgaatcgatttcctatgctaatgagtgaacccaaaactctgaggctttgcttgaaaagtttagggctgcccttcctcattcgctatcagtcatgcttatggtcccctcaccagacccggagccgctgggatcttcctgcgttacagactgtcctggcggtgtctgcaagtcggtaaccccc

SEQ ID NO: 70449 - DNA, 328 bp, Homo sapiens
  chr10:119304501-119304829
  hyper
cgtttctcttctagttctcgggagccgggagccccggagcccagttcgcgagaggcagcagcggctgtagccaagcacacccgccggccagatttctgtcccgatcgggcttcaacgactcgccccgcctctatacttttccggaggggcaataaaacaaataatttaaaaataaatctccatgaaaactctggagagcagcccgccgcctttccaccgtgggtcaaagttccccgagaggttagaaagaagagaaagtagtttcttcgggttgtgggcgccaatcccctggccaggctctgcggctccctcccctgcctccagcgcc

SEQ ID NO: 70450 - DNA, 136 bp, Homo sapiens; identical to SEQ ID NO: 33422
  chr10:119304850-119304986
  hyper

SEQ ID NO: 70451 - DNA, 223 bp, Homo sapiens
  chr10:119305061-119305284
  hyper
gggccagcccggctcgggagaagtgcgcggctccggtcagagcagccccccctaatgggatttctgctgtgctccccgcagggaacgacactagccccgagagtttccttttgcacaacgcgctggcccgaaagcccaagcggatccgaaccgccttctccccgtcccagcttctaaggctggaacacgcctttgagaagaatcactacgtggtgggcgccga

SEQ ID NO: 70452 - DNA, 71 bp, Homo sapiens
  chr10:119306116-119306187
  hyper
ccgaggagggcctggcgggtttgtgcggagcccggcacaaggcgcggcccggctgatttctcctggacagc

SEQ ID NO: 70453 - DNA, 99 bp, Homo sapiens
  chr10:119306273-119306372
  hyper
cgccttgggccagcgccggggagaaatgaaccgtcctccccctcaattagcaaactcaaagcaaattaaattcagccttgttcccgctcagcttttttc

SEQ ID NO: 70454 - DNA, 52 bp, Homo sapiens
  chr10:119307022-119307074
  hyper
caggcaaaccctgatcgcctacccagggcccccgccacgaagaggagacgct

SEQ ID NO: 70455 - DNA, 68 bp, Homo sapiens
  chr10:119307830-119307898
  hyper
aacaaaccgcatacacgttcaccgagaaagggagagggaatcggagggagcagcggaatgcggcgaag

SEQ ID NO: 70456 - DNA, 30 bp, Homo sapiens
  chr10:119310948-119310978
  hyper
caacgccccccttcccggcccaaagaagga

SEQ ID NO: 70457 - DNA, 293 bp, Homo sapiens
  chr10:119311443-119311736
  hyper
gtgggtcagattctgcgctccttctgggacacggagaactgtatgcacgttgccattgggtcctgcctgggacccctaatggggatgtaggatacaagtttgatccatgttccgtttccttgttaattacttgtggaccttccctgtgggaccccttggccaagcgcatgttcgggagaggcacgggttctccgtttgcgctgccctgagagggtcaaacggaatctaccaagcgcgtgtgccgcggctacgttctcctgcgaagtacacatgggttccgtgtgcgtttctcg

SEQ ID NO: 70458 - DNA, 30 bp, Homo sapiens
  chr10:119311979-119312009
  hyper
cggctttggaaacctcggctcctccccgtc

SEQ ID NO: 70459 - DNA, 1163 bp, Homo sapiens
  chr10:119312341-119313504
  hyper
ctagctgtccttgtgcgtctagattgttttgagttagggccagcacgtgcagttgtgaggctgcagagtgcctatgacggtgtggaaatgcagtttattgaatgtgtgtgccgcggtctggttgcactgtgtatctgcgaattcgtctggagttgcacatctcagaagatgggggtggcctcggtgtgtgtggcttgcggggacgtttctcggtgtttggatgggggtccctgtgatggatgtccatgcccagccctagggcaacatctgtgtgtcttgggatcgaggcgtgtgtgtctagtgaggaggcttgggctggggtgtcgttccagcagcgccccactaactccggagtttggcaaacaacagccgttttgtgtaactgcgcatttttctagaccagtctttattattccagcaatcagcgctggaattactggggcgccgcctagaagcaaccgccggcggggcggcagaggatgccggcctccagcgtcgggggaccgcgcccgaaagccgggctgctttgtggggcctctcgcgcctcgcccgcagcttccggcccgcgccctccgctcgaccgccgattttctcgccccagccagccccgtagccagaggaaagtgggagttttgagaaccctctgaccccagccgtgacccctctccgggaggtggcttctcccgcaggacccggtgcgccagaaaactctaggcggcgccacgcttggaagcgcaaggtccattcatcagccgcgccccagcgtctaattggccttttgtttattagtgtctgttgcccggctgggagtctccggagggccccggagctgcgagtcggggtgccagaagcggacggcgggccagcgcccagagctggggtccgggtagggcagaggcgcgtcgcactcctctgagggggcgccagagcgcgccaaagatcacgcccacgtgcggagatgcgcgcatggaggctggactccaagtgctggagcctggtcctcccggctgctaacgccccaggcttcgcccctgcccccacctccacctgcagaccgagccctccccatctctccacaccctcaggatttcagacccgccttcctgcctctcctaagtacccatcccaggcgctggccttgtggctcggttccgctcacgtcc

SEQ ID NO: 70460 - DNA, 15 bp, Homo sapiens
  chr10:119313528-119313543
  hyper
cgagttcattagtcg

SEQ ID NO: 70461 - DNA, 114 bp, Homo sapiens
  chr10:119469814-119469928
  hypo
tacagatgaggaagccgaggctcagagacgtttcatggtttgcctgagactgcacagaccagtagagggcagagtgagggtttaagccccaatctatcgcgctccacagccagg

SEQ ID NO: 70462 - DNA, 42 bp, Homo sapiens; identical to SEQ ID NO: 33430
  chr10:119494127-119494169
  hyper

SEQ ID NO: 70463 - DNA, 223 bp, Homo sapiens
  chr10:119494374-119494597
  hyper
taggaagcctagggtcgccgatgttccaggatggaatgttctggtgtcaccgtgcgggggggtggggggtgtcacagagctgggaactcgctcagagccagggtctctgctggggtcagcgtctgtacgctaaagccagggcgcaaagtgcgtgggcactgcggacactagaggcttatggcgctggaaatacaaggccgagttgccggcgcaaagagttccc

SEQ ID NO: 70464 - DNA, 208 bp, Homo sapiens; identical to SEQ ID NO: 33432
  chr10:119494848-119495056
  hyper

SEQ ID NO: 70465 - DNA, 30 bp, Homo sapiens
  chr10:119777112-119777142
  hypo
taaaggttctgatgacgcattcctcaggcc

SEQ ID NO: 70466 - DNA, 181 bp, Homo sapiens
  chr10:119806950-119807131
  hypo
cagaagacctggttccggccgcgcctctgccgctatcagtgtgtgtgaccttggccgagtcatttcacctccatgagcctcagtgttttcacgagtaaaaaagccagttctacctcatgtctaagactccatcacgactctatgggctcgacgtcaaaaggacccccgtggggactcacac

SEQ ID NO: 70467 - DNA, 38 bp, Homo sapiens
  chr10:120127513-120127551
  hypo
ttacaggcgtgagccaccgcgcccggccccttgactct

SEQ ID NO: 70468 - DNA, 523 bp, Homo sapiens
  chr10:120353807-120354330
  hyper
gcaccagcccaaaggcgtaagggtcgatggcgtgggggtcgaggtcccgcagcaggttgaagacgtgcagcggcagccagcagacggcgaacaccaccacgatcaccaccagcaagcagaaggtgcgccggcgccgagcgcggtcccagtcggcctggctctgggtcacgcagcccggcaccacgcggttgcggagcttcactgacacccggacgtaagacaggaggatgaccagcagagggagcaggtaggtgaccagcagcagcccccaggcgtagagctggcgctggcgctcctgggagccccagaactcctcgcagaggcgcacgtcgtgcggcttgagctccacgtgataggtgtgcacggcggcgggcagcgccagcaccgcggacagcgcccagatggccagcacagcgtaggcgctgaggcgcagcgagatgcgccgcctcagcgggtgcaccagcacgacgtagcggtccactgcgatggtggtgagcgtgaacaccgacacatagacggtgac

SEQ ID NO: 70469 - DNA, 147 bp, Homo sapiens
  chr10:120354368-120354515
  hyper
cgaacacccagccgcgtggctcgaaggcataggccagcgtgagcggcacgcaggcggtgcacatgagcacgtcggacaaggccaggttgccgatgaggaagttcgtcacgttgtgcagccggcgcacccgcgcgatcaccagcacca

SEQ ID NO: 70470 - DNA, 166 bp, Homo sapiens; identical to SEQ ID NO: 33434
  chr10:120355260-120355426
  hyper

SEQ ID NO: 70471 - DNA, 177 bp, Homo sapiens
  chr10:120355461-120355638
  hyper
cgtcaggctatcgggaggagccggtgcagtcttaggagggaaggagcggggaaggaagtagcggtgggagattgcaatgcagctgggggcttgagagaggcacgactgacccgttcttaaaggctggatcctgcctagcggccaggttgcggagggcagagacgctagagggctcgg

SEQ ID NO: 70472 - DNA, 45 bp, Homo sapiens
  chr10:120355967-120356012
  hyper
tggaggcagctgagccgggggcctgggggtcggagactcatgact

SEQ ID NO: 70473 - DNA, 126 bp, Homo sapiens
  chr10:120668218-120668344
  hypo
ccaggagagggactgcgcaggcaagtggcagatggacgggagctggcgtttcagggtgcagagcacacaatctggagccagccatttgagtcctgtccaggctgtctgggccgctaaccaagacga

SEQ ID NO: 70474 - DNA, 30 bp, Homo sapiens
  chr10:1206813-1206843
  hypo
cggccatgttagctgcgaggacaatgcttc

SEQ ID NO: 70475 - DNA, 420 bp, Homo sapiens
  chr10:120766813-120767233
  hypo
atgtataaatgcatggcaaaaagcctggaattcctcacaaccacgccatgcagtagtattgttatccatttaagcttttgtgaggttaagtaacttgaacatatggcatagtaaatatggctattatatccagaccatatggaactggattatgataacaatcgctgagatttatatagcaaactttttttttaagaactgaagaatactcactaaacccattcattttactgtgtgcctggcactactcttgcctctggagataaagtgatgaaaaagtacaagtgaagtctctgccttcgtgacactaacactccagggtcacctccggggaggtaatgatagagagtgggagtcaaggagataaaggaaaatattatccttgtctataatgtttgaattattattattatttttttt

SEQ ID NO: 70476 - DNA, 42 bp, Homo sapiens; identical to SEQ ID NO: 42669
  chr10:120791236-120791278
  hypo

SEQ ID NO: 70477 - DNA, 120 bp, Homo sapiens
  chr10:120841443-120841563
  hypo
agccaccgcgcccagcccagaaggaaaatttagaaggcagcagtgaaatagattattgtcaatgtattacacatttaatagacgagatatgtgaattaatgaatgaggaaatcggccggg

SEQ ID NO: 70478 - DNA, 30 bp, Homo sapiens
  chr10:120863286-120863316
  hypo
aattgaggcaggctgcggagactcaaggag

SEQ ID NO: 70479 - DNA, 52 bp, Homo sapiens; identical to SEQ ID NO: 42435
  chr10:1209169-1209221
  hypo

SEQ ID NO: 70480 - DNA, 30 bp, Homo sapiens; identical to SEQ ID NO: 42670
  chr10:120922882-120922912
  hypo

SEQ ID NO: 70481 - DNA, 30 bp, Homo sapiens
  chr10:121228977-121229007
  hypo
ctatggagatgggcacgctgacctggttgc

SEQ ID NO: 70482 - DNA, 178 bp, Homo sapiens
  chr10:121249843-121250021
  hypo
gtccagctggctgcccgtcgatcacgactcgaacgcggggtaacatcgtgtgcatgtgtgtgcgggggactggggggacagtgaaagagtcccaggcaaggatccaggagtcagacccggccgggatctgctacccttccctgcgcaccttaggcagaccacacgacctatccctggt

SEQ ID NO: 70483 - DNA, 43 bp, Homo sapiens; identical to SEQ ID NO: 42672
  chr10:121256846-121256889
  hypo

SEQ ID NO: 70484 - DNA, 417 bp, Homo sapiens
  chr10:121301494-121301911
  hyper
gctggcccaaagtgacggccaaggcgaatccttcgtaacgtcagaacttcgctggctcggaccgcagaagtgcccttctccatcctggggttccgccaccctcgcgatcccaccttttggctcctcgcggcagaagcgaaggcccccgacgccccaggcccaggggcccagtcggatgcccgggtccagccgtgctcccccgggcgctcggcatccttccacccacgcccgcagcggaggcggagagcgtcacggagggagaagcccgcgcgccgttccgctttcggaatctggagccccatgtcacctccaaagtttggagatttggggcgctcctttttctcccagaccatcactaaaaagaaaactgcggctgttcctctttcagccaaacttcctccccggggctcccggagg

SEQ ID NO: 70485 - DNA, 165 bp, Homo sapiens
  chr10:121307203-121307368
  hypo
gcagaaagtttaatacgcaggagtaagagaaaggagaacagttctctctctagggagagagaggggcttccgaaaggaaagaccaacagtggtggggttcactggattttataggcagacttgagaaggcggtgaatgatttacatagggcccacagattggtta

SEQ ID NO: 70486 - DNA, 148 bp, Homo sapiens
  chr10:121354399-121354547
  hypo
gctgggattacaggcgtgagccactgcgcccggcctgaaggacaaatttcaagtgtgtcccaattctttcttctagggagagaaggcagaaatggaagacaacacaaaacacaaagacgttctattaagcaggcgtttcattgaagca

SEQ ID NO: 70487 - DNA, 30 bp, Homo sapiens; identical to SEQ ID NO: 42519
  chr10:12139715-12139745
  hypo

SEQ ID NO: 70488 - DNA, 30 bp, Homo sapiens; identical to SEQ ID NO: 42674
  chr10:121398024-121398054
  hypo

SEQ ID NO: 70489 - DNA, 27 bp, Homo sapiens
  chr10:121718497-121718524
  hypo
gggtgcggtggctcacgcctgtaatcc

SEQ ID NO: 70490 - DNA, 196 bp, Homo sapiens
  chr10:1218175-1218371
  hypo
gaagttttgctgtgacgagggtgcgtcttcaggaagaggcttctgcagcatcatcctcagcttctcataaggcgacattggtcacgctattcttggttattccataaaatcttggcatcttgtgatgtgttggttgtttttttatatgtatgactaagcctagcatgccaggcccccgggacgctgatttacaggc

SEQ ID NO: 70491 - DNA, 645 bp, Homo sapiens
  chr10:122216112-122216757
  hyper
ctcctgagagcaaagcgaagcccgcgagtgatctctggggaacttcctagaaaaaagaaagaatttcaggttcgaacggtgtagggagggccgaacacgggagcaaggttggccagggctgccctgagccctggagaatccccagagcgatcgtccactacatgcccacgtgcgtgcgtgtgccagggagcgagagcccggacagcgggagtcggaggcaggaccaggagctgcagaggggccgcgggcagagccccagcgagcgcgctgccctggcgcggagcccaggggccgcccactggcgggggaggcggggagcgcgcagggaggcggcggcggcggtggggcttccccgggcttcccctccccggtccgcgggtgcccggcgcgggcccaggaggcggaggcggctcctggggagagggatccgggagtccctgaggcggccccggctccgcactaggaggcggggtccgcagtatcgccagcggccggcgcggcttcccggagccccggagcccgaggcgcgaggtttaggctgagccctccccggcgcctgcccccgcccggcgcccgcctccgcccccgcccgcggcctggagcgcgcctccctcgcctcccagggtctggcgagccggcgccggc

SEQ ID NO: 70492 - DNA, 597 bp, Homo sapiens
  chr10:122216793-122217390
  hyper
cgcgggagctgctccggccgcaccatgcgggagctggccattgagatcggggtgcgagccctgctcttcggagtcttcgtgtaagtagtggcgcaccgcgggcagggcgcactgacgcgggggaacaaccgaccaagcctctctgtgccctaacttagtttgcgcagccgcttcccactggggcctgggttcgaggtcccttccccgccaagtgcccgcaacgtgtcctacgggaccaagagagacccttcctctctccttcctgggaccctaggcgcggagcgaccaccgcgcgccgaggctgagacctgctcccgggtctcaccgggcccgcgcctgtcgccagccccgcaccacctgcccgggggatccagggctgcacctctaaacagggacgcgcaccctggcccgtgccctcgggaagtttctccttctgtgtgatctttgaggcccacgttggaagtctttacccctggccccgtctccgattcctccccgctgtgcccagggccagactccttccgtgtccctggctttagcgcccgcggtcctggcgagcgttttcccagcgggcgtttgcggcgcttctcctactga

SEQ ID NO: 70493 - DNA, 30 bp, Homo sapiens
  chr10:122222277-122222307
  hypo
ggggctccttccatccgctgcctttgggaa

SEQ ID NO: 70494 - DNA, 92 bp, Homo sapiens
  chr10:122319368-122319460
  hypo
gtacgtggcatcattcgcagtcaataaacttgaagctgcagtattaaatcacagctgcgtaagattaactgtagaatgcgctgcacttctgt

SEQ ID NO: 70495 - DNA, 31 bp, Homo sapiens
  chr10:122319520-122319551
  hypo
ctaaaacaccgtgtggcgctgatcaccttca

SEQ ID NO: 70496 - DNA, 120 bp, Homo sapiens
  chr10:122379107-122379227
  hypo
acaagaagttgctgaagaagtcaacgttgacccttctatggtcatttggcatttgaaacaaattgcaaagatgaaaaggttccataagtgagtgcctcatgagctgagcaaaaatttaaa

SEQ ID NO: 70497 - DNA, 30 bp, Homo sapiens; identical to SEQ ID NO: 42676
  chr10:122394238-122394268
  hypo

SEQ ID NO: 70498 - DNA, 120 bp, Homo sapiens; identical to SEQ ID NO: 15393
  chr10:122492432-122492552
  hypo

SEQ ID NO: 70499 - DNA, 265 bp, Homo sapiens
  chr10:122708495-122708760
  hyper
atgatcctaaagggacgcagtggtcccgcccatcgccgcctctacagggagggagccgcggccccgagctggccacgcgatggcgctgtgcacccggccgcggagcccctgcacgtccggctcccgctcgcgctctcggctcgagctccggactccaggctcggagcaggggttcgggctacggttcccggctccgagggaccgcggggctctctgcctgggaaggaagcttgcgggcctcctcgggcctcgctgcagcccagct

SEQ ID NO: 70500 - DNA, 437 bp, Homo sapiens
  chr10:122738879-122739316
  hyper
actggttacatagaccgggcttctcaaactactgcgcacacaagtcgcctagggaccgaattaacgtgcagccctgatgcagccgcctgagacccgcctttgcagcagcctgccaggaggtgcggatgctgccggcgcctggaccgcgcgttgagcagtgcaggtgaacagctcgcctaacgcacaagccacgcccacaccctttctacacgctttctcgttcacttctcattgcaactccttccgccgcgtggacaggttcagcactctcggagtcgatgtcattattcgccatcgacgcgaacctcggcaaagagacgggtcttaccggtctccgaatgttctcaggccctaagcgcgcagccccgcacccgggtgcagccggcgcggtcccacgtgtccctaccgcgagccgctccccgcgtccctgctgccgc

SEQ ID NO: 70501 - DNA, 150 bp, Homo sapiens
  chr10:1233090-1233240
  hypo
ccttcaagtgattcacggtggcagctgccaccccgagagccgggagggacaatctggcccgttggccgctgtggctgtcctactaggcaggggccgcctgggcaggaggagccagccaccaaggccagggatgaccgggcactgggagag

SEQ ID NO: 70502 - DNA, 35 bp, Homo sapiens
  chr10:12331252-12331287
  hypo
atcttagactgtgggcgccccgccccaggggcaac

SEQ ID NO: 70503 - DNA, 152 bp, Homo sapiens
  chr10:123356838-123356990
  hyper
cgaactagaaaaagtcggtccagttcgccccctagccccaggcgcactgcgctccctccagcgccgacggcggctgcgggcgaggggcgcccaggcaccggagccgtcgcctccccagcagtgccacccctggccatcgccacccctacggg

SEQ ID NO: 70504 - DNA, 46 bp, Homo sapiens
  chr10:123357614-123357660
  hyper
gcctcccgggcttcacgcgtaccccaggctgcggaggagcgcgggc

SEQ ID NO: 70505 - DNA, 63 bp, Homo sapiens
  chr10:123358268-123358331
  hyper
tgagcgactgcgttacgttgttttatgtcaagttagaaaacaaatgaccgaaggctctaaccc

SEQ ID NO: 70506 - DNA, 30 bp, Homo sapiens
  chr10:1233724-1233754
  hypo
cgagggaggcgctggcgggtgggctgcggg

SEQ ID NO: 70507 - DNA, 143 bp, Homo sapiens
  chr10:123820809-123820952
  hypo
aaaaaaaaaaaaggagggagaaaagaatcgaggaagattcctgaagctttggcttgagtgactgggcaggtgggaccatatgctgagatgtgaaaagcactaaggtcaggtgtgtctgccgagttccacggccacagacctgg

SEQ ID NO: 70508 - DNA, 34 bp, Homo sapiens; identical to SEQ ID NO: 33445
  chr10:123873006-123873040
  hyper

SEQ ID NO: 70509 - DNA, 79 bp, Homo sapiens
  chr10:123922604-123922683
  hyper
gggagagccaggtgccgcagctctccctggtacagacttcagctgcctccaggacccggggcctgaaggaggcagaagc

SEQ ID NO: 70510 - DNA, 75 bp, Homo sapiens
  chr10:123923517-123923592
  hyper
cgcccgggccgccccgagtctcccggggaggaggagaggatgcccgggctttgttagtgtcgcctttcctaatgc

SEQ ID NO: 70511 - DNA, 30 bp, Homo sapiens
  chr10:12398063-12398093
  hypo
gattttgcagtgagccgagattgcaccact

SEQ ID NO: 70512 - DNA, 377 bp, Homo sapiens
  chr10:124133936-124134313
  hyper
tgacatcagagaacccggagttctacctccgagccaagcccagtggtggtcaaaaactacgaataccaggaagcaccgcggcgcggcggcccagagctccgcgcgcaggcctccccggcgcgccgaggccgccgccgctggaaccaggaagacgccagaaactcggcccgccacgccgcagggacccgcgcggggcctgccgggactcgtagtctctgcgggctgggagcgcccgctccggaatctcagccgccgtctgagggctgaggcagcgtggggacgcgtgcgcagtgcgcgggctggccgtcgcggacgccgctccgggcagccgagcctctgtgggagccggggccgcggcggcgcgggtgctccgggcc

SEQ ID NO: 70513 - DNA, 100 bp, Homo sapiens
  chr10:124220556-124220656
  hyper
ccgcggtcagggtcccgcgtgcggggtaccgggggcagaaccagcgcgtgaccggggtccgcggtgccgcaacgccccgggtctgcgcagaggcccctgc

SEQ ID NO: 70514 - DNA, 148 bp, Homo sapiens
  chr10:124220901-124221049
  hyper
cgccgtgcccgggcgcgcccgccctgccccctccgcgggcggtcccggtccagccgcccgccctccctcccgccatccggccagcccccatcccgggcgccgtgcccgtccccaaggcggctcgtcaccgctgcgaggccaatgggct

SEQ ID NO: 70515 - DNA, 206 bp, Homo sapiens; identical to SEQ ID NO: 33449
  chr10:124221715-124221921
  hyper

SEQ ID NO: 70516 - DNA, 30 bp, Homo sapiens
  chr10:12436198-12436228
  hypo
aagagttgcatggggcgaggtgtagggtgg

SEQ ID NO: 70517 - DNA, 135 bp, Homo sapiens
  chr10:1245923-1246058
  hypo
tgtgccggtaggaggcgggcagctggccgacaccctccatgcggtggctcatgacgcgtgcgaggtggcccgtgtggtgcaggctgcccaccacgatgctctgcaggtacacgggctccacgaagtgggacagga

SEQ ID NO: 70518 - DNA, 394 bp, Homo sapiens
  chr10:124639132-124639526
  hyper
gagggcctgccagtgcgcatgctccgctctttagcgcttcctgagcaaagtttgaacgcctctcgagtccagttggcttatgcgcatgcgtttctctggtgcaggttctcaccaaatccagaagcggcgggcatttgaaatgatgtaagccgggagtcgctctgcctgcccgtttctgcgctgcactggccgacacttaagcactggaagagaggcctggcaggaggcggcgcagtggacacgcggtccgaggacgggggcctcacccgccgccccacgcttgcctcttcctgggatgccgcaggcggggccctaactcacagcctcctcacccgggctcgtgtctgcgcccgcgacttcgactgggaggagcttctggcgccacctgcgccac

SEQ ID NO: 70519 - DNA, 30 bp, Homo sapiens
  chr10:12464455-12464485
  hypo
tgagaacaggtcttacgaggggatgcgatg

SEQ ID NO: 70520 - DNA, 30 bp, Homo sapiens
  chr10:124714138-124714168
  hyper
tctttcccaaggggacgccagggccttttc

SEQ ID NO: 70521 - DNA, 119 bp, Homo sapiens
  chr10:12481458-12481577
  hypo
gttattgtttgcctgcgttttagggcttggctgtgataacagctgtgggatttgctctcaccagtcctcctccctgctgtaggtagtgttgtcaatgtgcacatcggtgaagggtcccg

SEQ ID NO: 70522 - DNA, 30 bp, Homo sapiens; identical to SEQ ID NO: 42437
  chr10:1248527-1248557
  hypo

SEQ ID NO: 70523 - DNA, 147 bp, Homo sapiens
  chr10:124892251-124892398
  hyper
tttcctgagcacaagcgtttcgtccgctgatcggccggcggcgctgagtcctgggaagacgaatgaggcaggcccgttccctccttccctccccgagtccttcctggagaacacctagcctgaggttaggaccggcacctaaaggat

SEQ ID NO: 70524 - DNA, 275 bp, Homo sapiens
  chr10:124892918-124893193
  hyper
acaagcacataacagcgcccctgcgcgcccctgggaggggagtcaaccggagaacttggggcgacaaccggaaagccgggatccggtagccgcacagcagggatgcgggcggctgtcccggactcttctcccgccacactgggcctgtcccctccccatctgagtctagcgctggagttgtgatcagccacgagtccccctccccagactgaaccctcagcattcccagtttaaagtcgactttcgtgcgtcagaactctagccaagtttgcatg

SEQ ID NO: 70525 - DNA, 1370 bp, Homo sapiens
  chr10:124893237-124894607
  hyper
cgccggggtctctccacgcatactcggccgcgtggcaggctgtgtgcaggcggtgcccacccaaccctcatagacctacgtgcatcgagctatttctgcggttgggggaaaatgacctctgggtatccagcagcgattgggcgacctaggcccagtttcctcctctctgggcgcgggtttccacttacaaaatccaagtatgagacccaccctgctggggtctcagggcagtgatccgttccaacccagattttggatggcgtagcgttttgcattccagtaaagccctgtgtaaactcaagggagtaataacagtaattgtttatggaagcgccatttacgtttccagatttccaaagcaaaaatggggttcgctgctgtagatgaatgcagaaagaaacattacatatgcccgtcgagatttggtgggggagggtctgacgccccaggaccgaaaaacaaaatctacctctcaagtggggaccccacacgatcacgtctgccaatgcagggcggccttgaattaggcgaggctcaatctaacgaaaaagaaagcggtggggaggtgaagggatcccaaaaagccctcgtgtgcgggagcttcaccagggtggaagagggtgaggccagtttgtcacctttctctgataagaaagctgtctctcgggaggggacctcacaaacaattctgatttacttgatgcttaaatcatgagtcttaaatgtctgcctcatgggcttctcgtgcgaaccggggagctgtttttaaagccagtggagtggaatgtcctttcactaagccgttctgcaaaggtccagtgtggttctctaaggacttcgctgccgtcgagacgcgcagcggatgccgctgcttgccgcggcggaggaagctacgccgctgcgccttcggttcaccttgcccccattaaagcgttagttagacagctccaaacgccagctggccggagagacttcctgggagaaagtgctgtcgtcggggtcacagactcggagttgatccgcgagccttgggcaccggcggccagagcagaggggtgcccttccgagagcagccgtcggtgccgagaagctgttgccccagcagccccaccgagtgacgcgcgggttttggccgggtcagcgcgcatacgcacacaggcacacccactcctggtcccgggggaaggctcactcttcggttttccagggctaaaggccaaggccacgcggatttctgagtccgaagacgcagtgcgaggacttacacctggattcccttactatcggctggatggtgggtggggaacccaaatccctctcttcttggcctcgcccttcctagcaggctttaggaaaaataccgaggtcgc

SEQ ID NO: 70526 - DNA, 826 bp, Homo sapiens; identical to SEQ ID NO: 33455
  chr10:124894870-124895696
  hyper

SEQ ID NO: 70527 - DNA, 701 bp, Homo sapiens; identical to SEQ ID NO: 33456
  chr10:124895832-124896533
  hyper

SEQ ID NO: 70528 - DNA, 759 bp, Homo sapiens
  chr10:124896937-124897696
  hyper
ggagcgagccggcctggccgcgtccctgcacctcaccgagacgcaggtcaagatctggttccagaaccgccgcaacaagtggaagcggcagctggcggcggagctggaggcggccaacctgagccatgccgcggcgcagcgcatcgtgcgggtgcccatcctctaccacgagaactcggcggccgagggcgcggcggctgcagccgcgggggccccggtgccagtcagccagccgctgctcaccttcccgcaccccgtctactactcgcacccggtggtctcttccgtgccgctgctacggccggtctgaggccccagaggggtgggggagggagcgcccggcctccttgtccggaccccggaggagactgggccgggccgagggcgccgagaagtccagcggccttcaggaactggggcttgggcgcgcagcctctgcttcccctcccccagtcggtagcattttgtaagtatttgcaatgcattttcgtgcaattcatccctaatggattggaggcgcttcccctcttacttttggtttttggcttatattaagagaaagcaggaacaagacaaaattttcgggtcagagatttcggccgatagtttttgtaaaatgtgcagccctcccttccaaatttccattgcgcggtggctttttggttttatttttatagaaggaaaataagcgcaaaacctaaatccctctagtttattcttttctgcttttttttttttttccgagacggaatcttgctc

SEQ ID NO: 70529 - DNA, 37 bp, Homo sapiens
  chr10:124897936-124897973
  hyper
tacaggcgtgagccactgcgcccggcctagtttattc

SEQ ID NO: 70530 - DNA, 152 bp, Homo sapiens
  chr10:124899035-124899187
  hyper
taagtacaacctggacgcacaaccctgtattccgggaggcggtggagacagaggcggctttgttcgcgaccagaggcactctctcccctgtactttccgcggcctgaaacgcccagcgagcagggaagaatgctgggcggaaggggagtgga

SEQ ID NO: 70531 - DNA, 644 bp, Homo sapiens
  chr10:124899554-124900198
  hyper
attcccggggcgactcgagcatgggcgcggtcctgatgtgctaagtgtgagggaacagaggctacctagctgctgcagctgcaacagagaagaccttgtctcttccgtgccaggctcttctctttcccctggcgcccaacacctcctgggcggcatctctagatccccgaccctgtcctggcagacgccgagaagcgtagcgctcaccacacccgcgcgctactgggttccaggccgccgcgctcttagtgagcagcctgcggaggcacagcgcgccggaaccgcctggaagggtgggtccgcccgacagaagcaggtgcctgggcgacactcgctggccgggtgtggccgcctgcctttaagctgggggtctgcacgtacaattcctggcggggcacctttgaagctggggagccgaaagggggagatgaggaacccagagggtgaaaaagattccagagagcagccatagggcgcgaccgctggggagcgcctgcacgcctctctttcctctcgcagtgcgttgctaggctcctcaaattcaatcgacacaattgattctactgtggctgaaacgtccagtatagttttctgttaatggaaaactgccctccgaataaaccgacatgcgtatttatggcaaa

SEQ ID NO: 70532 - DNA, 77 bp, Homo sapiens
  chr10:124901589-124901666
  hyper
gaacatcctttggaccgggatgcctcgaagtccctcctcacaagccacctgggatacactagcggagcctgccacca

SEQ ID NO: 70533 - DNA, 155 bp, Homo sapiens; identical to SEQ ID NO: 33462
  chr10:124901892-124902047
  hyper

SEQ ID NO: 70534 - DNA, 431 bp, Homo sapiens; identical to SEQ ID NO: 943
  chr10:124902138-124902569
  hyper

SEQ ID NO: 70535 - DNA, 1400 bp, Homo sapiens
  chr10:124902607-124904007
  hyper
cgccctctcgctgtcccccaccccctaacccgggctttgaggtgtgagcgatcccttgcctctgggcctaggactctggaagtgtgcacggccgttgtgcagggtggatggtgttgaccttttgacctgaaaacagttgggggctggggagcggaggaaggatggcggaagagaggaaagagccacgagaacaactaggcgggatgtacttttgagccctgccgggtgtctccgatcggagtctggggttgagatttgggctgcacttgtccccggtgtgtctctccggcggagtaccctgaaggtgcacgaggtggggagcataggctgaggtgggtaatcgggtcctggatagaaacacaaccctcgtcctcactggggcccatgtatgcgcctgggattcctccccacccttccatttccaggacccctaagggtatcactccagcgacggggcggttctggagacccgagggaagggatagctggagactgcagcgcgccttctccgagagtcccctggaggtgcgcatgagttgtactagcgcagatctcttccttggctgctgctcctggcgatgcatctccgggggaaacttcccaaagtctgagttgccggggttccaaaaggatccctttgggtttaggcctgggagaggtatagagccagcgagagagcgcgttgcgcctatcactgaggcaggagcggtgaggtggagtcacctgctgtgcctcacccaagcgctaatgtcttaaagaaatataaagaatccccttctttcgtgagctccttcaccgccctcgcccccgttggtgatggagtgcacgcatcagattttcatcaaagttctattaagtgaaacataggttgcagggcaccctttgattgaaacagtttaaattttaattgtgtttttaatttgacatatagttgcagaaaggaatgacactgcgtcgccaaggggcggtcgattttcttaatttctcccagaggaattgatgagtctatcaggccactagattggaaacccattaaagctctctggttaggctgttaattggaacttgatggatgtgggggggtggggaggggggtggagagtgtcgggactcggctatgctgatccaatcttcatgactttctgttttccaataaattacacaattcattttccagcagcagattacataaattgtacacctctggggctctctttttcaaatagggagcccttttccccaaaagcctattgtgagatgtcatttgcaccaaagaacgaacagcagaggcccttgaacgaaaatcgaaacataatcaacgtttatacttagaaaatttattgagatcattttctctggtatttccttattttaaagtttggacgcgccatatatcataa

SEQ ID NO: 70536 - DNA, 30 bp, Homo sapiens; identical to SEQ ID NO: 33465
  chr10:124904318-124904348
  hyper

SEQ ID NO: 70537 - DNA, 677 bp, Homo sapiens
  chr10:124904557-124905234
  hyper
gggcgtctgggcctccgtgctcccggtgaagatccccatatgctagaaaggggcggcaaggaaggttgtttcttgtccctcccgtccttgcggtgtgacggctataggtgctggaggggcgggaggtccctcgggctatcaatcgaggggagctcaggggaactgcagtcagtcaggctgcagagctgggtctccaccacagccttccttgccccagccccgtgcccaccaccatctcttccctggtaaagtgcacgcactagtaggagctcagtgaacgtttgctgaatgaatgtgtgagtgtgcgcaggcgtttatgcaagtgccttcatgcgaattaatgcgtcctttgccgggtgtggcagcagaggaagtgcctcggtgaagatcagaccctcgaagcgattagagggacgggacagaggaaatacaaggcaagatggatctttttgacttcccaaactatccctaggggaaggagagatagggacgcaaggcttcataacttccttgtttagagtccgcaagccaggcttcttgcaagggtcgactccccagtctctcactgtttcagggcctgggagttgcttttccgaggcccacttcgaggtcccctgatctgacagagatcactccttgggctcttgccccacccatatacccgcccccgccatccc

SEQ ID NO: 70538 - DNA, 399 bp, Homo sapiens
  chr10:124905481-124905880
  hyper
ttccagcatgttccccgcacgacatatttacagttcaggaaggttcgaccaactttccctgcctgcccccagctttcttccccagcggggtggctggcactgctccccgagttagctggccagttcccctcggggctgccttgaccctggctccggaggcagcgcctagctcaggatgtctgcgagaagcggatggttagtgagaatccgacgattctttcgctgaacctcccgcgtaccccccaacagcgcgggagcacgcgggacccgctgcgacgtggcccaggagcctgcgccgccgcggcgcagaggagaacgcacaaattgtatttcagcgccaggtccttccgggttaatgagctgacaccatgattaaagctgaccatttgtaatgtgtct

SEQ ID NO: 70539 - DNA, 191 bp, Homo sapiens
  chr10:124905919-124906110
  hyper
cggaggccggcacctgcccctcgctggcctcccgggccgctgcgcgcaccccctggcccccgccccctcgcctgcccctgccccggctgcgcggccgactcctaatcaattagcccattaacgagcccctcgaggagttaagtagggaagagttctgccacgggcagggccgcagtcggtaactcaccgcg

SEQ ID NO: 70540 - DNA, 174 bp, Homo sapiens
  chr10:124906770-124906944
  hyper
acaaaaacacagattcgcttaaaacacgggtgggccatgggctacccggccaggtttatggagtacctactatgcgctgctagtgcttcgaggcttttaatccctacctgaggcaatccgagaagttattttcaactatgagggcagagaggctttaatcggcatgagttgtgc

SEQ ID NO: 70541 - DNA, 1105 bp, Homo sapiens
  chr10:124907268-124908373
  hyper
caagcccctgggaggcgcggagacccgtcgcctgcggaggcgtcgagccactccagctccgagtcccgcaccgcccctgcctctggagagaagggtccaaggggtccaaggagtcggagttgccgcagccgccaggaacccgggctagaatctgcagctgctttcagccctggctgcccctggttagacgccgctgatgcccgccaggccctcggcgcgctctgggggcgcaccggtgctgtgtgcctggccggagcgttttgaaattttccggggccgctcggcggcgctgcgattggccgcgttcgggtaacctctatgcaaatgaggccgcgccgcctccgcgccgccggagacccggcgagttggcgggcgaggaaggggcatttgcaccggggctgggcgggcgcacccagagccaggcgggcaggaacccctgcgcagccatccggtgcctgcatgtccctggcgcggaagggacgcctcaccagcctcggcgccccctccccctagatttcctccccgcccctccccactgcctgcctgctgcaccaccttccacccagatcacccagatcgtctctaaagggagttcttggtttccttcgatttcttatgaacccaggatgggcagcaaagaagatgcgggcaaggggtgtccggcggccggtggcgtctccagcttcaccatccagtccatcctgggcgggggcccctcggaggcaccgcgggagcccgtcggctggccagccaggaagcgcagcctgtccgtgtcctcggaggaggaggagccggacgacggctggaaggcgcccgcctgcttctgcccagaccagcacggccctaaggagcagggccccaagcaccatccccccatcccttttccttgcctgggtaaggatcgcacgtcgccagtgtggcagcgagcgagcgcgaggggagggaggctgagcgccccgccaagactcccgcgccgggccccctctggccagagctgcggcagccgggggttcgggaccgcggggagaggggcgcgcactgtggtgcctcctccgcccggtgggcccctgggagcaggcgaacacagacccgtgccggcttgggc

SEQ ID NO: 70542 - DNA, 211 bp, Homo sapiens; identical to SEQ ID NO: 33472
  chr10:124908904-124909115
  hyper

SEQ ID NO: 70543 - DNA, 286 bp, Homo sapiens; identical to SEQ ID NO: 33473
  chr10:124909252-124909538
  hyper

SEQ ID NO: 70544 - DNA, 254 bp, Homo sapiens
  chr10:124910201-124910455
  hyper
gtgggcttggttacccggcatgataacgcacggaaggttttcaggtttttcggtggaaagacttgcatgcgtctgtctgtggaagtttggctcgctccacgtggagggtgggaccggggtcaggggttaaaggtcgggaccttggcgccgcccagactgcacgtggctggagctgcccgcccactctccctcctaacgcccagaatcgtcgcgcgggctggggcgcaccccggctggaatccagctcaagagtc

SEQ ID NO: 70545 - DNA, 520 bp, Homo sapiens
  chr10:124910708-124911228
  hyper
cgctgcgcccagctacccggccggtggcagagttatgtgtctcgcgcggagagggaactgggcgcggtgaggcagttctgcggctcaggagagatccgaggcccgggaccaggcaaagaaggtgagggaggcaaaggcgcttccctacactcttttgttgttaatagtttgcattggttcagcgtgtggctggatcaccggctagcacgcggccgcttgctctgaatggaaccttgacgcgcggcgggggcgcccacggacttcctcgccctgacacctgcggccgcgcaggggctgggagggcgctgcaccgagagaatagccgcgggagtatcatgcaaattgcagattctcgctcccaatagattgcagccacctgttcttggcaaaacctcggaaaaggaagcctgagcttggaggaagccggtggttcagcaccacctggggcgagctcctccggcctctggctgggcagagcggatgcaaaggagcctggagtccgcagcgctgaggccctatc

SEQ ID NO: 70546 - DNA, 30 bp, Homo sapiens
  chr10:124962095-124962125
  hypo
gtgtgtgtagcctggcgtagagtggccatc

SEQ ID NO: 70547 - DNA, 43 bp, Homo sapiens
  chr10:1250432-1250475
  hypo
gggtcccacagctctcgtgcctctgaagcgggcctggcttgct

SEQ ID NO: 70548 - DNA, 229 bp, Homo sapiens
  chr10:1252126-1252355
  hypo
aatgtaaaattccttcgcacgagagtgaagaggatgatccccaggtgcgtctctccattcccgggtcctaacgattcctccttaagccggctacctgcgcgggggccacgctctcccactgggaggatggtttctgggacatgcggcgtctcctccttgtgcctgtgcgtctgagagaactggggcgtctccttgaactgggacgtctcctcctcgtgcctgtgtggtc

SEQ ID NO: 70549 - DNA, 30 bp, Homo sapiens
  chr10:125219999-125220029
  hypo
cattggtgccagcagcgtcattcagtctca

SEQ ID NO: 70550 - DNA, 194 bp, Homo sapiens
  chr10:125252113-125252307
  hypo
gggagagaccctgcacgtgtgggcagtcaaggagggcattggcttggtgaggacaggcctggtgagcctcatgggttgagggcacctgcgagctgtcagctgcttcccagtgggctagctgcagtgatttggtgcacctggctgggacagcgagtgtgttgaggcactttatccttcatcggctcttcctgtgg

SEQ ID NO: 70551 - DNA, 30 bp, Homo sapiens
  chr10:1252590-1252620
  hypo
gcgcccatgagatgacgccttgtgactcag

SEQ ID NO: 70552 - DNA, 189 bp, Homo sapiens
  chr10:12531976-12532165
  hypo
tggggcaggtgtgaacggggcaggcacactcacgggtctgggctctggatgtgttggtggctccttggctggagcaggggagggcaagggtgccacgtgggtgtgtctccagccactgctgtggggaaggttttcctgggtgcagtctccgagggcctctgagtgagagcaactcgccccctctaccca

SEQ ID NO: 70553 - DNA, 97 bp, Homo sapiens; identical to SEQ ID NO: 33476
  chr10:125425515-125425612
  hyper

SEQ ID NO: 70554 - DNA, 259 bp, Homo sapiens; identical to SEQ ID NO: 33477
  chr10:125425689-125425948
  hyper

SEQ ID NO: 70555 - DNA, 56 bp, Homo sapiens
  chr10:125426031-125426087
  hyper
cgccgccaggcgccggcgctcttcaccctgaacctcacgtgcgggaacctgctgtg

SEQ ID NO: 70556 - DNA, 29 bp, Homo sapiens
  chr10:12554507-12554536
  hypo
cctcagcagctgcccgttgggagactcgg

SEQ ID NO: 70557 - DNA, 414 bp, Homo sapiens; identical to SEQ ID NO: 33478
  chr10:125650749-125651163
  hyper

SEQ ID NO: 70558 - DNA, 94 bp, Homo sapiens
  chr10:125651372-125651466
  hyper
gcagaggcgcggggcgggcgcaggggggccggccccgcccttccttcttccctccctttcccggcgacccctccgaggccggtccttggaggca

SEQ ID NO: 70559 - DNA, 110 bp, Homo sapiens
  chr10:125732094-125732204
  hyper
tgggagggagggatgcggcagcgatggggagaagggaggagcagggagaggagagaggtggaggagcgaagaggggatgaaggtgagcggcagggcggggatggagggac

SEQ ID NO: 70560 - DNA, 764 bp, Homo sapiens
  chr10:125851165-125851929
  hyper
gccacacttcattcccgagaactcggtacaattaacttaaccaacgtgaacaaggcgaaggcgcccagctgtcacagcggctccgcgcacgcaggcagacgaagaagggcccccgcccccaggagctggtcccagcctccagcctggcagcctccttcgaagacttccctacactgggcgcggacctccagccgccagcagccggcaacccagccccagccttcctcctctatacccgccgtcccagccgcgccggccggccccgggcgcagggcgggcgggaacgtgggcacccggacagcgacggggaggtcaagcagctgtgcccaggacccgggcggctccgaagcctcaacacgcacacactcgcgcgcacgccggcccatcggttgcctggaggagtcgggaaggtgcttccacggctcttcattcattttcccaaaggcaaggttcccttcgccccggcgcctctatcctgccatcccagggggccaattgcgccacagcccgccacccagccacccacagccaccgcgtcctatctcccggcacacacaacccaacagactcgcattacatctccaccgccagcgtcgcctccgcgccccggccgctgccatccggctccccagcttcgccgccccgcagccccggctccccgcctctggcctcaccgcgcggctcagagctgcctcgctcggctcgccgcaccaaggccggccagagacgccgccaccgccgggaagcgccggcaactcccgagt

SEQ ID NO: 70561 - DNA, 366 bp, Homo sapiens
  chr10:125852132-125852498
  hyper
ctccccgcccggaaccgccgcaaggctagagccagggttctggaagcgcatccgagctcgcaaccggggagagagtggcggatgcccacttacctgccccgggccgcgcctggaaacttccccaaagtgcgataggggtgtgggggcggagcgcaaggctggggggaatccccgtcccctaccgccaaacgacgcgcgctcacaccgtgaaagcactggtctgtccgtcggtcggtcccccgcctgcggctcccagagctgggcggtgcaggggcgccccgattccgactactgggctccttctcccggacagcccgccggtgcgttccacgcggcttgcgccccccgccggcctccggctatcca

SEQ ID NO: 70562 - DNA, 737 bp, Homo sapiens
  chr10:125852540-125853277
  hyper
cggccgcgtcctctctgcgagggagggggcgtgtgtcgccgctgggtaacccttcccgcggggtcctcaagcgcgcagggcgcccggagcgcggccaggaccaatggcgaagggactcctcccgctggggatcgctgaagcctcggggaggccgggccaaggagcccggggcccaaacctgcctcggctcgtcgagctcgcaagttcattgtctgcctgggccgccgccgccaccgccaccgccaccaccgcgccgggagcgccgcggggagtgaggctgcgcgccgcctccgccggcccggactccctacgcccagccccggccgccgccggcgctgcctggcccgaacccgcggaggggcgccggagccccgagcccagggccagacctcctaccgccgctcctcgccgaccccacctcggcgtctggcacctaacttgtacctgagaagcctgagtccagcccgggagcctctgcggctccggctccgcgggagcgcgcccagccccgagcctctagccccgcatccagggcgcgtcaacctgactccccgagcgctgggaggaaaagtttgggagtgacgtgcagacggcgaatgaaacatccgaggagaaccctccccccgccccatgtcgcgctgacacacatcagctccagtctggaatgtgagatcaaggcgtgtgcgccgagcggtgggtttggcccctgccccctccccctccgagtcaacactgct

SEQ ID NO: 70563 - DNA, 198 bp, Homo sapiens
  chr10:125853693-125853891
  hyper
ttaaggaacttggcggtctggagccagcccgtacattaatattcaaggccacagcgctggtgagttcggcgccctctgttgtatttttgcatcccgggaaggctggcccggctctttggcccggcgtgttttgcttccgcgggggaggtaaagctctgcaggaccccgatcgccacggcctgccgcagtggcctggag

SEQ ID NO: 70564 - DNA, 38 bp, Homo sapiens; identical to SEQ ID NO: 42679
  chr10:125919683-125919721
  hypo

SEQ ID NO: 70565 - DNA, 221 bp, Homo sapiens; identical to SEQ ID NO: 42439
  chr10:1259797-1260018
  hypo

SEQ ID NO: 70566 - DNA, 35 bp, Homo sapiens
  chr10:1260381-1260416
  hypo
tgcacctgtacccagcgttgcgtgggtttgcccct

SEQ ID NO: 70567 - DNA, 58 bp, Homo sapiens
  chr10:126077654-126077712
  hyper
cacgcccgggacagccgcccgcagtctacgcagggaggggccgcggggctctggtttc

SEQ ID NO: 70568 - DNA, 115 bp, Homo sapiens
  chr10:126083109-126083224
  hypo
tttctaataggatcacgccacgcccctgcttcaacccctttcttcagtgaccccactgctcaccaaattaagcccaaaggccctcattgtcattggccaccgtctccacaactcc

SEQ ID NO: 70569 - DNA, 15 bp, Homo sapiens
  chr10:126135816-126135831
  hyper
ggacactttgaagga

SEQ ID NO: 70570 - DNA, 846 bp, Homo sapiens; identical to SEQ ID NO: 33486
  chr10:126135877-126136723
  hyper

SEQ ID NO: 70571 - DNA, 1885 bp, Homo sapiens
  chr10:126137221-126139106
  hyper
tgtgcggggccggatcgatagatgtcatctattaaaggtaagttttaatcgaacaatattaggatcagacagggaaagggggtttgaagtcggtacctgcaagctgcgggcaggagatatgcaggcgccagtaatagaatatcgatcacgagggtgggggaagggagggcggcccctcggagagaagatccgaacaattaccaggccgcctgcctgggcccaagtgcggccgccagaggcgccccgggccccaggcaatcaccgccaaacttggggaggggagcagggggctgcgcggcatccagcctcccccgatgacctgagcctctgaccctccagggagccgcctttccctgtctgatcccagcaggactcctgctgtcttccgtccttccttccagccacaaactttcctaaccccttcatcaggtgtccgccagcgttgggagtaattcagaaagggtttcgagaagaaagtaccgaaagcttcccaacactccatccgagccccgcccccagcccagtcccagttaacagttgagtctggggagcttgagcgcctggggcagcccagccccgcaggcgtctccgggtggcacctgacctcgctactcacgaagacccccggcgcaagccttagcgtcagctcccccatccataaaatggaggtgatgttaatgatgctgtccatctctcaggttccgaagttttcatcacctttatcccagcccttagcccaggtcctagcacgtggcaagcgcattaaatgcccgataaatgagtaagcctggcaagacaggcgccaggtaagtttccaccgcgagcatcagaactgtggtgcgggtgagcttggcgggtgagcagggatgcggcaaatccctgccctgtaatgcggggagcctcctctctgcctctatccaagtccgaggcgggggctacacttcgcacccggtcccgtgcgccttctctctgaggaagacgctgttaagggccactcaccgggcccggctgttcccccatacactccgcattgttggggctgaggcctcctggggccggggccgccttgcatcttaccaggggtctccagctgtcggacagggtccctggagctggcatctttccccgcttcgacctccgccaaacttttcctggcttcccggggagccgggcgcacggcagggagcgctgcgcgggtgaatttctgtgggtccaggatgtccaggacagagaaagaaatcttgtggtgggagggagccgccttggccccgccgtcctgccatgccagcatgcccgtcgcccacgggccggcggtcggcggcgcggggttggggatggcgccgctcgggcttgccttcggctgtggcttggcggtagctttccagccaggagccgggtccgcgctgccaagtgaagctggggaggggggcggggaggcggggcggggagagcgccgcggggggctgcgcgccgattggcaccggcgcagcccgggccagcctcgggactatcaggcgctgtgccgcggccgcttgcctgggctcggggaagcctccgcgcgcccggtgcgcgcgaccgcggggacagtgttgtcgtctccgcgcgcctccgcccaaccctctgggactctccgagggcgcgagggaggcttccatcccggggatccctcaccccgacacacacacctctgtgacttgagtttgttccctttctccggtgcacccgccttagacttggggatgcaactgaggccaggactgcttactcccaggcaatgctcagcgcatctccttccccgccagtgaattactgtaatagcttcagacccggttacctcggaggtaaaatccctcacgttctcacagtttagcgttcacaaagccct

SEQ ID NO: 70572 - DNA, 30 bp, Homo sapiens
  chr10:126184143-126184173
  hypo
ggtgcccaggagtggcggagctggaggaag

SEQ ID NO: 70573 - DNA, 186 bp, Homo sapiens; identical to SEQ ID NO: 42680
  chr10:126198949-126199135
  hypo

SEQ ID NO: 70574 - DNA, 30 bp, Homo sapiens
  chr10:126254787-126254817
  hypo
tctccagattcttggcgccttcctgattgc

SEQ ID NO: 70575 - DNA, 30 bp, Homo sapiens
  chr10:126278930-126278960
  hypo
cttgggctctgaaggcgcctctcatcctct

SEQ ID NO: 70576 - DNA, 216 bp, Homo sapiens
  chr10:126314006-126314222
  hypo
ggattcgatgcagcccggtggtgtgcacacagcacaatcccctcaccacggcagagagctggagacggcgacccctgcacaacagccccaggttcctcaccggctcctggccaggcctggacgatggatcggcaaccaggatcctcgcctgcccctggccaggcctgggcgatggaccagcagctcccaaagcgaacctgccgcttgtgaggtgga

SEQ ID NO: 70577 - DNA, 209 bp, Homo sapiens
  chr10:126314738-126314947
  hypo
tgttttctgtggcctcgcacgtgaacgcagcaggagcgcagcctgcgcaatcggacagacgccgcacagcgcttgtctgtgctcaccctctcggtcctgctcggagcttcccactgacctcctctggcataaggcgcaggtagcgggggtgcctaacttatggccaccatgattgtgtgggtctcggcactaaccgtggtgctacggtc

SEQ ID NO: 70578 - DNA, 159 bp, Homo sapiens
  chr10:126331927-126332086
  hypo
tctccctattcacgacgcgcaggtggctgataaatttcccagggtttctcggcgcggtgattgcgcctggctctttcagcgtggctgcaggaatctatacaggtccacttaaatcagtctgaagctgtgaaagcctccatcactcgtcgcccgggcccg

SEQ ID NO: 70579 - DNA, 31 bp, Homo sapiens
  chr10:126479341-126479372
  hypo
cttctttttttgagacggagtcacgctctgt

SEQ ID NO: 70580 - DNA, 31 bp, Homo sapiens
  chr10:126479612-126479643
  hypo
taagccaccacgcacccggccctctgaatcc

SEQ ID NO: 70581 - DNA, 209 bp, Homo sapiens
  chr10:126697825-126698034
  hypo
agagccaagcgattcacggcttcatcagcccctgtgacctgcaggtggcctgggaggcaggaggagcctaagcagccggtgtggctcccagcctcatgcacaatgatccaggaagaaagaggagacaaaaccacacaaactccagaggccggggcgggacagggagtgacccaacacagccgaacctgaggccccgcctgcctccaagg

SEQ ID NO: 70582 - DNA, 30 bp, Homo sapiens
  chr10:126710554-126710584
  hypo
ggaatgtttttactacgcaggcatagatta

SEQ ID NO: 70583 - DNA, 90 bp, Homo sapiens
  chr10:126712034-126712124
  hypo
gggagattgctggctcgcagccaccgccggagggctccgcgacttgtgccatagccggccaggtcagcctgagagcgacagccgacccca

SEQ ID NO: 70584 - DNA, 30 bp, Homo sapiens
  chr10:126744811-126744841
  hypo
agaatgctccatgtgcgatgagaactattc

SEQ ID NO: 70585 - DNA, 87 bp, Homo sapiens; identical to SEQ ID NO: 42687
  chr10:126809890-126809977
  hypo

SEQ ID NO: 70586 - DNA, 171 bp, Homo sapiens
  chr10:126814656-126814827
  hypo
cctgtaccactagaccgcagtgcagcggtggcctgggagaggcccgctggacacacttcgcaatgggccagttcagctgctggtgctttcctgccttgtccaactatgtgacctcaggcaagtcacttagcctctcagaagctcacctggcagggtcgagaggaatgctac

SEQ ID NO: 70587 - DNA, 49 bp, Homo sapiens
  chr10:126847190-126847239
  hyper
aaggattgtttaccccggacagggcaaggaagcccggtatgacgacgta

SEQ ID NO: 70588 - DNA, 48 bp, Homo sapiens
  chr10:126850174-126850222
  hyper
accgtgccggagaggcggcgaccgctgtgggtgcgcagggaagggccc

SEQ ID NO: 70589 - DNA, 44 bp, Homo sapiens
  chr10:12685417-12685461
  hypo
cggcaggtgagtgggcgaagctgcgtttgtatttacagctgctc

SEQ ID NO: 70590 - DNA, 30 bp, Homo sapiens
  chr10:126881168-126881198
  hypo
cagtttacagtgtttcgtgtgctttgaaaa

SEQ ID NO: 70591 - DNA, 30 bp, Homo sapiens
  chr10:126914656-126914686
  hypo
gtaagagcagagcagcgagaagtgggggga

SEQ ID NO: 70592 - DNA, 194 bp, Homo sapiens; identical to SEQ ID NO: 42689
  chr10:127380217-127380411
  hypo

SEQ ID NO: 70593 - DNA, 30 bp, Homo sapiens
  chr10:127445232-127445262
  hypo
attactacagatgtccgtccctctttgata

SEQ ID NO: 70594 - DNA, 108 bp, Homo sapiens
  chr10:127451959-127452067
  hypo
tctggaaagaatcaacgttatcgtccacctgctgggccagcttgccgccggcagtgcagcgagcagcaatgccgttcagtgactgcacagagccgtgtcccagacacg

SEQ ID NO: 70595 - DNA, 134 bp, Homo sapiens
  chr10:127463291-127463425
  hypo
gaggaggtaagaggtcgcgggggaggaagacgctccccccggccttgcggggcaggtcgcgcagggcaggtcgtgcggggcaggtggggggtgccaaggaagtccgggcgtggccacaccgcagagaaagccat

SEQ ID NO: 70596 - DNA, 36 bp, Homo sapiens
  chr10:127464167-127464203
  hypo
atgtgcctgtgtgcacgtgcacgggcctgggggtat

SEQ ID NO: 70597 - DNA, 93 bp, Homo sapiens
  chr10:127475463-127475556
  hypo
cctactcagccttcacgttctcaggaatctccagcccaattgccaaagcaagcccaggctcccgactcacgcaatcgtcgaggacactgcgcc

SEQ ID NO: 70598 - DNA, 30 bp, Homo sapiens
  chr10:127568161-127568191
  hypo
tggttctgagtgctgcgtaattcatgagtc

SEQ ID NO: 70599 - DNA, 36 bp, Homo sapiens
  chr10:127582121-127582157
  hypo
agactgtggacgagtaaagggcggagagatagacat

SEQ ID NO: 70600 - DNA, 35 bp, Homo sapiens
  chr10:127601472-127601507
  hypo
ggattacaggcgtaagccatcgtgtccagcctatt

SEQ ID NO: 70601 - DNA, 36 bp, Homo sapiens
  chr10:127753348-127753384
  hypo
atgccgagcttgtggcggccacgtacctggtcccca

SEQ ID NO: 70602 - DNA, 338 bp, Homo sapiens; identical to SEQ ID NO: 33489
  chr10:128075686-128076024
  hyper

SEQ ID NO: 70603 - DNA, 619 bp, Homo sapiens
  chr10:128076244-128076863
  hyper
tggggatattcactgcgggatagggccagcaagaggacccgacacgcatcgtcccgagtgacacgtgtaaatgtcaagatacagagacatctgcaaatgtcacccaagagggtgaggacgggggagcggtcccgaggctgtgccctccggggcaggtactggctcctgtggggctgcgggccaagtgtcgcccttccccaaggaattggcacctggggggggggggtcggtctcgccgcgctggaagcgcaagccccggggctccggagatgcgccggggcgcgtcgcccctcggggcagccctggacctcggcgcgcccaggcgcagcgtgcggtgccctcggcggggcgggcagcgagccgccctagttcggcgacttacctcgggcctcgcagggcgcgagcagagcaccggccagggcgagcaggagggcgcgggcgggggacacgggcagcgggcgcgctgccatcgtcgccggccttcagtgcagcagctctcgggcccggcggcgagcgctgcaccatcccacgcgggcgccgagccggggccgggcgtcgcgaccggagggatttcctgcctcggcgagtcagctccggagccctcgcgcagcgcccgcgc

SEQ ID NO: 70604 - DNA, 301 bp, Homo sapiens; identical to SEQ ID NO: 33491
  chr10:128076940-128077241
  hyper

SEQ ID NO: 70605 - DNA, 14 bp, Homo sapiens
  chr10:128077431-128077445
  hyper
ggcgcgcgaccccg

SEQ ID NO: 70606 - DNA, 38 bp, Homo sapiens
  chr10:12828013-12828051
  hypo
atgttatattttccacgaatttccgtgagatgaaaaat

SEQ ID NO: 70607 - DNA, 30 bp, Homo sapiens; identical to SEQ ID NO: 42522
  chr10:12844882-12844912
  hypo

SEQ ID NO: 70608 - DNA, 32 bp, Homo sapiens
  chr10:128593761-128593793
  hyper
aactcaggagaaccccgcgggggtgcccgggt

SEQ ID NO: 70609 - DNA, 30 bp, Homo sapiens
  chr10:12872726-12872756
  hypo
aatgcctcgagcccacgggggtgtcccggc

SEQ ID NO: 70610 - DNA, 30 bp, Homo sapiens
  chr10:12876451-12876481
  hypo
caaacgctcagcatgcggctgccgagtctg

SEQ ID NO: 70611 - DNA, 203 bp, Homo sapiens
  chr10:128888576-128888779
  hypo
caggtgtttgtcggtcgccgctggagaccattgtgtggatcagtcacatggtctgctgcagtgtgagtgacagacggtgacttgctatcagtatgcaaaggtcacccggtgactattccaagaagtgtcattttccagtggagaatgggactttttttttttcctgttaataatttatttcttaattgcggtaaaatacatat

SEQ ID NO: 70612 - DNA, 32 bp, Homo sapiens; identical to SEQ ID NO: 33492
  chr10:128993490-128993522
  hyper

SEQ ID NO: 70613 - DNA, 902 bp, Homo sapiens
  chr10:128993580-128994482
  hyper
cgttggttggtttcccacgcctgtcccggtctgactcgggctgccaggcaccgggaagccccgcggcgccgaccccaacccgcagccccgggaaggtgccaaccccagcgagtggaggagacgagcatttcacgtgggcatctgccttcactgctgctcgcgcctctcctcaacggccggcgtcagggcccctctgttccaactcatcccccccccgaagttaatcagccgtacttgtactttccagggcgctttagtttggaaaatacttaaaagcctcgaaaccttccggggagacggccgcccccagatctcccagttttgcctggctagggctgtcgggcgctcacgaagctgtggcgtctgtctggaacccacatcgcagaggcgcagccccgctcctccctgacgtcgccaaagttgccagacgcccctcagcgacccggtcgcgccagatgcagttgcataaccttgccccccacctgcgaccgcaccgggtccgctcccggctgcaccggggtgtcccggccccgggagccgccgagtttccggccaagccggtttggggccgagtgtgtgcgcccgaatcggggtcggcgcccgtcccagcggtgctctgcccgcggccaagtacgacgggcgcgggggcgcgggaggagggcacgcggggctccgcttaccttccgctgcttacagataagtcgaggtcgatgcagcgcctggctcgggcatgtctcgctgcggaccctggcaagcctggggcggcacggagcactccggacagggcatccgcggccagactcgccgcgctcacgcggaggaagcctcggctccggggacttggcccgctgcgcgcctgctgcccgccccctccaccgctgccggcccggccctgctggccc

SEQ ID NO: 70614 - DNA, 225 bp, Homo sapiens
  chr10:128994686-128994911
  hyper
gccagggccaggaggcgggggcggggcagaggagggagcaggagggaagtcctttccgctgctccaggtcccagctactccgcggagccgggcggccagaggcgagggcgccccaagccgcgcgcctgccgcctgtgcgcccggctggcaccgaggcgggcggagccccgggccccgcggggcggaggtggggcgggggcggcgcggggccgggccgggccgggc

SEQ ID NO: 70615 - DNA, 455 bp, Homo sapiens
  chr10:129534992-129535447
  hyper
cgccctctatccctagccccgagtcccgggtaacccaggggccccggcgaggcgagtttctttggggcgagatgtcccgagccgagcaaaggggccgcgcattggacggggctcccaagccacagccctgggggccttgaggagtcgtggtacggtccagggcagtcggggctgcggggcccgtgaagccagacgaggctacggacttagggtccctgcaaccaagaccgcgagcgactgtggactcgggacggatcgcacaaaggaggaagggggaatcagaggggcgtccggtccaggacgtgtcaggcctgggcggggcggaaaactgacaccagggcgaggacaaggatttcgctcctccagggctgccaggggaggggctcgccaccgtcactctccatgggctctggccccgacggtgtttaaagggcggagggctgggccgggctggt

SEQ ID NO: 70616 - DNA, 529 bp, Homo sapiens
  chr10:129535695-129536224
  hyper
cgcttcgggtcccgggcctgcgccgccctacgcggccccgagctacggggctcccggcccgctcctcggcgccccgggcggcctggcgggcgccgacctcgcctggctgagcctctccggccagcaggagctgctgaggctggtgcggccgccctactcctactcggcgctcatcgccatggccatccagagcgcgccgctgcggaagctgacgctcagccagatctaccagtacgtggctggtaacttccctttctacaagcgcagcaaggcgggctggcagaactccatccgccacaacctgtcgctcaacgactgcttcaagaaggtgccccgcgacgaggacgacccaggtaacagcggcgcgccggctcgctccgtccaggactccccatcttcccgccgggccgcgggcactccgggggtgggagcaccttagacaacctaatttctccctgcgcggttggggatacccggggaggagggagaaggggaagaagtgcttgggcatggacaggttctcagacag

SEQ ID NO: 70617 - DNA, 64 bp, Homo sapiens
  chr10:129536258-129536322
  hyper
cggcggtcccggggctctcaatctctgtgcgctccttcggaggaagaagcgggagagccagcaa

SEQ ID NO: 70618 - DNA, 30 bp, Homo sapiens
  chr10:129684716-129684746
  hypo
aagcggtgcaggcctcggggtgcagcctcc

SEQ ID NO: 70619 - DNA, 402 bp, Homo sapiens
  chr10:129705629-129706031
  hyper
gaggcccaagcaggccggggcgctgcctcggccgctgccgcgggagggaggggccgctccggggctcagagtccggaccccggccccgccgcccccgcggcgcgcccagtaccagcggctggggcccgtacgacccccgaccccggcctgtggcgcgtcccctcacccggagtccccagcccaacttggcgaccacagtggcagtgctcacgctccctctcggtaaacaggaggagggcgcgcgtgtctgcgggtggctacagtgcgcgggggccggcggcagggcggcgtacgtgaaagcgggcgacacagagagggggtgcaggccgcgcgtggggggctgcgcccactcgaggctggaggctggagcctttgaagaaagtggctcgagttgtgccaact

SEQ ID NO: 70620 - DNA, 30 bp, Homo sapiens
  chr10:129885942-129885972
  hypo
gtcactcacccgggacgttgcacacctgag

SEQ ID NO: 70621 - DNA, 135 bp, Homo sapiens; identical to SEQ ID NO: 42695
  chr10:129888855-129888990
  hypo

SEQ ID NO: 70622 - DNA, 30 bp, Homo sapiens
  chr10:129897051-129897081
  hypo
cagtgttgggacagacgaggatagttgttc

SEQ ID NO: 70623 - DNA, 117 bp, Homo sapiens
  chr10:129914687-129914804
  hypo
tttgccaatatgcttcgcaaagacctgatctttcaggattctggaacaaaacccaaccactactcaccagggtcagaagagaagctagatcttgagacacgacgtgctggctcctgt

SEQ ID NO: 70624 - DNA, 122 bp, Homo sapiens
  chr10:129925726-129925848
  hypo
tacacaggattctatcggggtctgcttcagttgcgctggtggccatgtgggctcagtaggccacctggggtgaagtgaatggagcctaaacacgcttttggtgacaacggcctctctgcccc

SEQ ID NO: 70625 - DNA, 24 bp, Homo sapiens
  chr10:129947242-129947266
  hypo
taggtgatgggtacacggggtttg

SEQ ID NO: 70626 - DNA, 211 bp, Homo sapiens
  chr10:129947985-129948196
  hyper
ggatcaggtcaccttcgcaggcccagactccaccgtcagctgccgccgacggagcccacagaggaggctcgggcgcccgcgccccctgcgcagcggcccctccgcagcggccccagcccgcgtccccgcagcgccccttccgaagcgccccctccgaagcgcccacagcccgcgttcccgcccgcaccccagcccgcgccccctgcccggg

SEQ ID NO: 70627 - DNA, 30 bp, Homo sapiens; identical to SEQ ID NO: 33501
  chr10:129948725-129948755
  hyper

SEQ ID NO: 70628 - DNA, 17 bp, Homo sapiens
  chr10:129953663-129953680
  hypo
attatttttttgagacg

SEQ ID NO: 70629 - DNA, 379 bp, Homo sapiens; identical to SEQ ID NO: 33502
  chr10:130008498-130008877
  hyper

SEQ ID NO: 70630 - DNA, 327 bp, Homo sapiens
  chr10:130008906-130009233
  hyper
cggggcctttaggcgcccccgtttcctcgtcagtggggggcgcggtgccgcttctccgcgggctaaactgctgaggaaggggcgagttcctgcggcccctgcctgtcccggccacgccccacctccgccccgccgcgttgcgcgttcccgcggggccccgggcacccctggggccccggggatctctgacgcccccttccctccaacccccgctgcgatcccacaggtggggtgaacagcgcccctgctgtcccacggggcgtcttcgcgggtgatgcccacactctcagcctgaagagcaggacctgtccgcgggtggggcccacc

SEQ ID NO: 70631 - DNA, 53 bp, Homo sapiens
  chr10:130012130-130012183
  hypo
gacctcgaggagggacgtggacattatctcactttccgcggagggggcagcag

SEQ ID NO: 70632 - DNA, 104 bp, Homo sapiens
  chr10:130065661-130065765
  hypo
cgtgagccaccgcgcccggcccaaagcaggcatttttgtgagcctagcagcgaggtctggaggcttggtgtgctggagggtgaaagcagcgtcaggaggtcacc

SEQ ID NO: 70633 - DNA, 306 bp, Homo sapiens
  chr10:130084893-130085199
  hyper
taccagcacctgggccgtagttgtctcctggctcctggggtccgcggagctctagatgtacctgcagctcctcccgagtcctgcaagccacccttgtccctcttctcccgctcaccccccggcccccccatctcttttgctattccggggaaggccacgcagggtgcaacccggacgcgcccccgggggaagcccgcgacgcagcagccacacccccagcctgcactggcgcccaccccatgacttcgccttcgcggtcgcgggcagggagcgcgcgtttccatcggttgattagaagcgggagtc

SEQ ID NO: 70634 - DNA, 76 bp, Homo sapiens; identical to SEQ ID NO: 947
  chr10:130085200-130085276
  hyper

SEQ ID NO: 70635 - DNA, 83 bp, Homo sapiens; identical to SEQ ID NO: 33506
  chr10:130085355-130085438
  hyper

SEQ ID NO: 70636 - DNA, 34 bp, Homo sapiens
  chr10:130166708-130166742
  hypo
ttacaggcgtgagccaccgcgcctggtctgtttt

SEQ ID NO: 70637 - DNA, 232 bp, Homo sapiens
  chr10:130203334-130203566
  hypo
tgcacaacatcagggcgggagttgatgtggcccacagtgtgaacggcgccctccaagatgagcagtgtgatgctccgcagagtcgtagacaggaaaagtggaggctgaagtgggaccggacagcactggcacggcttgactttggcaatggacaacagggaaaatggaggcgcaggtgagaaaggaaggcaggtgaagcgcccgactcactccaagccgggggtctgaatca

SEQ ID NO: 70638 - DNA, 36 bp, Homo sapiens
  chr10:130268452-130268488
  hypo
agctcagggactggacgcaggcggcagagcgagtga

SEQ ID NO: 70639 - DNA, 53 bp, Homo sapiens
  chr10:130268909-130268962
  hypo
agcctctgactggcacgtccagccaggccacggtatcccgttccaaatgggct

SEQ ID NO: 70640 - DNA, 76 bp, Homo sapiens
  chr10:13027839-13027915
  hypo
ttaccaaaagacacacgtgataaaattgcatcgagttttttatttgtttgttttgggacggagttttgctctgtcg

SEQ ID NO: 70641 - DNA, 30 bp, Homo sapiens
  chr10:130299142-130299172
  hypo
ccggggcgctgagctcggggttcacttcca

SEQ ID NO: 70642 - DNA, 176 bp, Homo sapiens
  chr10:130317077-130317253
  hypo
ctgcctaattgctttcggtgaggcttcacttaagtgataaataaaaaattcattacttagttaatagttctttcatcaggaaaagtgttttaagatgaggctgtgagtcacggttgttttcttccctacctgcggactggtgtggaagagtcagacctttccgaatggcggctggt

SEQ ID NO: 70643 - DNA, 192 bp, Homo sapiens
  chr10:130338803-130338995
  hyper
cggctccctgggcccccagctcacgatgcccgctaggagccggcgccggggcgccccaaggctgcctccccccgcagcgctgcgcagtgcgccctggtgggatggggacgctgcacccctgaacccccccaaatccggcaggcctagggctggaggcgcggaaaccctcactcctgccgagctcccgagcgg

SEQ ID NO: 70644 - DNA, 89 bp, Homo sapiens
  chr10:130339328-130339417
  hyper
ggtggcccctgcccccgtgcaggccggcgtgacccggctcctaggtgaggctggagagaaggacctcgttttagcggattttttccttt

SEQ ID NO: 70645 - DNA, 16 bp, Homo sapiens
  chr10:130339653-130339669
  hyper
tatgtgcataaccttc

SEQ ID NO: 70646 - DNA, 120 bp, Homo sapiens
  chr10:130339670-130339790
  hyper
ctgtctcgctaaaggtcagcgcgcccctgctcatttcccgggctgccttttgggggcactctgatgccggggatttcctcgggtgttggggaaacaagacgtgctcgcctaacaaagact

SEQ ID NO: 70647 - DNA, 29 bp, Homo sapiens
  chr10:130402649-130402678
  hypo
tggagtgcgatggcacgatctgagcgtgc

SEQ ID NO: 70648 - DNA, 15 bp, Homo sapiens
  chr10:13043120-13043135
  hyper
cctggctctaggtaa

SEQ ID NO: 70649 - DNA, 726 bp, Homo sapiens
  chr10:13043175-13043901
  hyper
cggcggcgccgccgggctcacctgaggaagaagaaataggagtagtcctggaccacggtgtgggagtggcacgagaagtagcccaggccggtgaggttgagcctggagccggcgggcacctccagcatgctgccccacgcctggtcgcacagcatctcgacctcggccgagtagaagaggcccccctggccggcgtggtactgccagggcaggtggttgtagaggccgggcgcctcggggtgcagcgccagcaccctggcgtacacgatggtctcggccagctcggcgcggcagccctcgctcaggggcctccactcggagggcagctggcaggcgcgcgcgggcgctgggggacccgccaggcagagcgcggcgagcagcagctggcgcagcatgccgggccctcccggggcgcacggggcggcggcggggagcccggggagcccgccggcccgggaagggcagccctgggcgctcggctgctcgggccgctcccgggagctgagcgcaccgctgtctccgccacggggctcggcatgcccggccctggcgcgccacgctttaaaagggtcccggggactggacgcgccgggcgcccgcctcccgccctgccccctgcggctggggcgtgggcgggggaggggcggggagtcgggcgggtcccggcgccggctggggcggggaccagggactcggagaacgcggggacgccgggacccagccctg

SEQ ID NO: 70650 - DNA, 30 bp, Homo sapiens
  chr10:130520011-130520041
  hypo
acaagaggacagcaacggcagatcagacgc

SEQ ID NO: 70651 - DNA, 63 bp, Homo sapiens
  chr10:130546173-130546236
  hypo
gttagtgagtctgcacgctgccttctcactgacacggagggagaagcccgtgtggactcagag

SEQ ID NO: 70652 - DNA, 243 bp, Homo sapiens
  chr10:130577739-130577982
  hypo
agcctccgaggattccgcctgaggacacggccccatgagccggctcacgctcagaaggatggctgcctccacaaggctgccaatttgagcaccggccaaactgcaaccagaccccaggaaaggtaaaatagattgaaatgtattgcgcggtactcagattcactcctctgtctgcgagattattcttcttaaacacacacccacacagcgagcatctgcccacggccccgtggcgtgctggag

SEQ ID NO: 70653 - DNA, 20 bp, Homo sapiens
  chr10:130754356-130754376
  hypo
gacgccgatgctcctgcaga

SEQ ID NO: 70654 - DNA, 22 bp, Homo sapiens
  chr10:130803707-130803729
  hypo
agaactgaggccaggcgcggtg

SEQ ID NO: 70655 - DNA, 203 bp, Homo sapiens
  chr10:13081775-13081978
  hypo
aatggtaggaccatccgtctccctcagtacttggaaatgcgggagaggtgggttctagttgttacaataactgtgacagacgtactggtgacatacagtgggcaggatctagaatgctgtttgtcctgcacagaaaggtttcacagaaaagatcttcctgcctgagctgcctatagcacctaggtgaccgctgacattggtaa

SEQ ID NO: 70656 - DNA, 30 bp, Homo sapiens
  chr10:130829116-130829146
  hypo
agacttaactatttgcgtgtattttcccaa

SEQ ID NO: 70657 - DNA, 110 bp, Homo sapiens
  chr10:130829975-130830085
  hyper
ccccccaggaggccacgggggggagctgtggctctgctcagggcggccacagccagtagcggggaggagagggcggaaaatatactgtagcaaagcgatggtggaagagg

SEQ ID NO: 70658 - DNA, 85 bp, Homo sapiens
  chr10:130855248-130855333
  hypo
catgtacacacaggccgtgcacatgtggtcgtgtgtgcctatggctgtgtgcatctgtatatgtgtgtggcgcgtgtgcacttgt

SEQ ID NO: 70659 - DNA, 144 bp, Homo sapiens
  chr10:130855393-130855537
  hypo
gtgcactctcatatgtgtgcattgtccctgtgcttgcattcccgtgaggcttcgggatatgcatctgagtgtttctagagaaacaccacgggacgcagggtcctggaagtgcctgggcaggaagctcggcgacccaacccagag

SEQ ID NO: 70660 - DNA, 30 bp, Homo sapiens
  chr10:130911792-130911822
  hypo
acccgtccctcacctcggagcaactctctc

SEQ ID NO: 70661 - DNA, 152 bp, Homo sapiens
  chr10:130914837-130914989
  hypo
cacctaggaggccaccgtgatgtgctgctggctgcaaggctttgtcctgacctgacccagagcatcattgcacagacacttgagatggcaagtgtgtaggccacgcagcgtagggagggaagttttgctatcgtgctcgattatagtgtgag

SEQ ID NO: 70662 - DNA, 41 bp, Homo sapiens
  chr10:130938219-130938260
  hypo
tcctccaccattctccgagagaaactcgcatgtgtcatcct

SEQ ID NO: 70663 - DNA, 179 bp, Homo sapiens; identical to SEQ ID NO: 42702
  chr10:130946123-130946302
  hypo

SEQ ID NO: 70664 - DNA, 134 bp, Homo sapiens
  chr10:131034780-131034914
  hypo
attaaaactgccacccgaggattgcgattgcgagtctacagctgggatgttgtcaggaggcagcaactccagcagcttttaacgccatctccttacaggtggacctcgagtcccagcgccggaggaagcggcgg

SEQ ID NO: 70665 - DNA, 30 bp, Homo sapiens
  chr10:131058458-131058488
  hypo
cctctctcccatcatcgcaatcagtgcatc

SEQ ID NO: 70666 - DNA, 208 bp, Homo sapiens; identical to SEQ ID NO: 42704
  chr10:131058908-131059116
  hypo

SEQ ID NO: 70667 - DNA, 81 bp, Homo sapiens
  chr10:131146694-131146775
  hypo
accagtccacccctccgagccggggcttccacggccctgggtgtacggctgaccaatccactcctccgagccagggctgcc

SEQ ID NO: 70668 - DNA, 30 bp, Homo sapiens
  chr10:131171764-131171794
  hypo
aatggaaactctggacgttagttaccatta

SEQ ID NO: 70669 - DNA, 49 bp, Homo sapiens
  chr10:131265287-131265336
  hyper
gggcatgcgccgacccggtcgggcgggaacaccccgcccctcccgggct

SEQ ID NO: 70670 - DNA, 23 bp, Homo sapiens
  chr10:13130732-13130755
  hypo
tgaatattagctgggcgcagtgg

SEQ ID NO: 70671 - DNA, 47 bp, Homo sapiens
  chr10:131323870-131323917
  hypo
cagaaaggtgctgtgcggtgcggggccggctccgatgacagtaataa

SEQ ID NO: 70672 - DNA, 30 bp, Homo sapiens
  chr10:1313323-1313353
  hypo
gggcactgtcctccccgtcctcacagcctc

SEQ ID NO: 70673 - DNA, 75 bp, Homo sapiens
  chr10:13137668-13137743
  hypo
agtactggttcaccacccggggtttggggacccctgctttattggacataattattaggtcgtgttctttttggt

SEQ ID NO: 70674 - DNA, 30 bp, Homo sapiens
  chr10:131377867-131377897
  hypo
tctcagctgagtgtccgtgtttaaaggcga

SEQ ID NO: 70675 - DNA, 155 bp, Homo sapiens
  chr10:13140531-13140686
  hypo
accccttacaggccccggggggacccttttctgccgatcccagggtacagctgtgacaccgtcttttctgcctggattatcccagtagataaacaaaaattagagatcgtcattccatttctctctgtatatatttttccaagcccttttcatga

SEQ ID NO: 70676 - DNA, 34 bp, Homo sapiens
  chr10:13140986-13141020
  hypo
ttacaggcgtgagccaccgcgcctggccctcctg

SEQ ID NO: 70677 - DNA, 30 bp, Homo sapiens
  chr10:131456424-131456454
  hypo
aactaaaatggaagacgggcttctggctcc

SEQ ID NO: 70678 - DNA, 30 bp, Homo sapiens
  chr10:131503379-131503409
  hypo
acgcactgtagatgtcgcagacgcaggccc

SEQ ID NO: 70679 - DNA, 30 bp, Homo sapiens
  chr10:131510626-131510656
  hypo
ctttaataattccttcgtcacagctattgg

SEQ ID NO: 70680 - DNA, 30 bp, Homo sapiens
  chr10:131592644-131592674
  hypo
ttccataatgcttaacgtactgtttgtata

SEQ ID NO: 70681 - DNA, 213 bp, Homo sapiens
  chr10:131606675-131606888
  hypo
gacttccctggagtccgcccggcccatgcagcacccggggctctgcaggggaccccactccaaagcagaatgagacacacaggggttttctgatggttctttcatcccctcagctcctctttcttcaaatcgcctttaacctcagtcagaatgccagtcttcgccaggttggcccagtgcccagcaccctcgcacccacgcagagattctggc

SEQ ID NO: 70682 - DNA, 36 bp, Homo sapiens
  chr10:131636273-131636309
  hypo
tcccgccaacgctgacgcgggcggggctgcccttcc

SEQ ID NO: 70683 - DNA, 120 bp, Homo sapiens; identical to SEQ ID NO: 42706
  chr10:131641071-131641191
  hypo

SEQ ID NO: 70684 - DNA, 218 bp, Homo sapiens; identical to SEQ ID NO: 42707
  chr10:131647719-131647937
  hypo

SEQ ID NO: 70685 - DNA, 174 bp, Homo sapiens
  chr10:131739036-131739210
  hypo
ggatgccaggggaaccgcgggggagtctgggcatgggaaggcagagggcaccgcccaccccggaaacctgtcaccagggctgccataaacatcccacactcgatcctcccatgttgggccacagcaaacaggactgcagcgtaaaaccaggtaggtccccggtcccccagcctc

SEQ ID NO: 70686 - DNA, 30 bp, Homo sapiens; identical to SEQ ID NO: 42709
  chr10:131739627-131739657
  hypo

SEQ ID NO: 70687 - DNA, 22 bp, Homo sapiens
  chr10:131757029-131757051
  hyper
gagcgcgggctcctccgcggcc

SEQ ID NO: 70688 - DNA, 308 bp, Homo sapiens
  chr10:131757545-131757853
  hyper
cgggccgcggggagggcagggcgagggaggccggggccggggcgcaaggagcgagagcccgctggcaccgaccccggaacccggggctcccgggccccttcggcattccgcgccgccgccaggccgcgtcctcaggccattgtctacaacgagttccaatctgcatgttgggagaggccgatcagaacgccccgaggctaaagaagcagggaaggatggtcgcggcgcaggagcagtttgccaagggccgagggccgcgcccgccctgccctgcgcgctcccccggctctagcaagtctggcgccccg

SEQ ID NO: 70689 - DNA, 69 bp, Homo sapiens
  chr10:131758276-131758345
  hyper
cgcgctcagcccggctccgccgctgggaacccgagctggggatcgggagccgcccgcccgggctgggcc

SEQ ID NO: 70690 - DNA, 2330 bp, Homo sapiens
  chr10:131761007-131763337
  hyper
tacttcaagccccaccggttaatcatgtgaagtgccatcgacttattgatcgtttatgttttgttttccttctatgccatgagaagatttcgtgtttacatccatgtcattttaatctcaaatctttatgtcctttcaccagcgcagaaaaggagagccagccgctgcaggggcggcgagcacgcagcaggcacttaccgttgctgtacaataactggagtttatagtggatgccgttgttggttttctcgttgtttggctcctgaaagtaacgataaataattgcatttagtgcgatcggtgtcaggcgcggccaccacgctcggtccccctccgcgaccgaggctctcggcctcacacatggcaggattcctagctcgaagcagcgcggtgatgtcactttcctgctggaagcccagcgttctcctcgccccgagtaagtccgagggcgcagagaagttgcccagccctcggcggtcccgggcggccgcacgtggcggcggcggggtggcctggcggagccgagcccgccgcctaggggggcactcgaacccccgcgcaccggcaccgcctgcctcccgcttctagaaagagagagggtgtgatcgtgtgtttgcacttactttctctttctccacaaagtccacaaaagcggtcctttcaatctccaccggctgcccctgcctatcgtagagcgccagcacgaagtggaagaaattggatttccggaggttggaaggcggctgcttctcgaagtgcgcccgcgccagccccacgccgctgcgggaggaaagagacagcggcccggtgaggagcgcggcgccggccggcggagggggccgggccgggccggggccggggccagggcgcgcgggggcggccggtacgtacctctgggcggccgtgttggcgtccaccacgcccgccgtgtgcatccacgagcgcaccgggttcatgccgctgcccagcggctcctccttcatggtcgtccccccgcgcggaatattctcctgaatcccaaacatgaaaactgctggcggcggccgcagctcccggccgaaagcgtttcctcgagcagcggcgctcggggcttggcggcaggcggctgccctggccgccctcgccctgctcggcgcctgcggtccggccccgccgccggcttcagcccgtcccgggcaggcgcgacatacaccagcggccgggcgctccggacggccaggggcgcggaggcggctccaccggcggcggcggcgcttcgaaggagcaggacgcggtggccgcggcggcgcttgttgttgttgttgtttgcaggcgcgctcaacgtggtgtcatcctagccaggcggcgtccgcggctgcaggacactgcgggatcgcccgcttctggcgcggcccgcctgctccaaagacaaataaacggggcagtgagtgctgcggcgcagtcccgggcgcaggcggggcgcggcggggcctggagcggcgcgcgcagcggacggaggcgcacaaaactcagccctctctccccgaggaatggaccctttcccgggagccaaaactcgaagcccccgggagcggcgctgtcagagggtgacgtcggggggcggtgcctgcgccatatatgggagcggccgcccctcgccgcgcccctcgccgccgccgccgccgcgctcgccgactgactgcctgacggcgccgcgagccggcccgagccccgcgagccccgcgagccccgccgccgccgagcgccaccgagcgccgccgccgccccccgccacgcaccgcggctcctcgcgtccagccgcggccaaggaagttactactcgcccaaataaatcttgaaaagaaacaaacgcagccactgcacaattgcagtttggccccttaatacctccctgcaaaacctgccacacagtcgaacacgatgggcggggcggggggctgtaaaatgctgaggcgccccaagttgcccagatgcatgcaataaatgcaaggggctgcagcttgtcctggggccgcccgaaggagaagtgggaagaggcaggtcgaccgcagggagggcgccggagggaggagcgggcaacggactgggaggaggggtgcccagggctccccggccaaggctggacgcgcagctcagcctgatttctaagcagacctaaggctgctgcagggccggccggtcccggtctgagccccgccaggtaccccaagcttcctaccccggcggaggccgccgagtgccgggcagggaatcacgtcggaggcagggtctgccagatgctccctctcccccggtggccgcggcagaccccggcccctggcctgttctta

SEQ ID NO: 70691 - DNA, 311 bp, Homo sapiens
  chr10:131763632-131763943
  hyper
gggactccgcgcccaggagcgcggcccgcccaaaggacgtctgcgcgacacggagcagagacccaggggacgaccaggaactgtcctaggcacttccctgccaagagaaatcaggcccttttgattaaaagaaaaaaaaaaaaaagattgcagggcgcaagtgtgttgcagggcagcctcctcccgccgggtctggggcagcactcccttttcccgtgaattggcagcgtgtgtacgttaatattttaattaatcgggaaagtcgaagtccgattcacgttgtctggggacccccacgcctcttggaagga

SEQ ID NO: 70692 - DNA, 30 bp, Homo sapiens
  chr10:131767417-131767447
  hyper
cccggggcaggtgtccgccccgggtcctgc

SEQ ID NO: 70693 - DNA, 243 bp, Homo sapiens; identical to SEQ ID NO: 33517
  chr10:131768685-131768928
  hyper

SEQ ID NO: 70694 - DNA, 1401 bp, Homo sapiens
  chr10:131768929-131770330
  hyper
gcggccgggccggggagtccgtccgggtaattaactcagctccggcgactgcgacgatgaggccgggagggaaggaagagcataccgctcttggacagaaatgtgtcaagctctcctcccttccagcctgcataaaccctttcgcgcacattcgcgcgacttctaagggatccaagccagcggactgggtccagcagcgcgcggcggcgggacgcacccctcctctccccccaggaaggcgggtgcacgccggggctggaagggggagggtgcacctctggctacaaattcggccgcgaagagattctttaccaactctaagggtttgctgaatgtacagaccagaatgagtcccgttaaaaggaagctattcccacattaaacatgtgtgttttccatactaatggagtcacttaaagctgttgctaatttaactttttaaaaaggccacactgtggaaatttgcattttctttaggacattgaaatgaagagaaaactgctgggcggcaaggcggcccagggcatagctaggggccatgtagaaataaaaacagataaagaaaagaagaaagaaagaaaccggcttctcttctagactattaataagcaatttgtcccgctgaaatttacattgcaaagcggagggcgccggcagccgtggcggcgggcctggcgcgggctccgggggtgcgtcggcgcgggggcggggggggtcctccggccatccgggccgccctcgggggcgatccaccggcggctttgaactcggtgtccttgccgccgtgccgccgaccctcgcccgcacacgcgcgcatctgcacgccagggccccgcctgggctgcgcacccggaggccgggactggcgctgcgctagcgccacccgggctgagctgcagccttttgtggggggggcgggaatccctccgctcccagtgacgccttggactcgcggacccccatccgccccaaacgactgcccaggccttaaattaaaaatggcaacaataagcttaatttttttttcctccttagccgcgccgccccggtccaagtctaccgcaagcgtggagccccgagcgccgcgcccccgccggctctcccgcccgcgcgccgcccgacggagccgcggatcccgggcctagcgtggggccagggcgccatctacgggcgccgcgcggctccgggcggccgccgcctcctccctctcagcgtccagagcccgctcctcctcccgccgccgccgccctcgccccgcgccgcctgccacttatcacaattacccgacgctcccgtgccattttgcttatgaaacactgattgctagttatgcggacttttaagcactatattaaaactttcgaaatgaaggcgctctcctgcctgcgatttttaggtaca

SEQ ID NO: 70695 - DNA, 525 bp, Homo sapiens
  chr10:131770569-131771094
  hyper
ttttggttgttaatccgaaaggaggagttttaattgcttcctgcgttgtcgtccaggcatctaggcgcttcgaccttccccatccctctctccaagggtctggcgtttgtactgggggaagacggagagtgaaaaacgcggggtccttcagctaaatcctcggaaccccggatcttcgcccgtgccggtacgcgcctcccccgcgccgagaatccctggcacgcgatcgcctccccgcaggcccgccgggaaggccgcgagcagaggccaacggaggcctcccaggcagtgctcgccaggaaccaagacgctgccagggcgcggcgcaaaagttcactgcgaggccaggcctgggcgcagctcatggtcaggggctcctgcctccacagtcccaccccgcgcctccgccgcagccccgcccgcgctcccgtaggcgagaggagcgcacccggctccggggccccggcaacccggcccccagcgttcagtgtccggcccgccacgcgcgaagttcaactttgctgg

SEQ ID NO: 70696 - DNA, 21 bp, Homo sapiens
  chr10:131771281-131771302
  hyper
gggagagcccacgggcccggc

SEQ ID NO: 70697 - DNA, 43 bp, Homo sapiens
  chr10:131771415-131771458
  hyper
cgtgccccggggccgcagctgcgcccagcgctagccacctgga

SEQ ID NO: 70698 - DNA, 315 bp, Homo sapiens
  chr10:131825216-131825531
  hypo
ggttcccacacccaccgcccacctgctgccaggccctgggggagctctagtgagaaacgtccacgtactactgcccaacatgctcgccgctcctgaagagttttgtttgaatagaaatgtccccgtgtccacggccattttgctggaacagactccaggctgcacagaggcgccaacactgtccccagccggaggccaccgctgctgccctcacagctgccatctcacggtctccccctgccccacttcagggctctccccggggggccaaacaaggcccggcgatggggtggagccactcgcagcctcccccga

SEQ ID NO: 70699 - DNA, 786 bp, Homo sapiens
  chr10:131843979-131844765
  hypo
agaaagtcacagccacgtcccgccacgcgggcgggaaaacgtggaagcaaatgcgattgcctcgactcgaggctcagctaaggagcagtcaggtccgtgtcacctgtggcttccactcccaggaagtctgatggctccggtcgtggctgttgtggggaatccgtcgtgtggagaacgtgcctgccacgtgcgggggagaaaggagccaccttccgagtacgcgacctcacctgccgggcgtgaggtgctggactgagaccagggtggggctctgggcatgggaggtggggctgggcgtggggcacgtggcacagagggatgcgcgtggtagggctcagggcagacggaacgtggaacagggagtggctcagggcatggggatggggcggggcgtgggacggggcgtggcgtggggcacaggaaggggcagggcacgaggagtggggcgagaggtgctaagtggggcctgagtggggcgcggggcgtggcgcggagtggggtggagcgggtggggcgaggctcggcgtgggacacgagggacgggacgcgggggcacggcaatgggtggcgcagggcgcactctcgggctccctgcaggtgggcagccccacctgtgcacgccgctcccccgcccagcgcctcccccgggacctgctccagaagcgccagttgcgggaccccacacggaaggcagtcttcggtggttctcactgcaattcctcttaattatgtgtgacataaaaagaccacctacagacgagacaatgctgccgtaagagtctcggg

SEQ ID NO: 70700 - DNA, 211 bp, Homo sapiens
  chr10:131845025-131845236
  hypo
gcccgctcacctgcacgcggaggttcatttaatccgtgcgtctatgcagcgcctaggcctaactctcccaggaggcgccagtcacgttccccagggggagctccctgacctttctgggggtgacagagtggggaagtgggcagtgtgagcccacccctgaggcgtgtgtgtgtaagcgtgcacacttgctttttaacgttctgtattctag

SEQ ID NO: 70701 - DNA, 32 bp, Homo sapiens
  chr10:131851993-131852025
  hypo
ggatgccagtgaaaccgcgtcttaagtggaac

SEQ ID NO: 70702 - DNA, 86 bp, Homo sapiens
  chr10:131936580-131936666
  hypo
gtaaagtatcgggattacaggcttgagcccccgtgacctgccctgttgatctaaattgagtgaaattttgccgactgaatttgaat

SEQ ID NO: 70703 - DNA, 94 bp, Homo sapiens
  chr10:131937390-131937484
  hypo
ttacaggcatgagccactgcgcccggccaaaatggataaaagtttaaatgtaagtaccatttggatgttgtatccttgccgctggcctgtactt

SEQ ID NO: 70704 - DNA, 39 bp, Homo sapiens
  chr10:131987277-131987316
  hypo
cccgctgggttcttacggcggatccgttacctgggtctc

SEQ ID NO: 70705 - DNA, 30 bp, Homo sapiens
  chr10:131988259-131988289
  hypo
gctttgctgccgctgcggccttgtgtgaat

SEQ ID NO: 70706 - DNA, 44 bp, Homo sapiens
  chr10:131988602-131988646
  hyper
gcgcaagagtaagcccgcgggtgccggagcgcgcgccccgccgt

SEQ ID NO: 70707 - DNA, 262 bp, Homo sapiens
  chr10:132001274-132001536
  hypo
cccacacagcacacacggtgcccgcacagcccacacggtgccctcacagcccgcacggtgcccacacagcacacacagcacacacggtgccctcacagcccgcacggtgcccgcacagcacacacagcacggtgcccacacagcccgcacagtgcccacacagcacacacagcacacatggtgcccacacagcccgcacggtgcctgcacagcacacacagcccgcacggtgccctcacagcccgcacggtgcccgcacagc

SEQ ID NO: 70708 - DNA, 35 bp, Homo sapiens
  chr10:132005005-132005040
  hypo
atgggcagcaggcaccggcacgtggtgccctcagc

SEQ ID NO: 70709 - DNA, 75 bp, Homo sapiens
  chr10:132050760-132050835
  hypo
agccatggagcttctcgagtgtgtggccctgaagtctgatctggacacagaaagatagagcgatggcgctggccg

SEQ ID NO: 70710 - DNA, 98 bp, Homo sapiens
  chr10:132229336-132229434
  hypo
agtggcagcccagaccgacgcggagaccaaggttctttcgtgcactaccaggtgtccaccttgctgccacctgcagctgacatcgctgcctgctctga

SEQ ID NO: 70711 - DNA, 30 bp, Homo sapiens
  chr10:132237416-132237446
  hypo
caccatcccccctcccgctgcctgttttgt

SEQ ID NO: 70712 - DNA, 30 bp, Homo sapiens
  chr10:132280529-132280559
  hypo
gggaagtctgtttggcggagctcgagtcag

SEQ ID NO: 70713 - DNA, 30 bp, Homo sapiens
  chr10:132290329-132290359
  hypo
gcactgacttccttgcgcatcctctcaaac

SEQ ID NO: 70714 - DNA, 30 bp, Homo sapiens
  chr10:132308764-132308794
  hypo
tgctcctggcctgggcgtctgcaggggagt

SEQ ID NO: 70715 - DNA, 92 bp, Homo sapiens
  chr10:132317215-132317307
  hypo
gagcaggcaagatggcgctggtcaaagtaaggagcaggcaagatggcgctggtcaaagtaaggagcaggcaagatggcgctggtcaaagtaa

SEQ ID NO: 70716 - DNA, 247 bp, Homo sapiens
  chr10:132365670-132365917
  hypo
cccttgaggtggatgcggtgaggcgcgaacggagcgggtagaaatgagacggcgcaatggcggaaagcaaagcagaaatggcgtgacagccacatgtgcggggccggggaagtggaggctggctgctcctcacgggcactcgggtgaggctctctccacctcgcgcaggggctacccgctcgccgtgctgagcccttccagctctgccacgcgcaggaagccggtgcggtgacggcagcgcacgctc

SEQ ID NO: 70717 - DNA, 30 bp, Homo sapiens
  chr10:132447397-132447427
  hypo
accatgtagctgacacgttgtcagcagcag

SEQ ID NO: 70718 - DNA, 174 bp, Homo sapiens; identical to SEQ ID NO: 42719
  chr10:132525800-132525974
  hypo

SEQ ID NO: 70719 - DNA, 165 bp, Homo sapiens; identical to SEQ ID NO: 42720
  chr10:132586486-132586651
  hypo

SEQ ID NO: 70720 - DNA, 30 bp, Homo sapiens
  chr10:132600977-132601007
  hypo
gggcttcggaacagtcgactttgctccctt

SEQ ID NO: 70721 - DNA, 194 bp, Homo sapiens
  chr10:132609120-132609314
  hypo
cccatcctgcgtgagcgcatcctggagtggggggtccttttgctgcttttcctgcgtggcgactgtttcatgactccgattatgacaggggagctggctctgagtgagcacagggcgtctgcggtgtgcatggaggtgacacctgcagagacaagctccccagcacccccacccgccaacgcccagctctctta

SEQ ID NO: 70722 - DNA, 30 bp, Homo sapiens
  chr10:13276800-13276830
  hypo
gggtcatgctgacagcgaccagagaacacc

SEQ ID NO: 70723 - DNA, 150 bp, Homo sapiens
  chr10:132768174-132768324
  hypo
gagggtccggtgctgcggggaaggaaagtgctcctcatggtatttgggggtggctgcacgaccatgtgcatttgtccaaactcacagaacctacccttccaaagggggattcctactgtgtgtaaactagtccgccgtacacctgacttg

SEQ ID NO: 70724 - DNA, 194 bp, Homo sapiens
  chr10:132811723-132811917
  hypo
gtcagactctacccacgtcgaggtttcttgcggctggttggtgtatggggctggctctaaccggccatcttccatgttgacctctggaatccatgcttcctccaccaggatgccattcatctagggtgccagcatcttctcaggtccaagatccggacagcgcagtccgcccacacggacgtcattcccagctc

SEQ ID NO: 70725 - DNA, 164 bp, Homo sapiens; identical to SEQ ID NO: 42723
  chr10:132818146-132818310
  hypo

SEQ ID NO: 70726 - DNA, 124 bp, Homo sapiens
  chr10:132859296-132859420
  hypo
cttgattaaaagtgccgctcagccagcactgccctaagtactcatcacctttcctagtgagcgtgttcagctcttcaagactgacaccagactctacttaaaaatggctcgctataaaatatca

SEQ ID NO: 70727 - DNA, 35 bp, Homo sapiens
  chr10:132871489-132871524
  hypo
gtccctgtcctgggtcggctcgtgctgcctgaacc

SEQ ID NO: 70728 - DNA, 141 bp, Homo sapiens
  chr10:132873732-132873873
  hypo
cagagtctgggtctccgtgcagccttaggcctccttgcgctgggcgcacccgggtccgggctccggagtctgggtctgcgtgaagccttaggtctccgtgcactgggcgcacccgggtccgggctccggagtcaggatctg

SEQ ID NO: 70729 - DNA, 155 bp, Homo sapiens
  chr10:132893493-132893648
  hypo
gacggccaaccccaccgggcgtcaaccccaccgggcggccaaccccacctggctaggacccagtccccggtagctgctctcccgagaggcgggcagggctggggctaggggctgtccaggagtgttctggactgtcccgtcgccaccattcccac

SEQ ID NO: 70730 - DNA, 182 bp, Homo sapiens
  chr10:132976493-132976675
  hypo
acaagacagtgacagcggtgaccctgccaggtgcttggaggggacttccctggaaacaaggaagccgactagcgcggggccctggacgtacttttgaaacaagacgaggcaggtttgtatctgaatgtctcttgttcctctcagctgagctgtgacaaatggggtaacgagtatctcatgcc

SEQ ID NO: 70731 - DNA, 191 bp, Homo sapiens; identical to SEQ ID NO: 42726
  chr10:132977044-132977235
  hypo

SEQ ID NO: 70732 - DNA, 97 bp, Homo sapiens
  chr10:133058323-133058420
  hypo
gtggctcagtggagtcgggtcgatttgcagggtccgaagtcaagcaaagcccaaacggccccagccgaatgtttccctcaaccggagccgggcttca

SEQ ID NO: 70733 - DNA, 23 bp, Homo sapiens
  chr10:133089975-133089998
  hypo
accgcgcccggcctccataaaca

SEQ ID NO: 70734 - DNA, 137 bp, Homo sapiens; identical to SEQ ID NO: 33522
  chr10:133109124-133109261
  hyper

SEQ ID NO: 70735 - DNA, 121 bp, Homo sapiens; identical to SEQ ID NO: 3684
  chr10:133110064-133110185
  hyper

SEQ ID NO: 70736 - DNA, 322 bp, Homo sapiens; identical to SEQ ID NO: 33524
  chr10:133110553-133110875
  hyper

SEQ ID NO: 70737 - DNA, 15 bp, Homo sapiens
  chr10:133110966-133110981
  hyper
cgccagcctcctccc

SEQ ID NO: 70738 - DNA, 183 bp, Homo sapiens
  chr10:133117656-133117839
  hypo
ccacagtgtgtgctgcggatgggagcttagagcacaaagaataagagtggaagaggtattccttcagcagacccagctatcgacaggcctcatcaggccagggtgaagccctccctctgtgtgtgcaggagtccccaagagcttggtttaacatttggtcatgatatgcgcagatgaagggcc

SEQ ID NO: 70739 - DNA, 43 bp, Homo sapiens
  chr10:133226414-133226457
  hypo
gcaggagactttgtgcgtggctgctgtccgaagctgaagaagc

SEQ ID NO: 70740 - DNA, 17 bp, Homo sapiens
  chr10:13345114-13345131
  hypo
tttttttttttgagacg

SEQ ID NO: 70741 - DNA, 30 bp, Homo sapiens
  chr10:133495425-133495455
  hypo
ccagggctgcactcccgcagcgtgccctgg

SEQ ID NO: 70742 - DNA, 192 bp, Homo sapiens
  chr10:133516016-133516208
  hypo
tgtctatggcagacacgacctgccttcccgggacagacccgccccgacggcaagggcttctcatgcctgaggctcccagctccccgtatccagtaccagggaacgcgaaggcaggctgttggggatggcagcaggaatcctgtagagccaggagtaggaggtgggatcagaacaaagcgtatgcatgagtgc

SEQ ID NO: 70743 - DNA, 279 bp, Homo sapiens
  chr10:133530719-133530998
  hypo
gcaggggtgtggacacgcacatgtgctcaggatactggaataacactgactttctgcacggcagcccgcaccgccacccttcttcaggtgtgcctgggctgggcacggcagcccccaccgccgctcttcaggtgcacctgggctgggctttttatcatccagtgaactttagaatctgctgtcagtgtcattaaacatcatttgggattctgataggaatcgcattgattttataaattcatctgagaagagctgccatctttacgctgtgtcaatcaa

SEQ ID NO: 70744 - DNA, 194 bp, Homo sapiens
  chr10:133532602-133532796
  hypo
gtgtatgttgggagccgctccctcgccgccttggtggggcacacactccctttgactccctggatccaagccccaggccacctctgcctgctcccaggggcttcgacccacacaatgccttgggtatcagctttatttctgggccccagcaatgctaattttctctaacatgacggtagcgtttaattttcatt

SEQ ID NO: 70745 - DNA, 222 bp, Homo sapiens
  chr10:13355033-13355255
  hypo
taccccgtgggtatacggccttgtggtggggagaataacggtcctccccaaagatgttcacgccctaatccctggaatctgtggctgttaccttacctggcaaaagggattttccaaatgtgattaacgttaaggactttgatagggggatcaccccgtattatctgggtgagcccactgcaatcatgagtcctgaaaatggagaaacgtttcctggatgta

SEQ ID NO: 70746 - DNA, 51 bp, Homo sapiens
  chr10:133555035-133555086
  hypo
accgccgcagagcctcgggtgctgatgggccacaggcgagggtggctccct

SEQ ID NO: 70747 - DNA, 30 bp, Homo sapiens
  chr10:133589829-133589859
  hypo
gtcaactgtatgacccggataaaatgtatt

SEQ ID NO: 70748 - DNA, 30 bp, Homo sapiens
  chr10:133590138-133590168
  hypo
gcccggtcaataacacggctgattgggtgc

SEQ ID NO: 70749 - DNA, 30 bp, Homo sapiens
  chr10:133603524-133603554
  hypo
acggtgcaggaaggtcgccacctccttgct

SEQ ID NO: 70750 - DNA, 30 bp, Homo sapiens
  chr10:133645234-133645264
  hypo
gggagtggtgggtgacgtccccagccccca

SEQ ID NO: 70751 - DNA, 157 bp, Homo sapiens
  chr10:133783240-133783397
  hypo
tagagccctcctccccgctgagaggctgggaccagcccgaggaggagccgttttggcttcccgctctggctcttcaccaccgctgcggcgaacgctcttcagaacccacagcggcgcctgcctggtctctgtgttttctgcagggtgagtgagtata

SEQ ID NO: 70752 - DNA, 515 bp, Homo sapiens; identical to SEQ ID NO: 33525
  chr10:133794727-133795242
  hyper

SEQ ID NO: 70753 - DNA, 572 bp, Homo sapiens; identical to SEQ ID NO: 10641
  chr10:133795312-133795884
  hyper

SEQ ID NO: 70754 - DNA, 84 bp, Homo sapiens; identical to SEQ ID NO: 10642
  chr10:133795975-133796059
  hyper

SEQ ID NO: 70755 - DNA, 408 bp, Homo sapiens
  chr10:133806718-133807126
  hypo
tggctgagcagcatccgttgtatggatgtgccaccatttgtttactgttcacctgttggacatttgggatgttttcagttcttgccgctggcaaatcgagctgctgggaacgttcacattcatgtgccagcgtttgtatcgacatgttctttcatttcttgcaggtaaatgccatggagtgcagcggctgggtcgtatggggagggtgtgcttagctttttaaggagctgccatcgtgttctccaaagtgctcgcacatgttactttcccagcagcaggagagtgccagtggctgaacacccacgccaactgtggtttagccgggctttttaattgtagccattctaatgggtgtgtgctgccgtctcgtgattttaacttgcatttccctatcgtgacatcttttca

SEQ ID NO: 70756 - DNA, 34 bp, Homo sapiens
  chr10:133836708-133836742
  hyper
tggacgcttggcttccgctcgctggctcgccgac

SEQ ID NO: 70757 - DNA, 474 bp, Homo sapiens; identical to SEQ ID NO: 33528
  chr10:133849661-133850135
  hyper

SEQ ID NO: 70758 - DNA, 683 bp, Homo sapiens; identical to SEQ ID NO: 33529
  chr10:133850156-133850839
  hyper

SEQ ID NO: 70759 - DNA, 32 bp, Homo sapiens
  chr10:133858093-133858125
  hypo
aggctggggtcctggcgcgggctcttcctcag

SEQ ID NO: 70760 - DNA, 61 bp, Homo sapiens
  chr10:133910786-133910847
  hypo
gtggtgcagccacaccgtgggtcactctgcggcgagaagggtgaaccgtgggccactccgc

SEQ ID NO: 70761 - DNA, 139 bp, Homo sapiens
  chr10:133913329-133913468
  hypo
gcaccccaaacccctcgcactgccacgctgtccgtctgcagctcccgtgctcaccctggtgatggtggtcttgagcagagtccacagtgtctggagggctcgtctgcatctgagattcacgctgcgttgctgtgattcc

SEQ ID NO: 70762 - DNA, 277 bp, Homo sapiens
  chr10:133913780-133914057
  hypo
gtgcagagtgtgccacgtggggccgagcccttggcatgagccggctggacctcccgcatggctgaagcccatgccacacccaaggtgggggtgtctgggccaccaccagctgagatctcccactcccgcagcctttgggtctctctccagtcgccccgtctgcctcccaggagggtgtcaggaaggccacgagaagacgtattgaccagaacagcctcacacacccttgagactggatgattctctgcaccctggttccttacgagggttggggggt

SEQ ID NO: 70763 - DNA, 30 bp, Homo sapiens; identical to SEQ ID NO: 42732
  chr10:133921177-133921207
  hypo

SEQ ID NO: 70764 - DNA, 32 bp, Homo sapiens
  chr10:133935358-133935390
  hypo
caccctgaggacagtcgcgtctggcagggctg

SEQ ID NO: 70765 - DNA, 49 bp, Homo sapiens
  chr10:133935785-133935834
  hypo
gccctgactgccccccggtcggctccccggctgtcggggccctgactgc

SEQ ID NO: 70766 - DNA, 128 bp, Homo sapiens
  chr10:133947267-133947395
  hypo
gccctgtcaccctcccgtgggccccggcctcatcacccttctgctgcagttcatggcacttgctggcccggagtccggccctgggttggtgggaggaggctgtgctgggtatgcgctgccaccatctc

SEQ ID NO: 70767 - DNA, 307 bp, Homo sapiens
  chr10:133949128-133949435
  hypo
catctgtcaatgggacgggactcacccccggggacgccgagcccagccctgagcttgggttcactagggcaccgggcgagcgggttcacctgggcactggacgagcaggttcaccagtgctctgggcaagtgggttcacccgggcgctgggccagtgggcaccacttggaggcgtggacttcccaagtagagggctggggactgcgttgttgcagcccaagctgtggtcagtcagccgactctgcgtggagacctgctggttctccgtcacttaaagaacaatcacatagtgcgttgtctttcagtt

SEQ ID NO: 70768 - DNA, 68 bp, Homo sapiens
  chr10:133949784-133949852
  hypo
accttgcaaaggatgcggctgtggggcgtcccctccccaggcctgtttgcccacgtctcactcaaggg

SEQ ID NO: 70769 - DNA, 556 bp, Homo sapiens; identical to SEQ ID NO: 42735
  chr10:133951469-133952025
  hypo

SEQ ID NO: 70770 - DNA, 144 bp, Homo sapiens
  chr10:133952229-133952373
  hypo
tgcctgtgtagggtccgagtccccacgacctgtgggatgcacggctctgaggacgggcggctgaggctgctcacactcacccatcctggctgtgccacacaccccacgctcgcctgtcctgccgttcaccgtcctcggccacac

SEQ ID NO: 70771 - DNA, 85 bp, Homo sapiens
  chr10:133955427-133955512
  hypo
tggccaaggaggagacggagctgaggttccggcagctgaccatggagtaccaggccctgcagcgtgcctacgctttgttgcagga

SEQ ID NO: 70772 - DNA, 228 bp, Homo sapiens
  chr10:133962619-133962847
  hypo
actgagggatgtgcccgtgggctcagggtgggactgcccaggccacgtggccagagtgtgatgaactctgcccggcacatctggggtcagcgaatatacaggggcagtccttgtgggcaggtccaggtccagtgcagattctgccaccactgctgccgctgcggtttggttttcataaatgctgtgttgatccctggttccatggtcttggcccgtgttcctcaggcc

SEQ ID NO: 70773 - DNA, 65 bp, Homo sapiens
  chr10:133979162-133979227
  hypo
attgccaggagagaccgggtccctctggacagcagtcgccttagacgggccgtgtgtcatcccac

SEQ ID NO: 70774 - DNA, 152 bp, Homo sapiens
  chr10:133982809-133982961
  hypo
gcaggaggaggcttgcgggaaaagggagaaaccccgtaggtgcaatgaggccgctctccgagtgcgcctccctccgctgctcccgtgcacttgaacgtggacgccgccccacactcggccccggcacctgaggtgtccgctctggggaggcg

SEQ ID NO: 70775 - DNA, 201 bp, Homo sapiens
  chr10:133984033-133984234
  hypo
ccccacagctgccctcggtgacatctgggacttggacatccatggacggcatccctggatggagccatttcctgggtactggacctggaggtgactcggagcttctcctgctcccagcgtgtgtccatgggggcggtcagggtagacaggccacaccgtcatcagggaggggcagccggccgccaacgtgcagactgtgtc

SEQ ID NO: 70776 - DNA, 277 bp, Homo sapiens
  chr10:133999776-134000053
  hyper
cgaggtcccgcccaccaccgcgtcccggtccctggggagcgcgtgcgcctccttctgtctctctctctctctctctctgtcctattcgggcccctcctgccctccgtctctcgcggccagcgtggaacagcctcgcggggtcacagcctggcgctcggaccctggcccgggtcatctgcgaaggagccggctttggccaaggtgccttcctggacgggtgtggttcccagagcgtcgcggcccggggttgactggctcggaatcccggggccttggg

SEQ ID NO: 70777 - DNA, 16 bp, Homo sapiens
  chr10:134000108-134000124
  hyper
cggggcctggcaggac

SEQ ID NO: 70778 - DNA, 301 bp, Homo sapiens
  chr10:134000125-134000426
  hyper
tggccggactctctccctcgcctccccggggtgcaaaccccgcgcacatcagctggagcaggttgaaatccccacccagcgctcgtccgcgggtctgcgcgggggcccggggtgcagagatcagaccctgcagcggttccagcgctgggggggctttaaagcgaaggagtggctgagggcgggggcggggctgatgggcggggtgaggcggggctcgggctggggcgggccctatcgggggcggggcctgccgggggcggagccggggtgggggcggggcccagcgggggcgggaccggaa

SEQ ID NO: 70779 - DNA, 211 bp, Homo sapiens; identical to SEQ ID NO: 33533
  chr10:134000529-134000740
  hyper

SEQ ID NO: 70780 - DNA, 150 bp, Homo sapiens
  chr10:134000798-134000948
  hyper
cgcagacccccttaaggagcggggcgcccaggcccggcccggcccggccctgcccggccctgccgggccctgccgggccctgcccggccttgcccggccttgccggcttccgggagcctcggctgcgcccggggagaacccggggccggg

SEQ ID NO: 70781 - DNA, 286 bp, Homo sapiens; identical to SEQ ID NO: 33535
  chr10:134001139-134001425
  hyper

SEQ ID NO: 70782 - DNA, 168 bp, Homo sapiens
  chr10:134010456-134010624
  hypo
aggtatatcccaggccgctgctggtgcaggcgcagccccacccaggacgccaccacttctcttcccagatgtacgagatcttcagcatcatccgggacctgggggccttggcccaggtgcacgctgagaacggggacatcgtggaggaggtgccgtggggcagggctg

SEQ ID NO: 70783 - DNA, 354 bp, Homo sapiens
  chr10:134012163-134012517
  hypo
cctacagcctgtacccgaggcccagaaggtggcgtgggcaggcccaggcactgagcccgaggctgggccgctcctactaggctgccctgagcctgggatcccatgggtgacacctgggcatccccattgcccacactggtctggagccccagggccctcgtgtggcctcatccctctcatctcgtccccaggtggaggctgaggcggtgtaccgagctgtcaccatcgccaagcaggcaaactgcccgctgtacgtcaccaaggtgatgagcaagggggcggccgacgccatcgctcaggccaagcgcagaggtgagcacccagccccgcctctgatgccgaggggccatggtc

SEQ ID NO: 70784 - DNA, 342 bp, Homo sapiens
  chr10:134014286-134014628
  hypo
tgacctggcctctgccggctcaggaaggccaggaccctctgaccctggcttgtttccagcggggacctccaggtgacaggcagcgcccactgcaccttcaccactgcccagaaggctgtgggcaaggacaacttcgcgctgatccccgagggcaccaacggcattgaggagcgcatgtcgatggtctgggagaaatgtgtggtgagcacaggcctggccggggcacgccgtctggggagcggctgtgggcgggattgtgatggctggtcagaagggagcccatctaaccagtgcacactcgtgaaacagatcagagcacacgggctccggggtggcggattc

SEQ ID NO: 70785 - DNA, 341 bp, Homo sapiens
  chr10:134016098-134016439
  hypo
actgttgggccccagcgtggaggcactggaccctcgggcctctctccccagaacgtggagtacaacatcttcgagggagtggagtgccggggagcgcctgccgtggtcataagtcagggccgagtggcgctggaggacgggaagatgtttgtcaccccgggggcgggccgcttcgtccctcggaaaacattcccggactttgtctacaagaggatcaaagctcgcaacagggtagggcggcacccgcaagggtgttgtgcaggtaggcaggtgggcgctgagttctaggcccagaacgcacccctggtcaacctggcccggcctcccgaggggtcaggaag

SEQ ID NO: 70786 - DNA, 152 bp, Homo sapiens
  chr10:134016763-134016915
  hypo
tcaggagctcagccacgggagccccccccccatggccttccagtctcttactgtggtgacgccacgcttgcccggcatcatccgtgtctgacggtgcagcaggtgtggtctccccagaccaccaggtgcttcacacacgcacaggggcactc

SEQ ID NO: 70787 - DNA, 48 bp, Homo sapiens
  chr10:134018023-134018071
  hypo
cagcctttcatcacccggaacccagagcagggacgaggcaggactggc

SEQ ID NO: 70788 - DNA, 30 bp, Homo sapiens; identical to SEQ ID NO: 42745
  chr10:134019334-134019364
  hypo

SEQ ID NO: 70789 - DNA, 328 bp, Homo sapiens
  chr10:134022624-134022952
  hypo
cgtgagcgtgggggacgctgtccaggttccgcccatgtcccctcaagtgagtgtctgggcatccccatcgggcctccacctgtggctttggatgacggcctctgggctattgaagtgccccggccctccagcagccagactgcccgggagctcgcatctctgcgggtgactcacccaagcccgaggatgccaaggcccagctcccttgcctctgggtggatggcttggacttgctccgtggggcctgcaggaccaggcagaagctgttctctgcgggactttgctggaaaccactcccttgccgggcctttcccgtctcataccgggt

SEQ ID NO: 70790 - DNA, 257 bp, Homo sapiens
  chr10:134040240-134040497
  hypo
aggctgcttcagccccgcccacctcagcaggtacctgcgccgtctgccacgcacacacctgtggatgatgtgctggccgcgcaggtagtccagagccagtgccatctcgcagatgtacagcctcaccgtgtcctcggagaactgcacgttctgctgcaggtggtagcgcaggtccccgcccagtagcaggtccacgaccatgaacatgtcctcctcgtcctggaaggagtacctgtgggcaccgatggaaggcctgt

SEQ ID NO: 70791 - DNA, 29 bp, Homo sapiens
  chr10:13404822-13404851
  hypo
gaaaagatctcaaaccggccgggcgcggt

SEQ ID NO: 70792 - DNA, 149 bp, Homo sapiens
  chr10:13405091-13405240
  hypo
cctaggcaacgaagcaagtctccgtctcaaaaaacaaaaaacaaaaagatctcacaccactgcgcggtggcagaacggaggcaggagacaggacttgaactcagtctagacagcaacgcaagggggcatctatgcgattgaccatggcc

SEQ ID NO: 70793 - DNA, 41 bp, Homo sapiens
  chr10:134058780-134058821
  hypo
tccacaacagagctgcgcgcagaagccggagggctaattcc

SEQ ID NO: 70794 - DNA, 63 bp, Homo sapiens
  chr10:134063725-134063788
  hypo
tgtgtgtgaggcgcccgggacaggtcactgcagagaggagccccaccccgagggcaggtgtgt

SEQ ID NO: 70795 - DNA, 30 bp, Homo sapiens
  chr10:134064125-134064155
  hypo
tgggtgtgaggtgcccgggacaggtcactg

SEQ ID NO: 70796 - DNA, 42 bp, Homo sapiens
  chr10:134066350-134066392
  hypo
tcccgctaagtgacccgagcgtggggccgcctcctcccaggt

SEQ ID NO: 70797 - DNA, 849 bp, Homo sapiens
  chr10:134093628-134094477
  hypo
tccactctgtgatcacgcccctgcactctgtgatcacgcccctgcactccgtgaccacgccacctgcgctccatgaccatgtccctgcactctgtgatcacgctgaggcctccacaccgtgaccacgcccctgcaccccgtgaccacgcccctgcaccccgtgaccacgcccctgcactccatgatcatgccactgcactccctgactatgctgaggcctccactccgtgaccatgcccctgcactccgtgatcacgacactccaccccgtgatcacgcacctccaccccctgatcacaccactgcactccgtgatcacgccactgcaccccatgatcacgcccctgcactccgtgatcatgccacctgtgctccatgaccatgtccctgcactccgtgatcacgctgaggcctccacaccgtgaccacgcccctgcaccccgtgaccacgcccctgcaccctgtgatcacgccactccactctgtgaccacgcccctgcactccgtgatcacgacactccactccatgatcaccacactccactccgtgatcacgcacctccactccgtgatcatgaacctccactccctgatcacacccctgcactcggtgatcacacccttgcattccatgatcactgaggcctccactctgtgatcacgccactgcaccccgtgatcacaccacctgcgctccatgaccatgtccctgcactccgtgatcacactgaggcctccatgccgtgaccacgcccctgcactccgtgaccacgcccctgcatcctgtgaccatgcccctgcactccatgatcacgccactgcactccctgactacgctgaggcctccat

SEQ ID NO: 70798 - DNA, 385 bp, Homo sapiens
  chr10:134095563-134095948
  hypo
aggcagcagcccagccgctccgggggtgggggcgacaggtgctgggcggggaggcgctacattgtgtaacactcagcagccacgctacacttgggaagagcggatgtgctgaaaatgcccagtgcaggaccaaggtgcgccaaccagcccgcaccacgcccgagaggcttcgcagccgcccaccccggctctcacagcgcccatccctgccacacgccctgccagctgcgccagcttccccaggccgtccagagtcgctgctggaactggaataaagtcctctctgagacagctcctgggtggtttcctgcagttttctggtggctgatgaagagggcagtgccaggcgtcagctacccacctgtgcctgcgcccacctgtacct

SEQ ID NO: 70799 - DNA, 17 bp, Homo sapiens
  chr10:134099613-134099630
  hypo
agcgagactctgtctca

SEQ ID NO: 70800 - DNA, 30 bp, Homo sapiens; identical to SEQ ID NO: 42751
  chr10:134118399-134118429
  hypo

SEQ ID NO: 70801 - DNA, 132 bp, Homo sapiens
  chr10:134119982-134120114
  hypo
cacaccatgaatccccggtgccgtctcccggaggaacggcggtgcacggccccacactcaccaacgccggcctgaggtcgtattactgtaatttcccataatgcttaaattatttatcgcaagtaaatagcc

SEQ ID NO: 70802 - DNA, 308 bp, Homo sapiens
  chr10:134120706-134121014
  hyper
actgcaaagtacaaacgagcccgcacgtgggcccgagcggatcacggaaagcggaaagcagggctgccacgggcggtgggcggaggcgcgcgcaagcccggagacgccacagccgcgggggaccctcgccccgagggcccgggcccagcctgctcctcctgcggcgccgccactagaaacggaggacgcgggcgggcgcccagaactcgcgtggggccgcagccacccggcgcgagcttctccggaagccggggcgccccgggaagccgtcccggacaccgggggaacccctgcgggaaaaagccgcc

SEQ ID NO: 70803 - DNA, 658 bp, Homo sapiens
  chr10:134121693-134122351
  hyper
atgggggctgtggttcgccgggacacggggaccacggctcagactagacggcgggtacgagagcgagggaggcagggagcgtccccacgggtatcctggggccccggaggtcggcgtccctggcacggggactgctgtgcccggcacggcggcgggaccttctcgcggtctccgggggcctccctcccctgccttcttcgtgaaaacagccggcgcgcgggcttccgccgcccagtgcggggagccctaaactccagccttctgctttgcgcagggtgaggccgggctgcaggcccgggatgcgggcggcgggaatctgccgggcagagcccggctcacggtcaggaggcggcaggctgagtccaagcgctgcgccagagggtggggtggggcagggcgggcctggctgcgcgcgcgcacacgcgggcgcctggggtgggcgctaagccctgagcacgtgcgcccgcgctctcgggcacccccgtgccatcctcgcgacccccgtccggcctgagaccgcgtgcccgagtcgcccagggtccccttgtccagatgcgacaggggcctcggcactcggcgtatttcggaggcctggggcgcggcttgacctccgggcacctctgcccctgcgcagggccaggcgcgaccttgcgcggaa

SEQ ID NO: 70804 - DNA, 230 bp, Homo sapiens; identical to SEQ ID NO: 42752
  chr10:134123040-134123270
  hypo

SEQ ID NO: 70805 - DNA, 30 bp, Homo sapiens
  chr10:134126884-134126914
  hypo
tccacacgggccacacgacagacatttgcc

SEQ ID NO: 70806 - DNA, 37 bp, Homo sapiens
  chr10:134209613-134209650
  hyper
cccgcctccaggcctcgtcaggcgctgcaagtccggc

SEQ ID NO: 70807 - DNA, 30 bp, Homo sapiens
  chr10:134232907-134232937
  hypo
gggaggagcacctggcggggagccttgggg

SEQ ID NO: 70808 - DNA, 24 bp, Homo sapiens
  chr10:13426145-13426169
  hypo
cgcgcccagcggagtatggtagac

SEQ ID NO: 70809 - DNA, 237 bp, Homo sapiens
  chr10:134272641-134272878
  hypo
ccagggcagggcagccgctttgcacacagtctgggagtctggccctccctgttcctggaagagcctgggctgtgaacttttaaactgggcaaggtgtgactggagggtgtgccgcagtgggagaggacacagggcagggtgtgactggagggtgtgccgcagtgagcgaggacacaggggtctcccattgatctcggcccccggcatggctccccgcaccaccgcagaccggccgtg

SEQ ID NO: 70810 - DNA, 30 bp, Homo sapiens
  chr10:134281135-134281165
  hypo
aagccagcctctgcccgggccgaggctgcc

SEQ ID NO: 70811 - DNA, 145 bp, Homo sapiens
  chr10:134292484-134292629
  hypo
gtgtcagcagggccacgctccctccgaagcctctgtccctcaggggggacccttccttgactctgccggctcccggtggctcctggcgttcctgggcgtgtgcctgcatcaccccagccatgccttctcacggactcctctctgt

SEQ ID NO: 70812 - DNA, 299 bp, Homo sapiens; identical to SEQ ID NO: 42755
  chr10:134301017-134301316
  hypo

SEQ ID NO: 70813 - DNA, 30 bp, Homo sapiens
  chr10:134316646-134316676
  hypo
aagggtcactgtgcacgagggcgtccgggg

SEQ ID NO: 70814 - DNA, 37 bp, Homo sapiens
  chr10:134341480-134341517
  hypo
acaacagtgaccccccgccccccggggccatgggaag

SEQ ID NO: 70815 - DNA, 371 bp, Homo sapiens; identical to SEQ ID NO: 42758
  chr10:134481125-134481496
  hypo

SEQ ID NO: 70816 - DNA, 36 bp, Homo sapiens
  chr10:134489067-134489103
  hypo
ttccaggggccttgccgtgcccgggagagtgagggt

SEQ ID NO: 70817 - DNA, 205 bp, Homo sapiens
  chr10:134499328-134499533
  hypo
tttgcaaagtgggcccgctatcagaattcagctcccgaaatcaagctaagtgacacggtgtggccatttatcacattaccggactccaattgaagttgagaggttgttttaatagcatttgtaaatactccatcttcactagccgcccctgtgagaggcactgagcccccatggtacgcagggttcgttgcgccctggtcgccag

SEQ ID NO: 70818 - DNA, 30 bp, Homo sapiens
  chr10:134516665-134516695
  hypo
gacacctgtcccggtcgcttggtgattgca

SEQ ID NO: 70819 - DNA, 167 bp, Homo sapiens; identical to SEQ ID NO: 42760
  chr10:134518611-134518778
  hypo

SEQ ID NO: 70820 - DNA, 60 bp, Homo sapiens; identical to SEQ ID NO: 42761
  chr10:134542152-134542212
  hypo

SEQ ID NO: 70821 - DNA, 127 bp, Homo sapiens
  chr10:134557418-134557545
  hypo
cagaccatggctgagcgtgtggtcccgaattccatccttggaacagaggaagtttttgttatgagaaagaactccagccacagcggatttgcacctgcaggtctgtgtcttgcgacacttaagggcc

SEQ ID NO: 70822 - DNA, 64 bp, Homo sapiens
  chr10:134562719-134562783
  hypo
cgagcctgctggtgtcgcactggcttttgccccaaagcagctctgtgggcggcagcagctccgg

SEQ ID NO: 70823 - DNA, 30 bp, Homo sapiens
  chr10:134565567-134565597
  hypo
gcgtctgggtggaggcgggtgcccaggagg

SEQ ID NO: 70824 - DNA, 196 bp, Homo sapiens
  chr10:134566161-134566357
  hypo
tggaggggcacggggcgtggagggggtgcggcatggagggggtgcggcgtggaggcggtgcggcatggaggggtgtgtctagagcatctgggagcaattgtctttcatgtggatccaaagtcctccttttctctcagcattttgacacagagcacgcccctgctgtcggtagccaccataccgtacagtgtttcct

SEQ ID NO: 70825 - DNA, 142 bp, Homo sapiens
  chr10:134581976-134582118
  hypo
ggtgagatcagcttccgctttcccgctgcgtctgccctggcggggggtcccgagtgcctctgcgtgccaggctcgtccacctgccgcctcacactcttccccgtgcagctctgcccctgtcaggacacgttggccttcctgt

SEQ ID NO: 70826 - DNA, 30 bp, Homo sapiens
  chr10:134589397-134589427
  hypo
gagggagaactggttcggttccagcttcct

SEQ ID NO: 70827 - DNA, 4 bp, Homo sapiens
  chr10:134598087-134598091
  hyper
gtcc

SEQ ID NO: 70828 - DNA, 167 bp, Homo sapiens
  chr10:134598367-134598534
  hyper
ggggccgcccccggattctgcaaaaatagattcgcccccaccccgcgggtcctcacaaggcgtcccccgcgccgccgccgcacgggctgaccagcgccaagttcgagggtttgtgcttcttgagcagccgcgtgatcttctcgtcgtccgagttggggtccaggggc

SEQ ID NO: 70829 - DNA, 115 bp, Homo sapiens; identical to SEQ ID NO: 33540
  chr10:134599431-134599546
  hyper

SEQ ID NO: 70830 - DNA, 309 bp, Homo sapiens
  chr10:134599708-134600017
  hyper
gctgattggctgcggaccccgcggtccggccattggccggcgccccccccccgcccgcgcgcccccgccggccgcgcactccatgaagggcccattagcgcggcaggtgcctcccgggctgtaaattcgccccgatttatctccccggggacgaaataaatccagcttggatgggagtgtagttaggcaaaggttttcatgcgaaatcaggaaaaaatacgagaacgtattttattaacggaaagaatgcagatttgaggacccgcccgcgcgctcggagcgccccactcggggaagagtcccggcccg

SEQ ID NO: 70831 - DNA, 936 bp, Homo sapiens
  chr10:134600037-134600973
  hyper
cgccgcccgtggctggggtgggtgtgagcggcagcggacgccggcggggaacgcgctccgggcaggtcggggccacaggagggcggaggacgcgggcctcgagtccacggaatccacgggcctcacggccgggcgaggctcgcacggagctgcctctggtttcgccgacacgcggccggcgcggtggaggagtgaggcaggcgggagcggggcggggaggcgggtcccgggaccacacgcgcggctcggcacttccccgtcatcggcctccaggtctcccgctgggggtcccccaggatgtgacctgggcccacgacttcgcccacgggccgcctctcgcgaatccccggccgggagaacagagaccaggacggcctcagcgcggaagccctgtccagggcccgaacgtgggtgcgggctgggggcgcagcggcagaaacgcggccttagacgcgcgcggggggccggtgtcccccccgcccccacggcaccgggagccgctcgctcatccatcccgcagaccgggcggtgagatgactccgagccccgcgcacggcggccgcgagcaaacgctccgacgtctgtggtgacgtctcgtattgatttagggacacggggcggctgtggctgtggcccacggctcgtggggagcccgagtctgtgcgcagggaacgccgctgcgtggcctctctcgggcctgtgccgcggaggaaggcggcgcccggggttcggggccggggtctcacgtccgccccctcgcccccctccagcgtccgttttcgttttgtgcaggtcgaggcggggacttggcgccgtcggccgctcctggatggcggcttggaaaagccacctgcggccaaactccggggcagtggtgcggccgccgggtgtgtgcgcgctcggggctgccccggcggcttccggctccactgaggt

SEQ ID NO: 70832 - DNA, 512 bp, Homo sapiens
  chr10:134601204-134601716
  hyper
cccagcaccccaaggcgacggcgcccgcgcccaaggctcgggctctgagctgagacgcgggaactgcggggccggggggggcgggcagggggagttgggggcgggggctgctgtcgccctgggatcccccactctgcgcggccgggcagaccctgggcgggccgggaggggtgcgggtcgcccgaactgaggcccaggaggcgcgcgcgggcggaacggcgggaggaagccgcgctcgggacaggctctggctcttctcacagcctggaggggcggggcagggggcgtcgctagcgctgttttatggctgaggaaacatggacctggaggcgctgcgctgcggcccgataaaccctgggtctgtctgcgccccccggtcctccctgggctgccgagggaacgcgtggggtcgcgggtggggctggcgtgtcactggctgcggagcgcgcggctctccagggctcaggggcgcgggatgaggggccagggtgagttgggggcgcagaggagcc

SEQ ID NO: 70833 - DNA, 287 bp, Homo sapiens
  chr10:134602127-134602414
  hyper
cggcgccgacgctccgcgctggaaaaccgagagcgcggggtttggcagaggccattcaagtttgttttactcgttcagcctgtatttgtggggctcctaccgcgcccgggctgtccggggggtgcaccgtgaacgcagcgggctccggcccgggcgcgggcgggtcagagcagcaaacgcgctcccccggcacccccgcggcgtctgcaggggagcgggcgacggggaggacggcgggggtgtcggcccggaaggagagccggcctaggccccggtgtccccgcgct

SEQ ID NO: 70834 - DNA, 364 bp, Homo sapiens
  chr10:134607832-134608196
  hypo
agtggcctcggcagccgtgtctgcgtgacagaagccgagcgtgggacggctccagctcaggactgtctgagccccaccctgcgagggtgctctgagctctcagggcgttgcttctttgcccatttatcccgggtcttgggtgagttccagtggcggacagagctcagacaagagcagtgctcgcagcagcgccagcagggacagtggcaatacgagggtcacaggtgtgatcggaggccgccagcctgtgctgggtcaccgtgcggtgccagtgaaggtgccctctgcccaggagctgtgggggagccgggggtgccgccaggacgcagtgtgggtcgctgggaagacccgaaagaggggagga

SEQ ID NO: 70835 - DNA, 387 bp, Homo sapiens
  chr10:134610574-134610961
  hypo
ccctcagcctcccaacgcccctgcgcccgttctcactggcacggctcagtgtccacaccgggccagcagcgcaggaactggaggctctgcttcgtgatttccgcagtggcagatgacaggaatcaggttcctgcgggtggcagcggatgggggtgcagaactgcctttttgctgtttgcctgtttaccctctttgtgcccgcgccaaggtgggagccgctacacccagggaggcgctggagcgtgtgcggaggtcagagcctgatgccgcctcggtctctgggtgccggggcagccattccttcaaacaatggggtgcttccaaaccggtgcctcgtgaggaattgggaaagacaggagattgtcatcatcacgagagacaaaaccc

SEQ ID NO: 70836 - DNA, 30 bp, Homo sapiens
  chr10:134611744-134611774
  hypo
gatcctgaggtgggccgaggcggctgggct

SEQ ID NO: 70837 - DNA, 32 bp, Homo sapiens
  chr10:134613038-134613070
  hypo
ctgagcccgggacaccgcgcctgagccaggga

SEQ ID NO: 70838 - DNA, 60 bp, Homo sapiens
  chr10:134621273-134621333
  hypo
ccggccttcccatggcgagtcccaggctgaagaaacagccccacgcggccccacgcagag

SEQ ID NO: 70839 - DNA, 102 bp, Homo sapiens
  chr10:134623057-134623159
  hypo
taagctcctggtgagcggtggatactgaaggcctctgggggaagccttcttagtcagggcagaccaccccctccgtgcaccgctgagcgcctcaactcaggg

SEQ ID NO: 70840 - DNA, 81 bp, Homo sapiens
  chr10:134624068-134624149
  hypo
gatgccaggggcccacgcactttcccataagacgctggcccgcagcgcgttgtcctgcagcagcgtcggccactggtttgc

SEQ ID NO: 70841 - DNA, 42 bp, Homo sapiens
  chr10:134626641-134626683
  hypo
acacccctactcgggcggggctcgctgcgggaaacgctagga

SEQ ID NO: 70842 - DNA, 142 bp, Homo sapiens
  chr10:134629717-134629859
  hypo
cgtttctggcgttctcggttgctcttctctgtggcatctctgtttccctggcgtcttctgcatgttctcctctgctcacctggggatcattctgcctccttgctctgacttcttctttttttttttttttttttttgagacg

SEQ ID NO: 70843 - DNA, 37 bp, Homo sapiens
  chr10:134640686-134640723
  hypo
agacacaaccccacacggtgctcgtcaggggaaggca

SEQ ID NO: 70844 - DNA, 123 bp, Homo sapiens
  chr10:134647633-134647756
  hypo
gtcaggttatatattcgggtttaagaaacagagataacaaacgcttggaatataggcgacacctgctcagcctgtttcactctaaggcagcagcaccacgaatccccacgctcacttctgggg

SEQ ID NO: 70845 - DNA, 57 bp, Homo sapiens; identical to SEQ ID NO: 42767
  chr10:134648015-134648072
  hypo

SEQ ID NO: 70846 - DNA, 30 bp, Homo sapiens
  chr10:134651763-134651793
  hypo
tgggcagccctccatcgagctgtgaggctt

SEQ ID NO: 70847 - DNA, 74 bp, Homo sapiens
  chr10:134659532-134659606
  hypo
aggttcagcggcatccgtgcccgcttaccttggacacggcggccagcctctgctccacacgggcgcccaggctg

SEQ ID NO: 70848 - DNA, 87 bp, Homo sapiens; identical to SEQ ID NO: 42768
  chr10:134662545-134662632
  hypo

SEQ ID NO: 70849 - DNA, 55 bp, Homo sapiens
  chr10:134663367-134663422
  hypo
ccccaggtccctgtgcggggcctggccagagccgctgctgcgggacacaccagtt

SEQ ID NO: 70850 - DNA, 193 bp, Homo sapiens
  chr10:134664613-134664806
  hypo
caattaccaggccgacggaagtgtagtcactggtgttctgcagatagtccgccagcagcttctccagggacccctgctcactctgctgcccgtgggcctcctcccagatgaactggagcatgtccagagccatttccacgaggccgagcttgaggcgcgccagcttcctcatcaggggcgtgttgacgttctg

SEQ ID NO: 70851 - DNA, 406 bp, Homo sapiens
  chr10:134665007-134665413
  hypo
atccccaaatctcttcgcgtcccctcatgttccctcccggtcacctagctgcctgccggcaccctgcattccttggcattttccagaaccgtacctaagtggaggcgcacagagtgctgtctttccgtctggttcattttcctcggtaaagtcaccgtgagactcccccacgcggctgcacgcatgctccttccctctcacagccggcgtcggtgcaccgtgtgcacgcgccacaccctgcttatctattcaaatattttatttccagttctggggctactaccaataaagctgctgccaacattcatgtgcaaggtatccacagatcctgatccacagacgtggtatgttcctccatttacttaggaattctcagatcctgatccacagacgtggtatgttcctc

SEQ ID NO: 70852 - DNA, 153 bp, Homo sapiens
  chr10:134671588-134671741
  hypo
tgcaaggacaatgtacgacatccacagtaacagacacggctcaggtcagaccttgtggtgggttatgcttccctcgcgcaggcttctacacgcccgcactgggcccgccgtgtcgagacgcttgcgtgtggacaagtccgggggccataggtt

SEQ ID NO: 70853 - DNA, 128 bp, Homo sapiens
  chr10:134672396-134672524
  hypo
ggcatgtgatcagaacgtgtgggtgaggcggcagccgagagcttcccaggggagggtcctgtggaccccgcgggggtgcagccggggtgagccaggcccagaaggcaggatggcgctgggcgtgttgt

SEQ ID NO: 70854 - DNA, 315 bp, Homo sapiens
  chr10:134676338-134676653
  hyper
gagggtgaggaggggcgggaggggagggcagcacatggaggcaggctttctgtggtgtggatgtggctgagaagccagggtgagctgagggcaaagttgaggacgggaggtaggaggccttcaggcaagagggcgggaaagatcaaggaaacaaacaacttcctgtcagaagcgcctgctgtgaaacaaagtccctgcaaaacagcggctgcaggaaggagggtggcgaacccacgttcgcgggagtccagcacccatcacgtctgtcctgggtctgggctccaaggtccacggtggccccgggtatgaggcagg

SEQ ID NO: 70855 - DNA, 52 bp, Homo sapiens
  chr10:134679419-134679471
  hypo
cctgctagagctgaacgctacagcccaagcttctgcccgcagtccctccact

SEQ ID NO: 70856 - DNA, 30 bp, Homo sapiens
  chr10:134679999-134680029
  hypo
ccccttgccccacctcgtggtgccgaacaa

SEQ ID NO: 70857 - DNA, 230 bp, Homo sapiens
  chr10:134682617-134682847
  hypo
acgacccaggagaaccggccacagccgtgtcccccaagtgctcactctccccagaggggcaggagtccagggaagagggtggccgcgcagctggctttcacctggccgcaccaagggcgagactcaaaccccaggcggcgcagggtgggacggcacacacctggcctgctccagctcgctgacgcacacctgcccgaccgcctcttcatggcgcgcggctgcttctctca

SEQ ID NO: 70858 - DNA, 56 bp, Homo sapiens
  chr10:134683657-134683713
  hypo
gggcaccatcagccacgcccatatgagacggtgaactgagtcgataaatgtcccgt

SEQ ID NO: 70859 - DNA, 41 bp, Homo sapiens
  chr10:134684038-134684079
  hypo
acgagaaggtggagccgcctcagtgccggtatgaaaaagtt

SEQ ID NO: 70860 - DNA, 65 bp, Homo sapiens
  chr10:134690483-134690548
  hypo
aggatttacctgaaacggtggaggtgaaacagcagacacccccggcccaccggcatggctgtgca

SEQ ID NO: 70861 - DNA, 164 bp, Homo sapiens
  chr10:134692244-134692408
  hypo
ttcctgctctgcccacggctgggcggtggccctcttgatcctgagatgccctatgggggctccgggcaaactcatcctcagaagaaaggcctgccatgcctggcgctgccctgctggggtgtagcctgcgggaggcctagacagacgcacggggaggcccccga

SEQ ID NO: 70862 - DNA, 183 bp, Homo sapiens
  chr10:134693583-134693766
  hypo
gatggccctgctgtgcgcacgtgtgtgtgtgtgcatgtatgtgtgtgtgtgtgtgtggagtggccaccctagctgggctctgccggcctctgctcttcacggcaggactgccgagccaccccatgggactctccgtgcgcacctgcgctccccacagagtttctgccccgggtcaccctgggc

SEQ ID NO: 70863 - DNA, 60 bp, Homo sapiens
  chr10:134699346-134699406
  hypo
gcacctgcacagcctcgtccagcaccttgaggccgccctcccagtcgtcctggtcggcat

SEQ ID NO: 70864 - DNA, 425 bp, Homo sapiens
  chr10:134699648-134700073
  hypo
cccacagtggccacccgggatgccctttccgttgcaggaagcagctgtcttgtctccttgctgcctgtcactctccatctccttggagaattctgcgttcacaaacacagacctgtgtttccacgtattaaagattggcgagcaggacttggggtcctttcaggagttgcatggaaagctcccccgcggccgaggacacagcgccacgtgcacgctcgggagtcctcatgcttggtgcccgcagcacgggaacaatccccgagtctccacgcaggcagcggagccatgtgacacgcagaggcaaaggtgcctgccttcagggcacacacaaaaatcgcctgcctgccgggaggtgagccccacccagcctccatagggcgccctgtgggccatcagtgcccccaaatgcacgaagccagcagggt

SEQ ID NO: 70865 - DNA, 99 bp, Homo sapiens
  chr10:134720606-134720705
  hypo
tgtgggaagatggggcgtgggcctggggcgctccttgcctccggcaggtgctgcccacgctggccatttggccacagaaaacatcgttacagcctttgg

SEQ ID NO: 70866 - DNA, 70 bp, Homo sapiens
  chr10:134726229-134726299
  hypo
atttcctggacttctcggcagcctggactggaatccagctgatgatcaggcctcgcgccaaggtgttgca

SEQ ID NO: 70867 - DNA, 63 bp, Homo sapiens
  chr10:134729962-134730025
  hypo
gggtgtccctccccacgccagcctgagtgcaggggacactctgacccacggccccgggcggtg

SEQ ID NO: 70868 - DNA, 170 bp, Homo sapiens
  chr10:134730580-134730750
  hypo
catgtggcacagccccgtggccgccgctggctctggttctgccatgtggcctccggctccctgagcagagagttctgtgccgcttctcaccctgaccccagctgagggcatgggcctggcacctgggagccactcagcagacatactgcctaaatcggcaggtgccctgt

SEQ ID NO: 70869 - DNA, 30 bp, Homo sapiens
  chr10:134730962-134730992
  hypo
gagtctctgagcctgcgtgggaggaacagg

SEQ ID NO: 70870 - DNA, 177 bp, Homo sapiens; identical to SEQ ID NO: 42783
  chr10:134731838-134732015
  hypo

SEQ ID NO: 70871 - DNA, 1043 bp, Homo sapiens
  chr10:134732792-134733835
  hypo
acacactcgtgagggcgggtacgaacctcgccgcagcctcaacttcttcaccttgacgttgtcatacaggaggcagaagcggctcgccgtccgacagacgtcccacacgccttgtttccgggccactttggccagctctgcccaaatctgtatcctgctcaccgagaacccaaacgagtgaaaggtgagtagacaagtgtggttgctgaagttagaaaacacctgggctggctgcctgagaaaaggccactgtggctctgcagtttcaaggtggcaaggagcccggcactcgcgctgggtacggcctggcgggtgcatgtcccagggtcgggcgcagctctccgctctccctgccagccagctgtgcgcggcacctcccttccctgtggtgagaagaaaggccacacaatccactccccgggggagtgcacgggacaggcctcccggggatggtaccgaccgcagggtcggtaccaaaaatcagcctgctctggtcacaggcgctgcgtgtcctccgagtgacagcagtgacaggcgggacagggcagccgcacacctcataggccgtggctgtcatcacaggctggggggtcccgtctgtggcgggactcccaggcagggacctcgtcccaccatcctggagcaggtggcctggcgagtccccagacggccacatgcagggtcagctcagccgccacagacactggccctcgggctgagcgacccccgggctgagctgtgcgtggcgctctggccttttcctcactcacctctccttgtcgttttcgttgcccaggcgccgcaggtgcccggcagctttgtccacgctgacggtgtggtgccacgccttcgcacagaggtaggtgaaccggcccctgttcttcccggtggagactgagggcggaaatgcaaaggcaggtgttgcagctgctggccaagggccggggacgtgcccatcagtaaccaatgccctgcgccggcgccggggtggccacccacaggtagcggctccaggggccctagatccccggctcccagaagcc

SEQ ID NO: 70872 - DNA, 205 bp, Homo sapiens
  chr10:134734065-134734270
  hypo
ggtttatccgcatgacgccagatgttccgaatcaccgctccttttcctggcaaataatcacgagcacccggaactcagctccacaccctggggggcctcctgtgcatgggcgaccccgggggctgggcctcccctggctggtgtccaccctctcggccagcacaggggttcaccttcaggagccactcaacggcatcctcccctg

SEQ ID NO: 70873 - DNA, 339 bp, Homo sapiens
  chr10:134734696-134735035
  hypo
gtgctgggtgaaagccgccggctgctgggcactgagctggagggaggcctggcagcagcccccagcaggaccctcaggggaccagcgggaagggctcccaagccaggcccagcctggcccctgcactgggctggagagagtggggccgcctgcgttcccagagccactggcgagtgcccagagaagctcgggcagtgaggatgcaacacacctgccgaaccctggctcagtccccgcacatgggccgtacggccccgtgtcccattacccaaagccagctcagggtctccctgggacagatgtgatggcttcagctttgacccccgtgatccagggagc

SEQ ID NO: 70874 - DNA, 30 bp, Homo sapiens
  chr10:134735976-134736006
  hypo
gcggcacctgctcaacggccatgatggcct

SEQ ID NO: 70875 - DNA, 543 bp, Homo sapiens; identical to SEQ ID NO: 42786
  chr10:134738145-134738688
  hypo

SEQ ID NO: 70876 - DNA, 286 bp, Homo sapiens
  chr10:134739166-134739452
  hypo
cagtcaaaaacctcccgcgagaagctcagccccacggaggcagacccaggagcaagtccacagcggcatcggcacccgccgggctgtgacacgtgtgccaggcagtgcgggctgaggatggatgcgttaggagtggggatggggaaggcctcccagctgccgtgctcatcccctgccacggcacctctggcactgacccgcacgcccctggctcctctgtacccagcggagcctcgcactgcctggctgacagggcctgagggttcccagccgaccctgtggcact

SEQ ID NO: 70877 - DNA, 37 bp, Homo sapiens
  chr10:134739723-134739760
  hypo
catgggacgcgtggccgtcccccgtcctcccaggcag

SEQ ID NO: 70878 - DNA, 53 bp, Homo sapiens
  chr10:134740858-134740911
  hypo
ggcggcagacgcctccgtcccggggagcaggtcctcggcggcagacgcctccg

SEQ ID NO: 70879 - DNA, 34 bp, Homo sapiens
  chr10:134754790-134754824
  hypo
gcctgtgctccagcacgcccgccccaccccagct

SEQ ID NO: 70880 - DNA, 332 bp, Homo sapiens
  chr10:134755846-134756178
  hyper
tgggatgagagggtccggggcctccccggggcgggggtcgtggcgggtcccggggcctccccggggcgggggtcgtggcgggcctggggtcaccttgctggctctcggcgcgggccagctcctgcgtgatgaccaggtccatggcgccggcgccctgctcgtccgctctctccggggtccgcggtgcgtcctgccgcccactgtcggttgggttctccagccgcgaggacccggccacggttgcctggagaccgaaagggacgcggacgcggggctacgggtcggcggcggggccacacttcggggaaggcgaacaacgccgcgcccccgcc

SEQ ID NO: 70881 - DNA, 30 bp, Homo sapiens; identical to SEQ ID NO: 42788
  chr10:134757661-134757691
  hypo

SEQ ID NO: 70882 - DNA, 30 bp, Homo sapiens
  chr10:134771907-134771937
  hypo
cctgtgggttgacagcgaggcccggagcac

SEQ ID NO: 70883 - DNA, 179 bp, Homo sapiens
  chr10:134772301-134772480
  hypo
aggtgacaggctgtgcggagccgtggggccctccccctgggatacctgctgacaccaggctgggcagggcccttcggaaggcgagtgggaggacccaggagctcctgctcctgagcccagggtcacctttagggagcactttggggggtcagttgtgcaccttccggaaggaggcagcg

SEQ ID NO: 70884 - DNA, 30 bp, Homo sapiens
  chr10:134773161-134773191
  hypo
agaccgacaggtgggcgctggaggcaacat

SEQ ID NO: 70885 - DNA, 147 bp, Homo sapiens
  chr10:134773880-134774027
  hypo
aggtccctgggccctcgccatgccccaaactggcagccatacagaggacgccccgcatgcaggtggggacccacaatcaggcccccggggcaggtgggcacctgggtggaggccacggctttctcacctggacggggactaaggagg

SEQ ID NO: 70886 - DNA, 33 bp, Homo sapiens
  chr10:134777879-134777912
  hypo
tcacagcccagcagccggcggcctgtccatgat

SEQ ID NO: 70887 - DNA, 90 bp, Homo sapiens
  chr10:134787026-134787116
  hypo
gctcatgcccctgtccggaggcccagcccagcccagcacacacaaagccaggcgtcagggctcaggcacagagcacggccatggccagat

SEQ ID NO: 70888 - DNA, 87 bp, Homo sapiens
  chr10:134788030-134788117
  hypo
cccgggagaggtggacgctgtctgcacctgcctctccccaacgcgccctgcccgggagaggtggatgccgcccgcacctgcctctcc

SEQ ID NO: 70889 - DNA, 30 bp, Homo sapiens
  chr10:134789538-134789568
  hypo
ttccttcctggatttcgacaatgtggatgc

SEQ ID NO: 70890 - DNA, 36 bp, Homo sapiens
  chr10:134793932-134793968
  hypo
cccgcaagtgcccagcgagtgcccggcgaatgccca

SEQ ID NO: 70891 - DNA, 98 bp, Homo sapiens
  chr10:134794346-134794444
  hypo
gcccagcgagtgcccggtgagtgcccagcgaatggaggctcctcgggtaacacgcgtggacccaggcacaatacaaagtcaaccgcccggggctctag

SEQ ID NO: 70892 - DNA, 54 bp, Homo sapiens
  chr10:134794878-134794932
  hypo
gctgcctgagaaaagcgaccacatctggggctgtgcccccgcccgacaagccca

SEQ ID NO: 70893 - DNA, 176 bp, Homo sapiens
  chr10:134795866-134796042
  hypo
ctggaatgaaacccacgtgggcagtcccacgagcaacacgccagcgccccaaggctggccacgggcaggacgcagagacagacgcgtcattagagcatgggcgcggcgtgtccgtggcacgtgaggccccgggccctgcctttgctttcggtctctgtgcacgctgcctcctgacc

SEQ ID NO: 70894 - DNA, 161 bp, Homo sapiens
  chr10:134797569-134797730
  hypo
ggctgctgaatctcacggcagctccgagtttaattctcggacgaggctctctgtcagtcgcgcgtgaccgcgtgggctcaggcgtctgtgcgagttgctgcgcgcgtgtgggtgtgcggccgacgtaagctcgtctgcgtccctcccgtttagtgcccggg

SEQ ID NO: 70895 - DNA, 41 bp, Homo sapiens
  chr10:134800646-134800687
  hypo
cgtgatctgattctgcgaaaattacccgagaatgtcaggat

SEQ ID NO: 70896 - DNA, 30 bp, Homo sapiens
  chr10:134806473-134806503
  hypo
ccccgaacgcagcctcgtgctgtgatgacc

SEQ ID NO: 70897 - DNA, 51 bp, Homo sapiens
  chr10:134807256-134807307
  hypo
cagcgtcgcacactgcgtggacttttaactgcccgtcgggatgctttgcag

SEQ ID NO: 70898 - DNA, 54 bp, Homo sapiens
  chr10:134809821-134809875
  hypo
ccctgattctttccacgacccctctgattttttcaacgccgacctcccctaggt

SEQ ID NO: 70899 - DNA, 30 bp, Homo sapiens
  chr10:134818621-134818651
  hypo
gcctctagccccagacgaggctgcatcatc

SEQ ID NO: 70900 - DNA, 30 bp, Homo sapiens
  chr10:134823987-134824017
  hypo
ctggaggtccctccccgaaggtctgtctca

SEQ ID NO: 70901 - DNA, 119 bp, Homo sapiens
  chr10:134826512-134826631
  hypo
acccagggtgccccccgccgaccgttacccgccctttgccccaaggctgtctttgaggtcggtctttctggggctgtggcccaaatgaagtcaagagacagcatcgggcgttgactgtc

SEQ ID NO: 70902 - DNA, 37 bp, Homo sapiens
  chr10:134830634-134830671
  hypo
cgctccccgtcgccacggtccccgtcgccacgctccc

SEQ ID NO: 70903 - DNA, 87 bp, Homo sapiens
  chr10:134832028-134832115
  hypo
cacggatgccacatacgggtctagtaggacagcgggacccgcagggagcgtggtgacagagaccgtggtgaccgggaccgtgtgcag

SEQ ID NO: 70904 - DNA, 30 bp, Homo sapiens
  chr10:134833453-134833483
  hypo
cagcacctgtccatgcgtcactaacccaag

SEQ ID NO: 70905 - DNA, 84 bp, Homo sapiens
  chr10:134834266-134834350
  hypo
tgccacccttctgcccgaagggacagccaccttccccctcaagagacggcgaccttctcccccaggggacggccaccttctccc

SEQ ID NO: 70906 - DNA, 395 bp, Homo sapiens
  chr10:134834562-134834957
  hypo
gtgcttctgtgggaacgcgtgtttccagttccaaaaagccaaccaaatgctcagaacctccccctgggctggttggtgtgattgagactggtcgctccagtctgcacctgtctgcggtgacggccgcccttcccgtcagcccctccgcggtcccggccccagccctgggttgagggagggctggggaggagcagggacagacgggcaggcaccaggacgctggctgctgcgtgaatgtcacctgtggtcacggccgacgcccggcgggcctgggcatggagtcaggaccggaaagcgaggccggcagcagcaccagctcctcagcaaggcccccgctgccgactgggcacgggcactccaaggggacgcctggcacgtgccgggatccacgcgcg

SEQ ID NO: 70907 - DNA, 30 bp, Homo sapiens
  chr10:134837231-134837261
  hypo
tgttccaggccacagcggaaggaggtgggg

SEQ ID NO: 70908 - DNA, 103 bp, Homo sapiens
  chr10:134855666-134855769
  hypo
ggaaggcagggtctgggaaggcagagtccggtaaggctgggtccgggaaggctggggtccgtggggatgggcagggtctgtggggacacgcagggtgtcccac

SEQ ID NO: 70909 - DNA, 30 bp, Homo sapiens
  chr10:134860784-134860814
  hypo
acgtgtcctcccaggcgtccccccaggcat

SEQ ID NO: 70910 - DNA, 30 bp, Homo sapiens
  chr10:134863667-134863697
  hypo
attcagcccagcttccggggccgtgatggc

SEQ ID NO: 70911 - DNA, 343 bp, Homo sapiens
  chr10:134875810-134876153
  hypo
ctcagtgattcaacacgttaagtaacgtgtcacgtgcctgctggccaccaccgtccgctcctgggaagaacctgttgactcagctgccgttttacctggatcatccgtcatctttctctcgagatagagttctccaggctttctggacccggacacacatggcaacacgccctgcagacaacctttcccaaagccacggcttactttgtaactcatcatggtgccttttaataatcaaaaattcctaattttaatgaagtccaatattcctgatgtttctttacaaacagttctttttatgccttctttttaaaaatctttgtctttgcgagtcctcaaagat

SEQ ID NO: 70912 - DNA, 258 bp, Homo sapiens
  chr10:134886068-134886326
  hypo
gccccatcactggagcgccccagtttggatgccaagtgccgagctcgcacgggtgactctacctcgctgagaactgacgaaccgtaagtggtgcattcacagaattcacacatcaagctttttaatttcatttccaatttaatatcatctatctcagtctgtttctcctgtaacacagtctttaaagttaagtgggcgcgacccacttaactgttcccaccccttccggcacggcaccggcaccgtcctgggcgcccc

SEQ ID NO: 70913 - DNA, 144 bp, Homo sapiens
  chr10:134886921-134887065
  hypo
agtcctgataaagggcgacgtgtgtgcacacgcgtgcacggtgtgtgagtaaagtggcagaaagagtgtcatgaggcggtgacgctaccgtccccacagccagcctcatctcactgacgcctccctgtacgcattgctaaaaga

SEQ ID NO: 70914 - DNA, 38 bp, Homo sapiens
  chr10:134890001-134890039
  hypo
agcccttgcagggcacgtgaaaccggtcactgtggacc

SEQ ID NO: 70915 - DNA, 30 bp, Homo sapiens
  chr10:134894556-134894586
  hypo
cgcggacctgtcccacgttgagatcagggt

SEQ ID NO: 70916 - DNA, 165 bp, Homo sapiens
  chr10:134895279-134895444
  hypo
tgggctcctggaggtcgtccacccacagaagccgtgttctgattatcaacacgccctctggcaggaccccctggagccagggctccctcggcagcaccgggcgctacaaccagacccgggcaccaggcagccagcagcaggggctgtgctcggatgcagctctac

SEQ ID NO: 70917 - DNA, 30 bp, Homo sapiens
  chr10:134897792-134897822
  hypo
ggtcagtgttgaaggcgttaggatttgcgt

SEQ ID NO: 70918 - DNA, 354 bp, Homo sapiens
  chr10:134898266-134898620
  hypo
tgtagatgcaatggccgtgaccagcacttggccgtctgcgctgtaggccaaggaggcctgcctgggcccacctggctgcagcggggagctgagcctccctgaggaggaaggaatcgcacctggggcagcaacagcagctcctgcctgggtccctcatggccgcgtgagccgcttcctcactgtaaagctcttcacctatgtaactatgtatcaatgtaaacaggaacgtatcctccgcctctgcatctctggtgaatccgggcgatacgtggtgagacaccttaataaacacctagatagaccctgccgtggtgagcacctgcctccaaggggcaagcacggggcattttcctg

SEQ ID NO: 70919 - DNA, 111 bp, Homo sapiens; identical to SEQ ID NO: 33549
  chr10:134901183-134901294
  hyper

SEQ ID NO: 70920 - DNA, 830 bp, Homo sapiens
  chr10:134901295-134902125
  hyper
gcggccgcccggctggaagagccatccccaccctgcggcaggagcccgcccgccgccatcgcccgccccggtccccatggttacgcgcctgcctccggccccgggtccccgctgtcgccgcgggaggtgcgcgcagaggcggcggcgctgctggccgggctgggccgctcgtgcgcggggctgtgactcaccggccggcgccgcagccccgcaatctgttgataactcggtcccagctcggccgctgccctcgcgaatggagagcgggtccccggcggggggagcgcagcgcgtctgtctccgggagcgcggcccggccgccccggcagccgcttcggccacagcaggtgggaaggacgcgcgggtctgggcggcgggagggacgcgcggggccgcggctcggcagaaaagctcgcgccccgaggtgacactggccgcgaggaaagcagctccgagtaactttcggctccgctggggcgggaggcgccacggataatccagggcccccgccccgcgcgcccggcccggagctcgagccacatccaggcagagcaggcgccgcggccgggctggggcgggcgggtcactcggtgccggttcccggtgcaaaccccccggcgcgcctctggctttgtgcagcccgagatggttgagtttggctccggagccgggagtggggcgcagattgatttttaaatatggagaaggagacgcatctgccgctggcgcgttcggtccgagccccccaccggtccccaccggcaccgcctccgccagccccaggcgcagcccccaggccgcccgcggaggggagggagcgacaggggccg

SEQ ID NO: 70921 - DNA, 74 bp, Homo sapiens
  chr10:134902187-134902261
  hyper
cgctgaccgccgctgtcttcacagatgggagcagctcccggactgcgcccgccccgccgcggtcaccctgaggc

SEQ ID NO: 70922 - DNA, 91 bp, Homo sapiens
  chr10:134907606-134907697
  hypo
cttgccgcctcagtccgtgtgaaacctcacagcttggccttcagacgagaagccccacacaaggcggcgtggccctcgctgtcactggagc

SEQ ID NO: 70923 - DNA, 218 bp, Homo sapiens
  chr10:134912118-134912336
  hypo
gaaaccctcctttcccgtcccacagcgccatccgcatcagccgcaagggccggcacacgctcctgaatttctgcttccacgcggccctgaccttcactgtgttcgccggcggcatcaatcgcaccaagtaccccatcctgtgccaggcggtgagtgccggggcgccctcgttggctcctcccagaggggaactgcgtgagcgtcgtcttgtttactaa

SEQ ID NO: 70924 - DNA, 354 bp, Homo sapiens
  chr10:134913693-134914047
  hypo
ccagcatggccccggcggaggagtcgctggcacgcacctgaaggtggctaaggtcagacgtacctcctgcctccttaatcattcctctggtaagctggaaacaaccacagcaagtgcccgggaaacgccattgacgtcccgcctgtaagtgcctgcgagaggccgtcaccatcacgtctgcactttgccaccaagtacgccccacactgggatgaagcctgctggatccgcgggtgaggccccccgagggccttcagcaaaccccgcccgcgccttcgggaacacctgccactgcttgcctggacggagctcctggggcccaggcctgcggtgacagctcggggcggatgctgg

SEQ ID NO: 70925 - DNA, 60 bp, Homo sapiens; identical to SEQ ID NO: 42804
  chr10:134916714-134916774
  hypo

SEQ ID NO: 70926 - DNA, 30 bp, Homo sapiens
  chr10:134928644-134928674
  hypo
cacctgggcctcaggcgatggatgaggtgc

SEQ ID NO: 70927 - DNA, 202 bp, Homo sapiens
  chr10:134930863-134931065
  hypo
cccagcaaacacccacggaacagcctactgacggtgcatccagcctggagccccacagaggccaagcgctcagcgtggccacaccagacctgccccctgggaggtccggtgcactgtggacgtgggcagggcagagcccgggagactgcctgggccaggaggccccaggatcaggccctcactagcccgggcacctgctcag

SEQ ID NO: 70928 - DNA, 269 bp, Homo sapiens
  chr10:134937581-134937850
  hypo
cttggcactgggtcacgtggtgatgcactcagggctggtcccaggctctgcaccctccccggccagcccaccctcttgggctctgcaccctccccggccaggccaccctcttgggctctgcaccctccccggctctgcaacctccccggccaagccaccctcttgggctctgcaccctccccggctctgcaccctccctggccaggccaccttccccgggctctgagcaatgtgctctgccgtgagtcagctcccgctttgcccctccg

SEQ ID NO: 70929 - DNA, 569 bp, Homo sapiens
  chr10:134940715-134941284
  hypo
caacgccttcctccccggcaggttttacctcgtcagcggaggggtcccctttatcatctgtggggtcacggctgccacgaacatcaggaattacgggacagaggacgaggacacggcgtagtgagtaccgggcacccagaaccgggagctgggagcagcgggtgggctctgcctgaggtccctcccaggcacctgtggtggggaagcccaggacgaagcagcaaggcctgggcctggacctggggcttgccgagagctgcgcccctcccagctcgcacccccgaggagtgcgcagcgccccctcctctcccagggagtccaacctaatctttgcctttggacaaggcaggcctggtttgccttctatgggaggggcctggggacaaatagcgatttggcaacagcacagagctcagctgagaagggaaaccccatcgagtaggaacggcggtccagccatcagtgcccagagccagcctggaacctctcattcagggccctcagttccttctgcggccccaggatggcccgcccgtctgccctccgccttgccccgcccacccagctcc

SEQ ID NO: 70930 - DNA, 248 bp, Homo sapiens
  chr10:134941647-134941895
  hypo
agggccaatagggcccggttcccatccacactctcagcgactctagaaacgcccaaggcccccaagccgcagctgtgcaaagccactcgctaggccgggtgggtgcagggccctttgctctgcagggggcgtcctgagtcctggccgtgctggccccgctgacactgacgtgcgtctccccacagctgctggatggcctgggagcccagcctgggcgccttctacggcccagccgccatcatcaccct

SEQ ID NO: 70931 - DNA, 687 bp, Homo sapiens
  chr10:134942452-134943139
  hypo
ccagttgcctgtcaccggccaccccgtgctgcgccaagatgcactgcgagccactgacggcggacgaggcgcacgtgcacctgcaggaggagggcgccttcgggcacgacccccacctgcacgggtgccttcagggcagaactaagccgccctactttagccggcacccagcagaggagcccgagtacgcctaccacatcccatccagcctggatggcagcccccgcagctcgcgcacagacagcccccccagctctctggatggcccggcggggacacacacgctggcctgctgcacccagggcgaccccttccccatggtcacccagcccgagggcagtgatgggagccctgccctctacagctgccccacgcagccgggcagggaggcagcgctcgggcccggccacttggagatgctgcggaggacacagtccctgccctttggtggccccagccagaacgggctgcccaagggtaaattgctagaaggcctgccgtttggcaccgacgggaccggcaacatccgaacgggaccctggaaaaacgaaactactgtgtagatgggggcagaggacacggtgttcctggaggagcttcagagcagagtggggggcccatctgccacatgaggtcactgggggtaccgaagtgaccccgcctttcagaagccgttcacacccctgc

SEQ ID NO: 70932 - DNA, 64 bp, Homo sapiens
  chr10:134943548-134943612
  hypo
tgtccccagcattctcgctctgggcagaaccctcgggaccctccgctgtcgtgtgtctgagcca

SEQ ID NO: 70933 - DNA, 201 bp, Homo sapiens
  chr10:134944571-134944772
  hypo
gcagagcctccctaacgtgcacctccgagaagaggggtgtcggggagtgttcccagcacctgctcggtggaagggctctccggagactggcactcagtatctgagtatgaggagcctcacttcccggggtgtcggtaaacttgaccgtgactcagtaacccacagcgtgctcctcccagcaaaccccgtgtgtccttacag

SEQ ID NO: 70934 - DNA, 30 bp, Homo sapiens; identical to SEQ ID NO: 42811
  chr10:134945693-134945723
  hypo

SEQ ID NO: 70935 - DNA, 150 bp, Homo sapiens
  chr10:134955035-134955185
  hypo
gacggcacctgtggtcggcgagcaacaaggacacgcacagtcctgtaccgtccccttcccaggcccaggagccacccgcaggggctgagccctgggagcatcccagccgggctctaagggaatgtacagggggcccggtgacctgggctg

SEQ ID NO: 70936 - DNA, 52 bp, Homo sapiens
  chr10:134955660-134955712
  hypo
cctccacagacaccccgtgcaggccgggacctgcacccgaggaggcacacac

SEQ ID NO: 70937 - DNA, 30 bp, Homo sapiens
  chr10:134968447-134968477
  hypo
aaaactacaaaatatcgttgggagaacagg

SEQ ID NO: 70938 - DNA, 30 bp, Homo sapiens; identical to SEQ ID NO: 42813
  chr10:134970630-134970660
  hypo

SEQ ID NO: 70939 - DNA, 383 bp, Homo sapiens
  chr10:134973889-134974272
  hyper
tccatggagccagggcgcgcgtagccgagcccagcccagcccagccggaggccccgggggcggtgcgcggcgcggccgcaggatgcaggccatggacccggccgcggcggatctttacgaggaggacggcaaagacctggacttctacgacttcgagccgctgcccaccctccccgaggacgaggtgagcccccggccccactggggggccccttccgccgccgaggggtccgcggagagcgcccggggggaggacccgggaggggctgtgagctcccgcctccccaggcgccctccatggccgaggggttcccaccgccgttctcagcccccgcgttaggattttcacccggaggggacagcacccccgaatgcgcacggga

SEQ ID NO: 70940 - DNA, 147 bp, Homo sapiens
  chr10:134974307-134974454
  hyper
cgcggtagctcctggtggaaaccctggcgggacagtgtgggggcagcaaggaggacggaggggggtctgcttactccctgccgggccccaggaggccagcggggtgcagagcagcagagtccaatcaggcgccgctcaggagctggg

SEQ ID NO: 70941 - DNA, 166 bp, Homo sapiens
  chr10:134980970-134981136
  hypo
cctgtccatgcggagcgtggcccacgccgccatcttccagagcctgtgcatcacgcccgacaccctggccttcaacaccagcgggaacgtgtgtttcatggagcagctcagcggtgaggcggcggtggcggtggcggcggcggcgggcacgcggggtggaggtgcc

SEQ ID NO: 70942 - DNA, 107 bp, Homo sapiens
  chr10:134992393-134992500
  hypo
cgtgagcagggctcccgctctcaggagagccgccctcatcgacgctgggcagccgcagcagacagtccctgtggacagagaggtgggaggctcgactccttctcttc

SEQ ID NO: 70943 - DNA, 651 bp, Homo sapiens; identical to SEQ ID NO: 42815
  chr10:134996258-134996909
  hypo

SEQ ID NO: 70944 - DNA, 248 bp, Homo sapiens
  chr10:135001179-135001427
  hypo
ttggtcccagctgtccgtgaggccttggagtggagagtggcctcccaggctgaacgcatgcctggtgtcacggtgtgtgtgtatgtgagaaaatgcaccgaacaaaagccaccacttcaaccctctgcaagagcacagctcagcggcattgggtgtgttcacgctgttgcacagctgtccccatcagcccacacgaaaccccaacccccgagcccgccccctgcaccccgtcccgccctccacctcca

SEQ ID NO: 70945 - DNA, 230 bp, Homo sapiens
  chr10:135001972-135002202
  hypo
acatgcctctccaggcggcgggccctggcaaggggtgtccacactgacctcgccgctctcctgcccacagtgggtgtccctgcaggacctcctgtcccagctgggccggcccttccgggagtacgagctgtgggccctgtgcctggcctgcctccgcgcactgcagacacgccctgagcacccaggtgacgcacgcaccatcccatcccccccgccgtccccacccccca

SEQ ID NO: 70946 - DNA, 99 bp, Homo sapiens
  chr10:135002734-135002833
  hypo
ccagtgtccgtccaccgtgagcccgtggctgccccgtgggccctgactcgggacggggcctgtgacacgggggcttcaagttaccgtgttctccctgcc

SEQ ID NO: 70947 - DNA, 23 bp, Homo sapiens
  chr10:135004548-135004571
  hypo
taagccccaactggccgggcatg

SEQ ID NO: 70948 - DNA, 36 bp, Homo sapiens
  chr10:135008797-135008833
  hypo
cagtcggggggctcccgggtccgtgaggtgggggct

SEQ ID NO: 70949 - DNA, 121 bp, Homo sapiens
  chr10:135010570-135010691
  hypo
agctacctcctccagcgaggcatggacagccggaaaatccttgcccacctcagagcttccatctgccaggtgggctagaacagccaggccgccgcctcctccgccgcgcttagcttcctcc

SEQ ID NO: 70950 - DNA, 330 bp, Homo sapiens
  chr10:135011761-135012091
  hypo
ctgggtgggatgagccggtggtgcggcacgtgctggggccactccgcccgcccacaccctcagccccctggctccccaggcttcctgccggtgaacagcgacaccgggcttgtggctgtgccagggcccgtgcccggccagcacccctgcggtgaagaagccacccagctgcctgcagcgttcacctccgaggccacgcacttcaagcccattgtcctcgcgcagaacgcaagtgtggccaggtgagcatcgtccccacaccccggagctgctgggtcccgggcgcaggcagcccctcctgagctctgctcctcccgtagggaccagcct

SEQ ID NO: 70951 - DNA, 398 bp, Homo sapiens
  chr10:135012320-135012718
  hypo
cagagggggcctcatcggcagctcccggctctccagtccccgccccgcccacgaaggcatctgcgctgcccgtagagcaagggccggctgagccgatcccacctggagttgcttccgggggcctcaggcccgacgccctggggcccaccacggcccaccacggcccacgccacccgcccaagcccccacgaagcaaggccaccgagcgcccgggccaggagccagagggccccggggccacccctgccggggaacgtgatgaccagagtccagacagtgtcccagagaggccgcggcccgcagaccggaggctctgtctgccctgcgtggatgcctcgccactcccagggaggacggcctgcccgtcgctgcaggaggccacgcgcctcatccaggag

SEQ ID NO: 70952 - DNA, 716 bp, Homo sapiens
  chr10:135014688-135015404
  hypo
tgatagcagagccagcgaggacagggcccggccccaccccggggcgagtacgagtttggaagcagtgagggcgcagagtggggctccatctggggagaggcctctctctgtcacccggccccgtgcggcagttcagggtcccagcatctcccctgcactgggaggcggcagccgtgcccggggggcgcccgtggtgggcgggtgcaagagagaagggcgtcgggtgtgcaagcaccaccggcctcccattaacagcctgcccgggctccgcccacaggagccactgtccacgtaacctgcgtctctttctttcaaggaaaagagaagccagccatggccaggaccagcagcagggccccctgctcacccacctcggtgtcggatgtggactcggacgcactgtcacggggaaacttcgaggtggggtttcggcctcagaggtccgtaaaagccgagagagcgcagcagcctgaggctggcgaggacagacggccagctggcggggcctcagacgtggaggcagtgacccgactggccaggtccaaaggggtcggcccagccttgtcccccggcccagccggattccagagctgcagccccggctggtgcagcgccttctacgaggccgactgcttcggggccgacgtccacaactacgtgaaggacctggggcggcagcaggcggacggggccctgcccgacgcccagagcccggt

SEQ ID NO: 70953 - DNA, 217 bp, Homo sapiens
  chr10:135016590-135016807
  hypo
cactccacccccaaacgcacggcgtccagcggggagcactcggcccccaaacgcacggcgtccagcggggagcactcggcccccaaacgcacagagtccagcggggagcactcggcccccaaacgcacggcgtccagtggggagcactcggcccccaaacgcacagagtccagcggggagcactcggcccccaaactcacggcgtccagcggggagc

SEQ ID NO: 70954 - DNA, 563 bp, Homo sapiens
  chr10:135017049-135017612
  hypo
atttcctcccttcagcgctgacccccacctactggtgccggccgtgtgtgctgggctcagcactgcgggtgccctggggctgtggagctggcatccgcgtctcctgctgttaaaacaagcgtggctcccagagtcagcgtggacagcactggtgtgggttcctcccccgtctgtctgcaccggtgaagcctggcctcgtgtttccctcctcactgccccacatgtggtgtggattttagttaccgtggatttattaaaatcagtcaagaccgtcctcctcatggagtccgcctgtggttcccgcgtgaggagcgcccccgacggacatcgagtctgactgtgaacggaggccgtggaggtgccggccagagaggagtctgcgtgagctgcactccagccaggcgggcatcgggctcgcaggcacccgcctccaggttcctggatgcgtcagggtacacagacctttcccaggagattttctcgacatcagcacctctgcaaatggatgggggtgagagggctggatggagcctggcgccggtgacctccgggggccggacgag

SEQ ID NO: 70955 - DNA, 35 bp, Homo sapiens
  chr10:135018010-135018045
  hypo
cactgcccacactgccgtagcggggagcctggccc

SEQ ID NO: 70956 - DNA, 47 bp, Homo sapiens
  chr10:135018352-135018399
  hypo
cctcacaggaggctgcgggccgagggctgccgcgcctctcacctctg

SEQ ID NO: 70957 - DNA, 167 bp, Homo sapiens
  chr10:135018825-135018992
  hypo
gcatgaagcagtgcccggcggccctcgcccccagctcctgtgatcaggacctgcccgtctggcctcagtcctgcttccctcatggcgacagccctggggatgaggtccccggctccatctcgcaggcaggaactcagactctgggcaggttccggagaatcacaccc

SEQ ID NO: 70958 - DNA, 208 bp, Homo sapiens
  chr10:135020704-135020912
  hypo
ccgcaccctgcgacacgctggacttcagccccctggacgagtcctcctcgctcatcttctacaacgtcaacaagcacccgggcggccggcagaaggcccgcatcctgcaggccggcacgccgctggggctcatggcctacctgtactccaggtgcgttgggagaaaagctcacccggaaaaggagacgtagcccggggtgctgagaag

SEQ ID NO: 70959 - DNA, 30 bp, Homo sapiens
  chr10:135022018-135022048
  hypo
ccctctagagagggacgtggcccccccaac

SEQ ID NO: 70960 - DNA, 573 bp, Homo sapiens
  chr10:135023063-135023636
  hypo
gtgtggctttgtccacgtgtgtggcgtgcgtgtctgtggttgtacagtttgtggcttgcatggcgtgagtgtgagtgctgtgcttccatggaaggagcgtctcctggccgtgatgtggtcacgaggggcttccccgctctgtggacctggtgggcgtcacctttgcagggcagcctggggctggggctgtggccacctgtgtcctcggaccccaggtgagtgggtgaccaggccccttgttccagggccacgccatctcctgcctgagactcctccagggtgggaggaggccttgccaggcctccgcttcctgaccgtggccgtcgggctcccaggacagtcccagacctgcaggcggggccctggtcagtgtctcctgagggtggcgcggtttcacccagtgaagacccagaacctttgagcgtgcagcattgcgcccggtcccgaggcaccagctccctcagcttcccgagctaacgggtcctgcgagtggagacgtcacaaagccctgcatagggctgcgttcagaaaggccctggtgttcagcagggcacggtggctcacgcctgtcat

SEQ ID NO: 70961 - DNA, 33 bp, Homo sapiens
  chr10:135025715-135025748
  hypo
atatccacacctacacgtgtgcaccctcacgca

SEQ ID NO: 70962 - DNA, 30 bp, Homo sapiens
  chr10:135029314-135029344
  hypo
agggtgggcaagagtcgtgcaggctcacac

SEQ ID NO: 70963 - DNA, 382 bp, Homo sapiens
  chr10:135030573-135030955
  hypo
gggaagatggagagtcgcagacatgctgcacagtgtggatgtagttaacacggctgaaccgtgcactcagaaaaggctacaaaggtaaatcctctattacatactttttacaattaaaaatcaaaaggttaaaacaacagtgaaaaagtgtggcgaaatagttttatctcaaaattacatactttgcatctacttaaaccgatgaagaaacagactgagacgtcagcgtagaaagtgtatccggtaaacacttctcaagctcctctcaaggcgctcaggcaagagggctggggccgcagtcggggtgagcccaggatcacatgaggcgccttcagctgcacaggggccctgcagacaagagttgagcccgggggcaggcgcg

SEQ ID NO: 70964 - DNA, 62 bp, Homo sapiens
  chr10:135032634-135032696
  hypo
aggccctctcctaaacgaactgctgtgcagagcctgccgcacccagacgcaggcaccacaga

SEQ ID NO: 70965 - DNA, 428 bp, Homo sapiens
  chr10:135035009-135035437
  hypo
aatctcccaccctcccgtctcatctcatcgcctgccgttgtccacacacggtcaggtggaggctgcccaggccacggcggctccaccctcccccacggtagatggcctcacttggggagcaatgctcagcggaccaggtgcccatggatcctcagcctgataggtgaaggtccccttcttagatagccaccaatttaaaaacaataattataatatgccataaatgtatgcttatcgtaagagatcagaaaacccatgtcagcaaaagagaagttaaaaacttaaggtaggccagacgcggcggctcacgcctgtaaccctaggtaggccgggctgggtgcagccactcacgcctgtaaccctaggtgggcagggctgggtgcagccactcacgcctgtaaccctaggtaggccgggctgggtgcagc

SEQ ID NO: 70966 - DNA, 77 bp, Homo sapiens
  chr10:135037520-135037597
  hypo
tcttcccggcgtgtgtgtgtgtgagagcccatccaggcttggcctttctttgccgtaatggacgcccctttctttgt

SEQ ID NO: 70967 - DNA, 464 bp, Homo sapiens
  chr10:135043162-135043626
  hyper
gatgctggctgcagacgcgctgcagatggaagaagttcagattttaaaagctacttctgcgagcgcgtgaattccgacacccattcccgcggctggcgtggcttctcctcggacccatcccctggcctggcgactccccctgggacccgggtcggtcctccggacccctcgcgtgcaggtgctgagcccgggcgggggcggcgggggcgggggcagcactgggggccggacaagggggcgccagcgccttccggagcgggaggggctccgcacacacctcgacgggggcgggggtaggctcggcacaggctaaaaacgagcggagccgccggggcttaggcatcgcggcacctccgttgaacgggtctaagaacagaactcctgaggaccctccgtttccaaccgaagccagtctttgctctgcgtcttcccggccgcagcgccaggaccgaccccttaggacc

SEQ ID NO: 70968 - DNA, 565 bp, Homo sapiens; identical to SEQ ID NO: 33557
  chr10:135043826-135044391
  hyper

SEQ ID NO: 70969 - DNA, 241 bp, Homo sapiens
  chr10:135044554-135044795
  hyper
cggacgcctcccccgcccccggctccccgccagctcccgccccgaccgccctcgccacctgcatccccgaggaccgcgcgcccgtccgcggccccgggtccccgccgccacccccggcccgcgaagaccccgactcgccgcccggccgccccgaggactgcgcgccccctccggccgcgcccccgtcgctgaacaccgccctgctgcagaccctggggcacctgggcgacatcgcgaacat

SEQ ID NO: 70970 - DNA, 635 bp, Homo sapiens
  chr10:135048782-135049417
  hyper
tggtcccagagtgctcggaggaggctcgggcgagtcgcgacggggccggcagcacgcgctgggcccggtgtctgtcctcaggccctggactcggggggagcgcgtttcggggactagctggactccgggctgtgcgtgggggcggtgctgtcggcctgggagtgacgcgggacttcctgcccagcgcaacccggcctggcccccgagggtgggggacagggcgacgcccgcggggaccacgctctggggcgtgcggggcgcaattcacggggctgggctgccccaggggctgggaggaaggaggcaggggggcgcccaagtctcctacccatggcagcgcatcagggcgcgtcccagagccgggggtggacggaggcttggaggcggaggctttggggacccccaagcctgggctagagcagcctcggcgggctctagagggagggtggagggaggggcccgggctgcaggaggcggggaggcctgagccacggtggtggggccgctgggcaggagagaggggctgcctgaccctgccgtgtgaaggtgaggttgtcttcgggcttggggggatcggagggggcggttcaggtggaggtggtggcggggggctgggaaaccggcaggaggggctc

SEQ ID NO: 70971 - DNA, 628 bp, Homo sapiens; identical to SEQ ID NO: 33560
  chr10:135049727-135050355
  hyper

SEQ ID NO: 70972 - DNA, 554 bp, Homo sapiens
  chr10:135050356-135050910
  hyper
tcctaccctcggcatggctgcctcccacccggtcacgtcggtccccgcgccccacgccgacgcgcaggcgacccggggacgcggagacgcagacagctcgggactcaggttcgtgggagcagcggccgcgcgtggctatgaccgtcccgggggcccgtgctcagggcgtccccgtgaggtttgggcgccacagtcaccggcggctctgcccgcgccctggccacagtggggacagcctggcttggcggggacgcaccagtcccgccgccgacgcggagttcctaccccgccgtgcgaggcagtggctccggcccttccagctcgggatggagtcagggagccgcccgcgcccgaatgcagaggctcctgcgatggccccggagtgagtcccccagaggagccggattagggctggaggcggccgagtcccccgagaggcccctcccgacattcccgcccccgcgcgccgctccccgggtcctccgcgtctctttcccgggaaagcctccctcggttcctgcgcggccgcacagcctggacgcagcgcacgcggg

SEQ ID NO: 70973 - DNA, 50 bp, Homo sapiens
  chr10:135064477-135064527
  hypo
gaggagcccagggcccgtcttcctgctggccccatcggctggagcctggg

SEQ ID NO: 70974 - DNA, 30 bp, Homo sapiens
  chr10:135066354-135066384
  hypo
gaaacctgtgtccaccgtgtgacctggcaa

SEQ ID NO: 70975 - DNA, 165 bp, Homo sapiens
  chr10:135069783-135069948
  hypo
ttcctgcttgtaaaacgacacattgttatgatggagaattgtgagtactgcagaaaagaaataagttttgccaccaaaggcgatcactgtggatcatgccggttcctgcacacctgtggggtgctctgagcgtggactccccacgcgagccgtccagacgtgctc

SEQ ID NO: 70976 - DNA, 202 bp, Homo sapiens
  chr10:135076386-135076588
  hypo
acacacacacgcacccgcaagcacacagctcatcccagcctggtgcctgcagacagctggggctacacgtggccaaggcggggagaaggaattggctgagggcgtggacagcaggagcctctcaggtagatgcattcctgaggttagaacagcagctgagcctgcaaagtcagggtctagggctgagcggcactagctggac

SEQ ID NO: 70977 - DNA, 81 bp, Homo sapiens
  chr10:135078929-135079010
  hypo
tatttctgcaactcacgtacaagtctgaagttagttcaaataaaaagttaaaaaggaaagagagaaatagaaaatcactat

SEQ ID NO: 70978 - DNA, 47 bp, Homo sapiens
  chr10:135084770-135084817
  hypo
ttgcagcagcggttccggcagtcctggggcgacggcaaaggccttgg

SEQ ID NO: 70979 - DNA, 90 bp, Homo sapiens
  chr10:135086744-135086834
  hypo
caagggtgctcaccccgggccgaggcctgaagacggctgccgtccggggtcccaggaggctgcccaggctgtcgtcgctgaccccgcagg

SEQ ID NO: 70980 - DNA, 233 bp, Homo sapiens
  chr10:135087412-135087645
  hypo
cagcccctacctgcccgcccagctgctccgcccgacccatacctgcccgcgaggctgctccgtcacctcggagccattggcagccgtataggtctctgtgtagccggagcccagcaggtccctggaaaagaagtgctgtgactgcctcggccccctcggtgcagagaggctggcccagaggctggacgccggggacaccagtgtgctggagccaggcccgggcaggggggccg

SEQ ID NO: 70981 - DNA, 205 bp, Homo sapiens
  chr10:135124038-135124243
  hypo
gggtgtgggaatgagcgggcgcagcgcctccgcactcacacccctctgggccatgcctgtacctcctgcagcagtcggccgtggtcatccgcactcacacccctcggggccgtgtctgtacctcctgcagccgtcggccgtgctcacacatcatgcagccctggctttccttttgtcctggttggttgtgcgcatatgaacttga

SEQ ID NO: 70982 - DNA, 40 bp, Homo sapiens
  chr10:135133094-135133134
  hypo
tcctgtctgtgtgtccgtgttcacacgctcacacacgtca

SEQ ID NO: 70983 - DNA, 810 bp, Homo sapiens
  chr10:135138920-135139730
  hyper
gaagcctccggtggacgtgaaatctttacttagagaaaagcgacagagtcagagacccacgggggcggggctgcagcgagggcgcctggggacacgaacacggcggagagcatcgggagacgcgctggtcacaggagctggcggaggacgctgcggagacagagcccgagggttgagagcggcgacgcggccaggggctccccgcggaccccgcgtcacccggcgggctcggattcgcaacccccaaccccgaggttctggcgggccgggtcggagggaagaggaagggaagggtggcgggggtctttggctcagaagcggtggcgggaggccaggaagagacctgggcagagccggccggagccccgcggcgcgcacctaccccgggccgggctgcggggctggagacgtcactgcgcgggcgggggcgccgcgctcccggccgccttccgcgccgcctccttctccgccttggccgacggcttcccggggggttcggtggccgccgccgccgccccagcctgggtgggccccttgcgctcctccttggctgcgcggtagccgtccccccaggccgccggcgtctccgtgccgtgcttgcggctcagcgggtaggccccgatggccgccaggatgctgcggtggcgctcggggtccatctccgtgtagtacatctccagggtcagcggcgtgcagatcttgtgctgcgggaggggccgggtcagggtcggtggggctgagccctcctgtgcgccccgggcccaggccctcccgcttctgcggttggggacactgcggacagtttgtaat

SEQ ID NO: 70984 - DNA, 319 bp, Homo sapiens
  chr10:135148783-135149102
  hyper
aagggggcgcagtcccgcaccagggcccgcagcgccatagggtagggccacgccccggagggcccgcgccaggagtctccgcccgaacccccgctcgggcaggacccccgccaggaggagctgcgcttgaggggtccccttcgagccaaacttcaaatccaactcctcggacggccaatttacgtcatcgcgggtttccatggcaacgcagacaggcccgagacgcgtcttcaggaagaaaaagccattgggggcccactggagcctcgcttctggttccgggcccagcgccccgggcggaatgcggggttggaaaggg

SEQ ID NO: 70985 - DNA, 253 bp, Homo sapiens
  chr10:135150325-135150578
  hyper
gaaatagctcacaggcggctccactggcagctgctgcaggacgcggtcggggaggacgacgatgcggatgtggatgcggaggatgcggttccagacgcttcgcggccgggcggggcgggggctgcagctgcgagaccgaggctgtggtcgccatggaaacgcggctagaggcggggcctcgactctggtcccgcaccctctacccccacccaccgccccggctagggagccgcgcatgcgcccctcagaccct

SEQ ID NO: 70986 - DNA, 79 bp, Homo sapiens
  chr10:135159573-135159652
  hypo
tcgggtggggtcaggcggagattggaattgtgtttttgttttacagggtgtgccagggacggctaaagaaggtggtcag

SEQ ID NO: 70987 - DNA, 30 bp, Homo sapiens; identical to SEQ ID NO: 42836
  chr10:135162912-135162942
  hypo

SEQ ID NO: 70988 - DNA, 115 bp, Homo sapiens
  chr10:135170721-135170836
  hyper
gcagatggaggaggccgggaagttcaagtccgcaagaactaaacagccgggaggacagcccgtgtcggcacctatccctgccctcggggtcggcgccgcccgtcctcccacccag

SEQ ID NO: 70989 - DNA, 43 bp, Homo sapiens
  chr10:135208594-135208637
  hypo
gcccagattaagacccgtggaagggcccggcccggtggctcac

SEQ ID NO: 70990 - DNA, 345 bp, Homo sapiens; identical to SEQ ID NO: 33566
  chr10:135236927-135237272
  hyper

SEQ ID NO: 70991 - DNA, 30 bp, Homo sapiens
  chr10:135269174-135269204
  hypo
gagatgctcagagaccggagggtgagatcc

SEQ ID NO: 70992 - DNA, 80 bp, Homo sapiens
  chr10:13571373-13571453
  hyper
gggcgccccggggcccgacgcgctgattttaagcaagttttagggggaaaaaacttacccatttgcgctctctctagaag

SEQ ID NO: 70993 - DNA, 30 bp, Homo sapiens
  chr10:1367578-1367608
  hypo
tttagctgtttggggcgagggttcatatcc

SEQ ID NO: 70994 - DNA, 30 bp, Homo sapiens
  chr10:13706037-13706067
  hypo
tgccattcaattaaccgggagaacacaccc

SEQ ID NO: 70995 - DNA, 40 bp, Homo sapiens
  chr10:13715561-13715601
  hypo
gcacacatgtgcatgcgtgcgcgcgcgcacacacacacac

SEQ ID NO: 70996 - DNA, 30 bp, Homo sapiens
  chr10:13725649-13725679
  hypo
ggtggaacccacagccgggagctaactggg

SEQ ID NO: 70997 - DNA, 149 bp, Homo sapiens; identical to SEQ ID NO: 42529
  chr10:13751257-13751406
  hypo

SEQ ID NO: 70998 - DNA, 41 bp, Homo sapiens
  chr10:13771406-13771447
  hypo
agagaacgataaatccgcggcgcactcggcagaacgtacac

SEQ ID NO: 70999 - DNA, 43 bp, Homo sapiens
  chr10:1383819-1383862
  hypo
caccagagaacaacgtgccctgcaacggcgataatcagcatca

SEQ ID NO: 71000 - DNA, 30 bp, Homo sapiens
  chr10:13854970-13855000
  hypo
gtcgctgatgaattacgaagtagaatgcaa

SEQ ID NO: 71001 - DNA, 161 bp, Homo sapiens; identical to SEQ ID NO: 42530
  chr10:13898478-13898639
  hypo

SEQ ID NO: 71002 - DNA, 103 bp, Homo sapiens
  chr10:13933436-13933539
  hyper
acagtatgtgccccacgtgggatttgcatttaaaaactgtaacatacgcgaaataaacgactccaggcccccagtaaagaagcagcggcgcgtcccttttccc

SEQ ID NO: 71003 - DNA, 339 bp, Homo sapiens; identical to SEQ ID NO: 3509
  chr10:13933596-13933935
  hyper

SEQ ID NO: 71004 - DNA, 14 bp, Homo sapiens
  chr10:13933982-13933996
  hyper
cgccaccgcccgcc

SEQ ID NO: 71005 - DNA, 129 bp, Homo sapiens; identical to SEQ ID NO: 3511
  chr10:13933997-13934126
  hyper

SEQ ID NO: 71006 - DNA, 243 bp, Homo sapiens
  chr10:13934168-13934411
  hyper
cggaggtccccaagcgggggacccctggctcccccacaaaacccacccaaagccaccgctcgaggccctctcctaccctgagagcccggagacagcagctcccttggctgaaggcacagctcttacccctcgatctagtccaattgtattgaattttaatctcccctcaactcttcaatggaagttgctgcaggataaccgaggcatgtggctattgtcaaggcttcgcgacaatgactggga

SEQ ID NO: 71007 - DNA, 45 bp, Homo sapiens
  chr10:14000240-14000285
  hypo
ggaatgtaaaacagtcgcgtgaacaacagccatgaccattgtttt

SEQ ID NO: 71008 - DNA, 30 bp, Homo sapiens
  chr10:1406940-1406970
  hypo
cggcttcccaggtatcgtgttattcactaa

SEQ ID NO: 71009 - DNA, 79 bp, Homo sapiens
  chr10:1416159-1416238
  hypo
ttcctagtgaaaccgcgtggactccgtgcacctttcctagtgaaacccgcttccagtgagactccgtgggtggcatccc

SEQ ID NO: 71010 - DNA, 23 bp, Homo sapiens
  chr10:14166365-14166388
  hypo
aaactgaagctcagacgaattta

SEQ ID NO: 71011 - DNA, 30 bp, Homo sapiens
  chr10:1418261-1418291
  hypo
catgaacacacatcacgacacacacacaca

SEQ ID NO: 71012 - DNA, 242 bp, Homo sapiens
  chr10:14215671-14215913
  hyper
ggtacttcctgcaaacgaacagctccgagggctgcacggccccaaagcaagagtgactggaaatcctgctaaaatatggctgtctaatcaaccgagaggcgaactcatttactgaggttcccattgtccacgctgacagatggctcgctcccctctctgctctccccttcccctcagatcgcgctgccgtgcaggcaagcctattctttgagagatccagttgcaatcgccagcctagttct

SEQ ID NO: 71013 - DNA, 106 bp, Homo sapiens; identical to SEQ ID NO: 32899
  chr10:14216190-14216296
  hyper

SEQ ID NO: 71014 - DNA, 64 bp, Homo sapiens
  chr10:1438451-1438515
  hypo
ccttgagagtgctgccggactgaacttcccatccctgtccccaccccctcggtgacccatcgca

SEQ ID NO: 71015 - DNA, 92 bp, Homo sapiens
  chr10:1443474-1443566
  hypo
cccatgggaaggaggcgtgatgatggtaagcagcacagagccctgcggggaccagggttttggaacaccccggccttcggtcatgctgcggg

SEQ ID NO: 71016 - DNA, 38 bp, Homo sapiens
  chr10:1451436-1451474
  hypo
gcgggctcccaccttcgtcgccccgccctgcctgacgg

SEQ ID NO: 71017 - DNA, 124 bp, Homo sapiens
  chr10:14966088-14966212
  hypo
gacacacatcaagtacgaagcagagaaagatgtttccacacaaggtactgagctgccgcaggctgtgtgctcacgctaacgggagtgcttgctctctctcactcgcgtgcgctctctctcaata

SEQ ID NO: 71018 - DNA, 41 bp, Homo sapiens
  chr10:14996911-14996952
  hypo
aacccagaacactttcgctttattttatttatttattcagt

SEQ ID NO: 71019 - DNA, 101 bp, Homo sapiens
  chr10:14997192-14997293
  hypo
agtgctgggtgagccattgtacctggctttccaggcctccataacacttgaagtcccactttgtgcacagcactgtgacaaaccttcgggtagcattcaat

SEQ ID NO: 71020 - DNA, 24 bp, Homo sapiens
  chr10:15000601-15000625
  hypo
aacatgtaaattggccgggcgcgg

SEQ ID NO: 71021 - DNA, 120 bp, Homo sapiens
  chr10:15003045-15003165
  hypo
ataaataaaataacatgctcctcaatttaactatgggattatgtcccaatacacccatggtaggtcgaaaatgcatttaatgcacctagccaactttaaacgtcctcagaacacttagct

SEQ ID NO: 71022 - DNA, 141 bp, Homo sapiens
  chr10:15003225-15003366
  hypo
tgtcatgtaacttactgaatactgaattcaaagtggaaaacagaatggttgcgtgggtactcgaattactgaatgcgtattgcttttgcaccatggtaaagtggagatatgagttgaaccattccacgggaccatctgtat

SEQ ID NO: 71023 - DNA, 30 bp, Homo sapiens
  chr10:15009037-15009067
  hypo
ctctcatcttattaacggggagaggcccag

SEQ ID NO: 71024 - DNA, 19 bp, Homo sapiens
  chr10:15026279-15026298
  hypo
tttccgaggagatttcgtc

SEQ ID NO: 71025 - DNA, 332 bp, Homo sapiens
  chr10:1506252-1506584
  hypo
tggaggggccaggaccgccacacacatgcgctgggggcagtcacagcgggcagtgtgccggagaagagggtggacacacactcccccacacacgcgcggggggcagtcacagcgggcagtgcgccggagaagagggtggacacacactcccccacacacgcgctggggacagtcacagcgggcagtgcgccggagaagagggtggacacacactcccccacacacgcgctggggacagtcacagcaggcagcgcgccggagaagagggtggacacacactcccccacacacgcgcgggggccagtcacagcgggcagcgtgctggagaagag

SEQ ID NO: 71026 - DNA, 23 bp, Homo sapiens
  chr10:15131223-15131246
  hypo
taaatatgtattggccgggcgcg

SEQ ID NO: 71027 - DNA, 120 bp, Homo sapiens
  chr10:15140508-15140628
  hypo
cctcgccagccaacttatttcttttaatactgagatacctttctttactccatacttcctttggtaggcattgtttagatgtaggttaagaggtccggcccggcgcggtggctcacgcct

SEQ ID NO: 71028 - DNA, 24 bp, Homo sapiens
  chr10:15140868-15140892
  hypo
atgagactccgtctcaaaaaaaaa

SEQ ID NO: 71029 - DNA, 30 bp, Homo sapiens
  chr10:15255450-15255480
  hypo
caaggagacgaaccacgcccgggggtgcgg

SEQ ID NO: 71030 - DNA, 30 bp, Homo sapiens; identical to SEQ ID NO: 42535
  chr10:15255872-15255902
  hypo

SEQ ID NO: 71031 - DNA, 51 bp, Homo sapiens
  chr10:15412536-15412587
  hyper
cccggcgtggggagccgggagcgcgatcgggcggcgcgccctgggcggccc

SEQ ID NO: 71032 - DNA, 30 bp, Homo sapiens; identical to SEQ ID NO: 42536
  chr10:15484112-15484142
  hypo

SEQ ID NO: 71033 - DNA, 82 bp, Homo sapiens
  chr10:15536670-15536752
  hypo
ataatagcaatcatattgtgtatgctcacgacagtgtttgtatgcatttttttttaaatatgtgtttcggagatctttccat

SEQ ID NO: 71034 - DNA, 30 bp, Homo sapiens; identical to SEQ ID NO: 42442
  chr10:1555620-1555650
  hypo

SEQ ID NO: 71035 - DNA, 29 bp, Homo sapiens
  chr10:15568455-15568484
  hypo
tgagccaccgcacccggcccattataaga

SEQ ID NO: 71036 - DNA, 244 bp, Homo sapiens
  chr10:1558592-1558836
  hypo
cctgcttgtgaccagcgtgcattctcgacatacacgcttcagaccaaatgtctgcttgttcacctgtgcgggctttgtgtgggctgctctgtgctatgcgggctgctctgtgcgggctgctctgtgctgtgtgggctgctctgctctgtgcgggctgctgtgtgctgtgcgggctgctctgtgcttgggaaaatgaaggttggcatgatttcctgcggcaatgccctcccgttttatgccttaa

SEQ ID NO: 71037 - DNA, 927 bp, Homo sapiens
  chr10:15760927-15761854
  hyper
tgggcgccacaaaaccgtgcgcatgcaatgcagtctctgtaacctcctgcccggggacactggggcaggcgtggagggcatgaacgtatttatgatgaggaccgactgtcaaacttgatttcctcttggaaacgggggtccgcaacctggtttgcaagaatgcaaacggtcctgcttctctaggtggagctctgtgggtacagtgagatgagagaagggggtggggtaggaggaagccaaggacagagcccagctgctggtagccgacagctcttgcgcccagacgcaatggttacagactctgcataaacagacctcgctgtggtggcggttttaactggcttgggtcttctgggtcctgttctctcctttgtaggatgcgtgcgtcttggtacctggaacacccaggacttgcgtgttctatgcaagtggcatgtctctagctcaaaattcacaaggcacatctagcatggcaggggagagaaggggctggtggcggggagagggacgggaccccgggcaggcggcaggacggggatcccaggctgcggggggactccgcggcagagccgctgggacctgacccgggagcgccttcgtccccgcgcgcacctccccgggtcgggcgacttacgtgcgggcgtcgggtatgtggaagtccacggcgtagccgaagtagctgcccttggggccgctgtacactgtgagcttttccacgtccaggttgaacgcctgacaggcgggggaccacagcaacatccccagcgcggccgcggcgcagcagaggggcgcgatcagcggcgcctggcttccccggggaccgcggctggccccgggcgacatctccctccgccccggtgggtggctgctacccaggagcgcgagccgaggacccctgcggggcaaggggggctggtggaatctggc

SEQ ID NO: 71038 - DNA, 259 bp, Homo sapiens; identical to SEQ ID NO: 32901
  chr10:15761855-15762114
  hyper

SEQ ID NO: 71039 - DNA, 30 bp, Homo sapiens
  chr10:15762409-15762439
  hyper
tatacaagaaagcctcgagggttttttttt

SEQ ID NO: 71040 - DNA, 31 bp, Homo sapiens
  chr10:15783191-15783222
  hypo
agccactatgcccggccgtgattattaaatg

SEQ ID NO: 71041 - DNA, 129 bp, Homo sapiens
  chr10:1585292-1585421
  hypo
gattccaccctggggcggtgtggggtggcttccctgctctccctgctctctgcgttcccacggtgcaggatggcggcgttgagagccagaaacgaaaccctgagaagcagaagccgggcgtcctgcccg

SEQ ID NO: 71042 - DNA, 28 bp, Homo sapiens
  chr10:15932007-15932035
  hypo
ctgtgaaatcacacgatgccaagcatta

SEQ ID NO: 71043 - DNA, 194 bp, Homo sapiens
  chr10:16086369-16086563
  hypo
ttgttgggtctttttcgcttggaaaaagtagcaaatggcaatatctgaaagggacattttacttttttttcttttaataaagcaattcaagattgccggtgccatatattcaaatgctcaaatcacgcacacacccaaagcatccacagtggcttatatgacatattcaccaacaacatcgccatctccaattt

SEQ ID NO: 71044 - DNA, 30 bp, Homo sapiens
  chr10:1621521-1621551
  hypo
catggttatgtgtgccgctgaatcatgtaa

SEQ ID NO: 71045 - DNA, 30 bp, Homo sapiens
  chr10:16468573-16468603
  hypo
gaatcttgacttagccgtttattagctatg

SEQ ID NO: 71046 - DNA, 258 bp, Homo sapiens; identical to SEQ ID NO: 32902
  chr10:16562368-16562626
  hyper

SEQ ID NO: 71047 - DNA, 46 bp, Homo sapiens; identical to SEQ ID NO: 3516
  chr10:16562627-16562673
  hyper

SEQ ID NO: 71048 - DNA, 956 bp, Homo sapiens; identical to SEQ ID NO: 3517
  chr10:16562709-16563665
  hyper

SEQ ID NO: 71049 - DNA, 354 bp, Homo sapiens
  chr10:16563690-16564044
  hyper
cgcgtgggcccgggcgtcccccgggtgcgcccagcggcggcggcggcgggcacggtcggcacggcgaggctcagagctggggcggaggagcgagcgagcagcggcgagcgcctcacggccgggagcggagcgagagagagactgaaggcagaattctgcctgggtaccacctgccaggagaagaggaggctgacaaacgcgcgccggagcaatttataggcacccaaggcacagaggaaggggagccgctttggcatctcattgcagcatctgctctgctcatcccactcagagagagtttggcattactctgacaatgtgggatttttttttttttttcggcctctctttttt

SEQ ID NO: 71050 - DNA, 149 bp, Homo sapiens
  chr10:1669194-1669343
  hypo
gtcccaccttttccccgggccccggcgcacccgctagcaccgctttctgcccaccctggcctggacgcctctccctccccacaggctcacacatcagtcacccactcgaactggagccgggccctcgggtgaatcgttagctcctcgag

SEQ ID NO: 71051 - DNA, 30 bp, Homo sapiens; identical to SEQ ID NO: 42540
  chr10:16714330-16714360
  hypo

SEQ ID NO: 71052 - DNA, 49 bp, Homo sapiens
  chr10:16715583-16715632
  hypo
atgtttcttgaagcacgtgatcatgcctgactggcgctggatgtccctg

SEQ ID NO: 71053 - DNA, 96 bp, Homo sapiens
  chr10:16928712-16928808
  hypo
gaagatgaagatgaccgagatggagcagaagaaagaacgcccaatggtagtatttactaaaagcagggcacatatattaattttttctttttgaga

SEQ ID NO: 71054 - DNA, 30 bp, Homo sapiens
  chr10:17050934-17050964
  hypo
atacatcatgatttacgtcttgcatttaac

SEQ ID NO: 71055 - DNA, 78 bp, Homo sapiens
  chr10:17079889-17079967
  hypo
aaccacaacctctctcgactgctcttcccttggctcccatgacacagtcacctttttttttttttttagacagggtct

SEQ ID NO: 71056 - DNA, 38 bp, Homo sapiens
  chr10:1708651-1708689
  hypo
ctgtgttcccccaatcgtgttcccgcaggaaagctgcc

SEQ ID NO: 71057 - DNA, 35 bp, Homo sapiens
  chr10:1714389-1714424
  hypo
cacgggcactgccaacgccccgtctttcaacctcc

SEQ ID NO: 71058 - DNA, 186 bp, Homo sapiens
  chr10:1716294-1716480
  hypo
ggaggccactgggaacggccccgtcggccgggggcccaggaatcagccctgtgcagagtgcattccgtaatgtgtgcaccttctctacttcagaaaaaaatattctttgaaagatccattttttaaagcctccaacccccttgtgagaaaattggcaactgtgggggcccccgcagcctcaaattt

SEQ ID NO: 71059 - DNA, 30 bp, Homo sapiens
  chr10:1725740-1725770
  hypo
gtttgccctcagatccgcttgggtctttgt

SEQ ID NO: 71060 - DNA, 170 bp, Homo sapiens
  chr10:17270234-17270404
  hyper
gatctgggaggcccacgtatggcgcctctccaaaggctgcagaagtttcttgctaacaaaaagtccgcacattcgagcaaagacaggctttagcgagttattaaaaacttaggggcgctcttgtcccccacagggcccgaccgcacacagcaaggcgatggcccagctgt

SEQ ID NO: 71061 - DNA, 602 bp, Homo sapiens
  chr10:17270653-17271255
  hyper
cccccaacatctctccgccaaggcaagtcgatggacagaggcgcgggccggagcagcccccctttccaagcgggcggcgcgcgaggctgcggcgaggcctgagccctgcgttcctgcgctgtgcgcgcccccaccccgcgttccaatctcaggcgctctttgtttctttctccgcgacttcagatctgagggattccttactctttcctcttcccgctcctttgcccgcgggtctccccgcctgaccgcagccccgagaccgccgcgcacctcctcccacgcccctttggcgtggtgccaccggacccctctggttcagtcccaggcggacccccccctcaccgcgcgaccccgcctttttcagcaccccagggtgagcccagctcagactatcatccggaaagcccccaaaagtcccagcccagcgctgaagtaacgggaccatgcccagtcccaggccccggagcaggaaggctcgagggcgcccccaccccacccgcccaccctccccgcttctcgctaggtccctattggctggcgcgctccgcggctgggatggcagtgggaggggaccctctttcctaacggggttataaaaacag

SEQ ID NO: 71062 - DNA, 76 bp, Homo sapiens; identical to SEQ ID NO: 3520
  chr10:17271443-17271519
  hyper

SEQ ID NO: 71063 - DNA, 465 bp, Homo sapiens
  chr10:17271520-17271985
  hyper
tccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaag

SEQ ID NO: 71064 - DNA, 38 bp, Homo sapiens
  chr10:17347136-17347174
  hypo
gatgtgtacaccccccgtgataccggttgcagtatcca

SEQ ID NO: 71065 - DNA, 96 bp, Homo sapiens; identical to SEQ ID NO: 15356
  chr10:17429165-17429261
  hypo

SEQ ID NO: 71066 - DNA, 96 bp, Homo sapiens; identical to SEQ ID NO: 15357
  chr10:17429561-17429657
  hypo

SEQ ID NO: 71067 - DNA, 54 bp, Homo sapiens
  chr10:17495392-17495446
  hyper
gcccccccccaaccccgcgccctcttcaaacacacgcacactcttacactcact

SEQ ID NO: 71068 - DNA, 206 bp, Homo sapiens
  chr10:17495474-17495680
  hyper
cgagtccaagccggtgcagccgcgccccatgcccggctcgcagctcccgagccccagtccgcccgcgctgggcgccgctgtacctgttagtggcgcgcggtaccgcggtcgccgggctccggagcgtcctcagcgctgcgggggtgccgtgggtggcctccctgctttcctccaccagaatcctgcacagccggggagaaaactta

SEQ ID NO: 71069 - DNA, 94 bp, Homo sapiens; identical to SEQ ID NO: 32911
  chr10:17496002-17496096
  hyper

SEQ ID NO: 71070 - DNA, 300 bp, Homo sapiens; identical to SEQ ID NO: 10198
  chr10:17496544-17496844
  hyper

SEQ ID NO: 71071 - DNA, 43 bp, Homo sapiens
  chr10:17505922-17505965
  hypo
gccccattattagtccgtgtcctgttaggaccaggccacacag

SEQ ID NO: 71072 - DNA, 18 bp, Homo sapiens
  chr10:17531563-17531581
  hypo
gagagaagtcttggccgg

SEQ ID NO: 71073 - DNA, 95 bp, Homo sapiens; identical to SEQ ID NO: 42544
  chr10:17579985-17580080
  hypo

SEQ ID NO: 71074 - DNA, 165 bp, Homo sapiens
  chr10:1767764-1767929
  hypo
accacccagaagagacgcccaggaccccacagcgggggaattacccacccacccggggcaacacccgagagagcagggagcaaagacattcacttccaggacagaaggccacgctgccgcactcgtatccgaagtttgaatgtcctcagccgcagatgcgttttt

SEQ ID NO: 71075 - DNA, 515 bp, Homo sapiens
  chr10:1778568-1779083
  hyper
gagtttgtcagtggccgctgtcagccggctgcttttcctgctttcctggtttgcggtttttttctaccactaacaaaatatgatgcttctttctgttttcctgtattcatttctgcttatttctccaaggacgagccctgtgttctctttacgacccaatgtttacaaatcgacgggcaccacattgagtaaaaactgccagccaatttggagaggcgatcgcagggcttcgcctatcccttcctccgggacagtttggatgggagtagctggcgcgagggctcgttcccccgtttttgggtaattcctttggcactgggagacgagatggcctccggagggtggaaggcagtgccagcccggccggccactggggactgcggggcccggagacgcgcggggtccccggggagctcctcgccgccctcgccccacttcgtccgggtccctcaaacatgtcgcagcgtggctgctcactgtcccctctgggcaagaggaggccccagacatttcca

SEQ ID NO: 71076 - DNA, 724 bp, Homo sapiens; identical to SEQ ID NO: 32851
  chr10:1779111-1779835
  hyper

SEQ ID NO: 71077 - DNA, 220 bp, Homo sapiens; identical to SEQ ID NO: 32852
  chr10:1779836-1780056
  hyper

SEQ ID NO: 71078 - DNA, 41 bp, Homo sapiens
  chr10:1789225-1789266
  hypo
gtgtcacatggattgcgtgacatgaacgtgactgtcacatg

SEQ ID NO: 71079 - DNA, 30 bp, Homo sapiens
  chr10:1829119-1829149
  hypo
aaaggttgtcggcttcgcactcgtaggagg

SEQ ID NO: 71080 - DNA, 183 bp, Homo sapiens
  chr10:18349201-18349384
  hypo
ttaacttagcgagcccgtatctggtttgtgtcctttcagtcatcacactgacattgtgtttgctattccttcatttagctgagtcaaaatgagctggagaagcgaaaatcagcacttcagcctgctctgcggagcagagcgcaggaaggttgccaagcctcccttgatcgcataatgcctctc

SEQ ID NO: 71081 - DNA, 38 bp, Homo sapiens
  chr10:18363159-18363197
  hypo
acatccatcacaggccgggtgcggtggctcgcgcctgt

SEQ ID NO: 71082 - DNA, 30 bp, Homo sapiens
  chr10:18393639-18393669
  hypo
caggcaggatggtctcgtaaacaagtagtt

SEQ ID NO: 71083 - DNA, 232 bp, Homo sapiens; identical to SEQ ID NO: 32913
  chr10:18429517-18429749
  hyper

SEQ ID NO: 71084 - DNA, 401 bp, Homo sapiens
  chr10:18429750-18430151
  hyper
tggctcccgcgggggcgctcggagccgccgcacaggtagcgagagcgcggcgccttctccttcctttgtgagccgccgggcagggcaccgacctcgggttctcccggcgcctccactgcagggatctctagcctcgcacctcctcccctcgtcgcctgcccaccctctgctcctctcctggcgccggggaccctgcccctttgcgccttttcctggctctgcctcggcttccatttttctctgcttccgaaaagccagtggggaagggcgggggagacctgccagtcctcccagacttctcccgggttgctccagctggccctcctcgccccttcccgggagaggcacatggagagacatgaatcaggggagtggactggacctgctgaagatcgtgagtc

SEQ ID NO: 71085 - DNA, 64 bp, Homo sapiens; identical to SEQ ID NO: 32916
  chr10:18430183-18430247
  hyper

SEQ ID NO: 71086 - DNA, 90 bp, Homo sapiens; identical to SEQ ID NO: 42447
  chr10:1850230-1850320
  hypo

SEQ ID NO: 71087 - DNA, 122 bp, Homo sapiens
  chr10:18672520-18672642
  hypo
ctttcatattagcagcgaggggtaaaccataaataaatacataagtatgtagatggtgcaccagaaggttggggagatattaagcagagaagaggaatacagagtagcgaatagagtgccat

SEQ ID NO: 71088 - DNA, 30 bp, Homo sapiens
  chr10:1889085-1889115
  hypo
ctcacgcattaataacggcataggggaagt

SEQ ID NO: 71089 - DNA, 30 bp, Homo sapiens
  chr10:18950336-18950366
  hypo
ggctacttttatactcgcataattgttcag

SEQ ID NO: 71090 - DNA, 39 bp, Homo sapiens
  chr10:18979783-18979822
  hypo
tataatggaacagaccgggcacggtggttcacacctgta

SEQ ID NO: 71091 - DNA, 30 bp, Homo sapiens
  chr10:1981745-1981775
  hypo
gagtaacatctttcacgcagagaaaatgag

SEQ ID NO: 71092 - DNA, 30 bp, Homo sapiens
  chr10:19907854-19907884
  hypo
ctgtttgtctacactcgctcactctctaat

SEQ ID NO: 71093 - DNA, 389 bp, Homo sapiens
  chr10:1994909-1995298
  hypo
gagggtcctctgctgcgtccttgcggcctgttgtcttactcagcggccctgacacccggcatttatttaaagcctcgaggctggatgcggttgcgacagcagggcgtgttcagaggaaagaaggggctggagcccgggcactcgggttaggcaacgtcaaggggctcgggaggagagtgggctccgccaaggcggtggctgcaggggccacgtgtggcctcttggaacacggaggaaggaagcgctgaaggacgtaaggactgtctgtaaaatcctccctgacaagggaggtcagggtcgggatgtccccttggacgtggcgatgcggaggcctgagtgacctcaggagaggggctaggtggagatgacgctcacggagggtgactcgg

SEQ ID NO: 71094 - DNA, 76 bp, Homo sapiens
  chr10:20056020-20056096
  hypo
actttgctaggaaaacgggagcataggagagccagagtgacatctttctttttttttgagatggaatctagctctg

SEQ ID NO: 71095 - DNA, 30 bp, Homo sapiens
  chr10:2005972-2006002
  hypo
gtggaatgtaagtcccgtgagggaaaggac

SEQ ID NO: 71096 - DNA, 152 bp, Homo sapiens
  chr10:20069005-20069157
  hypo
caataacatgctgtgcgatattgtagcctaggagcaacagactattcattccatataacctggatgtgtaggaggctctaccatctaggtttgtgtaagtacacccaaggatgtttgtcaacaacgaaatcacctatcgatgcatatctcag

SEQ ID NO: 71097 - DNA, 54 bp, Homo sapiens
  chr10:20104308-20104362
  hyper
taagatatcaactaacgagagggccggcaagggttaacgcggaaacagatcccc

SEQ ID NO: 71098 - DNA, 237 bp, Homo sapiens
  chr10:20105418-20105655
  hyper
ggctgcgagaaaggacgcgcgccctgcgtcgggcgaagaaaagaagcaaaacttgtcgggagggtttcgtcatcaacctccttcccgcaaacctaaacctcctgccggggccatccctagacagaggaaagttcctgcagagccgaccagccctagtggatctggggcaggcagcggcgctggctgtggaattagatctgttttgaacccagtggagcgcatcgctggggctcggaa

SEQ ID NO: 71099 - DNA, 243 bp, Homo sapiens
  chr10:20106451-20106694
  hyper
aggctgtgtgctctccggctcctcctccttcctcgctgctggttaaactaagcgtgtgtggtatggggtgggtgggggacgttgtgaaagccagggattgcaggtctcccctctgcacgagaaaattccctgtggcagcaccttccttcccctggcgatccccactagctccgtctagtgacctgggccaagcgggcgctggaaggggggcggggtaaatgcggccggcgcagaggtggggag

SEQ ID NO: 71100 - DNA, 32 bp, Homo sapiens
  chr10:20106927-20106959
  hyper
tggaaccctgcccaccgcgaactgggtgccta

SEQ ID NO: 71101 - DNA, 30 bp, Homo sapiens
  chr10:20754862-20754892
  hypo
taaaaaaagaatagtcgtatagttcataga

SEQ ID NO: 71102 - DNA, 193 bp, Homo sapiens
  chr10:2094436-2094629
  hypo
ctggtttgccctggccgcgtctccatctgttactcagtttctctcatggattcgcaacccacattcaactgccttttcaacttgcaaaagggtcttgttttttgcatgactctttatttttaatcataaaaagtaaccattttgtgtgctcgtttttctttgtcctacaaggatatagcgtactaacctttat

SEQ ID NO: 71103 - DNA, 336 bp, Homo sapiens
  chr10:21461963-21462299
  hyper
caaatttccccagaacgcccctggctggtttcaactgtcagtcactccggatcgctcctgggtgtctctctcccgggctgttcatctccgtccctgcccgggaagggcagggggcagggctggaggggcccggctacagaactacttcccctggaattccccacccggtggattagacacccgtgggtccggcttgccgcgctgagccggagctctccagcagggattattcttagcaatgcggcagcggccgccccatgacatattaattactatttgcctctccccctcgccgcggtcacaggaggcgctgcgggtgggcggtgaggtgggatc

SEQ ID NO: 71104 - DNA, 53 bp, Homo sapiens
  chr10:21462618-21462671
  hyper
ggtgccaaaacttctcgaagcaggtgcagcccctcgcccggcaggtccaggct

SEQ ID NO: 71105 - DNA, 60 bp, Homo sapiens
  chr10:21463573-21463633
  hyper
cccaggcccaagggccgggagatccgcggggaacccggagacctgcgtcccagaggggcc

SEQ ID NO: 71106 - DNA, 63 bp, Homo sapiens; identical to SEQ ID NO: 32919
  chr10:21783695-21783758
  hyper

SEQ ID NO: 71107 - DNA, 67 bp, Homo sapiens
  chr10:21784179-21784246
  hyper
aataaacaaagcattcggacgagagtgggctgctgggggctcgggaggtgcgcgagacaaggttacc

SEQ ID NO: 71108 - DNA, 97 bp, Homo sapiens
  chr10:21789041-21789138
  hyper
aaatgcacgaccccgcgcgccgcgcgcgacctccacgcacacttagagccgaggtgacaagggaaggcggcgggggtggagccgctctctggtggag

SEQ ID NO: 71109 - DNA, 269 bp, Homo sapiens
  chr10:21805094-21805363
  hyper
tctcagataccctatcgttccttatctcagcgaaacaactccccaggctggccgggcagtacaccggagatgctttgggggcccagctctgcagattccactccgccggcgactccgctttgacactactcttgaggtcgggaagtctgccggcatcctcgaaagcagcgggtttggttgcagcggcggcggaggccagatggtacaagaagttggcctgcgcctgcacgctgggaggcttgcagaagctggtgcgcctgaatcggatg

SEQ ID NO: 71110 - DNA, 124 bp, Homo sapiens
  chr10:21810083-21810207
  hypo
aggcacattgggggtcgatcccgataaaaagatctagcagaggcccctgagcgctcacacatgaaaggcaggggactttaagatggatttgcatgcacaccggggatttcgatcaatagctacc

SEQ ID NO: 71111 - DNA, 137 bp, Homo sapiens; identical to SEQ ID NO: 42546
  chr10:22033212-22033349
  hypo

SEQ ID NO: 71112 - DNA, 30 bp, Homo sapiens
  chr10:22040753-22040783
  hypo
acacctggggaagaacgtggcttggctgca

SEQ ID NO: 71113 - DNA, 40 bp, Homo sapiens
  chr10:22047461-22047501
  hypo
aaggccaactacaaacggccacggccgtggaaagtaagcc

SEQ ID NO: 71114 - DNA, 41 bp, Homo sapiens; identical to SEQ ID NO: 42547
  chr10:22450029-22450070
  hypo

SEQ ID NO: 71115 - DNA, 97 bp, Homo sapiens
  chr10:22465341-22465438
  hypo
acacttcgcattagggttcataccctattagagtcgaatgccacaactgatctgacaggaggtggatctcaggtggagttcacggacagataccagt

SEQ ID NO: 71116 - DNA, 439 bp, Homo sapiens
  chr10:22518011-22518450
  hyper
gaaatacatgcatttcggtggccccgttacatttcacgcgtcacgaagccgagcaagaccagcccgggccgccttccccgtgtacgcgcgggcctccggggacgcgcagagctggagcggcgggcgcgcgcggcaaacgggcccgcgcggcctctgcgcgtccccgctccagcaccctggcgaggcctagaccgccgtgaagaccccggggaaggagtggccgcgctcacctgcagccgggagaggacagcgggggagaggaggccgctctgcaccggccgaaagcgaagggctcgccggctggccgcgtagtgtaagggtcggtggtttctttgcttggtccctggaaatccaccccttcttatcccggaggcctgaactcgatttctgcaaaacttcccgcgaccagctcataaaaggagagcgcgtccctgggtgg

SEQ ID NO: 71117 - DNA, 18 bp, Homo sapiens
  chr10:22518510-22518528
  hyper
cttcggtgtcattttccc

SEQ ID NO: 71118 - DNA, 1111 bp, Homo sapiens
  chr10:22540740-22541851
  hyper
cgggcgacgctcggctgatgggaccgggccgcgcaagcctcggatgcagccgggtggggggcaccaggcgctaggcgaaggagcgcaggaccaaaggagatgcttggctcctaagataacacctttaaaaagaagaagaagaaagaaagaaaaacaaacaaacaaactcgatacttagcctcacgatccttgccaccccctccctgctccgccacccacacacaaaataaagtgagccgggcgggggagtgcgcgccctgaaagggaacaagaagcaaggcgcctgtgacacaaaatggagaaagaggaaccgggagtggaaaggaagaaggaaaaccgagtaaaggaggttattcataagaacaggaaaggggccgaggggtagagaacacccgaaggaaagcgcaggaggccctcgtgagagggcaagggggaaaagatcgacgaagtaagagcgaaaagaggaaaggaaagaaagactttctagatgcggagtctccattttcagcagcgccatattcgcttttcctctcgccgcttttggctgggttttgtgtgcggcggtggacaggcgccagcacatttctgcagcttcagcagctctgctcagacacctggggagggccgcagggcccgggcgggggacgcgcgctcttggcccaggcccgggcgcggccccctccccggcctggcggttcctgcgcagcgccagccccgcgctcctctaggctgcaaagggggcctccgactcgggcccggcccggaggggacacctcactcggggccccgcggcagcccccaggggacgcgggccctctagtttcgcccacggtgtggctgggcatgcgtgccaaggggatgcgtaaccgagaaccgaaaaagacgaacttaaccttcggggaggaggagagggcgcacgctgcgggtaccggggcttgggggcgctcctggaggtgacggggtcacctccacctgcgcggggccactctctgggagccggcgatcgatgcccgccgcggcgcctggcccaggcccccaggcctctcgcggctcccggaaaaacgtccgaggtcggggctcggccgggagccccaagcgggtcccctggcct

SEQ ID NO: 71119 - DNA, 226 bp, Homo sapiens; identical to SEQ ID NO: 875
  chr10:22542024-22542250
  hyper

SEQ ID NO: 71120 - DNA, 29 bp, Homo sapiens
  chr10:22542567-22542596
  hyper
ggccccgggataatcggatcctcccagac

SEQ ID NO: 71121 - DNA, 25 bp, Homo sapiens
  chr10:22566939-22566964
  hypo
tagcatggttgttaacggtggaggg

SEQ ID NO: 71122 - DNA, 84 bp, Homo sapiens
  chr10:22567324-22567408
  hypo
cagagcgagactccatctcaaacaaacaaacaaaaaagaacgtacactccacagtgttcgagcgggcagcgggagtgagcatag

SEQ ID NO: 71123 - DNA, 284 bp, Homo sapiens
  chr10:22624022-22624306
  hyper
gaggaggggtggctgcgcggcgggaatctcaagatctgggcaaaggctcgcgtctcgggacgcgaagtcgacgccaaaatgggtccccggacaaggcgaccctgggagtgccggcgcccccggccgggcagaggagcgggtgggccgaggctgggacatcgcctccgaaagctgccgggacgcggcggcttcctgcagagcctgcgcctgccggatccccagaacacagaagcttctcggacatgggagctccccgtgcgccctaaaaccaggagaggaaggga

SEQ ID NO: 71124 - DNA, 560 bp, Homo sapiens; identical to SEQ ID NO: 876
  chr10:22624561-22625121
  hyper

SEQ ID NO: 71125 - DNA, 401 bp, Homo sapiens; identical to SEQ ID NO: 877
  chr10:22625382-22625783
  hyper

SEQ ID NO: 71126 - DNA, 292 bp, Homo sapiens; identical to SEQ ID NO: 878
  chr10:22625811-22626103
  hyper

SEQ ID NO: 71127 - DNA, 190 bp, Homo sapiens; identical to SEQ ID NO: 879
  chr10:22633985-22634175
  hyper

SEQ ID NO: 71128 - DNA, 108 bp, Homo sapiens; identical to SEQ ID NO: 880
  chr10:22634324-22634432
  hyper

SEQ ID NO: 71129 - DNA, 6 bp, Homo sapiens
  chr10:22634433-22634439
  hyper
gctccc

SEQ ID NO: 71130 - DNA, 215 bp, Homo sapiens; identical to SEQ ID NO: 882
  chr10:22634440-22634655
  hyper

SEQ ID NO: 71131 - DNA, 30 bp, Homo sapiens
  chr10:2264537-2264567
  hypo
aacattcacaccagacgtctccttcacagc

SEQ ID NO: 71132 - DNA, 125 bp, Homo sapiens
  chr10:22725790-22725915
  hyper
gcgcaggggcaaggccgcagcgggcagcggaggccgaaacagagaacacacacaacgcggaccgacagcagtcaccgcaggggtcgccggggcgcggctctataaagcctcggctctataaagcc

SEQ ID NO: 71133 - DNA, 1017 bp, Homo sapiens; identical to SEQ ID NO: 32936
  chr10:22764573-22765590
  hyper

SEQ ID NO: 71134 - DNA, 137 bp, Homo sapiens
  chr10:22823423-22823560
  hypo
tccgtggcccggggtttggggacccctgctataatacatcagttgcattagaagaaaaatgagttatcagagcaagtgctatagacaagctgtctgtgttaacctggcaccaagtggaatgccgttaagtctgctat

SEQ ID NO: 71135 - DNA, 30 bp, Homo sapiens; identical to SEQ ID NO: 15322
  chr10:2283030-2283060
  hypo

SEQ ID NO: 71136 - DNA, 48 bp, Homo sapiens
  chr10:22831077-22831125
  hypo
gtggggcagcagaggcgccgggtgcctccttcacgatgctcttacact

SEQ ID NO: 71137 - DNA, 102 bp, Homo sapiens
  chr10:22832580-22832682
  hypo
cctcccctagaatctcggcagctgccaggctgtgaggtgcacctggccgagatcacctggctgggatcatgtttgtgggggcggctgcggggagaaatctac

SEQ ID NO: 71138 - DNA, 64 bp, Homo sapiens
  chr10:22833946-22834010
  hypo
caaggcagccccaaacggggctctaaggttttggctttcactgcattcccgaatcccggcaggc

SEQ ID NO: 71139 - DNA, 30 bp, Homo sapiens
  chr10:22869695-22869725
  hypo
tttcactttcaaccacggtctacaagatgt

SEQ ID NO: 71140 - DNA, 138 bp, Homo sapiens
  chr10:22869936-22870074
  hypo
ctgaacaatgctggccgtcccgtgtgtggctcagaaattaagagcacacaccagataagtgggcttattctcctgtgagagcacaggcagcatgaacacaataccgaagagtgttcctttcagcggctccttgagtag

SEQ ID NO: 71141 - DNA, 34 bp, Homo sapiens
  chr10:22949402-22949436
  hypo
aaaataaaaaataaataaacgcttactgaatcct

SEQ ID NO: 71142 - DNA, 78 bp, Homo sapiens
  chr10:23001906-23001984
  hyper
ctgtcatttccattacgctgaaaaggacatacagacatccatcgaaatcaaaagcagggaaagcgaacttacactttt

SEQ ID NO: 71143 - DNA, 30 bp, Homo sapiens
  chr10:23002198-23002228
  hyper
cccgactgtgcgtgacgctaacctttccac

SEQ ID NO: 71144 - DNA, 18 bp, Homo sapiens
  chr10:23216825-23216843
  hyper
ctggattcaggtaatcgc

SEQ ID NO: 71145 - DNA, 286 bp, Homo sapiens; identical to SEQ ID NO: 32939
  chr10:23216844-23217130
  hyper

SEQ ID NO: 71146 - DNA, 242 bp, Homo sapiens
  chr10:23460221-23460463
  hyper
tttttattacacacacgcgcgggcgtgcgcgcacacacaccctcccccccatccccccaacggaaacaagcacacacccgggacgggaggtattaaaaaggtgtgatccccttgcttttagatttgagcagatggcccatggtttgaggcggttgcctccgcaggctcggcctttaccttcagcaccaaggccagcgcacctggctccacgaggctcccagaaccttcgccattccgggact

SEQ ID NO: 71147 - DNA, 1322 bp, Homo sapiens
  chr10:23461141-23462463
  hyper
taccaactgtcaccacgatccgcagttcttcgcccctccctctgtcccaattatctagaaacaaaaagagtagaaaatcgaaaatgagatggaggtcggcaggggtgtgaggccacggatggctgctgcttccttgcttccttcttttgaagccagaatcgactctgctcttgctcgatgacagcccctcgccggaggcgcggctcctggcctctgcgggggtccgcgcaatccgggcgcctccagctgcccccctcctccgagggtcgcagccacagagcgcaggcccaagctggggcagaccaagggcggctggggtgctcatgccggtgccggcatcactgccggagccgccctgggcgcactgcacccagcgctgcttctctcgctggttctgtgccgctgctcctcccgatgcttgggggaccgcagggaggccgaatgacaaccggggagcctcggggccgcgcctgaggcccagagtctgggctgtgcagagcgcagagccccagcttccccagctccctcctggattaatgcttggtgccagggagaagcgcagggctctttccgcctcctccccaagtgcacccgggcgcgcttccatctgattagaatgtttcttccatcttattagaatgacagtagctttcaagtcattcattatgagaagaattttagtcttaaaagaaaaaagggagtcccactgtaattgtgagttgtaataaatgcaaacttctggtgccttcctctgcagcatggaagacagtaaaaaatgtgtctcgtccaaacgcaccccctctccaagcccattgtgaagtcagtcgccaacaaaggggacgtgtgaatattcaacaccgactctttcacttgttttttccggaatccctgagtcgactcaccccctctcctttttttttttttttaaatgggcgaatacctgtttaagttttaaaagcacatggaaattgcccgcgagcgaccatataatttgatttgccaggcaatctgcagagcgatcgcacgtcatttataatgttcattgagcattttgcctaattgtgtctgtctctgaaagggcagcgcaccccctcccgaccgctagcagcacaagtggcgacattcccatggagcggccgcgccgcagcttgccgcattcagcgcggacggcctggccgcgcgcttccccgcccggacgaccgggcgcgcctgacactaatagctcgcggctcaggtacgagcgggcgccgcatttgactcaattcaattcacaaccggccgcgcttgcaggtgtcgccttttgaaaccgccattcaggcggc

SEQ ID NO: 71148 - DNA, 130 bp, Homo sapiens; identical to SEQ ID NO: 32943
  chr10:23462485-23462615
  hyper

SEQ ID NO: 71149 - DNA, 440 bp, Homo sapiens; identical to SEQ ID NO: 32944
  chr10:23462634-23463074
  hyper

SEQ ID NO: 71150 - DNA, 588 bp, Homo sapiens; identical to SEQ ID NO: 3535
  chr10:23463266-23463854
  hyper

SEQ ID NO: 71151 - DNA, 190 bp, Homo sapiens; identical to SEQ ID NO: 3536
  chr10:23463887-23464077
  hyper

SEQ ID NO: 71152 - DNA, 821 bp, Homo sapiens
  chr10:23479876-23480697
  hyper
ttggaatttgagaggcgtctgaatacccaacagaagcctctagtgagacaagtgcctgaaaaaggaagcggcccaggaggacgactcctttcagtcctctgtagagagaatacgcacgatggctgcgcttctgaactctcccggggtggaagctgcagcctggcttttaaccggaattgcccagaccttgaaagtgtttctttgttgctcttaaaaagaggaattcacgttgcatcgcagtctgtgataaagtctgtcttggggcagagctgcatacgttttgtgttttttttttttttcagaaaagaaaggtcgagaaagaaaaaaacaagtcattcagggatggtccctgtggccagtcggaaaggtgagagactcgggctttgaaaacgattcacattctgccctttaacttcaatgccttccctccggactgcgccggagcagacgattcaatggactccttttgtatccagtttattgctcagaatccctagggtctagatttgctctcagaagaaacgcgccccgctgagctgctctgggggctgcccctcccgtctccccattcctttctccgggccggggagggcaggggaggcagccactgagccgatgtcgctggggacccgcaccaggcaccacagccaggctccagagcggagtcccataggtgcgctcccagcccccgtgttgcgtctggaacgcagtgggagtgggcccggatcaccttccaatgacacccgcatatactctgcaaactgtgcaaaagcccttgaaaagtccagagatgggacagaagcccccagcagaacccaggc

SEQ ID NO: 71153 - DNA, 147 bp, Homo sapiens; identical to SEQ ID NO: 32948
  chr10:23480903-23481050
  hyper

SEQ ID NO: 71154 - DNA, 82 bp, Homo sapiens; identical to SEQ ID NO: 10226
  chr10:23481303-23481385
  hyper

SEQ ID NO: 71155 - DNA, 400 bp, Homo sapiens; identical to SEQ ID NO: 10227
  chr10:23481386-23481786
  hyper

SEQ ID NO: 71156 - DNA, 446 bp, Homo sapiens; identical to SEQ ID NO: 32951
  chr10:23481787-23482233
  hyper

SEQ ID NO: 71157 - DNA, 180 bp, Homo sapiens
  chr10:23482288-23482468
  hyper
cgaaggctccggaggggctgggggagctgactgccaagcagacagtcggaccgacggattgtcggtgggcacggaaaaacttgaatgcgagctcgcgtttctcgtttttttttttttttttatttttctgccacgttgaccgcggctctcaagggcgcgcgtccccgccagacttgcagc

SEQ ID NO: 71158 - DNA, 1052 bp, Homo sapiens
  chr10:23483566-23484618
  hyper
agctagtgggctaagcgaatgggcctttctgcttccactggctgggaaaggggctactcttgagctgccctgtgaccaacctcttcggcagcaacagcatcaggtacctggaactcaggcttactcctcacaaaggagatgggacaggctacggtgccaaagcctagagaccactcggaggccactcaacaaaatccagggtcttttaggtaaggtaggaagaagccgcccgctacccctgccaccttcgcaacaggcttacttccaaaactgagttcgttttgccttcatcagaacttggccctcctcggccagcaacctggggagaaggcgagcctgaggcggggggcgtagggtagccccctagcgaaggggagaagagcgagggcgcggccgaggtcgcttagccagaaagcctgggagtccaggcttgggtttgtctcctttgtggccaagagcgcctcccgggctctcggggcgtcctcccctgcccgccagagccggggcgccggcactgggccctgaggcctggcgcgcgcgcagatggcgttggcgcgagcgcggactggagacgcgctcattgacgtggcaccgtagccccgtgcggcgcaggcctggcccaggcggggtgtggttccgtgggccgcagcggcctggtgggcgaaggtacaattgcggatagcctctaatactcacggccctgccgcaggacaatatgttggcagcatgctaattgctttaacctagtttcagacccaccgaggggttccccgcgcgccgcgggtgccatggacctcgtccaagagcaattaaagcgaggccgcgagcccgaccccgcagcgcggcctggccagacacgcggagattctgggtcgcaaggctcccgggagccccttggccgtggaccctctcaccccttttaagccttcgcgccctctccctccactcctcctaaaagaagatttcacactggagacagaatttcagaacgagagaaaataattcgattttgtcctttattagggcctcattaaacacgaaagttgcttttg

SEQ ID NO: 71159 - DNA, 30 bp, Homo sapiens
  chr10:23484874-23484904
  hyper
atgaagcggaagaaccgagctgagcatgca

SEQ ID NO: 71160 - DNA, 207 bp, Homo sapiens
  chr10:23486207-23486414
  hyper
aggctgggagcagagcgcataaaaggccttgttggaactcctgtgaaatcggctgagaatgcttcccaggaccgctcatctgccagccccaggattaacgcccctccgtggagagggtgtgaagcctcttaaatccataaactcatcccatttccattaatgggcctttgcggtggcaccgagtaccagctgcgaggttgaacaaac

SEQ ID NO: 71161 - DNA, 517 bp, Homo sapiens
  chr10:23487742-23488259
  hyper
gcattactttcaagccgaacaaaggccagggccggggggaggcgggggaagggctcggctgtaatgaagcgcctctaaggcggaggtgctgccgtggaggctgaggcggcggcggagcgcgctgctgcgtttgtgcgcaagtgactctcctgtgccacacacaaaaggcctccctcttcccaccttctgccgcctttcagccctccggctcctgccgagcccgctcctgggactctgggggggatcctggctgcatccccagggcagcctgacctttgggacatccgccgctgccagggcaaacctcgccaaactttccccaaactccgcaggccggggagggaccctggccggaggcgcgcatgcgccccgcccgctgctccgcgttcccagggttccggagagccggggtggagtcggacgagtgtccccggaggcccgcctagcccttgctcccaggggcattcgggactcctgtgctgcctgtcttcgcttgaggctggaagtggctgcccga

SEQ ID NO: 71162 - DNA, 1713 bp, Homo sapiens
  chr10:23488342-23490055
  hyper
cgaacggccaaaaggagatccggggatgggaccccaggcttcttcggaggaggcccggggcaactacgccccgcggccgggagggaagccctcgggcggccgcctgtagagggccccgtggcccggggcgcaggttgtggcgagctggtttttgcctctgggccgaggcgccagcgctagcagcgacagcagcggggggcgcaggtttctagccagtccccactttcggacctctgggggtctgcccttgcttctcggggagtcttggcccttgactgatccccgcaacttaaggccaatcccatccctagctggccggcacctgttccaaacaacctgttgcgctgacatcgctttggagaggcgccggcgctttgctggtggaggcgggttgtgtggaggccccaagccttcaggaaatagtttagggttccgttgtggtgagaggcaccccctccccgcttcctgtggcatgtggggtgtttcacctctgcctgtgtcccaggaacccaaggcgtcctgggcacctctgcacctcgcccactctagggacttctcatgtagagctcggcagtttgggtggattagacaaagatgaggattagagacacaccgccggctaattaaatgggctcttctcctctcctcgtcccctccccgcaacccgcagccagataggactcttcggttccctacccccactcctaggccctatgtaagtgcggatggagaaagctagttacattagcccttctgtcttagaggtaccggcacctcggggcattctcgctcttaaagatgcgttttctgaattatttctagttttacaatttctcttcggtgactgcacaggatcccttctagctcttttcctgttggagtcgctggacgtctcccaaacagctagttagtcgcctatctctggagcgcaggccttcggaattggattcagggtatgagtctagctaggggatgtttctagaagttttataaaatccatttgggcaagcgttggcattcggattttaaaaatatagacgtgcactggcattgggcaactcaaaaaaaaatgtgtctcctggcgcttgtcagtgacatgctaattacaaattttaaaacaagccacttctaagcgaaggacgcctggctgcaaccccacaactcacaccggtgcatataataaaatattagggttcaacagttggcatatgtggcaatagcaaatgtgacacctcgaagcgattatctggaagtttttccgtacttttgaaaatacacttgccgcctcatttctctgatggccgctcaatagacactgggagatggtagctgggccacccctcccaagagttcttcttgcgtgcagcgctttcatccagggcttgaattgtgttgtcaaagtttagcagacaagaggagggggcatgagaacgggagggtgtcttgaaaagtcttggaaatcggtgtattttgcaggtgtagaagtgcctaataaccatggctagtgcgcgctccccaatggcgagggtatgacagggacagctggctcagttttcagtgtgaaaacaccccctcggtggaccaaacacaacgacactgacctttcttcggggggaaccagggatgtgcctttgactgaattagccataaagacgtcttgctatgacttttgttccccacgaaagcaaagaaatattgcgtttaatatgagaa

SEQ ID NO: 71163 - DNA, 76 bp, Homo sapiens
  chr10:23491161-23491237
  hyper
acctagctagttctgcggacctctttgttccgcggcagaaagtcaaagaaaaaaggaaaagcgctgccagttgcca

SEQ ID NO: 71164 - DNA, 47 bp, Homo sapiens
  chr10:23632977-23633024
  hyper
cggagtcgggaacccggcgtccgttgccatggcgactcccaggtaac

SEQ ID NO: 71165 - DNA, 123 bp, Homo sapiens; identical to SEQ ID NO: 32958
  chr10:23633374-23633497
  hyper

SEQ ID NO: 71166 - DNA, 29 bp, Homo sapiens
  chr10:23708959-23708988
  hypo
tacaaatgggccaggcgcggtggctcaca

SEQ ID NO: 71167 - DNA, 126 bp, Homo sapiens
  chr10:2374203-2374329
  hypo
ctccataccccacaccgttcagtcacttagctcagccaccgtgggaacagtgcatgaattgcgacaaggctgctcagccaaggccctctctgaagatgaatcagtgatagacgctgtcttctggaa

SEQ ID NO: 71168 - DNA, 958 bp, Homo sapiens
  chr10:23982384-23983342
  hyper
ctcgcagttaaaaaccgttgccactcgacggtggcaaaattgctggctgcactggagatcactgcagagcgctcctgatgcctcgatgctgacggcggatctggcgcgggctggggcgcattgcacattctgctccagccgggaggcggcgggcgggcaactccgggttggtcactcggcagccggcagaggtgcgcagaaggcgcacagaaccaggcactcagcctcaaggatgtctgggtctctgctaagggacaaacgctccaggaacaaggaacaacctctagccatcccagcaccacctaacgaaccttcgtttggctctctcgcagaaagtctcttctatttttggcccccaagacaatttcagagaaccagtaaagttgggtgacaacgtggatcgctttctagtgtaaggtcccggggaatggcaaaactcaaatgtagcctcactgatgagctcaaggaactctgcttggagttgtcacccctacgactgacctcagacccaggacccaagggcggggccctcttgcatctggaatccagcctcggccttgacccctttcgcttgttcggagtgctttcgcccagcttctggcggaggttcacgcagggaggggactcaggtggaaaaggctggcccctttgatctctttgcaggaacttagtagacaggggccccgggctggagatttgcttcgagtaggctagaggcgcccttggcgcaccgaagctggctgccttgctggaacctgccgcgggggtggaggttgaaaggactctgagctcttcttccccaagccgaactccctcctacaggagcgtggaaaccaactctcccacaccgtctatcccactcttcccccctaaacctctagcgcagctttttaaaggcatcctgtgcagcctccaactttggggaaagagaatgcccaactcccgctctccaactacc

SEQ ID NO: 71169 - DNA, 1158 bp, Homo sapiens
  chr10:23983617-23984775
  hyper
cgcggggtggggggtggtgggggtgacgtcaggactgcagtccagaagagagcggctggagagggctgcgcgcttctcgccaagcaagcgggaggcgcactggggccgccgccgttcccgcgctcctccctctcctctgcacccactgtcacgctacccgcccgcgggggagcctcgagagcctccaggtgaattgaaagtcgtttccgggggaggacggagagggtgctgcagtcctggcatgccctgaaactgcaagtcgggcagaaacgacccggcggaggagcagggcgcgcagcgccctgcgcagcatccccgggctgccagaagaggccaccactcggctggcagccgcgagcggcggccgaacctcggccccagactcgggcccccggcacgctcgcccgggagataccccttccccctcttgcgcatttcgcagctgcgctggtgtggggcatgagagcgaggtggctccaggtctccgcggagcagctgccagtgggagagcgaggagaggcgagggggcggcagcctcggcccgaagtaagtgcagcagaagtttgcgtcggttgccccgccgctcccccagcgcgagtgggaggcacatctcccctccttggataaggaaaccgaggggagacttacaagggagccttgcgcgggagagcaagtgagcgtttcgagagagggcaaggacccccccaggagggccaggccgggaggggtcccggtgcggtgatggggtgccaaaaggagaagacccccaactgggaggagggactggagaggaaccggaccccggggatctcagaaagggaaggatgtggggagagtgaaggtggaggcagtcacacctatcctggtgaccttggcgtgcccccctggagtggcgagccaggggcttatataggtgcgactaggatgttgcctcgtttttcactcggggctgcgaagagggcattgctctttctgatggctggaagacaggggcaaggagagagagaaccggccccgagacgggctggagggtggggacactggggagtttggagctgggggttcggagtgggaggtttgggtcttctgagacgctccagactctccggaggcggcagaggtcgaggcaggaggcgaatgtgacgcttagggtcgcta

SEQ ID NO: 71170 - DNA, 146 bp, Homo sapiens; identical to SEQ ID NO: 10240
  chr10:23984841-23984987
  hyper

SEQ ID NO: 71171 - DNA, 145 bp, Homo sapiens
  chr10:24440378-24440523
  hypo
gtatctagtatgcatcgggcatggttcaaggttctatgacaggcgctggaggaaggatgttccagccacatcatacacggcgttgtaagaattaatgtactctaggtgtgtgtgtgcttcagagttgatgcgtaagaattcagaa

SEQ ID NO: 71172 - DNA, 44 bp, Homo sapiens
  chr10:24497697-24497741
  hyper
aatgttttccttcctcggctgcagagcctcggtggtttgcagca

SEQ ID NO: 71173 - DNA, 30 bp, Homo sapiens
  chr10:24498138-24498168
  hyper
gccagaaatgtgagccgtgccttccttact

SEQ ID NO: 71174 - DNA, 102 bp, Homo sapiens; identical to SEQ ID NO: 42450
  chr10:2452926-2453028
  hypo

SEQ ID NO: 71175 - DNA, 104 bp, Homo sapiens
  chr10:24841749-24841853
  hypo
catctcctacctactcgccttgtttcaaaaataaaatacaatgtcctagtggcactataacaaaggtataattattaccgtgccatgcacgcacccatcagcag

SEQ ID NO: 71176 - DNA, 24 bp, Homo sapiens
  chr10:24842550-24842574
  hypo
caggaaagggccaggcgaggtggc

SEQ ID NO: 71177 - DNA, 30 bp, Homo sapiens
  chr10:24860681-24860711
  hypo
cgtattctttagctacggcaatgtcaggtg

SEQ ID NO: 71178 - DNA, 42 bp, Homo sapiens
  chr10:24908420-24908462
  hypo
caaagaatcgccaggcggactggtactcgaggcttttctttc

SEQ ID NO: 71179 - DNA, 42 bp, Homo sapiens; identical to SEQ ID NO: 42555
  chr10:24988521-24988563
  hypo

SEQ ID NO: 71180 - DNA, 51 bp, Homo sapiens
  chr10:25241140-25241191
  hyper
gcagaagcgactccccgtggctcgcggggatggggacggctgggcgccggc

SEQ ID NO: 71181 - DNA, 274 bp, Homo sapiens
  chr10:25241730-25242004
  hyper
gagcagctgccaagccgctaccgctccccctgagcgcgggccccggacgcgtcccttgcggccgccgctgtcgccgccgccccctgccggatggtcgcgtgcagcccccggccccgccgccaagccccgcggggactctggagcaggaagcccgcggcaggaagagaacgtgtcccccaggcccctgattcccagatccaccgtcccagccctcgggctaacaatctccttgactcctccctgccagatttcatgcacgcgattgtcccaagca

SEQ ID NO: 71182 - DNA, 42 bp, Homo sapiens
  chr10:25408449-25408491
  hypo
gcgtgtgtgtttgcacgcatttaaacccgcctctgcaaatag

SEQ ID NO: 71183 - DNA, 452 bp, Homo sapiens
  chr10:25463441-25463893
  hyper
acccacgcaggtttccgagtcatccggaacgcgagtgggtgcgaggactcggcaggctgcctcccgcgcccccgccgcccgcgggccgcctcgggttcagcactggacagctccctccccggccccacaaatggcagtcggctgattgacagaggagccgaccaaacagggaacaagacgacttgcagccgccctacaagggtttggttgcggccaagctgcctctttaaactggctttcctcccccgaggagggagcagggagagagggtggagtgtggtttgcggccaaacctaaaggctgcaattaaccagccgcccggccttcgctactccggacagacgaacgtcttaaaggacgtcttcgctcctcgggagtcgcggctgcgctcgcggtgcgggtctgggcgcgcgccccgcgcctccgggcgaagcggtcgaggaggagccagt

SEQ ID NO: 71184 - DNA, 299 bp, Homo sapiens
  chr10:25464520-25464819
  hyper
tcggctccctggagccgctccaccgatggcaccatcttggcgcagaaactcgccgaggaggtgcccatggacgtggcctcttacctctacaccggggactcccaccagctgaagcgagccaactgctccggccgctacgagttggcgggcctgccggggaagtggccagccctggccagcgcgcacccctccttgcaccgggcgctggacacactgacacacgccaccaacttcctcaacgtgatgctgcagagcaataagtcgcgggagcagaacttgcaggacgacctggattggta

SEQ ID NO: 71185 - DNA, 249 bp, Homo sapiens
  chr10:25465101-25465350
  hyper
gcgcaaggacgggctcggcggggacaagagccacttcaagtggtctccgccttatctggagtgcgagaacgggagttacaagcccgggtggctggttactctttcctctgccatctacgggttgcagcctaacctggtcccggaattcaggtagggagggccggggggcaggggggaaggcaaaagcgaagctttccttccggtcttgtgggtgggtgcacgtgtgaggaaggaacccttggctgtgac

SEQ ID NO: 71186 - DNA, 249 bp, Homo sapiens
  chr10:25465351-25465600
  hyper
cgaacgcttctcaccctcagagtagagacccgggctgagggacaccccacgcgggcgcgggtgcttgggggcaagaagcgccccacgcccgtcagcttccggcgctcggcgaaagccattcattctctcggaccagtttccccgcactgggcgagggacaggcagcccttggcaggacggagacacccccgctgctctgtgcttccctccaattgtccggagagcagggaggggcgttccccaccgggg

SEQ ID NO: 71187 - DNA, 67 bp, Homo sapiens
  chr10:25465877-25465944
  hyper
gggtgctccttctaccggtctcccctctccccgcaattgatctttccttcctcggtggccttttcct

SEQ ID NO: 71188 - DNA, 148 bp, Homo sapiens; identical to SEQ ID NO: 42556
  chr10:25592447-25592595
  hypo

SEQ ID NO: 71189 - DNA, 183 bp, Homo sapiens; identical to SEQ ID NO: 32968
  chr10:26055811-26055994
  hyper

SEQ ID NO: 71190 - DNA, 32 bp, Homo sapiens; identical to SEQ ID NO: 42557
  chr10:26127993-26128025
  hypo

SEQ ID NO: 71191 - DNA, 30 bp, Homo sapiens
  chr10:2620590-2620620
  hypo
ccagaaaagtcaccacgtctgcacaatgag

SEQ ID NO: 71192 - DNA, 30 bp, Homo sapiens; identical to SEQ ID NO: 42558
  chr10:26211012-26211042
  hypo

SEQ ID NO: 71193 - DNA, 108 bp, Homo sapiens
  chr10:26222992-26223100
  hyper
cgaggatgtggatggcgcggatggcgcggcctccacctgcgggcagtggagagagcggcgagaggaagaatattccccgcgagccgggataaggggccccttcggctc

SEQ ID NO: 71194 - DNA, 105 bp, Homo sapiens; identical to SEQ ID NO: 32970
  chr10:26223101-26223206
  hyper

SEQ ID NO: 71195 - DNA, 672 bp, Homo sapiens
  chr10:26223425-26224097
  hyper
ggaggacctgtgtgtttgtcggggcctggggtgagagaggggactcgaggggagaagtagagcgggaaaccaagagggggaatgtgaggcttgaacgagctggatgggagagctcgaggggaggagagggatgaacttgagggggaaacgggggcgggggtgaactcgagggggagccaggaggagggaacgggaagggtgaacctgaggggtggacttgagggaagatcttgtgggtgaacccgaggagggaacgcgaggggatagtgaggggggatctcgaggagggaacgtgaggaatgaacttgaggagggaacgggaggggtgaacgtgaagtggaaacaggaggagggaacgggaagggtggcgtaaggggtgaaggaagatctttaggggtgaacttgggaaggaaacgtaaggggaggacctcgaagagtaacgaggggcgagaactgagggggccctgcagggagactggagggaggaggcgccgagtctggcgggtgtcgcctcggagacctgtggcgcgcgcgggctttgcggcgccgcccacaggtggcgctgggtcggcccgtccctgagggaactgcgttccgggtgatttctcagaacaagcaggtcggtggagctgggctccctgcaaccccaaatgcatccgtaaaggagtttta

SEQ ID NO: 71196 - DNA, 30 bp, Homo sapiens
  chr10:26494015-26494045
  hypo
agtaagagacaacagcgatggtgaactgag

SEQ ID NO: 71197 - DNA, 361 bp, Homo sapiens
  chr10:26500510-26500871
  hyper
aagctttagttagcacgtatctaaacaccattaccaggctccaccagcccctctgctcctcagcttagaggagtttttaaaacctgttgagaattatcgcagatacgtttggccattatccagtcgtttcgattgtgcctttcctaaatgtccgcggttggcagaacgtgggaggaagaggacccgcctaactcggggtaggtggggacgcgctgctcactgtggtgaggttgacacttgggccctgggtttcacttgcaggtgctgggcggcggagagccccgagaaggaggaggagagagagccagcagccaacccctacgacttcaggaggctcctgcgcaaaacctcccagcgccgg

SEQ ID NO: 71198 - DNA, 136 bp, Homo sapiens; identical to SEQ ID NO: 32973
  chr10:26501026-26501162
  hyper

SEQ ID NO: 71199 - DNA, 143 bp, Homo sapiens
  chr10:26501446-26501589
  hyper
gtgccttggaaaacccgtggtttgcgtgactgatccctcattttcccctctagggcttctgaggggcttctgctataaggctgtgctggtgacgggcccaaggaggggcgttgaggtgccttcatcagcgaactcccagcacc

SEQ ID NO: 71200 - DNA, 451 bp, Homo sapiens
  chr10:26503693-26504144
  hyper
tgagccctgagttttcgaccacccgggctcccacagcctggaacagacttcacctagcacgctcagtgccagccttcggcaggacgctatcaacgcccgactggtttcctgctctcatcctggcgcctgggcccagttgccatagtgtggatcccatgactcctcagggaacccctggactcaggcacgcgagaagaagacagcgctttgtggagagaattgaccagggacagttatgctcgagcacacaggacttgggcctgtatgcgtccagcatgggccccaggatgtcccttctaagcgagggtcgaggggtgctcgcccagacgggatccccgggtctctgctttgttagcagctttggtggctggttcaggaggtcagagaaataaaacgacttgtgaacacaatggaaatgacaggcgctctggccaggcgcggggaaggcagc

SEQ ID NO: 71201 - DNA, 694 bp, Homo sapiens; identical to SEQ ID NO: 3546
  chr10:26504190-26504884
  hyper

SEQ ID NO: 71202 - DNA, 228 bp, Homo sapiens; identical to SEQ ID NO: 32977
  chr10:26505008-26505236
  hyper

SEQ ID NO: 71203 - DNA, 62 bp, Homo sapiens; identical to SEQ ID NO: 32978
  chr10:26505441-26505503
  hyper

SEQ ID NO: 71204 - DNA, 114 bp, Homo sapiens; identical to SEQ ID NO: 32979
  chr10:26505504-26505618
  hyper

SEQ ID NO: 71205 - DNA, 640 bp, Homo sapiens; identical to SEQ ID NO: 32980
  chr10:26505713-26506353
  hyper

SEQ ID NO: 71206 - DNA, 265 bp, Homo sapiens; identical to SEQ ID NO: 32981
  chr10:26506354-26506619
  hyper

SEQ ID NO: 71207 - DNA, 528 bp, Homo sapiens
  chr10:26506902-26507430
  hyper
cgtttctccatgcaacaggtaaagactcagcggggagccccggggcgcccctgcccctctctctgccccgcccaccgcggccggtgcgggtccggcgctgagagccggacaggggcgtcgaggtggcagcggaggcgggacctgccagaatcttcagataaaagcgagaaatgcgggacctgcccgctgggtccaagcccccgaacctggcctcggagctccaagagggctctgaggccgtggcgctcttcccccagcgcggcccttgggatggcgggtggccgacgatccaggcgctcgtgcgctcactgaatcgatgacggctggcttccctaggccgctggggcctcgggtgggactcagtttccaaataccgtgcccgagaattcagaattgcattttttttaggtctttagatcacgagagtgatttgtagctgcaattgcacaagagaacgattccattcacatgaaacccgcgcgccgagttttacccccgtgcacttacacaccgtctcccaaatgtacg

SEQ ID NO: 71208 - DNA, 36 bp, Homo sapiens
  chr10:26634123-26634159
  hypo
acaggcatgagccactgcatccggctgcttttattt

SEQ ID NO: 71209 - DNA, 30 bp, Homo sapiens
  chr10:26634775-26634805
  hypo
agattgtctggccctcgtgactatccctta

SEQ ID NO: 71210 - DNA, 139 bp, Homo sapiens
  chr10:26638399-26638538
  hypo
gaaatattgggggcaggttcccccaatactggcatctataggaaatgtatatgagggatggaagagacgagaggtggggagaccagaaataacaaacagttcaggagagggatggaaaaggctgcggtgagaacagcgg

SEQ ID NO: 71211 - DNA, 32 bp, Homo sapiens
  chr10:26676768-26676800
  hypo
cagaaatcttaaggccgggcgcggtggctcac

SEQ ID NO: 71212 - DNA, 33 bp, Homo sapiens
  chr10:26680701-26680734
  hyper
acctgctggaaagctcgcagcagggcccgctcc

SEQ ID NO: 71213 - DNA, 171 bp, Homo sapiens; identical to SEQ ID NO: 32984
  chr10:26680960-26681131
  hyper

SEQ ID NO: 71214 - DNA, 26 bp, Homo sapiens
  chr10:26699638-26699664
  hypo
atgcacctgtcgtcccggctactagg

SEQ ID NO: 71215 - DNA, 85 bp, Homo sapiens
  chr10:26699784-26699869
  hypo
atgtagtgtatacttgaaaatcactaacagcgtaaattttaagtgatctcactgcacataaaaataagcacgtgaggtaagacat

SEQ ID NO: 71216 - DNA, 201 bp, Homo sapiens
  chr10:26710933-26711134
  hypo
tgatttatataaaatcgcacttgatcctcttactaactggcttttttcatgcagcctaattatttcgagattcatccatgttgtaccagaagtttacttcttattattgcagggtagcatttcaccatatgaatatcacacactttgttcatccatttacctattgatgtgcacttgggttgattccaattcagggctatt

SEQ ID NO: 71217 - DNA, 30 bp, Homo sapiens
  chr10:26716901-26716931
  hypo
tatctcagagtttcacgaatttcatgctta

SEQ ID NO: 71218 - DNA, 30 bp, Homo sapiens; identical to SEQ ID NO: 42560
  chr10:26720842-26720872
  hypo

SEQ ID NO: 71219 - DNA, 741 bp, Homo sapiens; identical to SEQ ID NO: 32985
  chr10:26727076-26727817
  hyper

SEQ ID NO: 71220 - DNA, 241 bp, Homo sapiens
  chr10:26727867-26728108
  hyper
cgggtccgacgccgggggcagctccaggatctggcctcgtgaacgcgtgcccccaggcgtggccctcgagcgcagcgggtccccagggtcccctccgctgatctccactctggacccggctcgcgagggtgggggtgtgagggtttggggttcgggtttgctttttcccgagctattgcaacagatttgacagatttcctgcccaggaaattgctgcaaggtcaaacggggaactgctatg

SEQ ID NO: 71221 - DNA, 162 bp, Homo sapiens
  chr10:26733284-26733446
  hypo
aggattctgagaaggcgaataacatgatctgacttaaggctcactctgactgcttgagaataaacctgggggagcagaggtgaaagcaaggaacccatgacaaagcgttggattctgcgtatattttgaaggagagccaagatttcccgacagaaggaatgt

SEQ ID NO: 71222 - DNA, 30 bp, Homo sapiens; identical to SEQ ID NO: 15362
  chr10:26739045-26739075
  hypo

SEQ ID NO: 71223 - DNA, 30 bp, Homo sapiens
  chr10:26746969-26746999
  hypo
gaagttgtatggagccgaaagtgcaaggac

SEQ ID NO: 71224 - DNA, 93 bp, Homo sapiens
  chr10:26775009-26775102
  hypo
aataatgtaaaaaaatataaataaattaaaaaataaaaggccccgaatgggacaaattaggaaggactttgaaagacacgctgagtgcctgaa

SEQ ID NO: 71225 - DNA, 23 bp, Homo sapiens
  chr10:26783462-26783485
  hypo
aaaccaattctagaccgggcaca

SEQ ID NO: 71226 - DNA, 21 bp, Homo sapiens
  chr10:26791280-26791301
  hypo
gtctcttgggccaggcgtggt

SEQ ID NO: 71227 - DNA, 39 bp, Homo sapiens; identical to SEQ ID NO: 42564
  chr10:26801561-26801600
  hypo

SEQ ID NO: 71228 - DNA, 99 bp, Homo sapiens; identical to SEQ ID NO: 42565
  chr10:26801660-26801759
  hypo

SEQ ID NO: 71229 - DNA, 30 bp, Homo sapiens
  chr10:26816959-26816989
  hypo
gacatattcttcccacggtcaatgggaaga

SEQ ID NO: 71230 - DNA, 81 bp, Homo sapiens
  chr10:26832035-26832116
  hypo
gaaagcactgaaggccgggagaaggctggatccgttcactcactcattcattcagtcatttaatgtttgttgaatgacggc

SEQ ID NO: 71231 - DNA, 207 bp, Homo sapiens
  chr10:26854203-26854410
  hypo
cgcttactcctgacacgagcttcacaaccagctcaactcagaccaagaaaaaatgtatcccttcctatatgacgaggactctggtggcttggcttgagaaccaaggagtgaagtcatttggcttccattttgaaggaatgaatgagctgagggtggtttatagactgagccaaccccacaagagatataccacgaaagcccctttag

SEQ ID NO: 71232 - DNA, 30 bp, Homo sapiens
  chr10:26871319-26871349
  hypo
tggcccagggctgctcgtgccagcaatgct

SEQ ID NO: 71233 - DNA, 60 bp, Homo sapiens
  chr10:26873385-26873445
  hypo
tggctctcacatctacgagtgtgcagacagcgaaggcacaggctgcgatatacaggagaa

SEQ ID NO: 71234 - DNA, 197 bp, Homo sapiens
  chr10:26877695-26877892
  hypo
gacagcaaagacacacgacacgatatacaggagcagaggcgcccagaacacgctgtcccccaatgccagccacaagcggggccagctcagggtgtagtgggtgaagccgtcctgcagctctgtgatccacaaggcggaggtggcagtagcacaggactccaccgctttggaggctgcccagtcgaatttgggagcca

SEQ ID NO: 71235 - DNA, 161 bp, Homo sapiens
  chr10:26902350-26902511
  hypo
caataaaaggcaaaccgttttctgcactgttcattcaaaatggcaaagtcatccttacaaataaatatttataacacaatttcagatcaagaagaagcacaaatgtgaaactgattaaaagcttttatataatgtactaagaaaaaacccacaaaagaata

SEQ ID NO: 71236 - DNA, 24 bp, Homo sapiens
  chr10:26907325-26907349
  hypo
caccgcacccggcccaaaaatatg

SEQ ID NO: 71237 - DNA, 45 bp, Homo sapiens; identical to SEQ ID NO: 42570
  chr10:26942249-26942294
  hypo

SEQ ID NO: 71238 - DNA, 30 bp, Homo sapiens
  chr10:26964475-26964505
  hypo
caccaccttccttctcggtccaccatcttt

SEQ ID NO: 71239 - DNA, 22 bp, Homo sapiens
  chr10:27004609-27004631
  hypo
gccaccgcgcctgggcactcct

SEQ ID NO: 71240 - DNA, 30 bp, Homo sapiens; identical to SEQ ID NO: 42451
  chr10:2706731-2706761
  hypo

SEQ ID NO: 71241 - DNA, 15 bp, Homo sapiens
  chr10:27542296-27542311
  hypo
cgcagttggactcat

SEQ ID NO: 71242 - DNA, 812 bp, Homo sapiens
  chr10:27547520-27548332
  hyper
ctgctaacttgtccccgaccccacaactgctcacgaccttcgtgaaggtcaacctttcctaccgcgtggagtgagttgggatgcatactggggagttgtataagagtgtctgagaaagggaaatgcagagttgaatgaaagtgtttcccgggaggggccgagtggaaagcagcaggtggccggcgcgggtggaacccagcgcgggcgcagagcgtctctggcgtgggcattcggtgcagcgagtccgcgggaatcttggatgcgcggaggtccccggaccgcggtgacggacggggctgcgatcgtggccggtgagactgggagcggagggctggggcggcgcccgagggagggcacaaacccgggaggcctcagccgacggcgcagctttacgcggccgtagggcgcccggggttgagtggtgtcctagcaacaggtgggcgccgactgcggcggggcagggcgctgcaggtgacttcggccgggggtccccaggcccaccccatgggggctctgcagccggccgcgtagatcgggaaaccggggccgctctccggccccgccgctgctgctctcgcctgcttccctttccctcccgggggccgagacctgccccctccccttttctctcccaggcccatctcgctccttcctccccgcgagaccctgcctcggccctcggttggggaccgtctgctcctcagtccctgcgcccctctctgcactaccctggacccatcacctcccggatcggttctccacttaccccgctgtttccctgtctctccttccgcgagcccatctttctcctt

SEQ ID NO: 71243 - DNA, 150 bp, Homo sapiens
  chr10:27548400-27548550
  hyper
cgaatccattcttggaaacttagggtctcagctctgacgcccccttcttgtaacgagtctggtgggggccgtcatcccacactaggcttagctttgattttacttagggccctgttcatgccagttctaaaagttcgattttctgtaggt

SEQ ID NO: 71244 - DNA, 222 bp, Homo sapiens
  chr10:2758950-2759172
  hypo
tgttttcatctttgccgtcggctgggatgcttgaaggagaggcccgtgactcatcgcgttctgtcactttggtgcctggaatacggtaaccactcaataaatattaattgccattataatgattaccattgctgttatcagtgttattcttctccactgtagcgtaatacttgctatgatccagatcaggtttttgaagcaacttcacgcttggcatttcag

SEQ ID NO: 71245 - DNA, 54 bp, Homo sapiens
  chr10:2775287-2775341
  hypo
cccacttgaggaaagcgacatcccagagagagagacagacgtccccacagaggg

SEQ ID NO: 71246 - DNA, 17 bp, Homo sapiens
  chr10:27794496-27794513
  hypo
atttattttttgagacg

SEQ ID NO: 71247 - DNA, 42 bp, Homo sapiens
  chr10:27846677-27846719
  hypo
ttgaaagttgagagacggcggagcgtggtggctcacccctgt

SEQ ID NO: 71248 - DNA, 640 bp, Homo sapiens
  chr10:28030465-28031105
  hyper
agcgacgcgtttgcccgcccggacgctccacgccccggccaagcccgggccccgcatccaaactgcgcattcctgccttgcgcccctgctttgcgcgcgcccagagtgtttgggagaggcaggaagtgggagccacacagtttctggatggggagatcatttcgataggtttatcttgaatagggggataccttgaacccaataccccaaggttagaggtttagaagacgaaggtcaagtgatttgaagaatactgctattccagtcgcgtatctgggcagcggggctaactgctacccttccctcacccgctggcgccgcaccctcgagtggccctggcctggcaggcctggcagggtatgcggctggctctcgaaacttccctcggggatctcttgtctgctcccagaggctttccgtcgcttgtggtcaggggaaaggtcgccgactggacatagggaataaagcaaaggagcattgccgccccggctctctttaagctatttcctttgatcttttaggaaaagggggaaactttctaaaggagttggtggtttgtggaggaaagctgcagaacccaaaaacaccgtcgggccgtttcccgactaagggagggttaaaagtacggcaagctctgtcc

SEQ ID NO: 71249 - DNA, 324 bp, Homo sapiens; identical to SEQ ID NO: 32990
  chr10:28031314-28031638
  hyper

SEQ ID NO: 71250 - DNA, 881 bp, Homo sapiens; identical to SEQ ID NO: 32991
  chr10:28031863-28032744
  hyper

SEQ ID NO: 71251 - DNA, 1139 bp, Homo sapiens
  chr10:28032952-28034091
  hyper
gatttgggggattttcgtgttttctagatcgtggatggtttggttgaaacccccgcatcttctgtccgccaaggtcccccggggtgaggttgggttcaaggacaggaaaaagttaagtggcgtcaggacgaaagcaccacttctcccccttctctcccagaatcttcctatcatcccccaacgcgccccgggaagtgcatggtcctaaggtccaaggcgccaggacccaggtccccagagccctcaatcagtgccattctcttccgcagcgcgggtgtcagccgcgagctcgtagcccctcgacacccgcctctctctggggtctccggggaccctttcagaggctgtaaaggtgtcagaagcccaaggcaggaggcagcttggtcggcgcacctcccgggccactgctgccactgtcggggagagccagcagctcacctctggggtcgcggaggccctgagcctctgcctgccgcgcaccggcgtcaggagcaagtccgcgcggccgcggagccgcagagttacagccccaaggcgcgcggcggacttcgcccgccccatctcctcgcctcgcgcctcgggacagctcccgtttcctccgagcggcctcagcttcgctgccagcgccccctttgcccgtccagccgcggcatgggctgctactccactaacacacgcgcgcgcgcatacacacacacacacacacacacacacacacacaccctttgcctcgccaagcgcccacactcgccaacgcccccgccccgcccttcggccaccgcagcagaggccacgcgtgacatttaggaccacgcgtgaccaccgcgatcaaacgacggctacggtctgtgttcgtagggaagtgaagtcagacctctgctggatgtcgtgtgtcccctaggactgcgtcctcccgcgcagacaggtacgtgcctggggtgtgcacatagcctcggtgataagtgtcaaagagaattttcgtgcttgcagcccctgttctacagtcaagactcgcgttggtgttttcttttaaaatcatgcccttagggatgtgtgttcatgctgctttatttgtacaagacacccttccccggcccggccttctccgagccaccccagcgcgtcctcctagatgcgac

SEQ ID NO: 71252 - DNA, 95 bp, Homo sapiens
  chr10:28034092-28034187
  hyper
acgtgtttttcctagcgaagtcatcacgaggttagccacctcggacacttccccggcagccccaagcccacgcagagatcgcagacacagacacc

SEQ ID NO: 71253 - DNA, 230 bp, Homo sapiens
  chr10:28034326-28034556
  hyper
cgcctcttctcaaatcacttaccccgattcactccagactgtggccggggaggtcactccctgcagaagtgtccccctcccccaacgccggcgaataattttaaagcaaaggaggcgcggccaggtgggctcccaagctccgcgcagacccttgggccagccttggccgctacccgagcgcctctccaccagaccttggagggaagttgggggaagggcgggagagcacc

SEQ ID NO: 71254 - DNA, 963 bp, Homo sapiens
  chr10:28034873-28035836
  hyper
ggtatccacgttcccgggcgggtggagaggaagcgtccgcgcccgcccggccgcgggggctgctgttaacccctagcagaggagccgctgccggggagccccgggcccgccgagtcctccggagccgggcgcggctcccagatccgccggccttgcagtcgtggagcagacggggcttttcccttcgcactttaggagagaaattggagaagctgccgggagcgctcggctccggctccagaagctgagaggctgcggtgcaaatcccgtgtcttagctggcccgattgccggaaatttcactgcgcgtggctaggcgggagaggccactgtgacgcgccctgtattttcctctcgattagctggagggaagttagagctccgttttgcacctacagccctggagcgtattgcgggaagtgctagtgcccaggagcctcttttctgatgtcactgggcttctggggtcctagttgtctcagtcaaagccaggcacacattcacctccggggcaagggctggtgaggctgccctcgccgctgggtatagggatgggggaaagcaaggatgggatgagttcagcccaggtggccaacccgcggtggcccaagtgcagaagaggaagcgcgcccaaagccaaggatctgcacgcagcaaaggagatggaacttagaagaatcacaagctgggacacagggcaaagagagagaatggctaccagattctctgattgatgatactttgcttcctaacattaccgcaaatataagtagcgaaagcggcggtttaggtgcaactgcaagctcagagcttctggcagcccagaagatccccaaggtgccaacacgaagctgcctgcgctctcgccgaaggccctgtggtcctagcgaactttcgccctttttaaagaacaaacttagatttccccccaccaagcttaaagaaatagcgccatttgtccttt

SEQ ID NO: 71255 - DNA, 30 bp, Homo sapiens
  chr10:28036088-28036118
  hyper
cggtttacatttttgcgcaccaggaagata

SEQ ID NO: 71256 - DNA, 137 bp, Homo sapiens
  chr10:28258201-28258338
  hypo
tgtgaatcctgcacccgatgccttctactctaggtatgtatcgccgccaattatagttttctattttcttatcttccccacccaacgttgcaacagggcctgcacctggttttccaggtattcgcaggctttgcata

SEQ ID NO: 71257 - DNA, 15 bp, Homo sapiens
  chr10:28287365-28287380
  hyper
cgggaggcagagctg

SEQ ID NO: 71258 - DNA, 429 bp, Homo sapiens
  chr10:28287777-28288206
  hyper
cgcgggtcaacactgcgcgccctgcggccgcgcacgccggcgcccttgtgggaggcctacagggcccgtgccctcccccgggcgccgccgccgccgccttccgctcccagcctcacccggccgcgaccgcagcccagtccgttaccctggtctcgggacctccgcgcatccaagattcccgcggacccgttgcaccgtatgcccgcgccagagacgctctgcgcccgcgctgggttccacccgccccggccacctgctgctttccgctcggcccctcccgggaaacacttttattcaactttgcatctccctttctcaaacacttttatgcaactcccgagtgtgcaccctaactcactccacgcggtgggaaaggttgactttgacagaggtcgtgagcagttgcggggtcggcggcaagttagcaga

SEQ ID NO: 71259 - DNA, 30 bp, Homo sapiens
  chr10:28504430-28504460
  hypo
cagggacagcgttctcgaggaagcgacaat

SEQ ID NO: 71260 - DNA, 32 bp, Homo sapiens
  chr10:28559044-28559076
  hypo
acgagactaagatggcgcgttaaaagagtgac

SEQ ID NO: 71261 - DNA, 30 bp, Homo sapiens
  chr10:2871024-2871054
  hypo
ttcttggtttatcttcgaaatggctactac

SEQ ID NO: 71262 - DNA, 22 bp, Homo sapiens
  chr10:28791009-28791031
  hypo
gccaccacgccctgccagtatg

SEQ ID NO: 71263 - DNA, 256 bp, Homo sapiens
  chr10:28850452-28850708
  hypo
atttacattagagcacgtgtgtatttaatggaatttgaccctgtgggaaaaaaggattatggaacttttaagttttttcgctaggtgggataatgggtgaaataatacaggttttttgaaaccccggcgtctttaacccctgggccacagaccagtacctttctgtggcctgttagcaatcaggcttcacagcaggaggtgagcggcagttgagcaagcattggagccggagttccgcctcctgtcagatcagcca

SEQ ID NO: 71264 - DNA, 572 bp, Homo sapiens
  chr10:28957423-28957995
  hyper
actcccgggctcccacgcggtttatttttaagacgctggtttaaatttctcgagttacggggggaaggggttgcggtgggagcgagactgagaaccacagcgcgaacaggggcgcattggtaccaggatcggtacagggatgtctccagttcctatagactctagcctcggggggagtctgtccagactacaagtgtctgtgcccctgttttattttgagacaagtcggggtcgctcaatgagtcagcacagaggaggcagtgggggagacagacagcggctgggacgcgcgggactggggcgcgccttgcgcgctgggcaccggagctgcgcacgggcggcccggggcgggggccccagagagcccgggagggcgtggactcggccggggaggggcgggctcgggcgcgtctgggttggagctggatgatgtaaaacagcgcggagctccttggcgcctcggcaccattaccttcaattatcataattggtgcctctctccagcgtttgcatttcccccgagggatctctcactagttcccgttccttctcctcgccctctctcgctcact

SEQ ID NO: 71265 - DNA, 86 bp, Homo sapiens
  chr10:28958043-28958129
  hyper
cgatctttttggatgttctccctgcctaaaacggatgctaatatctcttcgattgaaccgaaatggcgctgcggctgctacttttc

SEQ ID NO: 71266 - DNA, 192 bp, Homo sapiens
  chr10:28965689-28965881
  hyper
attgagtgtcagtctcggccagtgtcgtctcgttggcgccgggtgcttttggatttgctaattttcgttaagtgtctctagcccgctactcgtcccgcgtacccgggagaacctagcggctcctaacggatcaacagtcagtctgtctgggctttattgatcccatggcgggcagctcgaggcggacacgct

SEQ ID NO: 71267 - DNA, 30 bp, Homo sapiens
  chr10:28967236-28967266
  hyper
ctggcctgtagctgccgcgtgccctcagcg

SEQ ID NO: 71268 - DNA, 146 bp, Homo sapiens
  chr10:29011016-29011162
  hyper
tgtaatgagaaccaccgctgagagctgtttagacaaacgggctcagcgctccggagccgcgcgggcctccaaatgcaagggtttgttctgctggggcagcgtctgtcgcgaaagcagcggcggggaggaagcgcagagctgtgttt

SEQ ID NO: 71269 - DNA, 133 bp, Homo sapiens
  chr10:29011504-29011637
  hyper
tccagctaacatcagcgctcagtctccccgcccaggtgggatcctccaagcgcctcaacgcaccgcccatcccggtgccaggtgtaaatgcgccccagcaacacgtggctctaggagccgcagggatggcatc

SEQ ID NO: 71270 - DNA, 30 bp, Homo sapiens
  chr10:2908213-2908243
  hypo
cctgggtggagtgcacgcgtgttgcatgcg

SEQ ID NO: 71271 - DNA, 202 bp, Homo sapiens
  chr10:29164926-29165128
  hypo
gcggacatgaaacagcgattacacggtaggtatttctttgtagttaggcactctctttgccagcatgaaactcaacttgaacttactcaacagtttaaagtcagggattccagagacttagctttggaaaacacgtgaagaaatgttcgggggcaatgctgaaatttacaaggctgatgcgaaagatcgcatgtgtgaatgg

SEQ ID NO: 71272 - DNA, 30 bp, Homo sapiens
  chr10:2921407-2921437
  hypo
tttatcaaaggctatcgtcctgattagaaa

SEQ ID NO: 71273 - DNA, 38 bp, Homo sapiens
  chr10:29300117-29300155
  hypo
gctgcgccatccaggtttacagacgtgcactttatgat

SEQ ID NO: 71274 - DNA, 30 bp, Homo sapiens
  chr10:2932563-2932593
  hypo
tcccccacagcagcacggagggcattctgg

SEQ ID NO: 71275 - DNA, 30 bp, Homo sapiens
  chr10:2969923-2969953
  hypo
gtggagcgcaaggtgcgcataggcggttgg

SEQ ID NO: 71276 - DNA, 28 bp, Homo sapiens
  chr10:29718763-29718791
  hypo
aaatatggtagtggccgggcatggtggc

SEQ ID NO: 71277 - DNA, 26 bp, Homo sapiens
  chr10:30025527-30025553
  hyper
gagagaggacatctccgagaccttcc

SEQ ID NO: 71278 - DNA, 94 bp, Homo sapiens
  chr10:30026076-30026170
  hyper
gcttaccctggagccctgagaggcccctttgagtctccagaccttccagggataaataaaatctggcgacctgtgccaacgctgtgggccagtt

SEQ ID NO: 71279 - DNA, 30 bp, Homo sapiens
  chr10:30198419-30198449
  hypo
ggaatagactgtgcacgcatggtgatggct

SEQ ID NO: 71280 - DNA, 121 bp, Homo sapiens
  chr10:30259002-30259123
  hypo
ttctgcatgcattctcgtctttaggtagacagctctcggaggggagggaaggctgggcgtggctctgctgctgacagctctgtgacctgaggccagtgcttctgcacgtgtggttgggacc

SEQ ID NO: 71281 - DNA, 607 bp, Homo sapiens
  chr10:30348116-30348723
  hyper
gccccgggacccccgcgctccgagcggggcacctgaggggaggggacgcccctcccgggctggcaggcgccctccaccccgaggctgccgggctaggcaccgcgcggggggcccaggcggggctgcgactgggggtgcagacatcccccaccgccagggtggctggaaccggagcgacgtcccagctggagaagttggggggagtgcgggaggctgcgggtgaggcccgcgaagcgccgtgggagcggccctaatggacggtgggagccaggagggttagacgccgggacttaccgagcggctccctcatgccgcctcgcgccgccaccgccgccgctccggccggccggggaccagcgcgacccgccccgcctgcagccgccgaggccgagcatgcccggagaaccgccgtccgccccgcccaccgcccgggcccgccccgcccaccgcccggggctgcctcctctgcgctgagggcggtatccaggccacgagcttcctaggcttttggggtccgcctgcgtgggtcgcgcagaaggcacaagtgagctgaccaccattccctcttttcttgtcacttgggtttgggccacgtcaaccctgtgga

SEQ ID NO: 71282 - DNA, 30 bp, Homo sapiens
  chr10:30509201-30509231
  hyper
gttgcacaaacaggacgagaaggcagcaga

SEQ ID NO: 71283 - DNA, 91 bp, Homo sapiens
  chr10:3063272-3063363
  hypo
ggtttccctcctccacgcctcggcgcgaagccgaggggaccgcaattgagtggtctcagcgcacctcttccaacgccgctctactcccttg

SEQ ID NO: 71284 - DNA, 30 bp, Homo sapiens
  chr10:30736669-30736699
  hypo
gactgaagttctcaccgtctcacattttta

SEQ ID NO: 71285 - DNA, 32 bp, Homo sapiens; identical to SEQ ID NO: 42573
  chr10:31006068-31006100
  hypo

SEQ ID NO: 71286 - DNA, 213 bp, Homo sapiens
  chr10:31073224-31073437
  hyper
tcctgggttgggggacggcgctacgactctaaggttttaagcagtgatcccagcaggttaactggggcagtaagtgctgtctttctcggggagggagggagttcagctccaaaggcggcctggttcgcaggctcctttccctaagatcctttagaaatcgttcccatcccagaaaggaagctggggcgcagctgtgagcgcccccctctcccc

SEQ ID NO: 71287 - DNA, 38 bp, Homo sapiens
  chr10:31073843-31073881
  hyper
gccgcggcgaagctgcgctgggccgcccgcacacacct

SEQ ID NO: 71288 - DNA, 101 bp, Homo sapiens
  chr10:31074105-31074206
  hyper
taactctgaaaggctcggcggggctggccctccccgggccgcccagcgccgccccccgcggtgcaggggtgggtgagtgggggccccgagcccagtaccct

SEQ ID NO: 71289 - DNA, 151 bp, Homo sapiens
  chr10:3108902-3109053
  hyper
gggaaatggcagcttcgtcatggcccagcccgccacgctcaccttttcccaccacctggaggatccactctccgtccgtccttcccgacctcaggctgcagaggaaacctgggggcgggggtcgaggaagccgagccccgaggctcccagc

SEQ ID NO: 71290 - DNA, 114 bp, Homo sapiens; identical to SEQ ID NO: 32854
  chr10:3109054-3109168
  hyper

SEQ ID NO: 71291 - DNA, 144 bp, Homo sapiens
  chr10:31152656-31152800
  hypo
ctcccattccagagccggcctcctggctgagcatccacacgcactcccctcatattgtaggttcgcccccttgctgtcttcctacagaaccttgcctagctggccccaccttgtgctctccacttccaccgcctgttatttggt

SEQ ID NO: 71292 - DNA, 30 bp, Homo sapiens
  chr10:31167819-31167849
  hypo
atctgacaaaggggtcgagaaaaatcctgc

SEQ ID NO: 71293 - DNA, 34 bp, Homo sapiens
  chr10:3118378-3118412
  hypo
tccatgtggacgggacgcacgtggccagcggctc

SEQ ID NO: 71294 - DNA, 285 bp, Homo sapiens
  chr10:31422831-31423116
  hyper
ctcagctgctctccccgggagctggggagccgggggcgggcagccgcgtctgtcctgcccctcctcgccccctcccccgcagcctgaggagggcgttaagcaaggggcttcggagaaattagaaccagcgttctaaattaaggggagcagatgtccttgttttgctcgcgaggcctgggtggcctgctgttcagacagaaatcgttgaggcgctgaccttccgggactgctgtcaatctccgcgtgcagatggccagcccggagcctcgccgctcccctgcattg

SEQ ID NO: 71295 - DNA, 672 bp, Homo sapiens
  chr10:31608744-31609416
  hyper
cgccgcggccccggccggcgccgtcgctgtcgctcgggccccgcgactcgggccgggctgtgggcgcgcggcaggcgggctgcggcggcggcgggacggggcggccgcgggttgcgtggggtttgtgcgcgcgtgtgcgcgggcgccggctgtgcgcgccgcgggcggacagggttcggccggcggcggtaaagttgggacccgcgggccgggcgcgctcgcgtaacggggattagaggcgcgggggcgcgggtccctaagcgcccctcctccctggcgcctcccgctgcccggcccagagccccggcctggggactccgcggcgagccccgcgagtggggtccacgtttggcggggcgcggcggggcggcgcggggaacaaggcaggaaaggtacccacttaacgccgccgggagccgcgcggatgggggcgagctgggcggcgggtgtgtttgcggagttgttacctgggcttagagaccgggaagcaccacagacagatccccctcccggggcagacgaggtctctgcgccgggatgggccggtgtgcgtgcgcctcgcgcttttctctttcggtttttggggaagttgttacctgggccggacgcacggagcgctgaagccggataatggggcttggatggcgctctgggtctcgggtggaaggaggg

SEQ ID NO: 71296 - DNA, 439 bp, Homo sapiens
  chr10:31609668-31610107
  hyper
gctttctctccctctcgtgcagcagcgaaatgtctgctgattgttattgtctggacagttcctgtggcgagaggggcgagacttgtccgcccgggggcggcgggagcgcagggagagcagcccccgcctgcgccgccccggtacctgtttgtataataatgggcggcaacggccctgccgccggccgcagcccaggctatataaggaattacacgtacatttcggaccgaggggctcgctttggttcctgcgttatttttaaaacgacttttaagagaggggcaataaatgcgtctataatgggaccgctgcagcgtcgagaaaacgaggaaatacgtgtttaggagaaaactctctcgtgctcccccagccccaccccccgcgcctgggctccctttctccctcccctctgggatgcgaaacgcgaggttttgtaacc

SEQ ID NO: 71297 - DNA, 183 bp, Homo sapiens
  chr10:3160988-3161171
  hypo
gtacttggaagagatcgccacacagatgcgcacgcacagcatcaacgcgctgctgatcatcggtggattcgaggtacgttaccgtttctctcttgccggtcttgcaggtgtgagccgcgccctgtgttggctaaacattaagctacttgttggctactggccacgatccgagatgataggttc

SEQ ID NO: 71298 - DNA, 220 bp, Homo sapiens
  chr10:31769214-31769434
  hypo
agcacatagtaataacgctttcttgggcataaattataataaaatactataagtaatacatgtaaagaatgtatcagtcactatctaagccttgaagcaaattgtattcatccttcaagattcagttgaacctactctttggaatcattttcaaccagaggtggtgtatgatttagaaaagattgagcacatggcttctagtcttcgctgtaccatctct

SEQ ID NO: 71299 - DNA, 154 bp, Homo sapiens
  chr10:31874052-31874206
  hypo
tcctggaaatcttgacgtcttccttgcacccctccttcacctttctctccttccttccaacagcaaaggattgctgccaaatggccatagtcattcacattatgtctggtgacactcttttcagaaagttaccacgtggcgtctgctactgaaa

SEQ ID NO: 71300 - DNA, 384 bp, Homo sapiens
  chr10:31892881-31893265
  hypo
catgctgcaaattcccgtggccagcacccgaggcctgctggctccgatctgggccacgtgtacaaccaggtgtgcccccttagcctcacgccctcctcctgttgcctccccatccctctagccttcgggacttggggttgcaatgaatcttaggttttttccaggagtcttttattcctccagcgtctccgtgcgcctgtccgctccaacacctgacattttccttcaactccaccctcccctccccgagtccacagacacacacccacccacacgcctcttcccttcccctccaccctcagtcagcggcagagtcagtccatccaataggcaggagcccaaaagactgtccacggacagctgtcctctcgcccaggagagtgg

SEQ ID NO: 71301 - DNA, 98 bp, Homo sapiens
  chr10:31951749-31951847
  hypo
actgcttgcatttgacgctaccaatgtgggtttcagaccctgttgcggctgcaacagagcccgtttcaagtggcacaggtgggcgtccactcactgct

SEQ ID NO: 71302 - DNA, 138 bp, Homo sapiens
  chr10:3216467-3216605
  hypo
gggaaaaagtcccaacgtgtctaccctaaactctccatagggcagccagttctgggctgcaggtaaacacgtacctccttattgaagagcccaaaggaaccagaacacaggcaataataggagcgacagacacaaaca

SEQ ID NO: 71303 - DNA, 16 bp, Homo sapiens
  chr10:32171091-32171107
  hypo
tcggcctcccaaagtg

SEQ ID NO: 71304 - DNA, 39 bp, Homo sapiens
  chr10:32176855-32176894
  hypo
attacaggcgtgagtcaccgcgcccggcctgcccttcct

SEQ ID NO: 71305 - DNA, 198 bp, Homo sapiens
  chr10:32499001-32499199
  hypo
atcacctgggaagcaggagcaatgcaaattctccagtcccgcctcagacctactgaagcggacacactgtgggtgctgcccagcaatctaggttttaacaagccctccagggcattctgaagcgctggtaaattgagaactgttgctttagattttcgaacgtggttgaactgtaaccagagacggtccaggttctgg

SEQ ID NO: 71306 - DNA, 30 bp, Homo sapiens
  chr10:32621991-32622021
  hypo
gggcgcggtggctcacgcctgtaatcccag

SEQ ID NO: 71307 - DNA, 30 bp, Homo sapiens; identical to SEQ ID NO: 42577
  chr10:32638913-32638943
  hypo

SEQ ID NO: 71308 - DNA, 153 bp, Homo sapiens
  chr10:32670730-32670883
  hypo
tctcaaaaaacaaacagtacagtgttagagaataacagggagggaaataaataaacaaggtggtaaggaagttgtctctagaggagtggggcttaacctaggcttgaaggatgacaaggagacacatttgaaaaatatcggagaagtcacagt

SEQ ID NO: 71309 - DNA, 42 bp, Homo sapiens
  chr10:32736495-32736537
  hypo
ttttactgaaagcatcgtgtcacaatcggcatgagaaaaatg

SEQ ID NO: 71310 - DNA, 30 bp, Homo sapiens
  chr10:3280167-3280197
  hypo
atacaatacagataacgctttttcagaaag

SEQ ID NO: 71311 - DNA, 23 bp, Homo sapiens
  chr10:3285542-3285565
  hypo
aacaaatgagccaggcgtgctgg

SEQ ID NO: 71312 - DNA, 83 bp, Homo sapiens
  chr10:3285685-3285768
  hypo
tctcaaaaaataataacaataaatagcaaacagcagagagcatcatcttaaggttttgaaaatacatacgtattactattatg

SEQ ID NO: 71313 - DNA, 193 bp, Homo sapiens
  chr10:33233331-33233524
  hypo
ctacgcggcagcagccgtgatcatgggggccctgggctaggcaacagcactagttgtcgcgcgtcaccaaacactgtgaagcacctctctagcggagacctgctccaggatcaacatgctgcggggcacagaaattaatgtgttagctaacgctttcattgaccaaaggaaactcatccgagatgatgtcatg

SEQ ID NO: 71314 - DNA, 30 bp, Homo sapiens
  chr10:3329449-3329479
  hypo
ggattttaggctgggcgaggtggctcactc

SEQ ID NO: 71315 - DNA, 270 bp, Homo sapiens
  chr10:3329539-3329809
  hypo
ctgggcaacaggacgaaacaccgtatctacagaaaaatcaaatcgatcaataaataaaatggatgttgtttttcagagcaagtttagatttgcagaaaaattgcagagcaggtacagagagttctgatgtccaaccttcctcctgtgcgttgttctggtttcacatgttcgtgttgtaattgagtgcgtgcacactcagtaaatgcgaaatggtttcatcacaaccgcaccgatgcagttcctaaaagaaacacacgacagccgattttg

SEQ ID NO: 71316 - DNA, 30 bp, Homo sapiens
  chr10:3330158-3330188
  hypo
gtatgtgtgtgtgcacgtgtgtggggatac

SEQ ID NO: 71317 - DNA, 204 bp, Homo sapiens
  chr10:3330414-3330618
  hypo
agaggggaggggcagcgagcaggtgccacgtccacaccgggtgaggcgtgaggtgagggctcccccgcgccgccctggcgtccaggtggtgagggctgcacggaaacgtggacttcggcagaacatgtgtgcgccacggagcggctgcgtgcagcccgcaggtgagaccgtctgcataactctgccaaccgtggagtatccaag

SEQ ID NO: 71318 - DNA, 47 bp, Homo sapiens; identical to SEQ ID NO: 33011
  chr10:33622724-33622771
  hyper

SEQ ID NO: 71319 - DNA, 206 bp, Homo sapiens
  chr10:33623014-33623220
  hyper
cagcccaaggatcaacgtcaggagggagcccaaagacctgaaatcctcctgctctaaaccgcctgatctcatttcttcttctctcctcccagataaaagtttccttcgcccgggagtcggttgttcccggctgatcccgggaagccccgcctgagccccggtccggggcgggcagctgggagccggggcgccgctgtcacccgcgc

SEQ ID NO: 71320 - DNA, 394 bp, Homo sapiens
  chr10:33624053-33624447
  hyper
cgtgggtgcgggcgtcggaggaaggggcgcggaggtcagtgccagccgcagggtctggccagcccacctcgcgtgctcgctctgcacccctagagggagagctgggcagctcctgcaggcgcagatcccgccgccgcgcagtgcggagcgcccgggaggtggcggctgcttctcgcaacttcaaatcccggggcccgcgccctcggcggcgaggaacgcagggtcaccccctgccactcctcatcgcgccatcctgagacctgtggcggggagcagcggggcacccctggacgcccctgcccagagctggagggcgaggaggggaaagccgggctggagtgggagccgcaccgcgaagccgggcgaggggcagcagtgtcgctgtggtgtgaag

SEQ ID NO: 71321 - DNA, 143 bp, Homo sapiens
  chr10:33624698-33624841
  hyper
gtggaaatcaggggtcgggcggcccccgtttctctgtgcatcccgagggagggaaagagtggcgggggaggggtgctcttcgctgcgccctctcagtgtccgctcccggccacagacaacgtgcacgccggccctggagctcc

SEQ ID NO: 71322 - DNA, 582 bp, Homo sapiens
  chr10:33625288-33625870
  hyper
cctcggggtgcaggccgttcccgggccagtgggaggtgcacccacggagcccgcactcgccactctcttgccccgggtcaagcctgtcttctcctccccacgcgcctcgggattcccagtcgccaagttggaaactcggcccccccgagcgcctctttcctctgccagtttcctccttcttctcagctgtcggacccctgggaggcgcggggtgggaagtgggcaccgaagggctgggagttaaatgcctaagttgagcggaaggagcactgtcgaagccatgggcagccctgcgcccgggcaggcgggcaggcgggaggcgaggcgggggcgccgaccgcgcccagcgcagaccccgggggagtgagcgccgcagaggcagcctgggctctcggctactacccgcgcgcggtcgccgcctccccaggtgcagccccgccagtcccagcccccggctgcgccgggcgagcggcatcatcagatttagggtgacccggagcgacctcggtccaggctcggagggagaggcgcctctcaggacctggcaggttgacagggaaggggaaccgggagggagcggcg

SEQ ID NO: 71323 - DNA, 59 bp, Homo sapiens
  chr10:34001866-34001925
  hypo
cccagctccatgctgcgggaagcctgaactccatggagatgccacgtgtcagggctcag

SEQ ID NO: 71324 - DNA, 30 bp, Homo sapiens
  chr10:3438367-3438397
  hypo
gcaactctccccttccgtcctctgtctcac

SEQ ID NO: 71325 - DNA, 39 bp, Homo sapiens
  chr10:3440138-3440177
  hypo
ctgcgccccctcacccgattagcccggtgtttgccctgc

SEQ ID NO: 71326 - DNA, 32 bp, Homo sapiens
  chr10:35103047-35103079
  hyper
gaaaacttttcattccgcgactcttccaaggt

SEQ ID NO: 71327 - DNA, 52 bp, Homo sapiens
  chr10:35103482-35103534
  hyper
cagactccggggaggcgcccagggccggcctatgcgccgctgcccggctcgc

SEQ ID NO: 71328 - DNA, 39 bp, Homo sapiens
  chr10:35104078-35104117
  hyper
ctcagctcgcatgcccggcccggccgccctcgcctcgcc

SEQ ID NO: 71329 - DNA, 353 bp, Homo sapiens
  chr10:35104860-35105213
  hyper
cagttctgcctgaaacgcaagaattaatagtctgctctggggagacagtggggaagccgtgagcgaccgggccttttccagaggccactatttaccttgaagtttcctgttgaccctctgctgacccacccgcttaaatagattagaacttaaacatcgcaattctgatacatttatttctttgaagttctgcagcataaggaatcctaacgcgaatccgtgaacagtctattccgacggcgcagagaaatctcacgcggggatccccacgatgtgccggcgcttaacgcagacgcccgaacccaggggaaggctgcgactccgcgatgagtgacatgcgggcttgagacgtt

SEQ ID NO: 71330 - DNA, 38 bp, Homo sapiens
  chr10:35152333-35152371
  hypo
agagatgtttcaggccgggcgcggcggctcacacctgt

SEQ ID NO: 71331 - DNA, 38 bp, Homo sapiens
  chr10:35207255-35207293
  hypo
agttcttactggagccgcagaagcgtattaacctcgcg

SEQ ID NO: 71332 - DNA, 1225 bp, Homo sapiens
  chr10:35929333-35930558
  hyper
cgctgcacgccaccttctcgtggcccgccaccaggcgcactaggtagcccaccgacacgaagaggtagcaggccgagaggaagataatgggccgctccgggtacttgaagcgctccatgtcgataaggaaggtggagacggtggcgaaggtggacacgaagcagagcaccgaccacaggccgatccagaagacggtgaaggcgcgctcgtcctggctgaaaaaggggttgtggcagggcagcgcgcagttagcgatctggcctgtcttgacgcggttgtagagcgggtggcgctcgctggacacgctcaccataggcgcgcggcactggcacccgggctcgcagggagccgcgccgccgccagggggccgcgccttcccgccaccgccgccgccgcgagctgggggcgccgccgcgtccccgccgccaccgcccctgccgccgccgcggtgcgggggcctggcccccggcgggcggccgtggccgctgcccgaaggcggctgctcgccgggcggcggcggcggcaggcggcgcggcgggctgggcgcggcggtggttaggtcggtgcggttgtagtccatgcacagcgtgtcagggttgccttgctcgggcagccggtcgcagcgcatgcggtcgggccaggcgaagccgtactggcgcatgagcggcgcgcagccggccttggcgcgctcgcacaccgagcggcagggcggcagcggcttcttgtagtcctctaggcagatgggcgtgtacatgctgcacaggaagaacttgagatcgggcgagcactggatctccaccagcggccagaactggtgcacctccaggcccgcctcgtcttgcgtgtcgtggttgaactgattgggcatgtaggtgtagttgtagccgatgcccttacacagcggcacggtgatctcttggcatgccagctccttggccgaggcggccgcagcgccgctagagcgctgcagcagcgccaaggcggccagcagcgaggtcacttccaacaggtaaccccactccatgctgtgcgcctcggcccggtgccctcgccctccaggcggcgcgcagaggggtgccggggggggggcccacgagagagccgcagacgggtacagcgggtgatctggggtctcccttatgcttcgcccgggaggggggtctgccgataatctaaccccttctaggggcgcgtccgcagcggcgcggcccgcagcctgggcagg

SEQ ID NO: 71333 - DNA, 35 bp, Homo sapiens
  chr10:35931026-35931061
  hyper
gcctggaaaagtcagcgccgcgctccggccgcagt

SEQ ID NO: 71334 - DNA, 30 bp, Homo sapiens
  chr10:35931404-35931434
  hyper
aaccttgggattgaccgcagagacagagtg

SEQ ID NO: 71335 - DNA, 242 bp, Homo sapiens
  chr10:35931778-35932020
  hyper
aactggggctggacccgggacggcccgggtgagatgccccggagcccagccttgggcgcgcgaggggcgcgggggacaaatgcccgccagagactctcctcccgcctccgctgcgtgacctgggggagcctcagtttccccacctagagagttgggtgatcatagcacagatctccaagggggctttgataattaggtgagataaaatataggaagccccgagccgccgtgctttcttagga

SEQ ID NO: 71336 - DNA, 30 bp, Homo sapiens
  chr10:35989914-35989944
  hypo
tcgttttacctaaatcgtgcaagacaagag

SEQ ID NO: 71337 - DNA, 30 bp, Homo sapiens
  chr10:36211085-36211115
  hypo
tcagatgaactgtcacggacactcaaatga

SEQ ID NO: 71338 - DNA, 83 bp, Homo sapiens
  chr10:3641339-3641422
  hypo
agtggacctggacagcgcaggaattcactagaaaagcggaggaagttgggagggcgaggcgggcggatcggatcatgaggtca

SEQ ID NO: 71339 - DNA, 82 bp, Homo sapiens
  chr10:3678219-3678301
  hypo
cattaatttcatagacgattctgaaaagggtttataacatgatattactaggatcgtgttggtttacattgaatagaaatag

SEQ ID NO: 71340 - DNA, 261 bp, Homo sapiens
  chr10:3678601-3678862
  hypo
gggattacaggcgtgagacaccgtgcctggtccaaagagatgtttttatgtggttcaccttcgaccttcatcagggtgactcaggaggcacattctgaagccactctccaacacttaagttttttgccaggtatttttcacaaagcaacgatttgaacaatgaaggagaaaatgtagcctcgcaacttcattcgtaaataatccagactaaccgcacggagtataatggatcaaagtgagcagaatcgctcactttggatg

SEQ ID NO: 71341 - DNA, 301 bp, Homo sapiens
  chr10:37106743-37107044
  hypo
gaataaaataatacacgttagataaatgtcactgctttttagccactcatacattaccatttggaattatgtagtatttacaacccaaagttggttctcgaatcttttatttctcatctttgtgtaataattttacaaaatgtcctcttcatttttgaagaaaaagaaatgtgaaacgttcgtgatcgaatgcttccccctgtgttgtattagaggaacccgaagcaaagcctccagagggtgctggagaagctgcggctgcagagcagtgacccgaggcggggggcgcctcacccgccag

SEQ ID NO: 71342 - DNA, 94 bp, Homo sapiens
  chr10:37923450-37923544
  hypo
tgagttccaggtgggcgcgggctcagtaggccccacgctaggagcggccagccagcaccaccagccccaggcagtgaggggcttagcacctgtg

SEQ ID NO: 71343 - DNA, 94 bp, Homo sapiens
  chr10:37923604-37923698
  hypo
caaattctcagtgagcctccactgcctccctgcctgcagggctcgaaacctgcagcctgccatgactgagcgtgtggcccgagcatgcgtgtgt

SEQ ID NO: 71344 - DNA, 35 bp, Homo sapiens
  chr10:38078895-38078930
  hypo
aaacctgcctggggccgggcgccatggctcatgcc

SEQ ID NO: 71345 - DNA, 23 bp, Homo sapiens
  chr10:38301640-38301663
  hypo
tgaggcaccgtgtctggccaaga

SEQ ID NO: 71346 - DNA, 249 bp, Homo sapiens
  chr10:38445833-38446082
  hypo
agaggggtcctggctcggcctggaatggggctcggggagggtcagacggtctattgggctcccagcctgaggcctccctccccggcccgtaacccctcctgccgctggggccctcctgcctttccctgcacgccactccctgggaggccgagactcctgcctggcctccctctgccgctggcaccccagactcccggactcacccttggctgggttgccctctcctcctttaagcgctggatgccacaa

SEQ ID NO: 71347 - DNA, 30 bp, Homo sapiens
  chr10:3862581-3862611
  hypo
ctttaatctttagagcgggggccactgatc

SEQ ID NO: 71348 - DNA, 30 bp, Homo sapiens
  chr10:38690543-38690573
  hypo
aagcccggcaagtagcggagactacaagtg

SEQ ID NO: 71349 - DNA, 177 bp, Homo sapiens
  chr10:3895354-3895531
  hypo
gttcccaccacacagcggcggctcaactgcccaggctgtggggtttccagctgtgtcgtgttgacttgaaccgactcagcaggcggtgccctcctggagcacctgaagcctccagagaaatatgatggaaaaccaagaggcctccacctccctgacttgctgcgacctcctgggctt

SEQ ID NO: 71350 - DNA, 163 bp, Homo sapiens
  chr10:3983403-3983566
  hypo
cctaggccgctaagacgtcaggggagctgatacacacttccaagaacacggagacatcaaagggagctgagagtccacagcggcagcaaaacaggtgctgcttcacatgccctttgctaagagtcctggagtttgaagtctccacggccgatctaaaagcaag

SEQ ID NO: 71351 - DNA, 54 bp, Homo sapiens
  chr10:42777495-42777549
  hypo
tctaaaactactccacggccgaggaactgcggcctgcagcgggctgggacgagg

SEQ ID NO: 71352 - DNA, 19 bp, Homo sapiens
  chr10:42862078-42862097
  hypo
ttcctcactgcctctcgta

SEQ ID NO: 71353 - DNA, 59 bp, Homo sapiens
  chr10:43046988-43047047
  hypo
tcttttaaataaagccgaaatagataacttacagacctttcttgcggctgcacctctga

SEQ ID NO: 71354 - DNA, 30 bp, Homo sapiens
  chr10:43187000-43187030
  hypo
taccactccagcagccgtgcagtccctgtc

SEQ ID NO: 71355 - DNA, 1582 bp, Homo sapiens
  chr10:43248537-43250119
  hyper
tggctgctccagcctcgaggccgcaggtcaccgcgcgggccccgtgcctactggcccggcagtcctgcgggtcagctcaggggagtgctctggagagccctgagcccacctcctgcgccccgcccaacctcgggtccccaggcccagcctctgacacgccgctcccagcgcggccacgccacagctccgggctgcgctcccccaggcaaaggcgccgccggcgcgtccagcgcggcctcctcctccaggcggcgcttgtgagtcaatggaaaagtccttggcgaactgagcagccgcctagtatatctctgaagcctcctgcggagacttcacggcttgtcccaggagcttctacaacagcctggcattgagagtagagttgtaatattttccgccagtttttcccagcccggccccgaagcgtctgatcttaaagtccacgtatcagactccggggggcgtccctgcaagagcgccaggtccccgacacccaccagggaatgaatctgcgcccaggtccccgacacccgccagggaatgaatctccgtcccaggagaagggcgtggcgaggggagaagcaacaaccacaggacccgtgacagtggccaagccttagaggccccgcatgcctgccaggcgcccgagcccacgcagtccaggtttccccatccgggcgggaaccagctgtttcccctgcacgggcgagggcgctggggtcacctccgccgacgccaggcgtgagctccagaacccgctcccaaccgcccggtcccgtgagcgcggggagcctggctctcgcctgacaataaagaaatcatcacggacagaaggaaagaggagcgaggctgggaagggagcggctttaatccggggtccgcccccttcaattctccagcgcagcggccccgaaagtggggtggggacggggattgaggctgagctcgcttcttccttgttttccgggtctcgcgcctctgaagcgaactgggcctggaggggtgctggggatcgagggagcggcgttggtgggtgaccgagggaaaggtggggccagcccctgggcaccggtcggaggaggattacgaggcggagccgctgcctgcccgcgcctcacccgcttggtccacccaatagctccgctgtagactcgcggcggcaggagcggcgggccagatggtgattacaacccggggcgctatccctttggaacctgacccccaactccgctcagtaaccggatttccggaagccgcgacctcgaagcccccagcgtttctccaccgacggcggggccggggctcctggaagcctcggagccgcagctccagcctgcagcgcacgccttggcccccagggagcagagaggcagagtacccccctgcatccggagcatagcaagcatgccccaggctgaggacctgcgacttggtgggacttcggtgcccgcccctccgccactacagggagcagaggcggctctggaagtcggtttagtgcggagaccgcgaccggaggagcgcagaacgctcctcccagcgtcctgggctccgcaggcacaatttttaaaccagaggcgaaatc

SEQ ID NO: 71356 - DNA, 644 bp, Homo sapiens; identical to SEQ ID NO: 33022
  chr10:43250136-43250780
  hyper

SEQ ID NO: 71357 - DNA, 71 bp, Homo sapiens
  chr10:43250854-43250925
  hyper
cgcccaggccgccggctcggtgagcgcagagaggggcccccggtttatgccaaacgcgtgtcttctccaac

SEQ ID NO: 71358 - DNA, 36 bp, Homo sapiens; identical to SEQ ID NO: 42584
  chr10:43265217-43265253
  hypo

SEQ ID NO: 71359 - DNA, 30 bp, Homo sapiens
  chr10:43265495-43265525
  hypo
cctccccacccctttcgttactccctgagg

SEQ ID NO: 71360 - DNA, 30 bp, Homo sapiens
  chr10:43332265-43332295
  hyper
tggaacgcttcgtggcgctgctgcaaacct

SEQ ID NO: 71361 - DNA, 98 bp, Homo sapiens
  chr10:43332534-43332632
  hyper
cagcgcggctccccacggcgtgcaggacccgggactgtcgcgccgcgcccggggacgcacaggaggtgggaccccggagcgaagcccctgcagcgtcc

SEQ ID NO: 71362 - DNA, 73 bp, Homo sapiens
  chr10:43332713-43332786
  hyper
cgttctgggaaagttaaagaacgcgctgcagctacttcacctgctgctgaaaggagcccgggcagggctggtc

SEQ ID NO: 71363 - DNA, 178 bp, Homo sapiens
  chr10:43361545-43361723
  hyper
ccccacccgaggacccgcagtgcccggccgccgcgagctcgcggggtgtatgcccgccccgaggctccaccgcgcctgtgtgccgggaagcctggctccacaggaccctcaggcactgggcgcgccgtcgctgcagctgccaggagctcctgaggaagtggctcgaggccccggggcg

SEQ ID NO: 71364 - DNA, 350 bp, Homo sapiens
  chr10:43361980-43362330
  hyper
tgtgaacgcgtcatacgcttgtgaaagacggtgcttgtgcacacgcgtgtgcgtgcgtgtgaacgcgtcagggtacccgaggatgcacacacgcacgtgtgagtgtgcgcgagtgcgtgctcagaggacagctctcagcaggctggggacctccttcctctcacccctgagggttttgggggaccagcccccgtatccgggtgctgcgggatcccctgaggcgagcgcgcaccgctgtgctcgggctccggctttgtggggacccggccttcccggcccgcaccacgaggagttccacgcagtagccacgaggtggcaccgcagactcgctaccgcggagcgcggcggct

SEQ ID NO: 71365 - DNA, 30 bp, Homo sapiens
  chr10:43364192-43364222
  hypo
catcctcaccaccagcgctcgagtcagtgg

SEQ ID NO: 71366 - DNA, 182 bp, Homo sapiens
  chr10:43393461-43393643
  hyper
attttcacctttcatcgcaagggtcttcgcggcagaacgtggccgtccccacagccgtcgggggtttcgggttggatcccgcgttcgctccgctgcttggcctgcgcttcagcctctagcgacccagcgggggcgcgacttccgagccgcctccgcctcccgcctctaccgcggggccgggg

SEQ ID NO: 71367 - DNA, 208 bp, Homo sapiens
  chr10:43428369-43428577
  hyper
cctgctgaggaaagccggtgcctcctgctccccagccctgtgctcccgcgcccccagtctcagcgggttccggcttagtccggcaccctgggggaatgctgcgctctggctggcagcacgccctgcctgcgctcgccccgtctttgctcctggtcaccatgcgtcctgcacagttaccatccgtgcccacatgctgccccggggtcgc

SEQ ID NO: 71368 - DNA, 83 bp, Homo sapiens
  chr10:43428894-43428977
  hyper
ggagggcaggatgcccgcccggggcggaagagccgagggcaggccctggggcggggcgctgggctatggagaccacgctcctc

SEQ ID NO: 71369 - DNA, 131 bp, Homo sapiens; identical to SEQ ID NO: 33030
  chr10:43429066-43429197
  hyper

SEQ ID NO: 71370 - DNA, 223 bp, Homo sapiens; identical to SEQ ID NO: 33031
  chr10:43429215-43429438
  hyper

SEQ ID NO: 71371 - DNA, 30 bp, Homo sapiens
  chr10:43479981-43480011
  hypo
cactttctgcctgctcgtggtgctgcaccc

SEQ ID NO: 71372 - DNA, 1032 bp, Homo sapiens
  chr10:43571966-43572998
  hyper
gccgcgctcccactgcgcctctcgcctctgagaaatggcgcagcaagcgctccgcggagagcctggaggcggggcgcccttctctgagtccgcggggtcgcaccccgagccagtcggccagacctgcatcccgcgtagcatccctgccctctctgtgcagcggaaagggcaaaaggcagggactgcaagcgggcgcgcaccgggtaggaagagcggctctgcgtaggtgcgcggacccgggctcctgggttccatccccgccgcgcacctcggggtccgcacccggctcctgccgggcccttttcggccgcaccccgctcccgcaccccgctcctccccaagccccacccggcccaagccgcgcgtcccgcactgagctcctacacgcgccgcgccccggccgcaccccgcgcagccagagcaagcactggagccccgccccttcccgcaccccacccgcctccggccccgcctggcccacccctggaccgcccccgccccgccccgcccctacccgctcctccggcgcagccggcgcttacctcgcttcagtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaaggtgagttctgccggccgccggctcccgcaggggccagggcgaagttggcgccgagcagcggagcgggcgcgttcagaagcgcctttctgtttgccgtgggcagcgggctgtgcggtcgccggccacccggcctcggctgggagcgcagtggctgcggcgggcggcgggcgaagggcaggacgcctcgggccgggcgcctcgggccggggctgggcgggt

SEQ ID NO: 71373 - DNA, 52 bp, Homo sapiens
  chr10:43573249-43573301
  hyper
ctcccccagctctgccgtcctggccagccgagggattcggaggctcttttga

SEQ ID NO: 71374 - DNA, 47 bp, Homo sapiens
  chr10:43600276-43600323
  hyper
ggggaggcctggggccgcggcggtgtgcgccccgctctgaccgcaga

SEQ ID NO: 71375 - DNA, 81 bp, Homo sapiens
  chr10:43600550-43600631
  hyper
ggtgaccgtgtacgacgaggacgactcggcgcccaccttccccgcgggcgtcgacaccgccagcgccgtggtggagttcaa

SEQ ID NO: 71376 - DNA, 186 bp, Homo sapiens
  chr10:43615366-43615552
  hypo
accctgactccaccacgcccctgccatgccacacccccggcccaggtctcaccaggccgctacccgggccacacaccacccctctgctggtcacaccaggctgagccagtgaccgctgctgcctggccatggcctgacgactcgtgctatttttcctcacagctcgttcatcgggacttggcagcc

SEQ ID NO: 71377 - DNA, 109 bp, Homo sapiens; identical to SEQ ID NO: 33035
  chr10:43697887-43697996
  hyper

SEQ ID NO: 71378 - DNA, 77 bp, Homo sapiens
  chr10:43698279-43698356
  hyper
gccccaactcagacccgccccacagccccagccaggccacgccccaaccctagccctgaccccgcccccaggcccca

SEQ ID NO: 71379 - DNA, 902 bp, Homo sapiens
  chr10:43724462-43725364
  hyper
ggtctccataaacagcgtgggaaatgccagtgctccatgctcaggtcctctccaggaccagttctccgcctgcaccctacagcgccctcgccctggagcgcacactcctcgaagccccacggtgggctccactctccctaaacgcacaggcgcgcgtggggctcacaaggcacaggcacggctgcgctccctcccatgtgccgtgaataagcgcgcccgcgcttccgcagccctcccccgcctgcacctcacacagaccacacaccgcggaccacccctcgcccggcacatcctcctcagagcaacaggtggttctgcgcccctcaagtcgtccgggctcctacacgcccgtccccaccccttccaggctcgcaggagccactgtgctctcggcgtccgcgggccgcgccgcgaagggcagggcaggagcagaggcaggctgggcgccgcccaccgggcagtaggtgctccagcggggacgcacagagggcggcgcgcgggtcctcagggcgggcaccctcccgcacgggtcgggatgcaggggaccgtcgcacccctcccgagcccgacagcgcaagaaccctgccccgcggccttgcgcctgggcccgccgcagccctacctggggctccaggaacattctggccgccggctccccgcgccgtcctgcccggtccggcgtccagcgagcggcggctcctctgcccgcgagccaagcaagcacccactcctgcgccggcccctgccgctggacgcctccgctggaggggtgggaccccggaagcagggaaccgaggggctgggctggggaccgcggggtccgggcggggcagaggggccgcgaggccggccaggaacgcggggcggggccgaggctaggagcatggcgcggaggtggggca

SEQ ID NO: 71380 - DNA, 98 bp, Homo sapiens
  chr10:43762179-43762277
  hyper
gagggaccccgggcccgcgcacgccgcgccctgcccgcgccggcgaccggagggcacggccccaggcgcgggcgggggccccgaggcactgagggtcc

SEQ ID NO: 71381 - DNA, 396 bp, Homo sapiens
  chr10:43762357-43762753
  hyper
ggccggcgccggcggcggctcatgctcggcgcccgggcccgcggcacccgcccacccgcggccgcccccgcgctgcgccagctgcgggcagagcagctccctccgcagccggcgccggggagcgcgagcgagcgagcgaacgagcgagcgcggagcgagcgccgagcgggcacggagcgggcgcgagagcgcggggagcgggggagcgggcgggcgcgggacgcggagggaggagggtgcggggcaaaggtgcagggggaggtagggcgcgggacggggctcgagcagagggcactgggacagggcgggcgccgggagagggcggccaggctttcatttaaaaaggataaggcatcacgcctgtaatcccagcactttgggaggccgagacgggcg

SEQ ID NO: 71382 - DNA, 69 bp, Homo sapiens
  chr10:43778482-43778551
  hyper
tgccggccacaaagacgtgcgctgttggtcagcaccgaggacagcacttgggggcggtgctccggggaa

SEQ ID NO: 71383 - DNA, 45 bp, Homo sapiens
  chr10:43800413-43800458
  hyper
ctggcttcggtttcgcgaacttcctggccgcggagctttcccttc

SEQ ID NO: 71384 - DNA, 30 bp, Homo sapiens; identical to SEQ ID NO: 33040
  chr10:43818377-43818407
  hyper

SEQ ID NO: 71385 - DNA, 275 bp, Homo sapiens
  chr10:43857593-43857868
  hyper
agcctccaaggtccccgttaccgaagaccgccaccatcacgacatagcgcagcacatatgggtaaacaaatggactgagactcaagcaaagaagtaacccgagacgcgcgttacacggaaaacgactgcgcaagcgcggtagagcaggggcttgcaggtgagtgggagcagccaatccacgcgaagggggtcgggaccacttccgcggaggaaagccccgcccacacctcctgggccctcgcctcactggcggtttctcccgcgagccagcctca

SEQ ID NO: 71386 - DNA, 151 bp, Homo sapiens
  chr10:43858289-43858440
  hypo
gggacactcacagggcgggggtccaggcgggagtccagtagtcctcgtggagacagctgggaaaggcctcggggcaagggacctcggatttcctcctctgcctcaaaacagacagtctaagctgggtgcggtagcttgcgcctgtaatccc

SEQ ID NO: 71387 - DNA, 196 bp, Homo sapiens
  chr10:43892774-43892970
  hyper
gtcaccaatgggaaacgcgtgcctgcaggtgcggccccgtggcccgcgcgctgggcccaggcaggaagtgggggaaggagagagtcagggcggcgggaagacatttctccgagttctcccgaagggagccaggcgcgagcgcgacctggggaaagtccagagtgccagccacggggaagggcgggcagtgcagagt

SEQ ID NO: 71388 - DNA, 45 bp, Homo sapiens; identical to SEQ ID NO: 42587
  chr10:43905839-43905884
  hypo

SEQ ID NO: 71389 - DNA, 44 bp, Homo sapiens; identical to SEQ ID NO: 42588
  chr10:43906064-43906108
  hypo

SEQ ID NO: 71390 - DNA, 30 bp, Homo sapiens
  chr10:43915503-43915533
  hypo
caatccgtctgtctccgttttccaaagtgc

SEQ ID NO: 71391 - DNA, 41 bp, Homo sapiens
  chr10:44069791-44069832
  hyper
gggggcgcagcagctcggaaatgcggcgccgggacacacgt

SEQ ID NO: 71392 - DNA, 703 bp, Homo sapiens; identical to SEQ ID NO: 33043
  chr10:44185340-44186043
  hyper

SEQ ID NO: 71393 - DNA, 156 bp, Homo sapiens
  chr10:44197833-44197989
  hypo
cgagctgcccccccacgctgccaccggcgctgccacctgcccatatccccgccttccgcagaggcttcagcctcccctgtacagaggcggggcatggagccggcggctttcagaactcccagggtctctgctgcggtagaccggctatttaacctc

SEQ ID NO: 71394 - DNA, 30 bp, Homo sapiens; identical to SEQ ID NO: 42590
  chr10:44433895-44433925
  hypo

SEQ ID NO: 71395 - DNA, 30 bp, Homo sapiens
  chr10:44441910-44441940
  hypo
agatattgtgctaaacgctttatgcatggg

SEQ ID NO: 71396 - DNA, 595 bp, Homo sapiens
  chr10:44500784-44501379
  hypo
cgggctctggaagtccgctgttcggggtaaattggcagctgctgaaccctaaagtcgtggggcagggctccgacaggcctttgcgcctcctttccccatcagcgtttagagctaatgggaaaggaattgtttattttcttttgtttttatatttttgggttagctttaccgctacagaaaagtaaggtaaatgaccccgcattcacggagggtgactgtgcaaagcgtgaacatgcgccgagtttatgaagcgggtgtcggagccagcgctgcttctcgctgacccgcatgccccggccggccaggaacctgcgcctgagtgccctggtgtttctcttttttcccacgaaagcacgtgtgaagggcagagccacgtttatcaagaagtcatttttcccgttcgccggcattacaccattagcattacaggggccacctacacctcgtatttcgattccacagctccggagaacctgcggtgctgcggccactctgtgggtgtccccccacccccatctccactgcgagctctccggcctgggcacgcagctgctgacacacatcagcatggtgccctggccggcatctgctctgt

SEQ ID NO: 71397 - DNA, 220 bp, Homo sapiens
  chr10:44547194-44547414
  hypo
cacattcagagacatcggggctcccagaagcagcagcctcagctttggagaatggggtcaacagcttctggtagctgttcacctggagaaatgggggagagtgggaattctttaaaagatgacacatgctttgttatttctggcactcacggtgctgaactcgtttcagctgagtaagcactagtgactcaactccaaggcacaccgtagacttcatctc

SEQ ID NO: 71398 - DNA, 38 bp, Homo sapiens; identical to SEQ ID NO: 42593
  chr10:44594208-44594246
  hypo

SEQ ID NO: 71399 - DNA, 30 bp, Homo sapiens; identical to SEQ ID NO: 33044
  chr10:44788550-44788580
  hyper

SEQ ID NO: 71400 - DNA, 315 bp, Homo sapiens
  chr10:44806359-44806674
  hyper
ggcggtgatgctgcacgcccctgggggactgcatggagaaggggagggtgcgcggggccggctggtccagtgcactccggcgcggccccggcacccgtgggcaccgccatgtccttcgctcagctccgccgcggctacctgcggggtctgcgcggctgcggtggccaggtgaggacgtctctgcccttgcgcggcctgcgctgtatgcttcctgcctggcccgcgcttcccctgcctgcatcacccgctgcccgcgcggctcggagcgcgccctctgctggaccggccacggccggcgggcggctgcctccaggc

SEQ ID NO: 71401 - DNA, 34 bp, Homo sapiens; identical to SEQ ID NO: 42594
  chr10:44869035-44869069
  hypo

SEQ ID NO: 71402 - DNA, 245 bp, Homo sapiens
  chr10:44879151-44879396
  hyper
ttaggcagtccgccacgaccccaggctgcccagcttctccagcccgactcagctgcgctggtcctgctcacaccagcgcacagtccaagccagctaggacgccggggccacgtctgcaccaacccagccaagggctcgaggcgcgctgggcctgcacagcccgcggctgcaagagcactcagagtgtccttcaactctttgcaggaaacttcacagccaaggaagctcagcggcctgagccacag

SEQ ID NO: 71403 - DNA, 632 bp, Homo sapiens
  chr10:44879823-44880455
  hyper
cctggccaagagccccgcgagggtgtggggagaggatcggcttcgcagggagcggaggctgcgcggctgcatcggacctcacagcctcaagtcgcggcatgaggcgaactttgcaaagcgcgctctcgccatgcaccgcccgacctccagcactgtgcgcagcaggacctcggagcccattcgcctgtggaaaccgagcccgcagcgggaaggcagtgggtggagggtgggcaggcaggggtctggggtccgcggctccccaccctcgcgccttcccgcgccagtcccgaacgctctcttggggcgttcctgcccagttgtcccggctgacctcgctctgcagccagcttgaggtcaggcggtcgctctctgcaggtcacaaaccctcggcgcaaaagtagggctttgaacgcgacaccgcaccagagcgcccagctaagcgagctgcctccacccccactgtgtcgggcggcgcaaactgcgggcgcaggcagaggagccgcggctctgcgccgggcgggagccgaagcccagagcctcgccagggcctccccgccgagcgcacttaccgtcgctgaggcagagcgcggtcagcacgaggaccagcacgaccacgaccttggcgttcatgg

SEQ ID NO: 71404 - DNA, 26 bp, Homo sapiens
  chr10:44880519-44880545
  hyper
cggctgacggagagtgaaagtgcggc

SEQ ID NO: 71405 - DNA, 99 bp, Homo sapiens; identical to SEQ ID NO: 33049
  chr10:44880546-44880645
  hyper

SEQ ID NO: 71406 - DNA, 357 bp, Homo sapiens; identical to SEQ ID NO: 33050
  chr10:44880673-44881030
  hyper

SEQ ID NO: 71407 - DNA, 65 bp, Homo sapiens
  chr10:44882297-44882362
  hyper
gggcgccctggagctcggagatccgaccctgcgggagccgcgcgcagcctcgcttgcccttaaat

SEQ ID NO: 71408 - DNA, 85 bp, Homo sapiens
  chr10:45374177-45374262
  hyper
gggaggggaaaaggccgcttggaggtggaggggaggcctcctcgctcaccacccaatggcagagatgaggcgttggaggagcaga

SEQ ID NO: 71409 - DNA, 96 bp, Homo sapiens
  chr10:45565093-45565189
  hypo
ggtcctcaaatccagcggacatggagtgcacggtagctttctttcaagattccactgcctggaataaaaaattgtgccaagctctttctctgctat

SEQ ID NO: 71410 - DNA, 150 bp, Homo sapiens
  chr10:45568859-45569009
  hypo
agaaccagttcttatcgtaggcagcaagctctctgtgcttggccggcttgatggtgtccacccattcggtgactttcagcttcccagactttttgagaaaggctgccagagctctgatgaactcctgctggttcacgtcttttataccca

SEQ ID NO: 71411 - DNA, 228 bp, Homo sapiens
  chr10:4599777-4600005
  hypo
tggtgtcagccaaagcgtttcacagtgcggtgacgatgggatccgcccatgtttgcacgtgccaggagcagcggtagcagcagctccagggaggtgcacacttgtcagcggcagtggggtgctggcgggtgccagagggcctgccgccctaaggtcgttcacgatggtgtcagcggcaatgcagctggggtggagggcctgctggcagctgtgcgtgcagtgacactg

SEQ ID NO: 71412 - DNA, 30 bp, Homo sapiens
  chr10:46009559-46009589
  hypo
cttaagaatacttttcgcaatttcaagaaa

SEQ ID NO: 71413 - DNA, 67 bp, Homo sapiens
  chr10:46009822-46009889
  hypo
agtgcagcgcttccccgcaacatggtccctgtgcttgatgccggggaacaggcgctgcctgcacagc

SEQ ID NO: 71414 - DNA, 30 bp, Homo sapiens
  chr10:46092104-46092134
  hypo
caatatggtctttggcgacggggtattagt

SEQ ID NO: 71415 - DNA, 21 bp, Homo sapiens
  chr10:46098319-46098340
  hypo
acagagcgaggctccatctca

SEQ ID NO: 71416 - DNA, 28 bp, Homo sapiens
  chr10:46221028-46221056
  hypo
acaaacaaacaaacgacaacaaaaaaaa

SEQ ID NO: 71417 - DNA, 30 bp, Homo sapiens
  chr10:467990-468020
  hypo
gatcaggttttcctgcggcagctgagatac

SEQ ID NO: 71418 - DNA, 30 bp, Homo sapiens; identical to SEQ ID NO: 32855
  chr10:4698935-4698965
  hyper

SEQ ID NO: 71419 - DNA, 30 bp, Homo sapiens; identical to SEQ ID NO: 42428
  chr10:482288-482318
  hypo

SEQ ID NO: 71420 - DNA, 181 bp, Homo sapiens
  chr10:49393615-49393796
  hypo
cgtttcagtgtcacacgtacaatttctcggcccggttcagctataaagctcttcctcctattattctttgagcctagaggtagaatcagagcaccacattgtgcttttcccccaaattatttgggagctaatacaaaaggagtaaacagcatttcacacacatgcgcgcacacacattcac

SEQ ID NO: 71421 - DNA, 30 bp, Homo sapiens; identical to SEQ ID NO: 42598
  chr10:49541963-49541993
  hypo

SEQ ID NO: 71422 - DNA, 154 bp, Homo sapiens
  chr10:49652940-49653094
  hypo
atcccatcacccagacggctggctcgcgtgtcagtggccgagcaaagacagacgccactctccccagcccctcctgagctccggcatccagaccttgatgctgctgagggccctgagcaggtgcccgcctcctggtggacgagcccctggtagc

SEQ ID NO: 71423 - DNA, 407 bp, Homo sapiens
  chr10:49731394-49731801
  hyper
ccactatgttcccaacgatcaacagggatcatttcagtcagtcaagggttaagtcggccgggccccagcccccgggaggccggacctccggcggccgccaacgtcctaagcgtgtttctgggctttgggccctctccaagactgctgcattcctcaagcagctctgctcgcaggttgccgccgcgagttttggaaaactctgagtcagggccccaccgtccaagtttgtgacagaggcgggcgagaatgaatggtccctctcccggcagttaagccgcaggggcggcgcagggcgcgcgccgggctcgcggtgcagagacctgcgagcgggtctgggcgccgggggttcctccgtcccggccgtggacttggcggacctgcagccggcgccgcggccagccccgggc

SEQ ID NO: 71424 - DNA, 86 bp, Homo sapiens; identical to SEQ ID NO: 33052
  chr10:49732002-49732088
  hyper

SEQ ID NO: 71425 - DNA, 160 bp, Homo sapiens; identical to SEQ ID NO: 3561
  chr10:49732155-49732315
  hyper

SEQ ID NO: 71426 - DNA, 293 bp, Homo sapiens
  chr10:49732316-49732609
  hyper
cagcgggcatgccggcctccgggcagaccctgctaatcaataggagaacgcgcagatcgcgaccgccgcgccactgcccgcttttatctccgcgcgccggggcggccccgcgctgctccctgccctcgccggcgccctccccacggcccgttactctcccggggtgccgggccgcgcgctctcccaggagccgccagggggcgccacggagccggggctgcctccgcctccctgggagccaagcaggggtggggggccacaccggcctggcctccccgcgcagaatgggaaga

SEQ ID NO: 71427 - DNA, 187 bp, Homo sapiens
  chr10:49857079-49857266
  hypo
gccgacctctcgccccgctgccatgcaattattcctatgaacattctcatcagatcagtcctgtgcttataaccatcaatagctccctatgcctcacgagaacaagtccaagtttctgaatatggcatccacctaccattcctcccttattaccccattccaactgcttcagcgcccctctctctaa

SEQ ID NO: 71428 - DNA, 30 bp, Homo sapiens; identical to SEQ ID NO: 15370
  chr10:49929928-49929958
  hypo

SEQ ID NO: 71429 - DNA, 30 bp, Homo sapiens
  chr10:49939380-49939410
  hypo
agaggccctggtgttcgagctgcactacgt

SEQ ID NO: 71430 - DNA, 20 bp, Homo sapiens
  chr10:50007560-50007580
  hypo
gctgtaatcccagcacgaag

SEQ ID NO: 71431 - DNA, 34 bp, Homo sapiens
  chr10:50078993-50079027
  hypo
tttttgatggaggctcgctccttcccccaggctg

SEQ ID NO: 71432 - DNA, 30 bp, Homo sapiens
  chr10:50088696-50088726
  hypo
accctgtgtgaggttcggctcctggcccag

SEQ ID NO: 71433 - DNA, 30 bp, Homo sapiens; identical to SEQ ID NO: 42602
  chr10:50105263-50105293
  hypo

SEQ ID NO: 71434 - DNA, 30 bp, Homo sapiens
  chr10:50121842-50121872
  hypo
gttgcttcagctccacgggcagcccgttgc

SEQ ID NO: 71435 - DNA, 30 bp, Homo sapiens
  chr10:50160854-50160884
  hypo
gcagctggaccagtgcgtgggcttcccaac

SEQ ID NO: 71436 - DNA, 30 bp, Homo sapiens
  chr10:50300840-50300870
  hypo
gtcaccggaagaagacgcaagcggcttggt

SEQ ID NO: 71437 - DNA, 432 bp, Homo sapiens; identical to SEQ ID NO: 33055
  chr10:50323255-50323687
  hyper

SEQ ID NO: 71438 - DNA, 22 bp, Homo sapiens
  chr10:50323824-50323846
  hyper
cgaccggcggtcctctgcccac

SEQ ID NO: 71439 - DNA, 30 bp, Homo sapiens
  chr10:50340253-50340283
  hypo
agtaggactggtactcggaggactctgagg

SEQ ID NO: 71440 - DNA, 108 bp, Homo sapiens
  chr10:50373584-50373692
  hypo
ccctactccctttgacggctgtagcctgtggccctcactcttgtgacacctgcccactggtccagaggaggagagagtgtaaggaggggaccacgaggtgcattctag

SEQ ID NO: 71441 - DNA, 30 bp, Homo sapiens
  chr10:50376617-50376647
  hypo
tctcgctctgggctgcgtggtatagtgtcc

SEQ ID NO: 71442 - DNA, 41 bp, Homo sapiens
  chr10:50460235-50460276
  hypo
gatgcaaataaattgcgcaaattttccgaaaacaatttgat

SEQ ID NO: 71443 - DNA, 302 bp, Homo sapiens
  chr10:50507426-50507728
  hypo
gctgctgggcagagccgggtttctctcccattcccgaggaggcctgagcagctggacacgcagagagcggaaggtacagcccagacacttgtctggctccttagcgtgggcagggaggctcaagttcatggcgggagggatgttcccgctgggccgatgctgtgctggggaagtagttcggtgccagggtgctgtgcagggtggtatgtgtgtgccgggagcccattggtgttggggctaaggttcttggtgtgctggatgggcctcggggaccacgtacccggaaccgtgtacatgtgtga

SEQ ID NO: 71444 - DNA, 420 bp, Homo sapiens
  chr10:50603003-50603423
  hyper
gtgagagcagcccagcgacgggcccttgtaggctcgtgcagctcgtgatctgggccaggacgcggcgggtccactcgcctttgctttctgggatgtttgcagaagcaccgtgaaagattgatgcggccccctgggttgcggagccccaattagaggcgtgacaccagcatctgtgctgggaggattcggccggtccccgcggcacgcctagcccggggcgtcctggcccaggcggggagggagctgggaggcaggtggcgacggggcggggagctggagcgggcctggagtggggtgtagggaggggtccagggaggcccctactcaccggcaggcggctgcgccccccgcagggcggggacccagccacccaccagccctgctgccgctccggccctttctggccggctctggcttcat

SEQ ID NO: 71445 - DNA, 1141 bp, Homo sapiens
  chr10:50603748-50604889
  hyper
ggtgtgtccacctcccggacggccgtgccctcaccctggccccagcaccaaaccccgcagcgtagtttctggctctctggggtcccagccagaagccctgcacccgggccaccgcagccaggtccggctagcgcgcaaggccatctgcgagctgcagctcaggccaggaaggcagccgagccccaaggcccggcgctcggggcccggcgagtgggtcaggagccgagcatacctcggcgggcggcggtcgaggaggtcggagcgtgaccgcctccgatccgcaagccctgctcggctggcggcgggcggggctcggcgcggctggcgcccgcaggaccaaagaagtgactcgggaagtggccagatgtcttgctgtctgtctgcagcgcgcgccgccgctcagcactcgcctttataatctcacgcataattggccttaatctgattatttccagcgctgtctacagcgagtaacttggataggtctattgggccttacaaatggcccacgtggtgttaaaaaaaaaatccgtcatttctcagcaaacatcaggaatgctttttcctcttttaaaagagaacgatacaaccaccaccaccatcacccccaaaaacatacattttccgaaaacacactaggccccaccccccacctcatgtcccctcagaggcaaacctttctccgagagagcctggtttgggctgcccttatcaaaggcctggtgactcccgggctgcaaattggcaaagcgctgctaattgtcgccgccggatgggttttggggggactctttgcacacggcttccctttccaaacgatcgtacaaaaggaaagtttgattttgttctcagcaaggggtccctgaatttatgttcgcttctcgatgcaaatgatatgcggtgggaccctttgcaattacttttaaaatgcatccgaggcagacactcaacggagagagaccgcccttctctctgcctgggtgaaaattaaactctaaagtaccgggctgaaattttcaagtcaggggcgcgggattggatcaaatcacataaactgcaaaaaaagcaagtctaatggcgcataattggttctgtaatagcattacaccaggataatagcccgttacggccccctgcacta

SEQ ID NO: 71446 - DNA, 1620 bp, Homo sapiens; identical to SEQ ID NO: 33059
  chr10:50605142-50606762
  hyper

SEQ ID NO: 71447 - DNA, 85 bp, Homo sapiens
  chr10:50607131-50607216
  hyper
atttaaagttaaaaccgcggggtcatatttcagcagattcacagtcctccccaccccctcccccgctccccgccctcacctagcc

SEQ ID NO: 71448 - DNA, 86 bp, Homo sapiens
  chr10:50748356-50748442
  hypo
ttacaggtgtgagccaccacgcccggcttgtaacttgcttttttttttttttaaaggagaaagaattctagcgatttcttggataa

SEQ ID NO: 71449 - DNA, 277 bp, Homo sapiens
  chr10:50815067-50815344
  hyper
tcagatagaggagtccggaaaggaatttaccaagcgttcaagtgaagaggaagccagaggggcggggcctccgtgggaggcttcttggttgcggtggggccggggccagcaccctggacagctcccggcggctggcggggagaagaggctttgccaggtcccatctcggctcagaccctcccgtagccttttgctgcaggggcctgacgcctccttgcaaccccggcactcccgtatttggagccacgatggattgggggggcgttgccctctgatc

SEQ ID NO: 71450 - DNA, 749 bp, Homo sapiens
  chr10:50817061-50817810
  hyper
acctccaacctcagccgccctggagcctctctcccgccagtccgcccactggaacacgggttccatgtgccatccagggtcaacgccgctctggggacgcgtcaggcccagcgcacagcctgggcagctcagcctgtcagctgagcacgggcgcctcaaggggtgcggccctctcagaaggaaggtgagtctccctggagcccctgacgacagcgaagcggctgggcgctctccggggagtgggcgcggcacccaagaagggtttcttacagttccaagagaggaccccagccacagtcactccagagcccacccggggcttggaggaggctctggaaaatgagggatgggggagtgtgcagaacagggggcggaggctggcaggagccgagggagggcttggtcgggtgcgaagagtgcctgggaggagttagagtggggagggggtgcggcggcggggagagaagaggcggagctgggggaccagaccgctaaaggagaaagggggattccaggcaaggggaatgtggccaggcagtgcgggagggcggcagcggccaggctaatattcgcgaccccgactggggcgcggcaacttctgccctcagtccccacaagctcccggccgcgattcgcggccgagaaattctgcggaggggccggtgggtcagagccaggccaggcagttgctgagccttcccctcccctcctggcgggagtgtgtgtgcaaggggccagggggcggagtc

SEQ ID NO: 71451 - DNA, 62 bp, Homo sapiens
  chr10:50817811-50817873
  hyper
gagaaagggttgggggtgtccgtgtccagcgctcctccggacgcggctccacaatccagctg

SEQ ID NO: 71452 - DNA, 480 bp, Homo sapiens; identical to SEQ ID NO: 33063
  chr10:50818152-50818632
  hyper

SEQ ID NO: 71453 - DNA, 294 bp, Homo sapiens
  chr10:50818986-50819280
  hyper
cggcgagggccccacccggactcccgaggtgtgggagcccaccctgccgctgcccactccggccaatgccagcgcctacacggccaacacctcggcgtccccgacagctgcgtggccagcgggctcagcccttcggccccgctaccctacggagagcgaagacgtgaagatcggggtgctgtttgcttccaaggctatcctgcagctgctagtgaaccccttgagcgggcccttcatcgaccgcatgagctacgacgtgccgctgctgatcggcctgggcgtcatgttcgcctc

SEQ ID NO: 71454 - DNA, 198 bp, Homo sapiens
  chr10:50819747-50819945
  hyper
cggcttccgagtgggagatgggcatggcctggctgccggccttcgtgcctcatgtgctgggcgtctacctcaccgtgcgcctggcggcgcgctacccacacctgcagtggctgtacggcgcgcttgggctggctgtgatcggcgccagctcgtgcatcgtgcccgcctgccgctccttcgcgccgctagtggtctcac

SEQ ID NO: 71455 - DNA, 422 bp, Homo sapiens
  chr10:50820239-50820661
  hyper
tgcttgatgagccaccgcaaggtctgtacgatgcggtgcgcctgcgtgagcgtcctgtgtctggccaggacggcgagcctcgcagcccgcctggcccttttgatgcgtgcgaggacgactacaactactactacacccgcagctagcatccccactcctcctccagcccacccaaccgccttgggtcaagggggctgctctgcaagcccactggccagctctggctcagggcccacctcctccagcgagtaccccagccactcctcaaccttgacttctgcccaaatcccctccctgtgacccgttccatatccctttctctcttgtccaatggggcttggagcaccgaggccagcgaagccatcgcgctccttgcggaggtgaagaggaccctgagtccccacctgcggctcccctgtgta

SEQ ID NO: 71456 - DNA, 197 bp, Homo sapiens
  chr10:50821052-50821249
  hyper
cgctccagctaggcacgccaggccccgccctttgaggacacgccccacaccagcctcagagctctgaggtgcctgggctgagcttcccttcagaccagaatcccgccccgttgaggctttgagaaaggagtaggagccgagcattccggcagaggaagaaaaacggcccatcttttagagtccgacctctggaaatg

SEQ ID NO: 71457 - DNA, 229 bp, Homo sapiens; identical to SEQ ID NO: 33067
  chr10:50821472-50821701
  hyper

SEQ ID NO: 71458 - DNA, 750 bp, Homo sapiens
  chr10:50822142-50822892
  hyper
cctaaatttgttgcccgagttcctccgggaagcgctccgggtagattctgggggccgggagctgagatccctgggcggggagctggggaagggatggggctgaggacagcgaagaagagggggcttgggggaggggggaaatggaagagagaggagggaggaggtacaagaggaaggagagaagtgcggccagcttgctttctccagtcgggtggccgcggggacccgggcgacgtcggaggccctgccgggaacccaggctgcagcccccacccccgcgctgcgacacgccccccaccccttccggctcacacccccgcccacactcctgagtggtgcggtgcagcgtcggccgaggcagcagagccgaggagagcaggtgagaagaagggctgggctgggctggcggagcgcggtgccgggagcaagggcggcggtcgggggctctatccagggacagcaccggggccgagaggccccaggactcgtggagtcctctgagtcctgcgcagcagcggccgtcgggggtcagctaggaagctgcaggattgcgttgcttcggtgcctgggcttggggaggcttaaccatcagggcttcgggactccaagcgcatgttctcacttcacttggcccagcatctgctaagtgaccaggtccgcgctttctgtgtctagtcggagggtccttgggtctgacccgactcgcctgaattgctggttggcaaccgcttctcccgggagcagggggtg

SEQ ID NO: 71459 - DNA, 160 bp, Homo sapiens; identical to SEQ ID NO: 33070
  chr10:50887456-50887616
  hyper

SEQ ID NO: 71460 - DNA, 137 bp, Homo sapiens; identical to SEQ ID NO: 33071
  chr10:50887617-50887754
  hyper

SEQ ID NO: 71461 - DNA, 47 bp, Homo sapiens; identical to SEQ ID NO: 33072
  chr10:50887789-50887836
  hyper

SEQ ID NO: 71462 - DNA, 30 bp, Homo sapiens
  chr10:50966548-50966578
  hypo
gcgccagccaaacaccgggacgtcatgtgc

SEQ ID NO: 71463 - DNA, 516 bp, Homo sapiens; identical to SEQ ID NO: 33073
  chr10:50969896-50970412
  hyper

SEQ ID NO: 71464 - DNA, 161 bp, Homo sapiens
  chr10:50976356-50976517
  hyper
tcgggctgaaggccacgcatccctgcccgtcccctcacaggcggctgcacgctccggccctcgccccagccctcagggccccggcgggaagcccctctctgagcaggcctggccgggttgtgccctcctgcggagtccccaaggggcggggagcccgcgcc

SEQ ID NO: 71465 - DNA, 71 bp, Homo sapiens
  chr10:50977033-50977104
  hyper
cgctgagcctgtgggccaggcccgcgcccaccacaggaatctctcccgggaaagcccggaaagatgccagc

SEQ ID NO: 71466 - DNA, 30 bp, Homo sapiens
  chr10:518309-518339
  hypo
gctgggcacaggcaccgtcctggcacaggt

SEQ ID NO: 71467 - DNA, 88 bp, Homo sapiens; identical to SEQ ID NO: 10312
  chr10:52177735-52177823
  hyper

SEQ ID NO: 71468 - DNA, 306 bp, Homo sapiens
  chr10:52178170-52178476
  hyper
gggtgtggcccggcagcagagggtttttggaatgcagggtgtggccctctaccacggcaaaaaagaaatgagtcagcccgttcagtcctaaccaataagcatgttcagtgtcggttaaggcggaactttcctttcttgatttataccaagcttagaagcctttcacagccttttctttacgcctttgacaacttcgacacaacttctagaaaagggtaggttgcctttgaaaacgcttgggaaacaaggattaatcttacgaaagatacttcagtggatgtacattagtttcgattagtaaaagtt

SEQ ID NO: 71469 - DNA, 112 bp, Homo sapiens
  chr10:52419113-52419225
  hypo
agcaggagctggacccgcagaggctgcagatcatcagcaactacacggaggtctacttcccccacatgcaggaggaggaggcctggctgcagcggtgcgcccagtgcatcaa

SEQ ID NO: 71470 - DNA, 163 bp, Homo sapiens
  chr10:524508-524671
  hypo
tattcccactcatcccgtgtccgggcgtgctggggctgcagacacatccaaattcccatcttattctcaactcatcccgtgtctgggcatgctaggggtgtagacacatccaagttcccgtcttattctcactcatctcgtgtccgggcgtgctgggggtgta

SEQ ID NO: 71471 - DNA, 214 bp, Homo sapiens
  chr10:52750888-52751102
  hyper
gcctctcctctccatcgcttttagacttctcatcctcccctcggtgcttttagtccattcagcagaagcggatcgaagcaggaggctccccgcgccgcattaggggcgcactccgccgcgctcgagtacttagcgcccattcactcgctcacccgcgctctccgctgccggctgccgtcccagccgccgccgccgccgccgccgccgccgccgc

SEQ ID NO: 71472 - DNA, 179 bp, Homo sapiens; identical to SEQ ID NO: 33079
  chr10:52751383-52751562
  hyper

SEQ ID NO: 71473 - DNA, 166 bp, Homo sapiens
  chr10:52751795-52751961
  hyper
tggagagcttcccagcggcgaccccccggactcaggccactggacatgctcagtggggctgtccgagcctcctagggaggggcgactggaggctggacagggttgggctcaacttagggactgaacttgcccagaacccgagctctgctggcggatgcggggacag

SEQ ID NO: 71474 - DNA, 513 bp, Homo sapiens
  chr10:52833568-52834081
  hyper
agaggcaagtttcttcgcaagcgttagccacctgtgtgaggcgctctgggtgggaaaggtggcgtgggagaagcgacagctcggccacaccgctcgggagctttccttagtgaggccggccgtcaaaatacctccagaactcagagctttgatgatgcagagtcccctatgcctcgtacgtcgctaggatcgtagctcaacattctccaggctggtctgctctggagtcagctgaggcctcccgagtttgcccggggtcctccctgtcccctccctcccacctccccacccccgaagtagcgctcccgcctcgctccacccgcacacccccggcgcgcctcggaggcttatcaggctccccgcacgccccgcaagcttccttgggcgcccggcgcgagggactctgagagcccagccgctgcctcggagcccccattcacgtcccctcctcccgctcccccgccaccgcgcctccgactcttctcccccgcgccgcggcgcccaccgcgtctc

SEQ ID NO: 71475 - DNA, 395 bp, Homo sapiens; identical to SEQ ID NO: 33083
  chr10:52834361-52834756
  hyper

SEQ ID NO: 71476 - DNA, 464 bp, Homo sapiens
  chr10:54068146-54068610
  hyper
tctcccacctccccccggacgccggagacaccgcggagcctgatgtccctcagagctttaatcttcccctcagtcgcctttcccctcacccgcctctaattaagtcagaaaggccctgtatttatttgcccatgaactgacacagcaaaccaacagcagccattgtagtgtgaatggatttgcgaccaggcaaggggcttcagccgggattacccgccccgcagccggatgaatgtgctgagcacaaagtctgctcaaagccgagcaaacggactatttgtgaaaatgccatcctggctcaagtctgattaagaccgggggtccccaggccgtttgatcttcgctcatcaaagagagtctttaaacaagcttcattttacactactgtatgctagcgacgggttgtgacacccaagtgcagccaccgtgagcacccggcactgggagcgcgtgaacaataatgg

SEQ ID NO: 71477 - DNA, 833 bp, Homo sapiens
  chr10:54072904-54073737
  hyper
caccaatttcaatgacgtcaaattcactttctaattcactttcagctcttcttctcctcaaggttgtttcttttctccctagaaagggtattgcgtggtcccgtgcaaggtaagacttgggagcaaaccctgcattcggaagcgttgcgatgtgatatactaatgaggaagtcaggcgctaagccctaagggtttcttatttctccacattagcccaccactgagaagggagaaccggggaaaggcgactgacctggcacgttggaccctgtccgctttggtcccggccactttgatctcacgcgtctgcctaatcaagttcatctaccgccgcgattgccctgattcaaagaacaacattaaatggtttgattatcggatggtcatttccctcttccctccacccctgatctaatttctaaacgccagtctctcgcctccctctctaaacttcccatcaaaagagaattagctcttcttccttcttaccctcgtttgatgtgcaaatttccttctctttgcacatttttctcgcagtggcggggggaggtgggggaggagggcaactgaaggacctcaaagccggggatctaactcagatctgcaaactgcgactctaaagggttaatgagcaacttgcacccgccacctggccctctcagaggcgtcttgctagagccattgaattacagaccggtttgtatttaatactgaatatgacttgtgtgcacagtcagcgagtattggcataaaggagaggggcaaaaagtgcttttgcagagcctatcacccctcggctctgtaaagtatttcagatccggataattcaaccc

SEQ ID NO: 71478 - DNA, 220 bp, Homo sapiens
  chr10:54074198-54074418
  hyper
tggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtacca

SEQ ID NO: 71479 - DNA, 111 bp, Homo sapiens
  chr10:54074714-54074825
  hyper
cactgatgagtactgcgctagtcccacccgcggaggggacgcaggcgtgcaaatctgtctcgcctgcaggaagcgccgaaaacgctgcatgcgtcacgctatgtgctgccc

SEQ ID NO: 71480 - DNA, 203 bp, Homo sapiens
  chr10:54700730-54700933
  hypo
cctaaccaggcaagtcgaaacccacagatttctctctcacagggtttaaaatagctcttctcttaagaatgttttgctacaggctatggcaatgttactaagtaaaatgagcattaggctcagctgccaaatgcgcaaatcagaccagctgttcctagagatgccatttatttctctaccccaacagccgcaggcatgcacgg

SEQ ID NO: 71481 - DNA, 147 bp, Homo sapiens
  chr10:54716651-54716798
  hypo
ttttctgtaataaaccgtaagcgtgaatacaacagcttttatgtcctgtgagtctttctagtgattcattgagcccaagagtggtctcggggaaccccaccaacaccagtattgtgagactgcagaaagttgcgttgcgctgtctgc

SEQ ID NO: 71482 - DNA, 185 bp, Homo sapiens; identical to SEQ ID NO: 42464
  chr10:5507960-5508145
  hypo

SEQ ID NO: 71483 - DNA, 30 bp, Homo sapiens; identical to SEQ ID NO: 42465
  chr10:5523260-5523290
  hypo

SEQ ID NO: 71484 - DNA, 355 bp, Homo sapiens
  chr10:5530764-5531119
  hypo
gcttccaggtgcagccggggttgggaatcgctggcttatgcaacccagcagagaggcgggaaaggcagagctgagatcgggtggggccacctgtggtggggaaagagatgagctcacacctggagatggtaaacagtgcaaaagcaagaagaagcttacagaaggagtcgttgggcctttgccccagctgcagccacgtgagagggaagccaggggaggagcaaggtgcaggcatctgtgggctgggcagggcctgactgcactgggcccaggctgggaaggcctcacctgcttctccagcgggaacggagggcgacctgcgcagcctaggcactgcggccgtggttcacatgca

SEQ ID NO: 71485 - DNA, 163 bp, Homo sapiens
  chr10:5538775-5538938
  hypo
cccgcctcagtgccccgggctacccctggccccccaggctttgtgctgaagccgagataaagtggacaggcgcacctcactcctccacaggtgtgccccacccccccacccgcaggtctgcccgagagcacggcaggtgggaaagagacgaatcctgactcca

SEQ ID NO: 71486 - DNA, 877 bp, Homo sapiens; identical to SEQ ID NO: 42469
  chr10:5540651-5541528
  hypo

SEQ ID NO: 71487 - DNA, 30 bp, Homo sapiens
  chr10:5546861-5546891
  hypo
gctagttggcaaaagcggtcctcccccaga

SEQ ID NO: 71488 - DNA, 44 bp, Homo sapiens
  chr10:5551853-5551897
  hypo
cacccagtcctggcacgggcaggggcctgcggaggtggccggga

SEQ ID NO: 71489 - DNA, 47 bp, Homo sapiens; identical to SEQ ID NO: 42470
  chr10:5553281-5553328
  hypo

SEQ ID NO: 71490 - DNA, 87 bp, Homo sapiens
  chr10:5567123-5567210
  hypo
ggctgcatcaccacccgcgagctgggcacggtcatgcggtccctgggccagaaccccacggaggccgagctgcgggacatgatgagt

SEQ ID NO: 71491 - DNA, 30 bp, Homo sapiens
  chr10:5567536-5567566
  hypo
cacagggcaagaacccggggcctcccgcct

SEQ ID NO: 71492 - DNA, 58 bp, Homo sapiens
  chr10:5576230-5576288
  hypo
ctgccctgctcaccacgtcccactgcgctcccagggcagggcccgccccacccagacg

SEQ ID NO: 71493 - DNA, 30 bp, Homo sapiens
  chr10:5576653-5576683
  hypo
gacgacagatgtagtcgggaaagagcttct

SEQ ID NO: 71494 - DNA, 211 bp, Homo sapiens
  chr10:5588268-5588479
  hypo
gggggacagaggggacggtccccagggaagggagccacaaggcagaccacaagctggacagaagtcaggaacgcaggctgaggaaaaccattgcagttctgttctaggagcccagaatgccagagccaaggacaccctcctgaaagacagtgcagccaacagaggcatggccccacctgggcaggagggtgccggccggctgaaggtacca

SEQ ID NO: 71495 - DNA, 30 bp, Homo sapiens
  chr10:5617971-5618001
  hypo
ccacctgccccagaccgaggcctgttctgc

SEQ ID NO: 71496 - DNA, 30 bp, Homo sapiens
  chr10:56782981-56783011
  hypo
atgagccaccgcgcccggtttattgcttac

SEQ ID NO: 71497 - DNA, 1116 bp, Homo sapiens
  chr10:57387425-57388541
  hyper
ctccttcagcagcagcggacgtagggatcccgagcagccacggagcttaggtcccgcagagagctcctgccaagcgcttctctctcgactagttaccaattgagaaaaaaaagggtcagagacacacaaggatggtgatcaaaatccagtgtcaggcaccagggtcccagaaggttccggctcctcttctgcgccttacccagctcttttcgtctggcaaagggtcacccagcgagcccccagcagcagatccttcccttttgctcctcctgatagcgccaatcttcgccgccactgccacactgcgcgcccgctatccactcaccgcacagcgagaaggcctggcggagatagcgcggggggaggagggtggattaaaaggatagatttttggaagggtaagggagaaaaactttgatgttgtaaccacacacaggactgagaagaaaccaaaacaagttgcagcttcaggagcggggaggacgcttttcggggtaaaaaaaaaatcaccccctaccaaaatcagggggaggaagctccctgctccttgagcgatcacccagagcacctcgcaatctctgatcttcgaacccactgaaaaagcacagggcatggggagtcctgttggttcatgcccagggtacgaataccaaaagcgcctcccgctggagaggctgcggggaactcgaggcaaagacagaggcaaacgcaacgctgggaagagtgaggggagtccgagctgccgcctgcaaaagcagagacgcgtcgcccttcgggcaaagtgactgctacaaagtccgttccctcctgcgcagggacagagacatttaaaggcctgaatggacgtcagcaccagtcgagctcgctgggtgagcgccaggtctccccgccccacggattgtagcgcgcacagggcgatctgctgctcgcgaggtagagtggcttacttggggagaaaacagagctggtggcgctgcggagtgtcaaaccctggagcccatcgtcaagacgttatactggtggcagttctgctgtgagtgcacttgccgaattaaaaagagccagagctgcgtggagaggggtctggccactctgcgcgcgcgcacccagtattgg

SEQ ID NO: 71498 - DNA, 119 bp, Homo sapiens
  chr10:57389660-57389779
  hyper
cacttggtgtgtgtgcgctggcgcgtttatgttgggaaggttgatcactaagagagcttacaaatatctgtaggctctcctgtgtaacctccttctcttcctagccagggccattcacc

SEQ ID NO: 71499 - DNA, 189 bp, Homo sapiens
  chr10:57389780-57389969
  hyper
gtaggctctcaggcgccacttctagagcatcctctgatgttggtcctgaactgggagagtctgaccaaacttgacgaagaggactgtcaaaaggcgttagaaacttcggaaactggcaacagttacggcatttttgctctgcgaagaatacgcccagaaggttcagaaagaagtcgggagtggggatgg

SEQ ID NO: 71500 - DNA, 501 bp, Homo sapiens
  chr10:57390175-57390676
  hyper
ggctttcctggattccgcgaccacaacccaccaccccaaaccccacttcccatgtccttgatttttgaggctttttgggagggcatgatttcagggaacattactcttggccagctcaggggagcatagtcggaaatcttcggttgtattcctgactcagcctgggtgcggagcgagcgcggacaggaaccgagatgcaaaggcggacgcaaccagcgcacccgcagacggcgcgcggcaagaaccaccttctagccctgagcctgcggtgccgggcgggctcaggaggctagtggggtattgtgatcactgggacatcaggatgaaggggtcactccaatcccttggagatcagattctcggggactccatggccagacccgaacggcgcccttcacatggtgggtggagagggtactccttggccgaattgacccctccctgtcccgcagggtcagccccgcgcccacccacacatccagtctccgggaacaaaactct

SEQ ID NO: 71501 - DNA, 227 bp, Homo sapiens
  chr10:57391133-57391360
  hyper
ctagggctcccccagcgcttccgggcgcgccgggaactgcagctggtgcgccactgccttccccgcgcggtgcccaagagcgccagtagaaggaggaggtcggcacacctgctgttcctgcttccttcccaggaggccgattctctccatcccaactcgctccgtggctcctgcttgctcctgttccccctcccgactccccgggtaacagtcgaccttagggtcac

SEQ ID NO: 71502 - DNA, 30 bp, Homo sapiens
  chr10:57478909-57478939
  hypo
cctgacctcgtgatccgcctgaaatgtggc

SEQ ID NO: 71503 - DNA, 30 bp, Homo sapiens
  chr10:5757140-5757170
  hypo
actgagaaagattatcgggcttcatggcta

SEQ ID NO: 71504 - DNA, 17 bp, Homo sapiens
  chr10:57918195-57918212
  hypo
atttgaatgtaaggccg

SEQ ID NO: 71505 - DNA, 30 bp, Homo sapiens
  chr10:58168698-58168728
  hypo
tcaaacccatgtcaccggggcctagtgtcc

SEQ ID NO: 71506 - DNA, 160 bp, Homo sapiens; identical to SEQ ID NO: 42473
  chr10:5868078-5868238
  hypo

SEQ ID NO: 71507 - DNA, 570 bp, Homo sapiens; identical to SEQ ID NO: 42474
  chr10:5874775-5875345
  hypo

SEQ ID NO: 71508 - DNA, 48 bp, Homo sapiens; identical to SEQ ID NO: 42475
  chr10:5952951-5952999
  hypo

SEQ ID NO: 71509 - DNA, 294 bp, Homo sapiens
  chr10:5998554-5998848
  hypo
tccatgcaattcccccgattctatgtctaggcaaaaacacattctctttcctgctgagggtgccagctcccagtcgtcccacacctctgctcctcatccttgtccttctcaggcagagtgcctggggtgacggggcagggacggagcaagtcaggagggagcagtaagagcctcaagggcaaagccaagagtgcgatgaggagagagcattcctgctgctaaagccagggttgaaaaagcagacagggacacacccctcctctgctgtccccagtacaacgcccactttgcttc

SEQ ID NO: 71510 - DNA, 45 bp, Homo sapiens; identical to SEQ ID NO: 42476
  chr10:6003482-6003527
  hypo

SEQ ID NO: 71511 - DNA, 26 bp, Homo sapiens
  chr10:6009733-6009759
  hypo
agaataggctgggtgcggtagctcac

SEQ ID NO: 71512 - DNA, 30 bp, Homo sapiens
  chr10:6018636-6018666
  hyper
ttccgtcctccctgccgagatcagagctcc

SEQ ID NO: 71513 - DNA, 44 bp, Homo sapiens
  chr10:6024581-6024625
  hypo
ctgcagtggcaacaacgttgctttctgggcgttcaatagacaca

SEQ ID NO: 71514 - DNA, 109 bp, Homo sapiens; identical to SEQ ID NO: 33091
  chr10:60272038-60272147
  hyper

SEQ ID NO: 71515 - DNA, 279 bp, Homo sapiens
  chr10:60272555-60272834
  hyper
gcgcggctgtaggggcggcgggcggggagggggcgccgagccctgcggatggaggcgcgggcagcgcggcgcgctcattccgcgcgggcgttgctggcggggggcggcgcagccactggacccggaccggggccgcgacccggggtggcgggtggcgtgggcggcgcccggggctgggatgcgccgggggctcagtggcggcggcggcgttggcggtggcgtcggcggctgcagggggacgagctagcgccgcggcgctgggagccagttgagcccggc

SEQ ID NO: 71516 - DNA, 384 bp, Homo sapiens; identical to SEQ ID NO: 33093
  chr10:60272895-60273279
  hyper

SEQ ID NO: 71517 - DNA, 30 bp, Homo sapiens
  chr10:60273557-60273587
  hyper
ctcactattgggaaacgctctgcagatgtc

SEQ ID NO: 71518 - DNA, 30 bp, Homo sapiens
  chr10:6041312-6041342
  hypo
ggctcttgactgaaccgtatccactctgtg

SEQ ID NO: 71519 - DNA, 205 bp, Homo sapiens; identical to SEQ ID NO: 15336
  chr10:6042309-6042514
  hypo

SEQ ID NO: 71520 - DNA, 28 bp, Homo sapiens
  chr10:6055232-6055260
  hypo
tgcagttgtgctgtccgataacacagac

SEQ ID NO: 71521 - DNA, 88 bp, Homo sapiens
  chr10:6055320-6055408
  hypo
tgtatttaatttatttgagtttaaatacacttaagtatccacaggtggctagtggctactgtattggacaatacggtcttagcctttt

SEQ ID NO: 71522 - DNA, 170 bp, Homo sapiens
  chr10:60935826-60935996
  hyper
acgcctcaggtaatccgctcatttctcacacagacgcagctgtttccgaggaatgtccggccgagcccgcagggtgcgggcagcgagtatcctgggaccttcaggggaggaggtggctcccacaccccaataccgtacagagagtccgaagagtccgggcccttattttt

SEQ ID NO: 71523 - DNA, 421 bp, Homo sapiens
  chr10:60936309-60936730
  hyper
aagccctatacatcacgttccccgagagcagcgtcccctccccgccgggagcgcgcgcctcccatcctcgcgccgggtcctgctcggtctctcagagccgcacactccgcggagctcctgccacagccgtcgccttcgcggcggctctccagccccgcgcctcagcctcggcgccgcatcaccgcgtcccaggcctccttccctccctctgccactccccctccctttcccgctcttcttgcccacccggccggcagagagagcctggatacgaagcaggcgggcttcagagtgggttggaaaaatggaggtgccgcgcctggatcatgccctcaacagccccaccagcccctgtgaggaggtgatcaaaaacctcagcctggaggccattcagctgtgcgaccgggacggtaagagcggc

SEQ ID NO: 71524 - DNA, 62 bp, Homo sapiens; identical to SEQ ID NO: 33095
  chr10:60937041-60937103
  hyper

SEQ ID NO: 71525 - DNA, 30 bp, Homo sapiens
  chr10:6109019-6109049
  hypo
cttggggcttgttaacggtcacttccacaa

SEQ ID NO: 71526 - DNA, 146 bp, Homo sapiens
  chr10:61122490-61122636
  hyper
tggagagttaccacacgaccccgacctcgccagcccaggcgccgcgtttaatcttgggctctttgtgccagccaccccccgaggctggcaatgagaatgccccagtgtttctgccgaagtgctgaaatacccgggagacttgcttt

SEQ ID NO: 71527 - DNA, 24 bp, Homo sapiens
  chr10:6127024-6127048
  hypo
gagccaccgcgcccagccttcttt

SEQ ID NO: 71528 - DNA, 35 bp, Homo sapiens
  chr10:61468736-61468771
  hyper
taggtcaggagtacccgcggcgccccattcccaac

SEQ ID NO: 71529 - DNA, 102 bp, Homo sapiens
  chr10:61469892-61469994
  hyper
aagcccgccaagggccgtgcgcgtttggggggagccggggtgtacaaatgaatgcgagtgttccttggtctccctggctcccggggccgctggcgccctcct

SEQ ID NO: 71530 - DNA, 205 bp, Homo sapiens
  chr10:6159761-6159966
  hypo
ggtgtgagccaccgagcccagcctgaaacgcctttttctgtgtggggaacttccttgtttccctcctccccgcaagagactagaaacttgctttcccagcctgtcttgcaggttgagtagggttgtgcgcttgggatctctgatcagaccggcaccgcagtgtgggagagaagctgtgtgaagagtctgtcgtctgactttggca

SEQ ID NO: 71531 - DNA, 87 bp, Homo sapiens; identical to SEQ ID NO: 42482
  chr10:6162138-6162225
  hypo

SEQ ID NO: 71532 - DNA, 30 bp, Homo sapiens
  chr10:61658400-61658430
  hypo
gtcaagtgcaatcctcgctatgctaccggg

SEQ ID NO: 71533 - DNA, 24 bp, Homo sapiens
  chr10:6199196-6199220
  hypo
tttttttttttgagacggagtctc

SEQ ID NO: 71534 - DNA, 18 bp, Homo sapiens
  chr10:6222017-6222035
  hypo
tgtgtgggccaggctcgg

SEQ ID NO: 71535 - DNA, 152 bp, Homo sapiens
  chr10:6242759-6242911
  hyper
gacaggaaaagtgcccggtctgcgaaagttcagctggacctccgggacatcaactccctgtgccctaagagctgaccgctgtcagatgcgttatctaggtcaagagatgaatgatgtgccgctgctggggcagacgccgtctctctgctctc

SEQ ID NO: 71536 - DNA, 54 bp, Homo sapiens
  chr10:62493236-62493290
  hyper
tcctcctgctgtgtccgctgcgaccgccaggtgcccgcgcgggccggtgcgccg

SEQ ID NO: 71537 - DNA, 30 bp, Homo sapiens
  chr10:6261147-6261177
  hypo
agcctcctcccggcacggggagcattgcgg

SEQ ID NO: 71538 - DNA, 30 bp, Homo sapiens; identical to SEQ ID NO: 33098
  chr10:62702560-62702590
  hyper

SEQ ID NO: 71539 - DNA, 100 bp, Homo sapiens
  chr10:62704183-62704283
  hyper
ggttcctcggctctacgcagacccgacgggcccgggcacggaggcggatcgcccgggacaaaccgacacagagcatgggagaccccggccctttccccgc

SEQ ID NO: 71540 - DNA, 51 bp, Homo sapiens
  chr10:62761321-62761372
  hyper
cccgttccgccacctcgctcccggcccggcagccgccgccctgcggggcgg

SEQ ID NO: 71541 - DNA, 1185 bp, Homo sapiens
  chr10:63212027-63213212
  hyper
gcaagataggcaggccgttagccaagccccaaagccagcaaacccagacacctgaagctggcgctgtgctagagaacgcgcgacgcgcgcggctggagggaagggaagcggatgaaaccacagacgtgcagcgagggtcttctcgtcttaggagggtggccagtgtgctcagctcttgcgaaggtcgctgatgcccagcgaaggacattcccacatgtgcacgcacgcagagtaacccgcgcacactcacacaccccagtttcagaaggcacactacatggcaacctccttgtcccaagactcccctatttgcgggcacattcagcaaaatagaccagcgcttcctctctttactcatcttccaagtttccaaacctgagactgggtgactcttgcctaggctcacagatcgagccttcccagtgttgcactgggaccctagggtggccctggggtgcccaagagatgcgcaagcatctcgcgccttccaagcgatcagcgaggaaaaacggggtccaaattcgagtagaatctgcgggttgcgggaagatggcctgcgagtgcggtgggggacaataccctagggccccgtgcgccctcgctttcccggggcactctcaccatttgtagcctctgccgcgcttgaacttgagggtgagcgcagtctccaggaagagcaagaggttgagcagcgcaagcagccagtaccgcggctccttcttcacctcggtcactcgccagaccccgaccagcgagtgcagcaggaacagcaaccgagtggccagggcgttaaggaagaccagtccctccatgctggccggagcactctgcctacgtccccttgcctgcgcccccaggaccctgccgggcgtgcccggagcccaccggtgagcaggaatatgacaagcactgagacctgctgctgcttgtggtcccttctcaccctcagcgcccgatgccggtagaactggtgcgcggctcgcccctcccccaaacttcctgagaactcttcaaagaggggtgagtccaaacccagcttttccagactgctgggttttccagggagtctggggctgcgctgccctgtctccagggcgttattctccagcgctgcccatccccctcccaatctcggggccagtctccatccctgtccggtatccccgcccccgggcctctgtgagg

SEQ ID NO: 71542 - DNA, 39 bp, Homo sapiens
  chr10:63656895-63656934
  hyper
tggaaagcaatgacccgtataacccggttgatcctcctt

SEQ ID NO: 71543 - DNA, 18 bp, Homo sapiens
  chr10:63795861-63795879
  hypo
gcgcgagccactgcacct

SEQ ID NO: 71544 - DNA, 538 bp, Homo sapiens
  chr10:64133867-64134405
  hyper
agtgtaatcctgagtcggatcgggctcccggctgggtggcgggggggcagatgatgctcccgccagctgggcagagcaagggtgttccccgcggaggtggcagccctgggccgcggcgttccggaacccccgcacccacggcgcggtgccccacggtgcccgcgagcgccgcccccgctggctagccgcgcctcgctccgccctggacgccgccggtcccggcgcggaggtgcggcggggagtgggagccggcccggctcagtctgatttacggctctgctgaaaaccgcttcgctcccgcagcatcagcaccggaggcggcggctgcagcagcagcagcaacaagtcgggtaagaggcggccgccggccatctgcgcccgcggctcggcggaggggacctgccggggtggccggggctggggagggggtccccgagcccgcagcatggcggggagttgggagagccggcttcccggcccccaccagcaggaactcatgtgcacacgaatccactctggcacccgtgggctggcacgc

SEQ ID NO: 71545 - DNA, 515 bp, Homo sapiens
  chr10:64574553-64575068
  hyper
aaagcctcatccgcccggagcttttctccctcttttttgcctgggggttccacggctgaggcaccaagacaaacaccacccaagaatcgacctatcccagtcagtgccgtgatggtgccaaaccgagaggagagcccgagaagggggtgggtgatttcccggctgctccccatccccggcgccttgtgcctttttctccctccctctcccgctgcgcttcagccgagggctgctggagcgaatgggggatgtagaggaaggagtccgtaggtttccgtgccctcccaatcttctccgcctttcccgacagccgcgcgtccccgcctcagcccaaggccagtggcccggcctcgaggaaggcgcgggggccgcgagagacgactttccacagcatcgccaaggaaaccggcgtcgccggtgcccccgcgggcctccctcggcagtccgggggctgcttcccgccgttgcgcgccctcctccaccacccactcgctgcctccgccggccggagcccc

SEQ ID NO: 71546 - DNA, 735 bp, Homo sapiens
  chr10:64575127-64575862
  hyper
cgcaagaagggagcgctccgagattttcccggggtcggctctgcccaggagggagctaccgacgctttcccctggcgcttctccgccgctcggctctccaggcgcgcagctctccccgagagccccgaactttaccgtcactttgcccctgccccgggagaggggaggtcgaagtgctgccggccagagggcctacgcaagcctcgaaacccggggggacgcctcttccacccccatccctgcgctcgcccggggctgggcgcgccggggcgcacgcacgccggtttgctggcgacctggcgcatctgcccgcgcgccctggtctcagctgtcgcaggttcctcctgcacccacttccagtcttcaaagccagtgcagtcagcaccgtccacctggagccccaatcctctcctgcgattcccgcacacccactgcaccccatccaccacctccgggccgcgcaggtccgggcctgcgaagacacgcggcttacctccggccactccgttcatctggtcaaaggggcctcccagttcggcattgggaaagatggtcaccgacgtggcggcgaggtcctccaccgggtagatgttgtcagacagctggtgcacaaaaccactgagagttactgggattttgtctacggccttggcggtcatcatttgctcctcgcacaacctggagacccaactccctcgctacctggagtgtcagaaaagccgttttggagagggg

SEQ ID NO: 71547 - DNA, 342 bp, Homo sapiens; identical to SEQ ID NO: 3567
  chr10:64578287-64578629
  hyper

SEQ ID NO: 71548 - DNA, 37 bp, Homo sapiens
  chr10:64578651-64578688
  hyper
cgagggggagctcctggacgcccgagtgcccggccag

SEQ ID NO: 71549 - DNA, 133 bp, Homo sapiens; identical to SEQ ID NO: 42484
  chr10:6462190-6462323
  hypo

SEQ ID NO: 71550 - DNA, 165 bp, Homo sapiens
  chr10:64812014-64812179
  hypo
gaatttaacaaaaaacgctgatgtgcatgtattaggaggaggtatgtgggggtggcaggaagtgtcaaagagtgctgctttctcatcttgtataattcaaagtaaatagacaatttctaaagctgaagataacaaaataggctggctgggcacggtggctcacgt

SEQ ID NO: 71551 - DNA, 186 bp, Homo sapiens; identical to SEQ ID NO: 42485
  chr10:6505370-6505556
  hypo

SEQ ID NO: 71552 - DNA, 130 bp, Homo sapiens
  chr10:6520821-6520951
  hypo
ggatggcaggtacaccgaaatgtaagataaatatggaggcaatgactcgtgtctcctaatgagggcgccattgaaggtatcatgctgagacaggttagaggggaggtagggttgtcggagcagaagccat

SEQ ID NO: 71553 - DNA, 178 bp, Homo sapiens
  chr10:6527860-6528038
  hypo
agccaagggcaaggccggtgctcagaaatacatcccggcatttcccatagggctgccacaggtgaagcagcagaagtgcatggacatccttgctgagcggccatggcgggaacgtgtccacggcacatgctcctacctgttgagtgctctcaatcatggccagcgcttcagccattag

SEQ ID NO: 71554 - DNA, 140 bp, Homo sapiens; identical to SEQ ID NO: 42487
  chr10:6531036-6531176
  hypo

SEQ ID NO: 71555 - DNA, 30 bp, Homo sapiens
  chr10:6531585-6531615
  hypo
ggtgagcggagcaggcggggtgagcacagt

SEQ ID NO: 71556 - DNA, 163 bp, Homo sapiens
  chr10:6562091-6562254
  hypo
tgagcaataaagtcacgcattcgactctctcctggaaatctccaaggggaccccaaactcaccaggtcccatacagaactccctgccttccctttcaaacttgccttttccttcattttgccagctcggtgctgggtgccgcgacgcccggccctcacccgct

SEQ ID NO: 71557 - DNA, 118 bp, Homo sapiens; identical to SEQ ID NO: 42489
  chr10:6577643-6577761
  hypo

SEQ ID NO: 71558 - DNA, 30 bp, Homo sapiens
  chr10:6586370-6586400
  hypo
agaatatattgttaacggcaaggagagaca

SEQ ID NO: 71559 - DNA, 21 bp, Homo sapiens
  chr10:6586866-6586887
  hypo
ccactgcgcccagacccacat

SEQ ID NO: 71560 - DNA, 23 bp, Homo sapiens
  chr10:6591880-6591903
  hypo
accgcgcccggctgaaattcacc

SEQ ID NO: 71561 - DNA, 186 bp, Homo sapiens
  chr10:6622520-6622706
  hyper
acagccccgggagggcggcgaggcggagcaggagcgccccggctccggccacattctcagagtcaggaaaaggggcgagaggccacatgtctccctctcgcccaactgaaaacgaaacggcgctccagcagattgggtggaaagagctgggtctcttttctctgtttttcacgctagaaagggctt

SEQ ID NO: 71562 - DNA, 30 bp, Homo sapiens
  chr10:66600483-66600513
  hypo
aatgtcaggacttcacgatgatgatccatc

SEQ ID NO: 71563 - DNA, 30 bp, Homo sapiens
  chr10:6661702-6661732
  hypo
ttagtggtagtaaagcggtatgggtggcct

SEQ ID NO: 71564 - DNA, 198 bp, Homo sapiens
  chr10:6666769-6666967
  hypo
agataagcctctcatcgggcagggattttagtattataatgaggcaagggtccggattggtcattctcatggtcttgtgcacatgcaggtgacagggttaactcccttgagtaagatttatagtggaatgctcctgatgttagcttcttcacgcagtttgcaagatctgatcagtgggggtggcgccagctggcgggt

SEQ ID NO: 71565 - DNA, 26 bp, Homo sapiens
  chr10:6680303-6680329
  hypo
attttcttaagaagtcggtcacgcct

SEQ ID NO: 71566 - DNA, 30 bp, Homo sapiens
  chr10:673796-673826
  hypo
gcctcgaacagaccacgccctcattacggg

SEQ ID NO: 71567 - DNA, 21 bp, Homo sapiens
  chr10:6781373-6781394
  hypo
ttgcatagccgggctcggtgg

SEQ ID NO: 71568 - DNA, 39 bp, Homo sapiens
  chr10:679363-679402
  hypo
gctgcagagcggacgcggggagtccgaggtggtgccgta

SEQ ID NO: 71569 - DNA, 25 bp, Homo sapiens
  chr10:6810214-6810239
  hypo
attaagcttgtaggccgggcgtggt

SEQ ID NO: 71570 - DNA, 42 bp, Homo sapiens
  chr10:69283867-69283909
  hypo
agtgttcaaaatagccgggcgcggtggctcacgcctgtaatc

SEQ ID NO: 71571 - DNA, 86 bp, Homo sapiens
  chr10:69310933-69311019
  hypo
ggagagaaacacatcttggtggaggaatacacaagcagctgaacattgagagggcgtcgagaggaggagatcggtggaagaagaca

SEQ ID NO: 71572 - DNA, 37 bp, Homo sapiens
  chr10:69521314-69521351
  hypo
tagcttaattgaaaccgccacataaaagaacagaaac

SEQ ID NO: 71573 - DNA, 42 bp, Homo sapiens
  chr10:69571254-69571296
  hypo
tcacgtcgcacccagcgagaaacccaccgtcttcactgagtc

SEQ ID NO: 71574 - DNA, 65 bp, Homo sapiens
  chr10:69578014-69578079
  hypo
aaagatccacataaacgttcagaaagttgtattaatgaaaactgagtaaacggatgcttaaatag

SEQ ID NO: 71575 - DNA, 106 bp, Homo sapiens
  chr10:6962043-6962149
  hyper
cccctgacttccatacgctccccttctgtgccccgtattctccctatgtgtctcgactcggagacatcgcacctgcgcagatgctgacagacgcccatagatggca

SEQ ID NO: 71576 - DNA, 30 bp, Homo sapiens
  chr10:6984700-6984730
  hypo
taggaagattagaaccggtgatcagcccca

SEQ ID NO: 71577 - DNA, 30 bp, Homo sapiens
  chr10:69896480-69896510
  hypo
tcattttggtaaggacgagaaatgttctct

SEQ ID NO: 71578 - DNA, 40 bp, Homo sapiens
  chr10:7028274-7028314
  hypo
gattacaggcgtgagccaccgtgcccggccagccaattca

SEQ ID NO: 71579 - DNA, 120 bp, Homo sapiens
  chr10:70288069-70288189
  hypo
cgcctcaaaaaaataaaaaataaaaaggcccacaaccttagaaagctctctcctgtctcgtcccttgacctatattgaccactgaccagtaatcgcctatcgcgcttttttttttttttt

SEQ ID NO: 71580 - DNA, 907 bp, Homo sapiens
  chr10:70320021-70320928
  hyper
tgggtaaatccagctcgcgttttgtctctcgctcaactgtgcagggtccagcgaaggcagagccccagcttcactccctgaggtctgtcctggggagacactgctgctccggggggctgacctggcggggagtggccgcgcagtctgctccggcgccgctttgtgcgcgcagccgctggcccctctactcccgggtctgccccccgggacacccctctgcctcgcccaagtcatgcagccctacctgcctctccactgtggacctttgggaaccgactcctcacctcgggggctcgggccttgactgtgctgggagccggtaggcgtcctccgcgacccgcccgcgcccctcgcgcccgccggggccccgggctccaaagttgtggggaccggcgcgagttggaaagtttgcccgagggctggtgcaggcttggagctgggggccgtgcgctgccctgggaatgtgacccggccagcggtgagttggggccggggcagagggcaggggtgcggggagcgaggactccgacgccgaggcccgaggggggtccgggaggcggcgctcggcgcgggctggatgtggccggggctctgcgtccttggctctcccgctgcctcaggggtgggctcgttccccgcctcgaccccccaccccgggacgctcgggacgcttttgttgccggagataaacaatgcccccggccggaggtatcggccacccgctccggaggccccgccacagcgccgggttgggggcagcgggggcgcctggggctctgaccccgggctgcggtggaagcggggctgggggagggcaagtgtggcgtgggggagatggctgaatataccagcggttggttccctggcccctttggggagttggaggtcggggcgcctcggggtgagg

SEQ ID NO: 71581 - DNA, 35 bp, Homo sapiens
  chr10:70377573-70377608
  hypo
attacaggcgtgagccaccgcgcctggccaatgga

SEQ ID NO: 71582 - DNA, 105 bp, Homo sapiens
  chr10:70476531-70476636
  hypo
tgagccactgtgcctggccaagactagaacttgataatcacgaggatgttctatagttttccattgaaactatattgtctctaaaatcaccgttatttttattaa

SEQ ID NO: 71583 - DNA, 20 bp, Homo sapiens
  chr10:70482667-70482687
  hypo
tactccgtctcaaaaaaaca

SEQ ID NO: 71584 - DNA, 18 bp, Homo sapiens
  chr10:70483311-70483329
  hypo
taaaagtaaatgggccgg

SEQ ID NO: 71585 - DNA, 75 bp, Homo sapiens
  chr10:7105495-7105570
  hypo
ccctcgatctctgccttctttctacaagaatctctcatgtcagtctctgccaacccccatcggtatgacaaaggc

SEQ ID NO: 71586 - DNA, 42 bp, Homo sapiens; identical to SEQ ID NO: 33108
  chr10:71267763-71267805
  hyper

SEQ ID NO: 71587 - DNA, 41 bp, Homo sapiens; identical to SEQ ID NO: 33109
  chr10:71327725-71327766
  hyper

SEQ ID NO: 71588 - DNA, 229 bp, Homo sapiens; identical to SEQ ID NO: 33110
  chr10:71328773-71329002
  hyper

SEQ ID NO: 71589 - DNA, 457 bp, Homo sapiens
  chr10:71329076-71329533
  hyper
cgggctccgggcagagaccgctagcagcgcggtttaaaaagccccaggactcaaaacgccgcaagaagtggaaggcggggacggtggtgcagagctagttggacaggccacccctagaaatgtttccgagcccttcttgctcaggggttctttggaaagaggcatggacgaggtttcccactccagcgtgattccacacacttagacggagctcatccagcacggaaccctaaactttgcctccgtgattcaaagaaaccctaaaccctcctccgccttctcctgacttggagagtggggctgactgctccgggggtctaatccgccccaacccaaggtggcggcctagcagccgagttggttaacccgtacgtgtgtgttttaatttgtggggcggaggaccagtctgtgtgtgttgggtgactaatggctccttaatgagcgccctcaaaagcag

SEQ ID NO: 71590 - DNA, 471 bp, Homo sapiens
  chr10:71331434-71331905
  hyper
taaaaaaaaaagatgcgcggtgctccaggcacctgcagcgcagctcacgtttcaggcgcagttcgcagggaggctggggagatgctccctggccgggctagcgctttcccagttcacagcctggtcttccgccccgggagggcaatggctccgaaaagtgcacgaggagaaggcagagggtcgccttcgtggctttaaggcagagtgaggcgccctgaaatcccggacctgattgggagtagagcagatcggcagcgtctttggagcaaggcaaggggagtaagcgctgagagaccaaacattggattgaatcacattggaggaggggtggtaagagactgagaggcagacagacttgagtgagggtagggcgacccaagacggtgggcggctccggccgggtagtgctaccattctagtattctttgaatgagattatggggtggtggcagagaggaggcctaaaatgag

SEQ ID NO: 71591 - DNA, 597 bp, Homo sapiens
  chr10:71331949-71332546
  hyper
cgtgcgttggcgcggctcggagggccggggaatgaacccagcctgccgcccccgtggaggcctgggccggccaggggtcagccagggagaagcagaaggaacaagtgcttttgagggccgccgccgtcggccaccctctacggctcccggctccctccctctcccttacccttagcacccacagcccagcgacagacaggtcctttcacagaaaatctgagaaagccagactgcctgggctcaagcaggcggaaaaggtggcccccagcagcccgggtcgctcctccagcgacgcggcgggactcaggctgccagcctgggagactggggagtagagggacccccagtccccgggggaaccgcctgggctgcccagctccccgcagtgcggcgccggcggctccagcgcgtacaagctgtggtccgctatgcgcagcgtttgagtcagcgcccagatgtagttgtgggcgaagcgcagcgtctcgatcttggtgagcttcgcgtcgtctgggaaggtgggcaggacaccgcgcagggcgtccagtgccgagttgaggttgtgcattcgattgcgctcgcggtcgttggccttctttc

SEQ ID NO: 71592 - DNA, 354 bp, Homo sapiens
  chr10:71332778-71333132
  hyper
acccgagggttgaggcgtcatcctacggcggggtcagagggaagggtaagtttgagtccgtcactgggcgcagtccgcgattccgaggctaggtgggaaaaaacaaaaacagccatcctcccagcccccgctgggtcagaggatccctctttcccctgcccgtccctcggaggcctccaaatattacctttctaccggcgcaaaagaatagagagcgatgagcagcgagggccgtggggagctcagcgggcttctggtcgccaagttcagctgagctgcaggcgcccccgcctgggagttgccccagccccaaaggagaaaagaagagagaatggggtccgaggcctctgtcac

SEQ ID NO: 71593 - DNA, 96 bp, Homo sapiens
  chr10:71334295-71334391
  hyper
ctcgaactcctgggctcaagcgttcctttcacttcagtctcccaaggcgctgggaagcagagctgctgtgcccctccccctcgtgtcttttgaact

SEQ ID NO: 71594 - DNA, 129 bp, Homo sapiens
  chr10:71334827-71334956
  hyper
atatcctgagtctcccggaaactgcaggaggggacaggacccgacttcgagactgtagggtggggtgaggggatgaggtaggtctgtgagtctgccctagtgatagcctcttaccgcctaggctgcttg

SEQ ID NO: 71595 - DNA, 371 bp, Homo sapiens
  chr10:71336120-71336491
  hyper
atcactcctgctttgcgcaaaaagcagccagggcgaggagcgcgcggtggctgggggcagccgccttcttgagggatgcaaggatttcccgcagtcctcttccagccaggaggccagggccggaggtcaaggagtcttaggcgattagagattgaggatccatgccctctgtctcagctgcaggggacacatagacccctctccaaagttaattcctgtgcctttggctgcggaggcgcaggcggtaatgactccgtgcgcaccggcagtgtttgtgaaatggctcttcccgcagacagcagagtctgttcctgcagctcctggtcatccaccgcccctaagacctccaggactcccgcacccctacacct

SEQ ID NO: 71596 - DNA, 30 bp, Homo sapiens; identical to SEQ ID NO: 33118
  chr10:71337383-71337413
  hyper

SEQ ID NO: 71597 - DNA, 30 bp, Homo sapiens
  chr10:71337640-71337670
  hyper
ggcgctcaggagagccggaggtctttattt

SEQ ID NO: 71598 - DNA, 225 bp, Homo sapiens
  chr10:71338101-71338326
  hyper
tccacccccacctaccgccccaatcttagcagcttcgctgtaggactttattgtcaaatttaacacatgcacatttgttcccagcgcttggccccaaatacacacacacgtacaaacacgcaggcatccacagaaaacgcgactgatgacacagatgcggagcgcgagatgcccatatgtccggctctgcgcccatcccggctggggaaacgaataggctgtgtg

SEQ ID NO: 71599 - DNA, 100 bp, Homo sapiens
  chr10:71338575-71338675
  hyper
gggctcttgaactctcggatggtgaagactctcccgtcctcctgggattcccaggagttggcgtccacctgaggcgcactaggggcgggcgggtacaccg

SEQ ID NO: 71600 - DNA, 49 bp, Homo sapiens
  chr10:71390060-71390109
  hyper
cgcctgcaggtgagtcgccgcgccggggagggagcgcatccctcgctgc

SEQ ID NO: 71601 - DNA, 192 bp, Homo sapiens
  chr10:7139938-7140130
  hypo
tgctgccagtgcctccgggagcccagctcctccagcggggttctctccagatccttgcagaccccaaacagagagatgatggggcctgcagaccttgcctggctgtcagaaattttccacccgctgaagaggtggctggcagtggtctacgctctgcgtgtggccttcctaaattaacgaacatattcacac

SEQ ID NO: 71602 - DNA, 44 bp, Homo sapiens
  chr10:71561793-71561837
  hyper
tgaaactgactggcccgggagacacgaggcgcccagaaggactg

SEQ ID NO: 71603 - DNA, 687 bp, Homo sapiens
  chr10:71562106-71562793
  hyper
agagccttttggcagcggctgtcgcctttatttattctatttatttatttattggttctcaagacgcgagaggatggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacggctattttgggacgagtcaatcaactgctggacgaggtctgtgctctttgttgctggcttttatccctccccgcggcgccccctcgcgcagcctccagactgttcagccggtgtccgcgggcgctcgctctctgcgagccccaggttcgcgcgagttgcctgcgggaggggtcggggacacggacagacgctgccctaccagggattcggaggacctggtgggcaagagcatgacccagcgactcccgcctcgggcaagcgcccccggcttccagcgctgggagcgccctgggcacgccgggcaggtggaggaaggctgggcgcgcggaggctcgcggaggcgggcaagctccact

SEQ ID NO: 71604 - DNA, 30 bp, Homo sapiens
  chr10:7156226-7156256
  hypo
tcccaccagattctccgggagctctggttt

SEQ ID NO: 71605 - DNA, 30 bp, Homo sapiens
  chr10:7164293-7164323
  hypo
cagctctgctctgtgcgttctcgattccag

SEQ ID NO: 71606 - DNA, 799 bp, Homo sapiens
  chr10:71813100-71813899
  hyper
ggtctcctgggaatgcggagtttcgggcgcaggagcgggaggacggaggcgcccggccgccgatgggcacggggcgatgggtggggggctgcgcagggcccgagggagcccggggagggccgctcgggggcctctgaaggtgcccgggcagggcgccggcggctccaggctgacaatggagggggcgcggagcagccgggcggaggttagggacccgagtccgggggcgggccgcgccggggaaggtcaggtcggggacgccgggtggcggggcgagggctgggggttgctgcgcggacacccgggcgccgcgggcgggcgtgcgccccggggccggcgcggaagagggcgcgaggccgggcactccccttcggttccctttccggggcgcccggtgccgacgcgcgctgcgctttcaccgggaaatggcggcccggccgtggctcgcctgggcagtctggctcccgctttgcgcgggaaaaaataataataataaaaatatcgaaaaagggaataaaagtaaactggctgcggcgcaggaaagggctctgccgggcgccggacgccgtgcgtatcgctcgcggggcgcggcggttggggaccagccctgcctcccccggctcccagcctccagccccggcgcacctcagccccagcccggccagccccccggatcgcccgtgggtgtcctcccccgcctttccttgggggggcgccctcagttcttgccctctttgttccttacaacaatggccaaaggggcattggttccccaagggccaaacgagcttcctccagg

SEQ ID NO: 71607 - DNA, 233 bp, Homo sapiens
  chr10:72015162-72015395
  hyper
cagcgtgaagaacagcgccaccatgaccagcatgtgcaccacgcgcgctctgcgccgcgatgctcgcgggtccgcagcctcctcgcccccgggggccgggcccggggcctggcagagcttgcgcgcgatgcgggcgtacatgaccacgatgagcgccagcggcgccaggtagatgtgcgagaagagcacagtggtgtagaccctgcgcatgcccttctcgggccaggcctccc

SEQ ID NO: 71608 - DNA, 158 bp, Homo sapiens
  chr10:7202969-7203127
  hypo
atctcctccctggcacgtgcacagacagtgctcacccatggtgaccgcaactgcacagagaaacgctgaagttaaactgtcagggtgaaggatacggagagtcttgggcgcttggctccacgggaagcaaacactttcccctgcgacagtggctgtat

SEQ ID NO: 71609 - DNA, 142 bp, Homo sapiens
  chr10:72043778-72043920
  hyper
cgccccgggcccgcctcccgcatggcgctctctccacagagcccgagcgcccctccgaagtaggggacacacccctcctcccactgcagccctggcagcggcgtcccgtaattccccacctctctcccgtgcctcatatgcc

SEQ ID NO: 71610 - DNA, 110 bp, Homo sapiens
  chr10:7205677-7205787
  hypo
aacctttaccaacaccgcatcccagcaataatgggccacctcccgagggcagactcagttggcgtactgggcgtagaaagccactttgactctctcgatctggtggcata

SEQ ID NO: 71611 - DNA, 30 bp, Homo sapiens
  chr10:7209019-7209049
  hypo
agggcaaaattaaatcgattttgatagagc

SEQ ID NO: 71612 - DNA, 30 bp, Homo sapiens
  chr10:7211951-7211981
  hypo
aagcagcattcagtacgacacaccagccag

SEQ ID NO: 71613 - DNA, 378 bp, Homo sapiens
  chr10:7212745-7213123
  hypo
gagggagaagggtctcgcacacctgccgagcagcgccgaagaaccccctcgcaggtgtcacgaggaagccggctaggacacgaggttcatttcagatgcagagtctcagcacatcaaacaatcgacacgcggcaaccaccgtacctgctcctgaaatatcttggccaagggggcacagtctgtcagcttaatgaacctcaccacgtcggtgaccgtccactccaacgggttgctctccagaaccagtctctcctcctcctcctgtttcgtgtcctgcagagaaagggcaggaggagctcagctgcggcacagtcagctggctgggtcctctccagcactctccaggcctcggccgttcctggccggaagccactgcct

SEQ ID NO: 71614 - DNA, 833 bp, Homo sapiens
  chr10:7213624-7214457
  hypo
cgtccaggaaagaggcgctgtctccaccctgggcactccattctgatgccgaaaggcccctccacccagaggtgaagtgccagcctttgttcctgacttgggaactagctagagcagctgctgctgttggaggtattttaaacaggtttccccacatcgtggccctgaagtgtaacaggtgtgcttcttcagacccagcgggaagccctctgtccccacgcccgggcatcacctctgtcccctcgggcttggtcggcgggcacttctccccttcctctgctgaggaggcagccggcgccccgcggccccttcgtgtcctctctgggggtggccggcgcacgggctctgagccgctccgcagggtgacggccctccggggccgggccgagggcacctccgccgacgaggtgtccgtctggtcatcccggagctcggagccggtctcctcactggcggtgtcatcgtccatggcgtcagcgtcctcctcttcactttcctgggaaggaggaaaaggcatttaaggggctggtggcccgggggcctgtagcggtggccccgcggtcagaccctgggcccagtgcagaccacctagcaaaccctcggaaatggagccagtggtcccacccgtgggccctacgaggcccttcccagccaaagcagctggacacactacatttgttttcagcaagtaaggaggagggggctcttcttcagtgtttctgaccatcttgccacaatctccagggccacctctgctgtgaagcagccacacttgccggccagggccagatgacagagctacaggctggcaggtgccccgggcagaacatacc

SEQ ID NO: 71615 - DNA, 314 bp, Homo sapiens
  chr10:7215974-7216288
  hypo
ccacctcctcccctgcgtttgatcacagcatggcatttggaaaaactgtcgggaagccgcacagcagcagccctgtaactcccaggaggcacacctgctccgggagccccggcctgttctcatcaatctctcaaaaggagcagctggcaggagagcttggaacaatgtcccgtgtccagttctataaggaccgtgttactcagtgagcaggaataaactgccgtgggcgagcattgctctgtggccatctccaggtacggggcaaatgagcaagcctctgtcccctcccaaaccccaagcgtgcatgacagggc

SEQ ID NO: 71616 - DNA, 166 bp, Homo sapiens
  chr10:7216521-7216687
  hypo
ttattatatgagatccggagacatctctgagttcatttcggcaatgctgaatgggaggtgtgggaccctgctccttccctgccattcccagtgtcctggaagaacacagaagcccacctggcaggtaagcattcaccgtacacggcaaaggcgagccctcggttag

SEQ ID NO: 71617 - DNA, 43 bp, Homo sapiens
  chr10:7219062-7219105
  hypo
ttcggttgctttctccgaagcagtaaatcgaatcctttctgaa

SEQ ID NO: 71618 - DNA, 47 bp, Homo sapiens
  chr10:72200018-72200065
  hyper
agtgaactggaaaagcgctccctcccttctttgccccctcccatccc

SEQ ID NO: 71619 - DNA, 655 bp, Homo sapiens; identical to SEQ ID NO: 896
  chr10:72200117-72200772
  hyper

SEQ ID NO: 71620 - DNA, 679 bp, Homo sapiens; identical to SEQ ID NO: 33128
  chr10:72200824-72201503
  hyper

SEQ ID NO: 71621 - DNA, 150 bp, Homo sapiens
  chr10:72218318-72218468
  hyper
ggcagtgagtgttcccgccgggcgggtggcgttgtcgccgccaagggggacccgcccctctcccctgttccccgcactgccggtcccgccgccggggccgggacaagagcctagtgagacagagacgctccggcgcgagctcctgcccag

SEQ ID NO: 71622 - DNA, 274 bp, Homo sapiens
  chr10:72238584-72238858
  hyper
cgtcgccggtgagcacgggctccctctcgcgtggcctcgccgggtccgcctggcctgcccacctccggagccacctctgcccccgcatgggctggcgaagttgggaggagcgagctggagccagagcgcgcgccgggcgcgccccgtcgctgcctgactcggcgcccgcagttcgggcgcagcacgccggccgcaggagcacggatgccccccggagccgcgggctggcaggtaccgaagtgtcctgccctggggctggcgaggggagggcaaa

SEQ ID NO: 71623 - DNA, 30 bp, Homo sapiens
  chr10:72297836-72297866
  hypo
cccacctctttccaccgggcccttgtctct

SEQ ID NO: 71624 - DNA, 30 bp, Homo sapiens
  chr10:7234209-7234239
  hypo
tccgaggactgacttcgctgaggtcagctg

SEQ ID NO: 71625 - DNA, 155 bp, Homo sapiens; identical to SEQ ID NO: 42498
  chr10:7236090-7236245
  hypo

SEQ ID NO: 71626 - DNA, 30 bp, Homo sapiens
  chr10:7237870-7237900
  hypo
caacaatagccttatcgatttctgacaggt

SEQ ID NO: 71627 - DNA, 30 bp, Homo sapiens
  chr10:7240552-7240582
  hypo
ctgccagtctgaagacggtgaagtagacct

SEQ ID NO: 71628 - DNA, 675 bp, Homo sapiens
  chr10:72431955-72432630
  hyper
agagagcaggccctgcggccaagaaagggggcggagcagccatagaaagcggctttgggccaccactccggggatcccaggcgtctgaggggacaatcggtccgtgcgccaggaacccctgctctgtctccgcgtggcacttccgatccccggccgcaggcagctgcactccccagccgcgcgccccgcccccgggcgcccggcgccccagctccgacccgcgcccggccccgccccgcccagtgtgcccacccccggcccgtcccgccgccccgtcgcccggctcccgcggagtcccggagcgtcactgcgcgggcgggctgaccgaccagccggcagttggcaccgggtgcgctggcgcgtcagtggccccgctctccagccggcagcctcgcgcgcccggagccagcggtccaggcggcggcgccgcgcaggggacccggagcaggcgggagggaagcagctaggcggggaggcggctgaggcggcagcggcggcagccagccggtgctccgacagcccggggcgcaccctagcctcgccgccctcagcctgggacttggggatcgggcgcttgcccagcccgcgtcccagcgcggccacatggctccactccgcgcgctgctgtcctacctgctgcctttgcactgtgcgctctgcgccgccgcgggcagc

SEQ ID NO: 71629 - DNA, 43 bp, Homo sapiens; identical to SEQ ID NO: 33133
  chr10:72432660-72432703
  hyper

SEQ ID NO: 71630 - DNA, 148 bp, Homo sapiens
  chr10:72470413-72470561
  hypo
tttgggggcgagttacgaaccctctggtgtgtctcttctgcactttgaaagcagcattaacagtacttactaccagaggttttggggaggatgaaatgagcgcatggtgcacagcatggccatgcagagcatgcgctgtcagtgggtg

SEQ ID NO: 71631 - DNA, 175 bp, Homo sapiens
  chr10:72489751-72489926
  hypo
tcctctgggccttagcgttcccatctgtaagtgggaggagagaggcctgctgtttctagggctctgaccctccacgtggctgttggtgctctcccggcccctgcagtccctgagcctgatcgagcgcgggaacccctcacgcagcctggagcaggtgtgtcgctgggcacactcc

SEQ ID NO: 71632 - DNA, 52 bp, Homo sapiens
  chr10:7255513-7255565
  hypo
attcgtcagccaggacgttcacggagaagagcagagacgggttctgacggtt

SEQ ID NO: 71633 - DNA, 81 bp, Homo sapiens
  chr10:7258531-7258612
  hypo
ggctcaagtgactaccgagctatcttgctgtcccctccttgccagtgccccatctggctagtgccccgtttgcttctaaaa

SEQ ID NO: 71634 - DNA, 155 bp, Homo sapiens
  chr10:72675717-72675872
  hypo
gcattcaggctcagccggaaagagtagcatggatgggcgatgtctatccgggtcagggagagggaggctggggtggcttatgtttactttccttgctgaggcttctgggccatgtggccattgttcataccctttgtgcacgcaaaacttctctc

SEQ ID NO: 71635 - DNA, 102 bp, Homo sapiens
  chr10:7271976-7272078
  hypo
ccctatatatatatatatatatttaagatgggagggtgacagttaagcaaaaaagcagctgtgcttcttgggtcccagagactgacccgtgaccttcccata

SEQ ID NO: 71636 - DNA, 30 bp, Homo sapiens
  chr10:72785075-72785105
  hypo
accttctcgaaaagccgagagtatagcgtt

SEQ ID NO: 71637 - DNA, 30 bp, Homo sapiens
  chr10:72799450-72799480
  hypo
cagtcattcactcgccgagctagggacaag

SEQ ID NO: 71638 - DNA, 22 bp, Homo sapiens
  chr10:7288388-7288410
  hypo
gaatgtgagagaggccgggtgc

SEQ ID NO: 71639 - DNA, 88 bp, Homo sapiens
  chr10:7288706-7288794
  hypo
ggtgagagacgctaccgctgacaggctatgcacatcaagtctgttgagtttaattgataaataccaggtgaagcgactctgtagcgtg

SEQ ID NO: 71640 - DNA, 67 bp, Homo sapiens
  chr10:7290469-7290536
  hypo
ctctaggggctgggtcgaagagcgagggaggaaaacccaccttagtcaccgacgcaggagagatgta

SEQ ID NO: 71641 - DNA, 109 bp, Homo sapiens
  chr10:72972434-72972543
  hyper
gccactgagcggtcgcgcaacttcggaggcacagcgccggagccaggcgagcgctcagagacccggagccagaggggcgcgccggagcctcgttcgagagccggcgcca

SEQ ID NO: 71642 - DNA, 136 bp, Homo sapiens
  chr10:72972814-72972950
  hyper
caagcaggtaggaagcgatcgggtctgggggcgcggggctaggggacccttgcgcctcactctgtcctgaagttgaggtggtctttcgtcgcatcgatgcgcgcaggaaaagcggcaagggcgcccaagttagaat

SEQ ID NO: 71643 - DNA, 159 bp, Homo sapiens
  chr10:72973223-72973382
  hyper
ttactagtctggtcccggctcgcctaggctcttacgcgctatagggacagcaatctgcagactagagggagagagcgaaaagacctgctgaacacaggaagcgcttcggtagcctcggcaggccggcttgcagggctcctgaagcggggagggctaagt

SEQ ID NO: 71644 - DNA, 30 bp, Homo sapiens
  chr10:72977387-72977417
  hyper
ggatgctaatggcagcgaaaatatttgctg

SEQ ID NO: 71645 - DNA, 82 bp, Homo sapiens
  chr10:72977625-72977707
  hyper
ccagccgagctaaatcggtctgcggagccccgggagctctaacgccaccgcctagcgagtgagtgcacggagccgccctcct

SEQ ID NO: 71646 - DNA, 67 bp, Homo sapiens
  chr10:73156149-73156216
  hyper
aaagccaacagatggcgcgggctcacctaggccgagcgcccgctcgcccgcccgggcttcccgggag

SEQ ID NO: 71647 - DNA, 15 bp, Homo sapiens
  chr10:73156346-73156361
  hyper
cgggcttcctccctg

SEQ ID NO: 71648 - DNA, 228 bp, Homo sapiens
  chr10:73156640-73156868
  hyper
gggggccgagcggggcgggggaagcaagggaaagttgatcgcggacttgagcggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccgg

SEQ ID NO: 71649 - DNA, 1045 bp, Homo sapiens
  chr10:73156912-73157957
  hyper
cgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggtacccggagccacgcaccgcctcttccctcctcgcttccctctccttcccctcgccgttcgcccgccgcgcggcggggaagttggtggtgaccgcggctgccgaaccacttgttcccagcgcggccatcgcccgtggcgggcgctcgcggcatccttcggtcccaggcccctggccctagcctcgcgccccgctccgagctccccgacgcgcggcaactttgattcctgggaactcgaattccattcgcgttggccttgggaggacaggcatcccatcccccatccccggtcctgggaccgcgaacatttgggggctttgctctcggcgctacggagagggtccaggtctggggtggagagattttcgagagtggagcgcgttgggatccaatcccctccccttctgagccctgggtccccatttggacagtggggatggggtggggcgcacccctactgcgggctgggcagaggcgctgaggggaactaaaggcacgtagttctcccctcccctcatcaagtccctgtgcccgcgggagaccccaggggacttacacatcctcccaaattcggtccagctatgggaagacgcgcccctcgaggagccgggagccttttgcggctctcgcttcgccttcctggccctggaactggtccgctacgagcggtgctggctgcccccaggagctggcacccgggagcactgcccctcatctccaccgtaggtcagcccaggactcgagcagagcccgcgtgttccaaggcagtgacggcgccagccggcggggactctgcctggctttctcggagcgggcacctagagaggctgcctccgtgctgtgagcggagatccgatgccagccgccgccccactgcgacc

SEQ ID NO: 71650 - DNA, 30 bp, Homo sapiens
  chr10:7323490-7323520
  hypo
gaagtggtgctaccacgtaagtcacacaag

SEQ ID NO: 71651 - DNA, 166 bp, Homo sapiens
  chr10:7339896-7340062
  hypo
acagtgggagcaccacgggctgatgcacattctccactcagggggctctcacttttgcccaaaggcagaatccaccatcactggggctcgcaggtgaggcctggaggtggtcgtgctgctgttggctgctcgcccagcacccagaggccctcgcagcttgtccttc

SEQ ID NO: 71652 - DNA, 137 bp, Homo sapiens
  chr10:73429932-73430069
  hypo
gtgctctataaaccccgcctcgccccatgcaatccagcaacccctctgtcgctgcttgctgcccaccatggtgtctgatggtggggtatcagccccacagaaggaaggttatgctggccctccgtggctggcagtgg

SEQ ID NO: 71653 - DNA, 123 bp, Homo sapiens
  chr10:73437184-73437307
  hypo
ttctctccatcctctcggcctggcacaggttctcgctggacaaggacacgggactcatcatgctgattgccaggctggactatgagctcatccagcgcttcaccctgacgatcattgcccggg

SEQ ID NO: 71654 - DNA, 350 bp, Homo sapiens
  chr10:73466313-73466663
  hypo
gttgtcatgattgtccgtgttgccatggtcgttgttaggtgcgtactggagagaggttctaaggttttctctcctccctttgacagctgagcagcaataagcccccagggcacagggacagcgggagggtctggagcactggtgggcctggtcctggccccggtgggcatggggggccctgggcttatggccaggaggtgttgacacagatgccacttggagcccgtgactcccttgggaattcattccctacttggtctggtgctggagacgctgctctggagctgggtcttctgcggcagaagccaggcctagccccggcgcccgttctgccccgcagtgctggatgt

SEQ ID NO: 71655 - DNA, 43 bp, Homo sapiens
  chr10:73468779-73468822
  hypo
caggagcagagtccccgcttcccctggccgggagctctgtttc

SEQ ID NO: 71656 - DNA, 73 bp, Homo sapiens
  chr10:734976-735049
  hyper
ctgctgcaccaaggacgccgcggctccagcgcagagcgcacgggaaggccgatcccgccgggcccgctgcatc

SEQ ID NO: 71657 - DNA, 30 bp, Homo sapiens
  chr10:73505195-73505225
  hypo
atttccatatcctcccgggacagtgtatat

SEQ ID NO: 71658 - DNA, 30 bp, Homo sapiens; identical to SEQ ID NO: 42614
  chr10:73553133-73553163
  hypo

SEQ ID NO: 71659 - DNA, 30 bp, Homo sapiens
  chr10:7367191-7367221
  hypo
aatgctgggattacacgcctgagccaccgc

SEQ ID NO: 71660 - DNA, 119 bp, Homo sapiens
  chr10:73723643-73723762
  hyper
caggaagatcctctccgggcagagatgatggggaacccgtgcagccagagggtctccctggcaaaggtcgggggagggggcggccgtaacggccccgggcgctccggcacggagaagcc

SEQ ID NO: 71661 - DNA, 514 bp, Homo sapiens
  chr10:73724102-73724616
  hyper
gaggagaagggctcccggacgccttggacgcggttcaggaatccgccgccgctagccggctcgggcctgagcggggagggcgccaggcaggacctctcgcaggctcgctgcgcaggacggcgcccgcctggcgccgcttcccttccagcgtgccgaccggccccgcagcgcctccatccctccggcccgccccggagaagacgcacagctcgggccgcgcgggcgccggggccgcggaaccgcttctgccgggatcttccaggaggaaagcgaagttgcgagcggatgctgcccgcgccggaccccagccgcggagggtcggggccgccggtggagtctcggcggccggggtaagtggggcgccggcgtcctggaaccgccgcccagcccgggggaggccgcccagccgggagcccccgccttccgcgtccaggcgcgcgcgccagactttggagggagaagggggcgaagcggacggtgggaggtggagttcccagctcggggaaaagcccag

SEQ ID NO: 71662 - DNA, 30 bp, Homo sapiens
  chr10:73724940-73724970
  hyper
agcagatgttgcagtcggttctcggagttc

SEQ ID NO: 71663 - DNA, 104 bp, Homo sapiens; identical to SEQ ID NO: 33140
  chr10:73847688-73847792
  hyper

SEQ ID NO: 71664 - DNA, 14 bp, Homo sapiens
  chr10:73848208-73848222
  hyper
ggtgactggcggag

SEQ ID NO: 71665 - DNA, 30 bp, Homo sapiens; identical to SEQ ID NO: 42503
  chr10:7391910-7391940
  hypo

SEQ ID NO: 71666 - DNA, 19 bp, Homo sapiens
  chr10:73975138-73975157
  hypo
agagcgagacttcgtctca

SEQ ID NO: 71667 - DNA, 43 bp, Homo sapiens
  chr10:73976883-73976926
  hypo
ggtagaaagacttttcgaaggtggcagggtgtttcttaagatc

SEQ ID NO: 71668 - DNA, 36 bp, Homo sapiens
  chr10:7401231-7401267
  hypo
agccctccatgcacccgaggccgtgatcatctgagc

SEQ ID NO: 71669 - DNA, 30 bp, Homo sapiens
  chr10:74027842-74027872
  hypo
ggcagggtttatgcacggtcagggccctgg

SEQ ID NO: 71670 - DNA, 127 bp, Homo sapiens
  chr10:7407101-7407228
  hypo
tgaccctgcgatttgcgtacacagagctggagcgggaactaaaaataaaacctgacttaagaacagccattctccagcactcacctgaatagagaggctggaaatccaggctcgcatgtccagagag

SEQ ID NO: 71671 - DNA, 74 bp, Homo sapiens
  chr10:7409558-7409632
  hypo
cgtcatgaaggatggcggctcgtaaatcgaagcctttgaaacaggggctcaccgtccggcggcatcaacacctt

SEQ ID NO: 71672 - DNA, 36 bp, Homo sapiens
  chr10:74100577-74100613
  hypo
tgctggtaggtatagcgcatgcggccgttgctgtag

SEQ ID NO: 71673 - DNA, 19 bp, Homo sapiens
  chr10:7414170-7414189
  hypo
cgcccggccttcttgaaat

SEQ ID NO: 71674 - DNA, 44 bp, Homo sapiens; identical to SEQ ID NO: 42505
  chr10:7414544-7414588
  hypo

SEQ ID NO: 71675 - DNA, 30 bp, Homo sapiens
  chr10:741557-741587
  hypo
gagcagcccacccatcggctcatcacactg

SEQ ID NO: 71676 - DNA, 30 bp, Homo sapiens
  chr10:7424626-7424656
  hypo
gcaggtactgcaacacgcagtgccctgcct

SEQ ID NO: 71677 - DNA, 186 bp, Homo sapiens
  chr10:7443826-7444012
  hypo
tttctccacgtgttccgcacaaccatgcatctcattccaacagaataccaactgcaggctatttagaacggtctcctacgaatgtctgtctttaattgaagaactgcaacctaagccatgtaccaattggtaccatttatatccagtgacagatataatgcagacaggagacggagagctcttgca

SEQ ID NO: 71678 - DNA, 148 bp, Homo sapiens
  chr10:74451157-74451305
  hypo
acgttattaatgtgttctgtttctgtaaatgcacacaaagtcaaatatgataaaatagtgctgtttctggagagtgtgagaatatccgtataaaggtgctgtaaaaatgaattgggtatttgagatgtatacacgtcagttaattcac

SEQ ID NO: 71679 - DNA, 236 bp, Homo sapiens
  chr10:7449954-7450190
  hyper
aaaacttgggcccttcgagaaccctgtggaatgttctttgtaatcaactgtacatccgcttccacggcacggcctcgtgcaaaatcgcgggtttcggggccttggagcaaattgcgcttgtcagcggcgacgtcaggaggacaaggggaggggttcgcggctgaaactgcagcttcgcagcacagagccattttaggctgctccccacctcgcggggcccatgggaaagccggccc

SEQ ID NO: 71680 - DNA, 2546 bp, Homo sapiens
  chr10:7450490-7453036
  hyper
cgcgggcccggaggaggtcctcccacctgcccccgccagccccggggaccgtgcgcggcctccgtgtggcccccgcccacgaggtccctcgggcaggaaccgccgcgcgacctctgttcagcggccgcgtcctggccacgggcgacccctgtcgggaaccctgttcccggctaagctgcgttcccgcattccggtggctctcacccgagctcgcgtttgctggctttccctctggctcctctgcctgaccccgattttgtctccgaactccactcccagatcctccccgccctggaacgccgacctttcccccgcacttcgccgcccactcacatcccccggcgactgcccggcctccatgcccgccaagacaagaagatgcccctctccgatgcgccgagagggttcctaagccgagcaagggacaatttcttccccaaacgctgtccccatcccccaccttccctagagcgcgaaacccaaaagtaaggaaggcaacccctcgcctcgaccctacgtgcttgtctcccagagccgcgcgctcccgcccttctgccccaccccaccaccaccaccaccactttggtcttctccaagcttcggtcccggtcccccacctcccaccccagagcggcgtggaggaaagcaggagcccactattaagtgcagcgcgccccctgcacacacgaaatccggctggcgtctgcagcccgattgcacccaatacccgggacagttagtccttttaataagcacctcctcgccccacctactcggggatctacccgcgcaggatccagcacacacaaggcgagagctagctcgtctcctagaaagacaaaataaatcactccctctgccctcatgtactttacaccacgtgtccgcagtttgtcacgtcaaatcatggcagggtctggttccaagacgcacacacacattcggggtggttctctttgacacacacacccaaaaaaactgcgcacacgcaggcctgcacactaatccacaggcacacacgacagttgcgtttcggtgccctggtccgggccaggggcacttctccatccctttcccccctagcaatggacttgacacacagactctaaccacggaaaaaaaaaaccggacagcccattccttctttttttccccacttaattcgctaaagcgcttcctggggtagccaaagagagtcgaaactaaggggtggaaacttcagctgggttttttcccacctcaaaacctttattttcagtttttaaaagccaccttagcccgccatattgaaactggcacggtttctaaagactccttccccgcagttgtggcgcttccaagaaaacacgagtacggatcaggctctggatgagtgtccggccaccgagaatcagccacttcccaccctccaggatcccccagctccctccagccccttcccaccgcccctggtcaaaatcaataaatacatctcgcagttcctacagttgcattttggcggatttctgcaaaacatacacacacatacacatacccacgcacgcatattaaaaaataaactccagaaccagctcaagtcagcaattttgaaagggggtcgaataagaggagacaaccggaaagcccctaagtgacaggatattactttaaagagaaaataatgaacaaaaagaccatcctcgctggagcacgctccaaaactactactgccaattttatttcagttgctcaggcaaatgtttccaagggagcgattccgaatgtctgcacgatttttacccccatgccggtctccgattccccgtcctcaccatctttttctcccacccaaaccaaaagaaaggggagaccccagcgcggaggagacgcgggagcgcggggtaggtagcagcggcggctgcgtcgctaaaatgagtgcagaaacgaggaaggtgggcggcgggaggggacaggctgcgcccggggaaggaggacactttgcaactccggacggactcccgcacggctcggcttttccgagcccggagacgcaggcgaaggggacccgggaagcaaaaatgacaacctggagcgcacagaggagtttgaagcttcgctcaagtgcagtcgctttcttctcctgcccttctctttcgctcccctgcaccctccccagccttcccccacccgccacctccaaccccagctccctcaggcttccttcctttttttttttttccttttttttcctaggctggaaaaagcccctgaccagcgcactcaacctgcgggccgaagggctgctctccggccagcctgggcgccggggacagcagccggcgcggcgtcctacctggtgaagttcgtcctgccctcggcgtggacccaggccccggtcgccgcccgggagggcaccggcctcgctcgcttgctcgctcgcccgcccttgcccgctcgctccccgcccgccgcctccctcgcgcgcccgctccggtcctccggctcccactacagctcattccaatatggcatcctctctgtgcgcatgctcggcgctcttttttttt

SEQ ID NO: 71681 - DNA, 561 bp, Homo sapiens
  chr10:7453096-7453657
  hyper
gcgaactccttcaacgaccttttccagcgcttgcaaaatttcttaagccaattagcctgcgggacgtgatcggctccttccccagccagctccgcgccattccctgcgcctaagcaggcgggcacccccaggaccctgggaccttccacgcccacgcggcctcctccccaccgcgctccccttcctcctttttgtgagctccctccatacatgatctgcagaaagttcccatcgcgggcgtttccgcacacccctccgcaaggacaactgggcaaactcccgtttccctggctgcggttcgtgagctgggtttccaatggctcagtcgaccgtgtgcacaaacttgcgctttatccgccggggatcgctgggagcggagataaattcaatccccagggcaatcttggccccgcccgccccaccccatcctgtgcttaaatagagcctttcttgaagctgcgaacatttccaggccccttgggcagggctggaggggccgaggagagctattcgagggaaaggtgccccgaggggcaggaaattaagttggggctgcccggg

SEQ ID NO: 71682 - DNA, 175 bp, Homo sapiens
  chr10:7453902-7454077
  hyper
cgcagagcccaaacgaaatgtccccagtgcggaaaagccggtgacgccctggtagcaagaccaagagcttccgaagaacgctgcgcccttaactagggggcctcgcagagatgcctgtgtgggcctgcattgtatatttctgcgaaatagcgaatggacacgtttgctcagggtt

SEQ ID NO: 71683 - DNA, 308 bp, Homo sapiens
  chr10:7454305-7454613
  hyper
acagaggtcctcaggcgggccctctcctggacggtggggccggagctgatctagaagaaatacggagggacgtgccgagaagccgctctccttcgccgcgaccctggagagcgcctctccacccaaaggatctgccgagctgagagatccagggcgggcgtccgcagccgtgaggccccctgcgccgccagtatgggaagatcctgcctccttacaccttggagaacgctgggcgacgactaaagcgccttccgccggcctgtcactccatgtgacacaggagccacgtgagacccagaagagtccag

SEQ ID NO: 71684 - DNA, 185 bp, Homo sapiens
  chr10:7454628-7454813
  hyper
cgcactttaaactctagcctgagtctgcgacccctccagctctccagtccccagctgttggggacatcaagccggagccctgggctctctgccctgtgggtcgctgaaagcagagactcctcaaaccaaccgaaccgggcgcattaaccctctcgcctgcaccccgctgcctcccggttgagccc

SEQ ID NO: 71685 - DNA, 73 bp, Homo sapiens
  chr10:7454891-7454964
  hyper
cggtttggccccgggtctcaacacccaagtcgcctcttctggctccttcaccacacagcggggcctgtggaaa

SEQ ID NO: 71686 - DNA, 60 bp, Homo sapiens
  chr10:746643-746703
  hypo
tgtgtgtgcaggcatcggcgtgcacctgtgcgtggtgtgtgtgcacgcataagcatgcac

SEQ ID NO: 71687 - DNA, 40 bp, Homo sapiens
  chr10:7472551-7472591
  hypo
gagaaatggacatagcggccgagcacggtggctcacgcct

SEQ ID NO: 71688 - DNA, 352 bp, Homo sapiens
  chr10:7488720-7489072
  hypo
attttgaaccagcctcgattatggatattcgagttattttcagttactgttcttgctgtggcaaacaatgcagcaatggctttgcttttacatacgtctttatgcgcattttcagcatatctgcagaataaattcctaaaactgaaattgctggatcaaagggcgtattcattttctaatttcgttagatatcaccaaataacactctatcttaacacgaaacaaacacttgcaaggatgctgtgctaatttacactctcatctaccgtgcacttgagtgttggtttctcatgcccttgctagcacctaactttgtcaaggtgattggtaaaaaaaccgtgtctcagttcca

SEQ ID NO: 71689 - DNA, 30 bp, Homo sapiens
  chr10:7498536-7498566
  hypo
cccactcacccctgacgacacacacctgcc

SEQ ID NO: 71690 - DNA, 23 bp, Homo sapiens
  chr10:75011146-75011169
  hypo
tctttgagatggaatcgccctct

SEQ ID NO: 71691 - DNA, 23 bp, Homo sapiens
  chr10:75011409-75011432
  hypo
attacaggcgtgagccaccgtgc

SEQ ID NO: 71692 - DNA, 30 bp, Homo sapiens
  chr10:7505493-7505523
  hypo
gtggagacggctgtgcgtgtctcctcctct

SEQ ID NO: 71693 - DNA, 32 bp, Homo sapiens
  chr10:75118507-75118539
  hyper
caaccaactacctctcgcgagaacttactttt

SEQ ID NO: 71694 - DNA, 153 bp, Homo sapiens
  chr10:75384262-75384415
  hypo
gccaaaaagccattattctaattaatgcatttgtgaacctcaacataaaaaaatccagttatataatcacaagagagttatccctttcaaatgtatacctacaaaagatagaaaaatgatcagaaaacttgtatctgtcgattgaaataaatt

SEQ ID NO: 71695 - DNA, 15 bp, Homo sapiens
  chr10:75407398-75407413
  hyper
cagattctgcacccc

SEQ ID NO: 71696 - DNA, 209 bp, Homo sapiens
  chr10:75407477-75407686
  hyper
cgtctcctcctttcccggccggaacatctgcttccgggtcccccggcgccgggcctcctgcaggatacccgtgcgggcagctggcacagagatgcgctgctcgcgagcgctggggggctcaggagcccctgggcctggggcaggcgcctctgggcgcgcagagggtcgcaaaggcgcagataggaagatagaagcggtggaggtcatgg

SEQ ID NO: 71697 - DNA, 36 bp, Homo sapiens
  chr10:7542725-7542761
  hypo
agaatcggctgggcacggtggctcacacctgtaatc

SEQ ID NO: 71698 - DNA, 22 bp, Homo sapiens
  chr10:75488953-75488975
  hypo
gcaatatctagaggccgggcac

SEQ ID NO: 71699 - DNA, 84 bp, Homo sapiens; identical to SEQ ID NO: 42616
  chr10:75501525-75501609
  hypo

SEQ ID NO: 71700 - DNA, 37 bp, Homo sapiens
  chr10:75633031-75633068
  hypo
aacagatgtgggtggcgtgccgcgctcccaccccctc

SEQ ID NO: 71701 - DNA, 30 bp, Homo sapiens
  chr10:75670725-75670755
  hyper
ccctccgctggagatcgcgcttcccccaaa

SEQ ID NO: 71702 - DNA, 78 bp, Homo sapiens
  chr10:75808858-75808936
  hypo
catctcaaaaaaacaaacaaacaaacaaacaaacaaaaacttaattgagcatatttaagttcacgtgtataataatat

SEQ ID NO: 71703 - DNA, 224 bp, Homo sapiens
  chr10:75832369-75832593
  hypo
aaataagtgagcaatcggtttgaactttcatagtatttcataatggatttagactgagaaagccagacccgggattgtttcactactcaccctgcacaatttcttctttgtgccccaggaatgactaagatggccaagatgattgacgagagacagcaggagctcactcaccaggagcaccgagtgatgttggtgaactcgatgaacaccgtgaaagagttgct

SEQ ID NO: 71704 - DNA, 30 bp, Homo sapiens
  chr10:75966942-75966972
  hypo
gaacccacgtctggacgaggataatatggt

SEQ ID NO: 71705 - DNA, 156 bp, Homo sapiens
  chr10:7608010-7608166
  hypo
tgctggaaaggccctcgctgttggcaatgtagaaacccaggtggtgtcgctggaagggcgccggctttttgtagaggtggatgaggatgacaaaggctatggagccctggatggtgacggtgacattggcgttggcagacacggacacctccagcc

SEQ ID NO: 71706 - DNA, 30 bp, Homo sapiens
  chr10:7641473-7641503
  hypo
tggattctagatccccgcatgtttcattgt

SEQ ID NO: 71707 - DNA, 30 bp, Homo sapiens
  chr10:76511158-76511188
  hypo
aacactccagtttcccgggaacacaccggc

SEQ ID NO: 71708 - DNA, 30 bp, Homo sapiens
  chr10:7673219-7673249
  hypo
gtggattctaacgggcggcaaagtttggga

SEQ ID NO: 71709 - DNA, 36 bp, Homo sapiens; identical to SEQ ID NO: 42617
  chr10:76784730-76784766
  hypo

SEQ ID NO: 71710 - DNA, 21 bp, Homo sapiens
  chr10:7678984-7679005
  hypo
gcctggcgacagaggacttcg

SEQ ID NO: 71711 - DNA, 33 bp, Homo sapiens; identical to SEQ ID NO: 33144
  chr10:76803629-76803662
  hyper

SEQ ID NO: 71712 - DNA, 30 bp, Homo sapiens
  chr10:7698170-7698200
  hypo
ggaaagtgatgaaatcgtctttttttagac

SEQ ID NO: 71713 - DNA, 35 bp, Homo sapiens; identical to SEQ ID NO: 42430
  chr10:769828-769863
  hypo

SEQ ID NO: 71714 - DNA, 23 bp, Homo sapiens
  chr10:76997760-76997783
  hypo
accgcacccggccaagaatccat

SEQ ID NO: 71715 - DNA, 212 bp, Homo sapiens; identical to SEQ ID NO: 42619
  chr10:77022117-77022329
  hypo

SEQ ID NO: 71716 - DNA, 447 bp, Homo sapiens
  chr10:7708410-7708857
  hyper
agactgccccccacgcgtgataaggaaaaaaccttgtaattataataacttttggagctacctcagaaattaacaacgacgaacagaaatctgcgcaatcaacaggagccaagaagaaaaactcggctccgcaggacaagtcccgggcacagttctgcaggaagcctcaggccagatcaggcaccgcggctcacacagaggtgacgcacgagtgacccacagagagggacccctgggcctctggtgggggcctgggagacggtcgaagggggcccgggcagaagctccgcggccgggccggcggagggaagggggcggccgcgcccgggacccggctcccctcggctccacttacctgctccgaagagtggccccagctctgcgcctcttcctgcgaccccacacacagggacagccccaggcacagccccagcagcaggagcatgg

SEQ ID NO: 71717 - DNA, 35 bp, Homo sapiens
  chr10:7708954-7708989
  hyper
cgcggtcccagcccggaccccgcccaccccacgga

SEQ ID NO: 71718 - DNA, 66 bp, Homo sapiens
  chr10:7709654-7709720
  hyper
cagtcccaccagagccgcgcctccagcccccagtgctgggctagctctgttcggggagaaggcatt

SEQ ID NO: 71719 - DNA, 90 bp, Homo sapiens
  chr10:77159927-77160017
  hyper
tcgacttgtcctccacgccgatgtcgctcagcttcagggggcccgatttggtgtccttgtcgcccgcagcaccgccgccggcaccgcccg

SEQ ID NO: 71720 - DNA, 374 bp, Homo sapiens
  chr10:77161032-77161406
  hyper
gggacgagcctgggccggggccggagctatttccagagagcgcgctggtccaggcagggtctgcaccgccgcctccgcctccgccgccgccgccgccgctgtgcttactgcttcttagggcagaaagcgagggcgctgtgctcatgacccacccgcgcgcatgggagcagcgggggggagggctccgggaggcgcggggcgggctcggggctgcgcgctcgccccgggagcaggagcagcgggaggaggaggagctggcgcggcggccacgggcgcccagcgcgccttctcggcgcctggagccagacgcgagtaatcctgggtggcccgcagcggagccgtggccgggctagaggagccggctggactgcggg

SEQ ID NO: 71721 - DNA, 68 bp, Homo sapiens
  chr10:77161623-77161691
  hyper
ggatgtgacgcgtcccgcgccgccgccgccgccgctgccaggactctcagtgccggttttaatgggca

SEQ ID NO: 71722 - DNA, 632 bp, Homo sapiens
  chr10:77162706-77163338
  hyper
tcggtctgttggggtcgcggagttcgggcgcggctccgggtacccgagaccagcggcggcaacttctaacacgggagatttcccgccaccccaccccgccgccgcgagtcctcgcggggcgtgttgcgtgcggaggtcaggctgccaccctctgtagttccctaaccccaaactcggagacttctaagagccacaccaccaaggaacttctagtcctggaggtcaatggtggggcaaacctcgcctcaattctttgaccccctcgggtcgtaagcagggctaagaggctgcgaagaagaggcctggccatgggtgtatgggggaagaaacatctcaggctcactcatgccccctccccgaccttctcccacctgccgccatccccgcaggctggggagccagggtaactcggggctgctctctcgaatttattggaacgccgagtcggaatgagctgcgctaggagagccgagggaaggagcgagagagggagggggcggctgcctgtgggaacgcgggttcttccagggaagcggagcgggactgccgcgttcccctcgatttgcaccgtcactcgggttgtttgggaagaaaaggggaggcgctgtgcgtgccaccgggtacctggacct

SEQ ID NO: 71723 - DNA, 64 bp, Homo sapiens
  chr10:77163662-77163726
  hyper
tgagccgggtgcgcgcgggggtcgggtctggaactgcccttggtatgctcgccctctcctcttg

SEQ ID NO: 71724 - DNA, 123 bp, Homo sapiens
  chr10:77169095-77169218
  hyper
ggcctctcccctgcccgcctggcccaggaggcgcccacacctgcgccctcacttgccgagacttttacctgtgcagtccccggcggcgcctgcagccgcgcaggtaaccgagaaatggaaggg

SEQ ID NO: 71725 - DNA, 520 bp, Homo sapiens; identical to SEQ ID NO: 33148
  chr10:77191185-77191705
  hyper

SEQ ID NO: 71726 - DNA, 58 bp, Homo sapiens; identical to SEQ ID NO: 42508
  chr10:7765067-7765125
  hypo

SEQ ID NO: 71727 - DNA, 30 bp, Homo sapiens; identical to SEQ ID NO: 42509
  chr10:7780425-7780455
  hypo

SEQ ID NO: 71728 - DNA, 30 bp, Homo sapiens
  chr10:7786837-7786867
  hypo
ttggaagaagcatcccgtcaatgttgactt

SEQ ID NO: 71729 - DNA, 30 bp, Homo sapiens
  chr10:77892448-77892478
  hypo
tcggagtacgagtatcggaggaacaatgag

SEQ ID NO: 71730 - DNA, 187 bp, Homo sapiens; identical to SEQ ID NO: 42620
  chr10:77893300-77893487
  hypo

SEQ ID NO: 71731 - DNA, 16 bp, Homo sapiens
  chr10:78601007-78601023
  hypo
ccgccgatgtacatct

SEQ ID NO: 71732 - DNA, 2025 bp, Homo sapiens
  chr10:79396631-79398656
  hyper
gagcggtgcaaaacacgcacccagctgcccccagcttcctccgtccccgctgagttggctgtccccaccccgcaccacggcacccgagcctgtgagtccccgaccccggccccagccgcagccgccaacaaccctacaataaacaagaggacaggattgagcgtccgcgtcccggagcgcactggctgggggcaactcctcacccccggcgcgccgcccgctgccccgatccgagagcaccgggagagccgagggaagggaaggcggcgaggggaaggcaggcggggatggagggaggcacggcgcggcgcggagcgaggaggtgggctgcaggggacgccgagaagcggtggggctggcgcagagggcgggcgcccggggcgcgcgttaccttcgtcttgcccccgcagtggcagcacacggtccacaggtacttgagcgtccgccagagcaagatgatgaagaggcccccgaagaaagtcaccatggaggaggccaggaaagcccaccacatgcgttggccccggctgtcgcacggcacctccatggtcaccgggatgatgagcgcatccatcttgggctcgtggaccgaggacgaggaggaagaggaggaggaagaagaagaagaggaagaggaggaggaggaggaggaggacgcgtctaggctgagatggttcgcgtggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccaccccaaacacccatcaacagccatattgctgctactgctgccgccgccgccgccgccgcggagcgcgggaggggggcggggaggcgcctgggctcggggcgctgtgcgcgacctggcggggtgcgccgagatatatacagcgagccgccgccgcccgcccgggggggagggggatggagtgcgcgggcagctccccctccccggcccgcgccccgctcgccccgggctgcgctggccccgagcgccgagagccagggggcgccgcgggccgcccgcgcccggggtctgcgccgcccccgggcccgccccggctccgcgcgcggtcccgggtgtcctcggcgccgcgccgcccgccgtgcgccacgggtgtgcgctgcgctcggccggtgacccccttccccgagcgcctcccgcgcggctaacgagccgctctccgcttattaggtggtaactcgttaataatggataatcggccccctccgcccgggcgcccctgcgccagccctcctcccccggctgcgctcggctccggctcgccgcgccagtgcgcgcccggccgcggcaggttcaccgcgtccggccgccggcccgtggccgcctgctagcccatgttctcgggaccccctagtcctgtcgccacgccgctgagcccctcggcctccgctcgctcttcctccttgccgcctccgactcctcctcgtccccgtcctcgccgcccaagcctcttcggcgcgcgccccgcgctccccgcagccgccagcagcagcagctgcagcaactggagcgggcgcggactcaggacgacccaggcgggaggggaggaggctcgccgcgctggctcgcctgggctccgggctgggcaggggtgggcagggcccctcggcagcggcccggcaagcgcccctgacccccagggcgcaaggtagagcgcccccagcccaggcgcggggccaggcgcctctctccaaggtgctgcgcccccagccgagagcggtggggtacactgggaggacggcggggcgccccggtcaggccgtttttttccccaaagagcccccagtggggaggggaggagtggccagctgtcaactggattccacaggctgagctccccaggaccctcgggcttcgggagtgaggaggaccccacgccaggatacacacagctacccacccctacttcgctcttcctgctac

SEQ ID NO: 71733 - DNA, 146 bp, Homo sapiens; identical to SEQ ID NO: 33151
  chr10:79470925-79471071
  hyper

SEQ ID NO: 71734 - DNA, 178 bp, Homo sapiens
  chr10:79491986-79492164
  hypo
agtgtctgctgtgaacgaaagtgaagacggcaggatcccgagtcattaatttgaagctcgctaacaacaccacagtgaaagccacagtcatatctgctgcctctgtccagagcgccagcagcgccatcattaaagccgccaacgccatccagcagcaaactgtcgtggtgccggcacc

SEQ ID NO: 71735 - DNA, 30 bp, Homo sapiens
  chr10:79661214-79661244
  hypo
acccatctggactaacgccggtgtcaggaa

SEQ ID NO: 71736 - DNA, 34 bp, Homo sapiens; identical to SEQ ID NO: 42510
  chr10:7985160-7985194
  hypo

SEQ ID NO: 71737 - DNA, 30 bp, Homo sapiens; identical to SEQ ID NO: 42511
  chr10:8025070-8025100
  hypo

SEQ ID NO: 71738 - DNA, 30 bp, Homo sapiens; identical to SEQ ID NO: 42512
  chr10:8067803-8067833
  hypo

SEQ ID NO: 71739 - DNA, 197 bp, Homo sapiens
  chr10:80683494-80683691
  hypo
attcgtcaaggtaatcgtgctccttctgcccatcagacagatttattaggagcagcagcaggagcccatcagagcccagtcacagcacccccccactcccatcaatcccaacacagggcgggcgagagacagaatatatgtaaggtcatttggagatggaaaaaaatcattcacagcactcccgaaatagccgatct

SEQ ID NO: 71740 - DNA, 15 bp, Homo sapiens
  chr10:8075930-8075945
  hyper
gctggcagccaactt

SEQ ID NO: 71741 - DNA, 124 bp, Homo sapiens; identical to SEQ ID NO: 3501
  chr10:8076053-8076177
  hyper

SEQ ID NO: 71742 - DNA, 1034 bp, Homo sapiens
  chr10:8076340-8077374
  hyper
cggtccctgggggcggggctctggcacgagggggaccctcccgggtcaagttcacagaggcggaggggcctgggctgcgccccagagccccagggggtcctctgctcccataaaaaacaaagacgggggcggcggagggtgtggaaggaaagaaattgaaaagggagtgcgggcgactgagggaagctggaggggaaataggggcctcggccaccagtggcctatgtccataactgccctttggttttggtggccttgcaggccgggaatcgagtctgccatgttcgctttcagacgggcctcctggcaagctcttggttgactgtccccagatgttccgggaacccacccctcccccacaccctcccgccccaaccctccgcagagaagccgaggaccacatccatccgcttcctaggaacctgcccgcaccagcaggccctgtttcctggacaaactgggcaaagaaacctaagaaccgcgcgatcccggcaggtggctttctgcggagccagggctgccagcgcggccgggcggcgcctcgggacccggcctggcatccgcgggcgcccggggagggccttggcgtcggcgggggtgggggtgggcggcagatccgaagcagggtcggggaaaaacggcgttgcgggagggttggggggtggcctctgaggaagtgggacaaaaggctttatttcagaaggtacgccaggaaaggggcgtgggtcaccaagtcctgcgcagcagagttggcgcggcctgggagccggggtcccttctgaccacagacgtggccaccgcctcttctcatcccgaaggtcccagccatcccgaggtggtcagagaagaccccgacgggcggatcgggcagtggagagacccgtggtcctcgcgcctgctgtgtcgctgtgtcaatgaccgtgacactcagggcaatccttaccaacacagagcaggacaacgataccccgcacccccccgtacaagtgcaaactagtttctgtgttgggggaaaaaagcgaataaaagtttaa

SEQ ID NO: 71743 - DNA, 369 bp, Homo sapiens
  chr10:8077874-8078243
  hyper
gtccctcctgcctcccggggggacccctgttccgctgcccgtctcctccccggcacccaactgcggggcacgcgcccgttgctcggccctaaaggggcctagagctgcgccccgggggcgcggaaggtgcggggagagggggtgaggaaggacagtgaggggccggtcctgggcccggaggactcagcagccgccttggcagcaaatcctgtaggctgtcccctgccttggttgtctcgatgttccgctcagcgctggggaaataaatcgaacctggtgcacacccctcccccaggttgtaacacaactgcccccccagccaacacacacgcccaagcacgcagactttgcacacgtgacatgggggtc

SEQ ID NO: 71744 - DNA, 63 bp, Homo sapiens
  chr10:8078628-8078691
  hyper
ggtggggaagctcagcggctctctctgcccgggtttctggccagcccccgagggccaggctag

SEQ ID NO: 71745 - DNA, 30 bp, Homo sapiens
  chr10:8079285-8079315
  hyper
agtccagcctgaaaccgaagcctcttgaaa

SEQ ID NO: 71746 - DNA, 30 bp, Homo sapiens; identical to SEQ ID NO: 32867
  chr10:8079721-8079751
  hyper

SEQ ID NO: 71747 - DNA, 42 bp, Homo sapiens
  chr10:8083222-8083264
  hyper
tacagttcttggtcccggaaatgtagtcgtagtcatggtcct

SEQ ID NO: 71748 - DNA, 449 bp, Homo sapiens
  chr10:8085599-8086048
  hyper
ttctccctgggtcctcaaaacgcgccaagaacgtggctctgccacttggtggcggaaggcgggaggcacagggcaggaaggtggaggaggggctgcattcgtgacgacgggggagcagagagggaaggacttagggactccccagagggcagacagacctggccagcttggcaaatcataaatccctctccctggaccctcggcctaaacctacccccagggtgtgcagcggaggcgcacaggggttggctgacgggctggggtgcgcctgggtggaggctggtttggggttctggcgtctggaggcaggccatggaaccagaggagagggcaggagggcccaccgcgcagagctgcggcccggctcctagagtggcgcccccagcctgggcatcgcgctcaactgctctctgaaccccatgtccacgagggttcgccctcaaaccacc

SEQ ID NO: 71749 - DNA, 55 bp, Homo sapiens
  chr10:8086685-8086740
  hyper
ttcttatgcctactccgaggagggtcagagggtagcagcccgtcacccagcatcc

SEQ ID NO: 71750 - DNA, 359 bp, Homo sapiens
  chr10:8087043-8087402
  hyper
cctgccagaagacagcgggctgtgcaggcgccaggggccggtcacatttcaggccgcctttccccacccccgccagatctgtcagtttcacacacccctgatgtgcggtttgcctgtttgcaaaagggggtgaaattcattccctcgctgtttctccttccctccctccctttccctcttcgcaacccggaagagctccgctctctacagtgagcaggagaaggcggaggggagggggctcccaggaagaacgtacatcgcccaggttttacctctcgctggaagcccgcctgagatgcggtgagcagttccagcggccaggacggcagcggcggccacagtggcgaactctgcctgtc

SEQ ID NO: 71751 - DNA, 334 bp, Homo sapiens
  chr10:8090424-8090758
  hyper
cggaggagaggtcgggtctagaagtagcaagcccctggctaggagtcactgatgccactgggggcagggtaagatgtccaaagcccgggagacccagggacgccggctgggctgcctccaccccttcttttcctcccgtggcacccacctgtccccccacctgccaaggccaggagggagggagagagctgaaaagggcacttttcctccagggtgactccaattcctttccactcaccctcaaggcgagttccttctctcccacccaacccggggctccccccaactgccactcgcctcacgtgtgagttgttaaacccgaaagcagaaatcc

SEQ ID NO: 71752 - DNA, 99 bp, Homo sapiens
  chr10:80909885-80909984
  hyper
gagccagggatgaggcgaaacccaaccctggcctggccccgggccgcagccgtgcaggtcactaggcctcggcgagtggccacccgcccacccaacagg

SEQ ID NO: 71753 - DNA, 639 bp, Homo sapiens
  chr10:8091359-8091998
  hyper
gtattgcccactgcccgactgccttttcttcccgtttaggtcttgctccccgctctccgcatttcagctcgcaagggaaagaaaacgggggcccgagtggcagagacagagataatatgtatttaacctgcgcggtccggggcgccctgccgcagcgggctccccgcggtgtggcccgcgcagccggggccagcggcggcgcctggagccgtgtccccggcataaccctcccgcccggcagccggcgagctgtttatacagctttacctgtgctatagtcctatccagtagaaacccttgcgcggccagggtaacctaatccaggggccgaggcggaggagggggcggtgaggctggctgggttggagacggaggtgtgcgcgctccaatacccgggatctctcctttgcccctcctcccaccatagggaaggaaatatggacatggttcgggtgacagaaatggggacccggggctaaggaggaaggaggccagttttcacggcccggtcctccggcttctctcctttgaacaggcgctggggacctccgcggcggccacagctggacgcgcgccgcgaaaggcgcggcggtcccgcgggcgcccggcgtgggctagagaggccggccctggcctggc

SEQ ID NO: 71754 - DNA, 89 bp, Homo sapiens; identical to SEQ ID NO: 32874
  chr10:8092446-8092535
  hyper

SEQ ID NO: 71755 - DNA, 104 bp, Homo sapiens
  chr10:8093360-8093464
  hyper
tcgcctgctcggctgcgggatgcttgctcccaaggtcccaggcgtccaggttgatcgccagccccttaccctggtgagggaggccttgcgccctgcagaagccc

SEQ ID NO: 71756 - DNA, 303 bp, Homo sapiens
  chr10:8093522-8093825
  hyper
cgagctccgccggctgctccttgggaggaaggggactcgctagaccaggccgaggcccaggtacctgggagggggtcgcgtcaggtctgcgggaaggcgctcaggcttctccgcaggaggccaggatcagctttgtggcggtggcacagggagaatcaggaccacctttcccccttacccccggccaggatccccctttccctcccccgcccgccaagggaggaggaagcccggcctgctcttgccggcgaggcgggtcaggccggcgcctggcctggcccggacccccgcagcccggctctc

SEQ ID NO: 71757 - DNA, 105 bp, Homo sapiens; identical to SEQ ID NO: 10171
  chr10:8093859-8093964
  hyper

SEQ ID NO: 71758 - DNA, 15 bp, Homo sapiens
  chr10:8094243-8094258
  hyper
gcccttctccatccc

SEQ ID NO: 71759 - DNA, 261 bp, Homo sapiens; identical to SEQ ID NO: 32879
  chr10:8095198-8095459
  hyper

SEQ ID NO: 71760 - DNA, 197 bp, Homo sapiens
  chr10:8095492-8095689
  hyper
cgcggctcggccacagcctcgcccgctgattggtccctccaggccccgcccccgctcgccccgcccctctcgctggggcgcctcggagccgcgtgccctccgccccggggtgcccattgcgcagagcgtggcctggagacccgcgagccggggaaggtcgccgtggagtcccgaccagaggccggggttggggtcgg

SEQ ID NO: 71761 - DNA, 1593 bp, Homo sapiens
  chr10:8095944-8097537
  hyper
ctgcaacagctgaagcgtgttcactctgggggcttgagagcgcagaaggctcgggaaagaggtgacaatgacaacaaaattgacgcggacgctccagtcaaaggcatctcccctttatccgatgactcaccctcttaggaagtcggcccgagaggcaaatctcaaaataccttgacatgaaacattttgtttttctgatcaatttaacgcgcacgtttccccacatcgatgcgctctcccaaacaccctgcattagatcctaataatgatccatgcgtgcctattttttaaaagtctgaaaaagaaaattctgcccatcgaaatgaacttcatgaatggggcaggctggctgcaccgggacggaatcgtccacccgacccgaatgaattggcaggagccgcggccacatttaaagggccagagcgcgcgttccctcccgtccgcccccaagccccgcgggcctcgcccaccctgcccgccgcccctccgccggcggccgccctctgcggcgcccctttccggtcagtggaggggcgggaggaggggcgggggtgcgcggggcggggggagaagtcctggagcgggtttgggttgcagtttccttgtgccggggatcctgtcccctactcgccagcgccaggctcctcccccccggcgcggatgacactagaacctccttaagttgcgtcgcgccacagctgtctgcgaacactgagctgcctggcgccgtcttgatactttcagaaagaatgcattccctgtaaaaaaaaaaaaaaaatactgagagagggagagagagagagaagaagagagagagacggagggagagcgagacagagcgagcaacgcaatctgaccgagcaggtcgtacgccgccgcctcctcctcctctctgctcttcgctacccaggttggtactggtgactttttttttttttaagtttgattttttgcccccaaccacttgggaggacctaaatcaattttaaaaactcaactctcctcttttggaggttttctaggggctgagaggacggtcccgggaccggtgtccccgagggagggacttgccctccaagtcgtaacagtcagccctgggacttgccctccaagttgctcagccagccccggctcccgcgagccgggctgcagggacgtccccgagagccctgcgggctccgcggccgtgtccccgcgctcccgtgcgggtctcgggtgcgctgggcgggcgggcggcgcgaggggaggttgtgccactccagcaactcaggggctcatccaggtctcccattctctcccttgcaggtgacccgaggagggactccgcctccgagcggctgaggaccccggtgcagaggagcctggctcgcagaattgcagagtcgtcgcccctttttacaacctggtcccgttttattctgccgtacccagtttttggatttttgtcttccccttcttctctttgctaaacgacccctccaagataatttttaaaaaaccttctcctttgctcacctttgcttcccagccttcccatccccccaccgaaagcaaatcattcaacgacccccgaccctccgacggcaggagccc

SEQ ID NO: 71762 - DNA, 40 bp, Homo sapiens
  chr10:81024063-81024103
  hypo
ggcatttggcactcacgcctcaccacggacactggtgcat

SEQ ID NO: 71763 - DNA, 30 bp, Homo sapiens
  chr10:81037768-81037798
  hypo
tttgcagtcagagctcggctctcattatcc

SEQ ID NO: 71764 - DNA, 139 bp, Homo sapiens
  chr10:81070800-81070939
  hypo
ccttcccagcctccccggcagccgccacaggccgctcccagcagccatccacacagcgacctgacctttaacccctcctcagccttagagggtcaggccggagcgcagggagcgtccgacatgccggagccttcgctgg

SEQ ID NO: 71765 - DNA, 51 bp, Homo sapiens
  chr10:81206300-81206351
  hyper
gctccagccctagcccgccccggtgccttggcgagtcgccaggacaccagc

SEQ ID NO: 71766 - DNA, 30 bp, Homo sapiens
  chr10:81206959-81206989
  hypo
agttattaatacaaacgacagcatatgtat

SEQ ID NO: 71767 - DNA, 636 bp, Homo sapiens
  chr10:81664437-81665073
  hyper
ttctggcttttgcaccgcaccaactaatccgcgccaggccgcacagctgctctggccttcggggaggactcctggagcgcggtgtacactgctccggagtccctccgcaggagttgaggcagcgagttccgagggcggggtggggcggaatccggaggcacgcggacccggtggaacgcactgcgcagacggcgccggcgcctgcactcagctgttgacgagtctttcttccagctctaccctgaaagtcctccaggcaccggtcttttttttctgccttttgtttccctcccggcgagtcggcgcgacagtgaatttccgtttcccgcggtgtccaagcggacctgaggagttgcagctgtgagcaggttcggtggtgccgcgggctggggtaggcggcggtggggtccctggctctggggcactgggaagatcgcgagtcgtgcgcgtgggaaggtcctccggctcatctttgctccccaggagcagcatatttcgcatctgccagaggtgtgcccgggggtcgttgggagagggacggggtgaatccctgcagagagccgggacggggagggaaggtgtcggggagacgtggtttcctggcgacgtggtcccggcaggcgacttagacctgag

SEQ ID NO: 71768 - DNA, 565 bp, Homo sapiens
  chr10:81741366-81741931
  hyper
ttcgtcctcccctggcgcaccgcccgtttttcctctttctccgttaaaaacaactgggtggctgtgggaagagggaaggtggcgccggcggagtctgggcaggcgcctcccactcagccgccagcagccctgggagccggaggatggctgcggtagcagccacagccccagaggaggcggtgcccgacgcccggggcgcccagcgcgcccagaccggcagtggccttcatggcgcaccagaacctaaaccagaggcagccacacggacacctgagccgcctcttcctgctagagccagcgaggtgtgcccgcagccgagaccccttcctctccacgtctcctcgtctccttgtctcccgtgcccgcgtcaggccgccagcctcgcccacctccccaggaagagcgcgccgggcgccgacttcccctggggcggcggccctggacgtgcggggggtctctctgggccggctgctgcgccttggccctgccctctagctcccgcgctcgctcccgccctcctggctctccgggcgcgcctggcggggcagggcggacatgggcacca

SEQ ID NO: 71769 - DNA, 409 bp, Homo sapiens
  chr10:81892268-81892677
  hyper
gggcggccccttcctcgggaggcgcccaggtggcacgtcggtgcctcagctcccggggtctctgggctccgcgctgcccacggggtgccgaggggcctctggagggggcgggttctctcgagccagaaagtccggagccgcccaggaattttggctcgaactgagtgcatttcctctcgggccggccgggtgcgatccgggaagggcggctgcgggcagacgcggcgctgcgctcggccaggccggcaccatgcggcccctgctctgcgcgctgaccggactggccctgctccgcgccgcgggctctttggccggtgagtggggcgcagggcgcggcaggggacctggagccggggagacccgcagatggcgaggaaggaatgagcgagagagacggagagagagctgg

SEQ ID NO: 71770 - DNA, 172 bp, Homo sapiens
  chr10:81921303-81921475
  hypo
tgacccatgcgggagcgcgatttacatctgttgaatgaatgagtaaatgaatggcacccagttttattgttatgactgtttcttatgccaggctttggaaaacactggattgggtgctcccgaaggaccctcccaactctgacgttccacattcccacgtacaaagacacca

SEQ ID NO: 71771 - DNA, 123 bp, Homo sapiens
  chr10:81930494-81930617
  hypo
tgattcctctggccacgcaggtgtggccccagggctgcctcagcaggagagctggactcaccattcccgagagatagtcctggttgaactgccccgcataggtggccacgttatccagcccga

SEQ ID NO: 71772 - DNA, 259 bp, Homo sapiens
  chr10:819352-819611
  hypo
gctcagcctggcgagatttcattttattgataaatgtaagtttttgcactgaactaaccccagacttcactaacgtgggtaggaagacatggctcctaggtgtagacgcaacccccagggctcttggacggagatcacgtggaatccagagtccagtgactttggcagtaactgaaatgggatatttaatattcacgcatttatttcacaaatgatcccagtgtgcctgtgtgtgcctgggccccggcagcggccagcc

SEQ ID NO: 71773 - DNA, 25 bp, Homo sapiens
  chr10:81966571-81966596
  hypo
aacaagctgctggttcgattttcct

SEQ ID NO: 71774 - DNA, 626 bp, Homo sapiens
  chr10:82116580-82117206
  hyper
ggtgagcagagggcacgcggtgggcagcgaagggggaacgcgcagcagagaggagagggcgtgcaggagtaggagcaggcggcagagtagagggggcgcggcagagtagagggggcgcggcagagtggagggggcgtgcaggagtaggagcccgccgcagagtagagggggcgcggcagagaggagggggcgtgcaggcgcggggcgcccggcagagagaaggggtcgtgcggaagggggcgcgcgccaggggagggggccagagaggagggggcgttcaggagtcgggcctgcggcagagatgaggcggtgtgcaggagggagagcgcgcacgagggggcaacgggcagagaggagagggaatgaaagaaggggagcgtggcagagagaagcgggcgcgctccagggggcggggtccagggaggagggggagcgtaggatcggggcgggaggcagagaggagcgggcacgcgggacgggcgtgtgctcgtgaggggtcgaggaaaggcgtatgtggaggcgcgcggggtgggtgagccgaggagacttgctacacagaaacctggaggagtaggggcacacaaaagagcaagggaccctgactggcagcccggcatgctctggga

SEQ ID NO: 71775 - DNA, 353 bp, Homo sapiens
  chr10:821379-821732
  hypo
gtggccagctttccacgcatctgtgatgcccggcctcagcccctgtgtccagcgtgagggctggtggctgtggagacggatcgcacgctgggtttagaggcgccagccgctggcagcgccggtgccacaagccctcctgagatattgttggaagagagccttggtgtgcctgcctggcacagagaagcctcctgagaaatgtcagatgagtcatgagtctcagagggggcgggcagccagggaggaagcaaggagcgaaaccaggagggagcccgcaggaagctgggggccgggcaggcaccggggtcagtgcagcgagggtcaggggttgctgggtgcgggcagtgggtgca

SEQ ID NO: 71776 - DNA, 60 bp, Homo sapiens
  chr10:82168049-82168109
  hyper
ttttgccctaggcagcgccctgaagaacgcgtcggggcctcggttcgcggacttgaggag

SEQ ID NO: 71777 - DNA, 239 bp, Homo sapiens
  chr10:82168477-82168716
  hyper
gaggcagtgcagggccggtagggtgggtgctgggctggtgaggcgcgcccctcgggcccgcgccaactttcttaggagccgccgcagcgctggcgctccctccgaggacgacgacccttccgccaccctgcgtggcggccgatggaaaaaccctgcgcccagacgtcggagaacggagacggggacccggcgctgctgcggcgggctagggccccctctgtccacgcccgcaagccttg

SEQ ID NO: 71778 - DNA, 50 bp, Homo sapiens
  chr10:82383742-82383792
  hypo
gtgtactttatttaacgacgggggctgatggctctcggaaggctgatcta

SEQ ID NO: 71779 - DNA, 37 bp, Homo sapiens
  chr10:82573954-82573991
  hypo
ggaggtgtggagggagaggcaccggtgggaaccgggg

SEQ ID NO: 71780 - DNA, 30 bp, Homo sapiens; identical to SEQ ID NO: 42625
  chr10:82607464-82607494
  hypo

SEQ ID NO: 71781 - DNA, 49 bp, Homo sapiens
  chr10:830731-830780
  hyper
gagcttccagcctcccgggtctaggggactgggggatgcgtcttcctcc

SEQ ID NO: 71782 - DNA, 95 bp, Homo sapiens
  chr10:830815-830910
  hyper
cgtccccggcgtccccgcatcgggcttctctggtcctttgtgaatcgggcctgagtcatccccggctcacggctgcgccacgtacccactgggcg

SEQ ID NO: 71783 - DNA, 197 bp, Homo sapiens
  chr10:833140-833337
  hypo
gaagaacagacaccacgtgctccctgcctgtgcagagggaaggcgcgaggtggctccaggaaccaggtcggccggcaccttggcccggaacttccagcctccagattgtcagaaacaaatccctggtgtctgcggtgttggggctgacacgcgctctgcctggctgccaggtcctctgcaggcggggacggtgccgg

SEQ ID NO: 71784 - DNA, 510 bp, Homo sapiens
  chr10:83633649-83634159
  hyper
acacttgccttgtaacgtgtgtacctgtgcgtacatttacaggtaaagacaatattttaaggcaagttcacataaatggcttggagatatctgacaggtctgattatacaaaggtcttctgctccacctgcatctctcaggaactcaggcaaaggtggccttccatccagccgcaccgccatccggcaggggagggcacaggcaccctcccacccgcatccgcccccgccccctcgcccagcagcgtcagtctctgaccccactggatccgtacaggagacgactcacaatcggtcggaagctgcttttgcccccccaccccaccgcaaacgggggtttgcttggatcatttatctatcttgtgtgcattaagaaaccagcattagctgctagtgggaggcgctactctgcccgaatcccagcccgccgcggcgattctgcacacacacacgcaccagcctggcagccagagcccgtctggagacgccctcagcccggggtctgcgttcc

SEQ ID NO: 71785 - DNA, 581 bp, Homo sapiens
  chr10:83634918-83635499
  hyper
tctcggggggaggggcgtgggggcagggagcggatttgcatgcggccgccgcggccgctgcctgcgcccgagcccgccgccgccgccggagcccgcgcccgcgcccgcgcccggcccgcgcggccccatgcctctgccgcggccctcgggggggcgaaggtgaagaccggctcctaggatgagtgaaggggcggccgctgcctcgccacctggtgccgcttcggcagccgccgcctcggccgaggagggcaccgcggcggctgcggcggcggcagcggcgggcgggggcccggacggcggcggcgaaggggcggccgagcccccccgggagttacgctgtagcgactgcatcgtgtggaaccggcagcagacgtggctgtgcgtggtacctctgttcatcggcttcatcggcctggggctcagcctcatgcttctcaaatggatcgtggtgggctccgtcaaggagtacgtgcccaccgacctagtggactccaaggggatgggccaggaccccttcttcctctccaagcccagctctttccccaaggccatggagaccaccaccactaccacttccacca

SEQ ID NO: 71786 - DNA, 103 bp, Homo sapiens
  chr10:83635530-83635633
  hyper
cgcctcctccaggacgcccaaccggattagcactcgcctgaccaccatcacgcgggcgcccactcgcttccccgggcaccgggtgcccatccgggccagcccg

SEQ ID NO: 71787 - DNA, 148 bp, Homo sapiens
  chr10:83635670-83635818
  hyper
cggtcccgtccaccacggccccgttcttcagtagcagcacgctgggctcccgacccccggtgccaggaactccaagtacccaggcaatgccctcctggcctactgcggcatacgctacctcctcctaccttcacgattctactccctc

SEQ ID NO: 71788 - DNA, 16 bp, Homo sapiens
  chr10:83636233-83636249
  hyper
ctgcagacctgctggc

SEQ ID NO: 71789 - DNA, 138 bp, Homo sapiens
  chr10:83636250-83636388
  hyper
agctgccggatcccgctccagtagagggccagggagggagagagggccttcccgaaggcactgagccccttctccgcccgccggtaggaaggaaagaaagcaaagcacatgcaaattgaccgacgataaaccacaaaa

SEQ ID NO: 71790 - DNA, 403 bp, Homo sapiens
  chr10:8374325-8374728
  hyper
agtcaggactctgggcggcagcggcagagggaggtgctgggggcggtggcatagcgcccacaccgcgtggtccccgcgcgcggctgggctggcagcgccccaggcagcgcgcacggtaagcaggaagctgcggccgagctgagtcgctcaaaagctactggagctaatagattgtggtcatgaggagagcggcagcatctcggtagtgatgggaacactcaaaagcatcatcaaaacagttgcagaaacatgctgagctctgcactcccgagcccgtgcctgctgcagccggcttggagtttgctggtagccactgcagccccggccccgcgcgtccagcctgggggtgcgatgagcaagagaaatgaggtgcaaaatgttgcatccgcggagctgcttgcaa

SEQ ID NO: 71791 - DNA, 43 bp, Homo sapiens
  chr10:838096-838139
  hypo
ctgtgacacagccaacggccaagagctgcgggtattgatcaga

SEQ ID NO: 71792 - DNA, 255 bp, Homo sapiens
  chr10:851249-851504
  hypo
gatgcaaaggacccccgggctgctgcgcggaaaaaggcggacggggatccagggcgcaagcagggatggagggagaggccgacacagacggcggcaggtgtgcgtggtgaggccgccccacgcagggatgggaggggcgcgcaagccgggacttgaacctgcactggctgagctgtggacgcggcctggcggcctctgcggagcgccctctgcggagctgcctctggcacctgtccacagcgtctggacaccggg

SEQ ID NO: 71793 - DNA, 30 bp, Homo sapiens
  chr10:8556196-8556226
  hypo
tccgcaggtgatcctcgtgcttcccaggca

SEQ ID NO: 71794 - DNA, 76 bp, Homo sapiens
  chr10:85949225-85949301
  hypo
gacaaaggccatgaccgggaaccaaggcttatgacattgtcagatgcctcttcattcattcattcaatattcctct

SEQ ID NO: 71795 - DNA, 816 bp, Homo sapiens
  chr10:85954289-85955105
  hyper
gccgctaattggtctcgtcaggcggccggcaggagcagatccgagccgtgtcatcctcttagcgccctcacgccacccgccgctcccgccccgtgccccctcccgccgcggctgcagtcgccgctacccccattgtggtctctgccctccccgcgggcccagggcatgctccgtgcccctgcgcccggtctcggcggcggcaggcgacactccgcgccggcggagacatgaggcgctgccggtgggccgccctggccctggggctgctgcgcctctgcttgggtgagtggccgctgggccgcgctggccgcgtggatggcgagggagatgggcgctggcgtcacccaggtggccagagggacatggtcctggaccacttccagagtgggactcgggctggtggacgggagcggagaagtccttccatcttcctggcccattcggtagtggggagtggggtagcggagtagtggggagctccggggcgcttctccagagctggcatcctagggccccagggtttggcgcccggacccccgctgctctccgcttgctgggaaccagagctgtaggcttggtggcagctccgatgctgcgtggggcaggagatagtgccctgactcgcggcttgaccttggctgggctggggcactgcccctctccgagcgcgggtgcaatctgcccattgatgaaggaggggttggattgctacctgggttctaagcgcccacatgctacgtgtccctgacaagcccgagcccaccgggggcggagtgggggtcaggggcatcctctgggcggcgccccagtggggtc

SEQ ID NO: 71796 - DNA, 73 bp, Homo sapiens
  chr10:86304014-86304087
  hypo
gggacagagaaactgcgcatactgctcctctccctgtcccataggaagaggtctttagcgtggcccagagcct

SEQ ID NO: 71797 - DNA, 82 bp, Homo sapiens
  chr10:87967280-87967362
  hypo
agatgcacctcccaacgctgcaacccactgcaccagttttgaagcaaacatctcttactaatggtttatgcgatggcaagga

SEQ ID NO: 71798 - DNA, 190 bp, Homo sapiens
  chr10:88055214-88055404
  hypo
gtggggatggagcatcgccatccactgccaccttctctctcctcagtgaactatatagggaacaaaactctgctgctcggggctgtggccagcatggaggagagaggaggtgttgcagatgcggaaagagaggggaaggtcagacggagtggagaaagaatggcccggagaaacgcgatatgacggccaa

SEQ ID NO: 71799 - DNA, 144 bp, Homo sapiens
  chr10:88124485-88124629
  hyper
ctcccatttcctgtacgtctgtcgaggggagtgggggaaggggacttgtgtcctaggcgcctccacgttcagatctagcggagctgggggtcccagaaggagctgctcttgaagggctttctagaaccgcggacagctcctcca

SEQ ID NO: 71800 - DNA, 1645 bp, Homo sapiens
  chr10:88125208-88126853
  hyper
cccactccccctcggcgcgccccctcctcctctgcgctttcatcttctctcccggttctctctctctatccatctcttcccgctcagcatccccctaccccccgctgcccacgcttcttccctcggctcccaccacccagaccgtctgggcccccaagacttggaccacgcaaaactctaggactgtccaggatggggatgcagtcgccacaaccagatacacacgcactcacacatacaccaagggctacacagacacacaccggagaagcaggcagacactgtgtccactctaacaggctgacagacagtcgtgcacgcaccaacacacgctcagatggccccacacaccccaacaccctctcacagtaacaccgacaccgtgccaggcgcacacagcgacacacgctgacaacacgcacccacacacattcacacacggttccggtccggcctctttgatcttgccctgccaacttggcgagccccccgctgtacctccccctgccccccgctgctctgagctgcgcagaagggccctcccgacccgccgacggccccgctaagggcgcgggtctcgacgcgcgtccatcccggtgttccccgaagcgtcggccctaagtgtcggtagaggccgcggggccccgcgcggagatcggagccccggggagcggcaagcagccagcgggagcgcggcgcggccggtgcacagctcctccgccgggcggcgcggcgcggcccttcgggggagcaccgcccgccgagcccctcggcccagggaaacgccaagtttggacgccgcgcaccccctgccccgttggggcccccgcccagcctcggcccggcctccagccgcgcttaccgatgtggatgatggagtcggcccgcaccgacacgcactggcatatccaggggagaagccacagcgtcagcgcttccatgtcccccgggcgcgcggctcatccacccgggcccggggcgaggccgagggcagcgcgaagcggggaggcgctggtcccggtgcagtcccgggccgctccccgggagagccgagcccgcccgtgcgtcttcccccgcgcgcccgcccctgcgccctgcgcccgccccagcccagcccagcccagcccagcgcggtcgggctcccgctccggctccggtggcggctgcggcggtgctggcagcttgagcccaggccggcgcggcgggggcggcccgcggctgtggcagcggcgcttcccgcggctagagcggcttcgggggaggctgaggcggtggcggcggcggccgggccggcgtggcggctctgggctggctgtgtgtctgagccccggcgaggagcgaactgcggaggacgccccctcccctccccctccccctcagctccgctccccctcccctccctgcccgcctccctcccctccgcccgcctctctaccacgtgactgcggagcctcagcctcgccgcgcggctctcgcccgctcgcggctcggagggggcgccgggtgctccacgctcccggctcgggggacgctcggagaccggcacagcggcggggaccggcctgggctgcggcgcgccgagctctgacggttcgggcctccttctccggttcgccaggggcgggagaatggaggagggccggcc

SEQ ID NO: 71801 - DNA, 279 bp, Homo sapiens; identical to SEQ ID NO: 10374
  chr10:88126854-88127133
  hyper

SEQ ID NO: 71802 - DNA, 50 bp, Homo sapiens; identical to SEQ ID NO: 33169
  chr10:88127346-88127396
  hyper

SEQ ID NO: 71803 - DNA, 359 bp, Homo sapiens
  chr10:88149287-88149646
  hyper
agaacttgcatcaggcgtctctgaccaccgagcctgcgaagacctagctgattacgaccaggaaacaggaggggacatggcccaaggtgggcggggccagtgctgggaagccccgccccgcccccgatcctgtgctcccaggtctgggcgttaggattctctcagtcccggagccacgccggctgaccgcagggctcggggagcgcggctgggccccttttcccgggtccgggaagcgccgggccacgccgggtccgctggagagactgagggccagggtcgccgctgccgccgggaggcgacagagccagctgggcgcacctgggtgctggcggctgcggagtcgcggggcccggtcc

SEQ ID NO: 71804 - DNA, 32 bp, Homo sapiens
  chr10:88280081-88280113
  hypo
tttgtgccaaaagaccacgtcttttacaaata

SEQ ID NO: 71805 - DNA, 30 bp, Homo sapiens
  chr10:88282807-88282837
  hypo
tccctccggtataatcggggaaactccaaa

SEQ ID NO: 71806 - DNA, 457 bp, Homo sapiens
  chr10:88391908-88392365
  hyper
gaggatacagggagccgtttgcctgggttcgcgctcggctgtcctagctcacggggcgacctcggaaacgtccagcgtctgccctgtccccctgcgccgcgtctgagcagccagccccgggccaaagggtcgcgttggttggggcgtggggcagctggagggctgcaggtccccagcgccgcctcccgggcaaggggcggaggcgcggatcgctgaagtcagcccgcccctggttccgcgccctggagcccgagtgcgtcccagggcccgccgcacactgcgctggcccgcggccagtcccccagcctgcggctccaagatgcgcttaacgccgtctctcataccccagaaccctccttagaaacaggcttaccctgccacccattccccatccccccacacacccctgcagggccagcctcaggggtgcatggatttattccgcaggtgcagcagg

SEQ ID NO: 71807 - DNA, 66 bp, Homo sapiens
  chr10:88414219-88414285
  hypo
gtctgagtgagctggcggcatggagcgactgagcatgtgcagctcccacatcgctatataaagatg

SEQ ID NO: 71808 - DNA, 70 bp, Homo sapiens
  chr10:88446786-88446856
  hypo
ctccctctccctgcccgtactcccgcacccctcccccagcgccgactaccaggaacgcttcaaccccagt

SEQ ID NO: 71809 - DNA, 30 bp, Homo sapiens
  chr10:88731103-88731133
  hyper
aggggcttcggggcacggggccgtgcacgt

SEQ ID NO: 71810 - DNA, 58 bp, Homo sapiens
  chr10:89419357-89419415
  hyper
aacttgaccccaggccgcgtgccgggcgtgccatctgccgctccgctgcaaggtctcg

SEQ ID NO: 71811 - DNA, 145 bp, Homo sapiens
  chr10:89605836-89605981
  hypo
gagtaatgcattactccatgacgttaggatggctaggttcacaaggcgataggaatttttcagctccattataatcatgggactgccttggtatatgcgggctgttgttgacagaaacgtcattatgtcacgcaagactagataa

SEQ ID NO: 71812 - DNA, 77 bp, Homo sapiens
  chr10:89621759-89621836
  hyper
gggactctctccccgcgttctgtaagaatcggcggcagccagcaggcggggaggcgggggcacgtgtttggatgtgg

SEQ ID NO: 71813 - DNA, 241 bp, Homo sapiens
  chr10:90342630-90342871
  hyper
gggccttttcccgggcggcggaagtccccgatcacgtgacgaggcgcgccactcggcgcatgggccgcgctacacggccgctcagggagctgagggtatagcgttttcgccttagactttcttgggtgcaggcccacaccacctcagcagcctgcccggcagtcctcttttcccaggttttggcgtttagacaacccacctgagtcctcagccttgtcccacacagcaaggtacaagggac

SEQ ID NO: 71814 - DNA, 96 bp, Homo sapiens
  chr10:90343138-90343234
  hyper
cgtccttgaggagcaaacctggggctgcggagaaccggggctgtctgtcttctcgctttgggggccgggcgccctgcccctcgcccagaaaagcct

SEQ ID NO: 71815 - DNA, 19 bp, Homo sapiens
  chr10:9071404-9071423
  hypo
ttttagacagagtctcgct

SEQ ID NO: 71816 - DNA, 1661 bp, Homo sapiens
  chr10:90966508-90968169
  hyper
aaaacagttcccagacgctcatatactgcgttgccagcgcgaacgaggacgagttctggtggtgcaccttgtggaaggtgcggtacagccagggcaccttgtggtgcagcaggtgccacacgaagaactccatgtcgaagagtagcaggcagaacaggatgtggtgcagcagcaggagcagctcgggagcttcgtggggcaggagggccgggctgcgggcccaatgcagcagcgtcacggggaacacaaacatcacatgctggtagagggtctgccccaggcaaggtagcagctgctgcgcggatggcgagaagtcagggtggatcttgtagcgccgcagggcgggcacccaggagcacaggatatccaggaccacgaagggcaggcaaaagcccacgtatgtggtgatggagaagatgaccgggaagaagggcgactgtaggagggcctcccagctcctcaggtggtcccagaggggctgcaggaacagctgcccggagctgcaaaggacctgggggtcggagcagttgtggcagctcattgcgaggctgtgcaaggcagctgaggctgctgctcgagtcccatcgacttttcacaggactcacggccccgccccgagtgatgtcagctgcctttccatccctttcccggcgatgcgaagcttgaataagctagcaacccggcagagtggcccttcattgctgtaaatgtgctcatctatagccgcatcttaccggcttttagatatgcgtgtatgcagtggcacttcgtacttttcatgtaagttctgatttttcagttgacgtacaattaacacgggacacaatgtacagatctaccgtgtggagtttctatgagtttggcaactcagttcacgtgtgtcatcacgggtctcaaactagaccgtttacattgccaccagaaagcgctcctttgcaatcaatgcagaattgtttgtgttttttaatgcatacgtataactgcatccatgtgctttcataaagacgcaagcataatcgcattttaaaaactgtttaaagctacatgcggtctgtagctcgggtgttttctgagaacccggttgcggtctatccagcggcgatcgagaaacgagccctttgcacagggaaccgctggtccccgaacgccggcggtgaccgtcagctcaggaaatcagacgggaagggtggccggatgggaacctccgccagctccagcttgtccccagagttttcctggccggcgggcagcaagctagagagaccacgcacgcaggctctccgggagaggccgcagcccggccgcgtagctaccctcggcggcgcgtcccggggcgccgggcccgcgatcggagccggaggcaccgcacagcggaaagagggctccgcggcggccaggctcagctttgccgggaaaatgctggatttaactcccagtctgcgccaatctggctaaaaagcccgttgtatctcaatttggggcgggaacacttaattcagcaaaccacctgcgttgttcgtcaagggaaagagatgtgagttcctgaagcctcccgggaggctattgaaggaccaggtgatgtcgtcactaccctacccttccccttgttggctttgcggggccaacttgcagtcgccctctgccaccggtccttgaatcca

SEQ ID NO: 71817 - DNA, 458 bp, Homo sapiens
  chr10:91294888-91295346
  hyper
tggtctctattccaccgagaagtctgcatttgaaaaccacaagagatggagatcaaagccgctcgttctccagccacctgcccaaaaactcggccgcagcgcagacccaacccagacagggcaagtgagcacgtgtctccctcccaacccaagctgcgcgccgacgcacccaagttagggtcccaggctcccggcgcgggatgggcgctagggcagcggagaatggagggtccccgtcctcctccagctccaacgacagcgccagcgccccgccgtcccgccgcccttccttgaaggatgcccgtgtcacctgagccaccgcgccctctgcacaaccgtgtcagggagagggaagagggggagccgaggaagcttcttggccagggcgctggggatccgggagcgggggccgccggcgagactgagcccgggacagcccagagctccagcgctccagc

SEQ ID NO: 71818 - DNA, 145 bp, Homo sapiens; identical to SEQ ID NO: 10383
  chr10:91295347-91295492
  hyper

SEQ ID NO: 71819 - DNA, 295 bp, Homo sapiens; identical to SEQ ID NO: 10384
  chr10:91295584-91295879
  hyper

SEQ ID NO: 71820 - DNA, 15 bp, Homo sapiens
  chr10:91295923-91295938
  hyper
cggtgttcccaaaaa

SEQ ID NO: 71821 - DNA, 442 bp, Homo sapiens
  chr10:92617097-92617539
  hyper
tcttgacgaagcacacggagatcaccaccaggcagttgcccgcgatcgtcagcagcgtgatgagcgtcaggatggagccgatcacaactttctcgactctgccgtagttgatctgttccccacagccggaggcattgtccgggggcgcgtcccaggtgggcgccgggctggctgtcacctcgctcagcaggtgcggcgcccaggagcccgcgaccgggtcggcgccaccgtcggggctcaagtcgggcagcccgcgccccacttctggcagaaggaaagagcggaggtgcccgtagaggtccgggcggccgctgctgttaacgtccatcatcgcgccgccgtgtgccgctgcccatggagccggcgccccggccacgcgcctccggctgccggccccggggcttcacctcaccggttccgctccgcccggcccagccatggg

SEQ ID NO: 71822 - DNA, 30 bp, Homo sapiens
  chr10:92618047-92618077
  hyper
tagaacccctccagccgaccccagcctccg

SEQ ID NO: 71823 - DNA, 75 bp, Homo sapiens
  chr10:92913398-92913473
  hypo
aaagccttggacaggcggcgtccagccatgcaagcaagacccagcggcccgaggggatttcggttgctctctgcg

SEQ ID NO: 71824 - DNA, 30 bp, Homo sapiens
  chr10:92993186-92993216
  hypo
ataaagtgttgtactcggtagaagaaaatg

SEQ ID NO: 71825 - DNA, 56 bp, Homo sapiens
  chr10:93392900-93392956
  hyper
cctcgagccccagggcgcgaccaaccagcgcccagctggggcgccagccctcgccc

SEQ ID NO: 71826 - DNA, 24 bp, Homo sapiens
  chr10:93628551-93628575
  hypo
tttctttttttgagacggagtctc

SEQ ID NO: 71827 - DNA, 24 bp, Homo sapiens
  chr10:93628635-93628659
  hypo
ctaggttcacgccattcaaggagg

SEQ ID NO: 71828 - DNA, 611 bp, Homo sapiens; identical to SEQ ID NO: 33181
  chr10:93647037-93647648
  hyper

SEQ ID NO: 71829 - DNA, 13 bp, Homo sapiens
  chr10:93647649-93647662
  hyper
aagcagaaccctg

SEQ ID NO: 71830 - DNA, 467 bp, Homo sapiens
  chr10:94180300-94180767
  hyper
ctcacaataagaacccgtccttcgcctgcagtatttaaacgattgtcggtggaagttcacgtcgtgctcctctttcgacagccgttgggtaacggatcaaaacccttaacggccgcggctggagcgcgagctcggggcgccgaggggctccgggcccgagcgtccaccgctcatctcctgggctcgggaggttttcgcggcgggggctcagccccagatcccgggactcaggaggagctgggccgagctgcgggaggcgtggaagccccaggagagggttttgcactacgaaaaaaccatatgcaaattgcctgggaagagtttagattctgtggccaaactgcaagcggccgttgctaaaatgggaagcatttacaggaaaaagcaaacggtttcatcgaggtggattcgacgacaaactaagcgaaggcaaaaacgatcgcgggagtcgacgtggagacagataa

SEQ ID NO: 71831 - DNA, 41 bp, Homo sapiens
  chr10:94342632-94342673
  hypo
gtgctgggattccaggcgtgagccagcgtgcccagcctgct

SEQ ID NO: 71832 - DNA, 143 bp, Homo sapiens
  chr10:94448826-94448969
  hyper
cgtgcaaaaccagagagccagactgcgcacagctgcgaccctcaagagccagcagaaaagacacggagcggcccccactggattgaagactgcacagcctctgcccggcgctgtaggacccgggcctccccttgattgctgct

SEQ ID NO: 71833 - DNA, 180 bp, Homo sapiens
  chr10:94449138-94449318
  hyper
cgctctgagctcgggaaacggccggtgtgacagccagcgccactgttaatccagggagcgcacccaccgaggaggcgtcttaggccagcggcctctgctcccgccgagtcccgctgctccccgcctggaaacagctgctgccaccccgggcccaggcctggacggcgcccccgaatttcg

SEQ ID NO: 71834 - DNA, 365 bp, Homo sapiens
  chr10:94449797-94450162
  hyper
gcgcccacgccgctgctgcaacccgcacacccgacgcccttttacatcgaggacatcctgggccgcgggcccgccgcgcccacgcccgcccccacgctgccgtcccccaactcctccttcaccagcctcgtgtccccctaccggaccccggtgtacgagcccacgccgatccatccagccttctcgcaccactccgccgccgcgctggccgctgcctacggacccggcggcttcgggggccctctgtaccccttcccgcggacggtgaacgactacacgcacgccctgctccgccacgaccccctgggtaaggcggccgggcgagggtgggggcgaggaagcgccacccggcaggtggcagcgcc

SEQ ID NO: 71835 - DNA, 349 bp, Homo sapiens; identical to SEQ ID NO: 33186
  chr10:94450377-94450726
  hyper

SEQ ID NO: 71836 - DNA, 135 bp, Homo sapiens
  chr10:94451369-94451504
  hyper
ctgtcggggctggagcgggaccctcagccgggccgggcctgggggctaacgttttcacagtgcgccctgagtttccttgggttactgctgggaccgcgcaggaggaagcaaagagtttttcgagctagaccaaca

SEQ ID NO: 71837 - DNA, 25 bp, Homo sapiens
  chr10:94603312-94603337
  hypo
aagcatgcatttggccgggcgcggt

SEQ ID NO: 71838 - DNA, 53 bp, Homo sapiens
  chr10:94822354-94822407
  hyper
agtttaggtctgggccgcttggaagagggagaaaggaccggaactggccttct

SEQ ID NO: 71839 - DNA, 38 bp, Homo sapiens
  chr10:94826099-94826137
  hyper
ccgcctgccgcctgccgcggcggcgcccaggtgggagg

SEQ ID NO: 71840 - DNA, 97 bp, Homo sapiens
  chr10:94828028-94828125
  hyper
cgtttccaggtgcctcgtggtcaggctgatctcctcgcctctctgcagggctaccagatccccaagggctggagcgtgatgtatagcatccgggaca

SEQ ID NO: 71841 - DNA, 739 bp, Homo sapiens
  chr10:94828193-94828932
  hyper
cgcgaagattcccggggcgcctccagccgcttccattacatcccgttcggcggcggtgcgcgcagctgcctcggccaggagctggcgcaagccgtgctccagctgctagctgtggagctagtgcgcaccgcgcgctgggaactggccacacccgccttccccgccatgcagacggtgcccatcgtgcacccagtggacgggctgcggctctttttccaccccctcacgccttcggttgcggggaatgggctatgcctctgacatgcttgcgctctaggacacggcttggccggtggctatggcgcgcacgcagcgccacccatctgccgctccccattgtagcgtcgcgcgcccactctttcactcgttcaacaatctttcaacaaatgttcgccaaacgcggatgtgtgccggactcgaggaaggaggagggcgagccaccgctgccgcgccagagaagcatctaagcccatgggaagatgccttctgcgctccgcgcccagaggaaggaaaatgtcgtgggccaagcaggaatggagggaatagatagatccccacgaggtgctgcttggcttccccttcccgagccaatccagggagggtgcatggatgggggaaggcgaggtaggggtggcaggggagtgggaatattgcaactcggggacattgcagagacccgacgcacgcggtgggacctgcaacccttgtaaggaagcgggcacgccgtgggcgcaaccct

SEQ ID NO: 71842 - DNA, 320 bp, Homo sapiens; identical to SEQ ID NO: 33191
  chr10:94831610-94831930
  hyper

SEQ ID NO: 71843 - DNA, 408 bp, Homo sapiens
  chr10:94831980-94832388
  hyper
cgctaggattgtgcgggtccctccgacctctgcagatatttcctgatacctccgggtttggggactaccgcgagaagggcaacgcatttaaactctcaggagcagagttttccacctccaagggacgccttccaaggcgtgcggcgtgcttctgccagagacagtgttcagttttaaacaaatgcaggtcattctgtttcattttcggcgccgcaggtgcgttcagcgcccaaacccaggtagcgtgtgaccctgactggtcccgagccgggaagctccggcaggtggagagcagagagagcaggtgcgcgtcccgcagcgtctgagctccgggcattggcagctcagtagcagctgattgtagatgggcaaagtacagaagacttcccagtacggatcccttcaccc

SEQ ID NO: 71844 - DNA, 30 bp, Homo sapiens
  chr10:94832671-94832701
  hyper
ttgcccaaggtcacacgcagtacagatgga

SEQ ID NO: 71845 - DNA, 623 bp, Homo sapiens
  chr10:94833026-94833649
  hyper
cagatctgcctattgcgcccgatgccccgaggctctctcttggactctggccctgagttcttctgcgcgatccttcggagacgtctggaggcctgctttatgcatctctcttggacctcagtttccccacacgtgggaggaggcagctggacgattcctgaaaggactttcccttgcttcctcatcacgtggaagagagcccacccggcacctggaaatggaaagccagtgaaggctgctttgggccggggcagcgggtgggaccgggcgggagggattccaaagagaccgccgggaaggctagagcttggaattccggctcctcggagtcctggccctcccccaccgccgcctcggagctcagcacaccttggatgggggaggcgggcagctcctagccccgcaccccaggaggcgcgctcggagggaagccgccaccgcgccgcctctgcctcggcgcggaacaaacggttaaagattttgggcagcgcctcgcggggggaggagccaggggcccaatccgcaattaaagatgaactttgggtgaactaattgtctgaccaaggtaacgtgggcagcaacctgggccgcctataaagcggcagcgccgtggggtttgaagc

SEQ ID NO: 71846 - DNA, 969 bp, Homo sapiens
  chr10:94834033-94835002
  hyper
cccacttctctcctccgccttcctcccacagcggaggaagttcctgcagatgaagcgcaggaaatacggcttcatctacaagacgcatctgttcgggcggcccaccgtacgggtgatgggcgcggacaatgtgcggcgcatcttgctcggagagcaccggctggtgtcggtccactggccagcgtcggtgcgcaccattctgggatctggctgcctctctaacctgcacgactcctcgcacaagcagcgcaagaaggtgggggcaggaggcgacggctggacagggagggggaccccatttatgagcggaattccggctgatggatgctaggcgcgggctagcagcttgaggtgggctaggaccctctgccagctccaggttagctttcccagctcggagagtgccatgtgtctggcaggactgggggtgtctggaaggggacggcggtagacgagaggggcggatggaggcttttaacgctgtcccctcctcgggactcaggtgattatgcgggccttcagccgcgaggcactcgaatgctacgtgccggtgatcaccgaggaagtgggcagcagcctggagcagtggctgagctgcggcgagcgcggcctcctggtctaccccgaggtgaagcgcctcatgttccgaatcgccatgcgcatcctactgggctgcgaaccccaactggcgggcgacggggactccgagcagcagcttgtggaggccttcgaggaaatgacccgcaatctcttctcgctgcccatcgacgtgcccttcagcgggctgtaccgggtaagggcggcaaacgggctgcggactaggggcgcgggacctgggcgtctgctcaccgccgcgcgctctctgcgctcagggcatgaaggcgcggaacctcattcacgcgcgcatcgagcagaacattcgcgccaagatctgcgggctgcgggcatccgaggcgggccagggctgca

SEQ ID NO: 71847 - DNA, 30 bp, Homo sapiens
  chr10:95257302-95257332
  hypo
gtgagccaccgcgcccggccccaatcaacc

SEQ ID NO: 71848 - DNA, 81 bp, Homo sapiens; identical to SEQ ID NO: 33196
  chr10:95326983-95327064
  hyper

SEQ ID NO: 71849 - DNA, 281 bp, Homo sapiens
  chr10:95361159-95361440
  hyper
cctccaggacagcctcgggcacagtggagcggccgcgcggggtggcctcggccaggccaaatgcgccagcggccctggctcagttaccctgcactcgtgccagcggccgccagctgcggtctagggtggcctccggggccagtggctctggcaggaggctcgagtcaacctggcgggaagaccgtggcctcacagagcgagagcggacccgcgaggctccctggtgcgtgagtgcccaggccctggccatgccaaattggcgcctccgtctgccttctgag

SEQ ID NO: 71850 - DNA, 276 bp, Homo sapiens
  chr10:95753484-95753760
  hyper
cagctccgggggaggcggccgggtcctcgctccgcgcccgccttccccgcgcggcaggagccgggggcgggcccggcacaggccgctcccccgcccggccgcccgcggtggcgctagcggcctctcacccggggcgggcgagttctgggaaagcccggcccagggcgggggccccgctgccgcccgcgcagccgccgctgtccgggcagcgcgcacatctcggcgggagcggactgtgaacggcgcgggtccacacggtaacgctgggcaacgtgg

SEQ ID NO: 71851 - DNA, 82 bp, Homo sapiens
  chr10:95754132-95754214
  hyper
ggaaaagtgtcctcgcgctcccgggggacccgaggcgggcggtcctccagggcatgcaggccgccctcgcaggggctaaagg

SEQ ID NO: 71852 - DNA, 30 bp, Homo sapiens
  chr10:96157039-96157069
  hypo
ttcataatgtttcatcgatatacctagttt

SEQ ID NO: 71853 - DNA, 120 bp, Homo sapiens; identical to SEQ ID NO: 15380
  chr10:96304080-96304200
  hypo

SEQ ID NO: 71854 - DNA, 30 bp, Homo sapiens
  chr10:963402-963432
  hypo
tcttgactggaatggcgtattttaagatat

SEQ ID NO: 71855 - DNA, 30 bp, Homo sapiens
  chr10:9637898-9637928
  hypo
cttctcttaggcccccgagctgccctggaa

SEQ ID NO: 71856 - DNA, 30 bp, Homo sapiens; identical to SEQ ID NO: 42632
  chr10:97202907-97202937
  hypo

SEQ ID NO: 71857 - DNA, 267 bp, Homo sapiens
  chr10:978811-979078
  hypo
ctgggatcaaggccccggcccttccccaaacccccaacccacacccgggaccaaaaggccccggccccacgtttcctagaggcgctgggttcgggcccacgttgcaacgagtcagatgctcttggtagctcagggaggtgttcacactcctgccgtttccgtgaggatggtgacgactccgaactatagcagcatactctacctacccctgatcagtttatggaagaaaaggaaaccaaacaaagtatgttgcgtttcccttaagct

SEQ ID NO: 71858 - DNA, 593 bp, Homo sapiens
  chr10:98129731-98130324
  hypo
gccgggactgaaagccgggcgtgtctgactccacaactcctgctgtgaatcatcacactctgccccggccccagcgtctccgggacttaccccagagccacagaagcggccgagcctgggcgctgagctgtcgtagccgtcgtaggcttccatgtagtcgtagccgcagtcggcctcctcctcaacctcaaaggtccggaatgtcagctccacgccgtagccgtcctctgccacgatcacccagtcacagcgggcctcgctcgggtagttgttgtccccaaactgggcgtgggaatagagctctttggtctgcacttcagccttcagcctgcccccgcactctggagcagagagaagtgagatgtcccctcagcacaagacaccctcgtgcctcccgcctgcgtctgctcggctttctctacagagcctggtgcgtgcctggcaggagaggccaggtagtctcgtcaccccatttgatggaggagtacacagaggcccctggctcccaggtcagggctccctcgggggtgcaaagtggccctcacaagccaaggtcccctgttcccagcttgagaatacgtgagcatgccatt

SEQ ID NO: 71859 - DNA, 123 bp, Homo sapiens
  chr10:98272645-98272768
  hyper
gattagagcacctgccggcttccatctccgcccgcccagagcgaccctcaggccggtaccgctacagggaagtttccggctattcgagtcttgctcattctccctcggcgacccctttccttt

SEQ ID NO: 71860 - DNA, 30 bp, Homo sapiens
  chr10:98292766-98292796
  hypo
attgtgtgaaacaatcgcataagatttagc

SEQ ID NO: 71861 - DNA, 163 bp, Homo sapiens
  chr10:98398908-98399071
  hypo
gagatgtctcacactcggggacacctaacagatgtctcagtaccacctatcaggtgggtgaggtctttacactggaatactgacacactattccacccacaaagtcgagaattacatcttattttctggtagctcaaattcaagaaatcgctgaacacctatt

SEQ ID NO: 71862 - DNA, 93 bp, Homo sapiens
  chr10:98528133-98528226
  hypo
ctcacctcctgctgtgtgacgcggttcctaacagaccacggactgatacaggtctctgtaccctggtttaatgggtaccgggtttcagcttgg

SEQ ID NO: 71863 - DNA, 78 bp, Homo sapiens
  chr10:98808749-98808827
  hypo
cgcttgttggcgaggcgccggggactggcacagcgggcaccactcgtctcgatgggattggtgcgcaggaagtctgcc

SEQ ID NO: 71864 - DNA, 32 bp, Homo sapiens
  chr10:98944809-98944841
  hyper
gcagctggctcagaacgcggccgtagccccat

SEQ ID NO: 71865 - DNA, 205 bp, Homo sapiens
  chr10:98945047-98945252
  hyper
gggatggggaaaccacggcgctcctggctcctggctcgggaaagaccccggcaggcactgacccgtctgtgggctgcggagcccggacgggccccaatggtcctgcccccacccccaagtccggaattgcgtctgggtgggagggcaacctcggagccagggagccaggggcggggaccatactcacaggcgctcggtgttccga

SEQ ID NO: 71866 - DNA, 274 bp, Homo sapiens
  chr10:98945472-98945746
  hyper
gccgctgaccatccccgtccggggccgcctccaggtgcagtcccggggcagagccaccgaagagcccgcgggcttgcgcgcggcgcccctgcgggctgggaggcaccttgctcctccaagcgacggcgcctgtgcgcggacggagggagggcgccttgggcggagggggctcggctcctctgccgtttcgccgcctgcgtctccctctccctccctccagctcccaactgactgctgcgaggaggaaaatgggcaggccccgcgcgcgcacgca

SEQ ID NO: 71867 - DNA, 261 bp, Homo sapiens
  chr10:98945806-98946067
  hyper
cccggcagtcatccatcaatcgaaaagcacacatccagggccaggctcctccccgccctcccccgccgcagcccccctctcccgacgaccactcagcggctgcaagccgcctacagtttcaaaggtggaacctccgaggcgccgtcagcgggcacggggctgcgggggatgggagaagagggaagggggtgtgactcgacccgccaagtcctggctgtacacacacacacacacacacacacacacacacacacacacaca

SEQ ID NO: 71868 - DNA, 106 bp, Homo sapiens
  chr10:98946094-98946200
  hyper
cgcaccccggcacccgcggccccagctgctagtccagggtgggagggagatcttattttgccgcttggacgccttcccggggagtcagacccgtttccccccatcc

SEQ ID NO: 71869 - DNA, 71 bp, Homo sapiens
  chr10:98955979-98956050
  hyper
aacattcaccagccccggcccgcggcgtcggggcagcggcgcggaacccggagtgccggctgggttcgcgg

SEQ ID NO: 71870 - DNA, 30 bp, Homo sapiens
  chr10:98986334-98986364
  hypo
atgtttactaaaagccgactcagcacaagg

SEQ ID NO: 71871 - DNA, 78 bp, Homo sapiens
  chr10:99051344-99051422
  hypo
ccggccccgtatgatattttaaataacacactcaaccacgctcatctgggctcaggaagaagccgagtcacaaagtta

SEQ ID NO: 71872 - DNA, 272 bp, Homo sapiens
  chr10:99080175-99080447
  hyper
gaggaaccgaaaaatcgcgagtgtttcgcgggtaactggggttgagggccaaaatatttggaatgaaggactttggccctatttaaggcagattttacagagcgcacctcaaacgtacaagtcagtaggactccttatttggcgtgacccgacctggccgcggagcctgcatttcctcgcagcctctcagtgccctccagccccgcgaccatgtggccacaatccacgcttctccggatcgcggtgcgccggaaccacggaggatgatgcca

SEQ ID NO: 71873 - DNA, 93 bp, Homo sapiens
  chr10:99080838-99080931
  hyper
gcacgcactgggttgcgggacagagtagccaggttctgccggtgctcggagaagagcgcagtgttttgcaagtgctggagtctcctgaggaca

SEQ ID NO: 71874 - DNA, 548 bp, Homo sapiens
  chr10:99531097-99531645
  hyper
cggcgatgcagaggtcgttgtccagggggaacttgtggcagtgcagcatctcaggccaggggaagccgtaggcctccatgagcggcgcgcagccggcgcgcacggcctcgcacagcgagcggcacgggtagatgggccggtcgagacagacgggcgcaaagagcgagcacaggaagacctgcgtatccgagtggcagcgcttggccagcagcggcagccagctgctcgcctgctgcttcacttcggccaggctctcgtgctccagcaggttgggcagccgcatgcgcttgtagcccaccgtgtggcagagcggcaggtcggcagggatgtcaaggcactgcggcggcttggagtaggagcggccgtgcagcggctcggcctgccagccatagtagtcgtactcctcgcagcgcgccggcgcccagtgcagcgcccccagcagcagcgccagcgcggccgtccgcacgcccccccccgccgccgccgcccgcatggctgcgccctctccaggtgcgcgccgcgcagccccccgacgctcggtgcccggc

SEQ ID NO: 71875 - DNA, 233 bp, Homo sapiens
  chr10:99531646-99531879
  hyper
gcccaggtgttccggcgtgcgcccccggccctgactctacccagccgccgccgccgccgccgcggaggtcgcccaggtgggtggcagcctgcgctgcgggcgccccgactgatcctggcgcctcccacctcggggctccagcccgggcctcgccgtgcgccccagccaatctccggccgcctggccccagctccaaggcggggaggcagtgggggcggccctcagcccctccc

SEQ ID NO: 71876 - DNA, 181 bp, Homo sapiens
  chr10:99531880-99532061
  hyper
caccctgcccgagcgtcccgcccagcgccaggtcttgcgcccctctcccggctcggctcccctgccgcagccctggcctcgcccagcgtttctccccagggctccctgcctccctgggcattttcctcgaccctcgccttctccatccttcctccttatctctctccgccacagcctctcc

SEQ ID NO: 71877 - DNA, 266 bp, Homo sapiens
  chr10:99789105-99789371
  hyper
ttccacttggcttcacgtggaaagtcctgcacccatcccagaagacacctcaagtgcaactcaagaatgtgtcctgtcaggagaacggaagcatctcctgggatgtgcagaagccacactgggtgcacccaccagcagcagcagcggcggcggcggcggcggcggcggcggcggcggcggcagcagcagcaatattcattagtcattcctggaggaagcccccccagctctcaaccctaggagaatttccccgccactctgggagg

SEQ ID NO: 71878 - DNA, 371 bp, Homo sapiens
  chr10:99789599-99789970
  hyper
gggaagaccacacctcgtccagcataaggcggctagcagctacgccgcgcgcggggctggctcccggagctctctgccacccagcgctgtgcccgggaactcggcttcccaggggaggaagagccagcccgcggggctcttccccagcctggaagcgtaggcactcggccgaggccagtggcttcccaggcccgggtctcagcctggctgactgggagactctcccgatagcccggcacatccctcctcacccgctccgccccctccaggccccagaggccccctcccctgacagctgacctccagtgcgcccccaacactttctctgccagctgctggctgtcgcccccacacatcagctcccacctctc

SEQ ID NO: 71879 - DNA, 319 bp, Homo sapiens
  chr10:99790021-99790340
  hyper
cgcgcgccaatcgagtccagcgcctcccagcaagttaggagcgaagccgccgccttcgcgatcccagtcttcccgggttcccgggcggcgtccccgccacccttgcgggcggatccgggggggcgcgcagagctggagaaactttctccgccttagggtggggggcaccggtgcagatactcacgccggggtcagcgctcggagccatcctcccgctctcggccccgccgcctaggggcgtgggaagcgggcgctcgctgccgcctctgccgccggcgccgccgcctgcttgctcccagccccggtcccgggctggcct

SEQ ID NO: 71880 - DNA, 323 bp, Homo sapiens; identical to SEQ ID NO: 902
  chr10:99790437-99790760
  hyper

SEQ ID NO: 71881 - DNA, 260 bp, Homo sapiens; identical to SEQ ID NO: 903
  chr10:99790917-99791177
  hyper

SEQ ID NO: 71882 - DNA, 53 bp, Homo sapiens
  chr11:1001969-1002022
  hypo
tgcctcagggcgagccggctgtggtggctgctggcacacggctcacaggacag

SEQ ID NO: 71883 - DNA, 50 bp, Homo sapiens
  chr11:1008075-1008125
  hypo
ggtcaacatagagtgcgtgtccgacttcacggaggcgccagtcctcaaca

SEQ ID NO: 71884 - DNA, 140 bp, Homo sapiens
  chr11:1008417-1008557
  hypo
gacagccagggcccccgcgccacctgcccggcttggtaccagacgacagctgtggggtgcaggcagctggtttccttcggccccctggcctggggggcgcgttttttgctcagttgagctcagatcgtaccactttgctt

SEQ ID NO: 71885 - DNA, 1086 bp, Homo sapiens
  chr11:100997659-100998745
  hyper
gctttcggttctggccggccacctctcaagtcccacccctcccgggggaacggtgccttaactcctctccaagacaagcactcctggtaaacgtccttcttctaagaaagaagcatttcataaagcccccaactcgccgcgcactttctgccccactgggctacagcggacctagtgtgacgctgcacgttttaaatcggggttggttctgcttcggaatctggaagattcggaaagttaaaaaacaaacaaaaaaacagctttcagggaggcacgccccaaaaatagtatattctgcgcccaccttcgtgtccccaagagtgaggagaggagggaagaagaagggaggcaactgcccctgtgctgtgtcccgctgcccaccctctccggccgccccggggagcgcagcggtgcgctggggctggggctgagggttggcggccgccgccgccaacggaaccgctactcccggacgcgctgggcgtgccccgtcccgggccctcacctcaggtagttgagatagggcgggtagacctgcggcaggccctccttgagcacggcggcctggtagccgagctgcgggagcccgttgaggccgagtgcagggtagagcgcgggggccgccccggcggcggcggcagaggcggaggtggagggcaggccgtcccgcgggagcaggcagccgctcgcgcccggcgccttgcagggcggcggcgcgaacgggccctgctggggcggcgcgccctccgctttgtacaggatgcactccagggtcgaccccgaggaggacgcagacgagactgaggcactggcgggtgcggccgtcaccgccgcttccccgggtctggatggggtcgctcgcggcggcagcgggggcggtggccccaacgggaaatccgggaaggctgcggggttggcaccggccacaaggtaggaacgcggggagcgcgcggaggcctccgcgccttcctcctcctcctttatctttagagcgggcggctggaagtcgctatagagagggtacgcgtcgtccttgggctcggcgtcgggcgggtacgcgcagtcggggaagtcgcctacagcgac

SEQ ID NO: 71886 - DNA, 40 bp, Homo sapiens
  chr11:100999320-100999360
  hyper
acacccgctgggtggcgggggcagccggtggatcttcggg

SEQ ID NO: 71887 - DNA, 118 bp, Homo sapiens
  chr11:100999601-100999719
  hyper
tgtccctggcagggccgagggaagagtagcccgtccagggagataggtatggccgaaacttcaggcaaggtgtccgaggtctggctccccgggaacggacctgcggctgggcgacaca

SEQ ID NO: 71888 - DNA, 74 bp, Homo sapiens
  chr11:101000148-101000222
  hyper
gagtactcacaagtccggcacttgagtggctgcggctgcgacggcaatttagtgacacgcggctcctttatctc

SEQ ID NO: 71889 - DNA, 43 bp, Homo sapiens
  chr11:1011399-1011442
  hypo
tcctgtcagagtgggcgtccccaggccacggtgcaggcctgag

SEQ ID NO: 71890 - DNA, 18 bp, Homo sapiens
  chr11:101361883-101361901
  hypo
ttagaaaatcctaaccgg

SEQ ID NO: 71891 - DNA, 448 bp, Homo sapiens
  chr11:101453090-101453538
  hyper
tagagctgagaacctcgggaaaccgcttgcgggtggatgtgacaagtcaggaaacttgactacccaatcacccaaaggggcaatgggacagaaatgctatctgcccgctgcacatgtggtcacagcggtgtcggggaagcggagtcttttcttctggagtccactctgcttactccctacctcccctcccgccacccacccagctaaaaaaaaaaataccctagattcataaacaaaagcttgcagttacccacagcccaatacaaacgacccgacgccctcacttctatagcccgtgagtctcccagcccctaacaggctcgtctccccagacgccccgggtgaaaaggttcgcgccgccggtggagagtcctattggttctatttctgtcttcactccaaggccccaggaccggggagaggtcctggtctaactttggctgtccca

SEQ ID NO: 71892 - DNA, 237 bp, Homo sapiens
  chr11:101454510-101454747
  hyper
gggcagagagggcacaggcggggccgctggtggtagcgaagcgtaagagcggagagcaagggagacggagctgaagagttactatgtcaacagagactctccagccctcagctcccgccttcatcccccgcactctccgtcaagatccccacctttaaagggatccgagcgacgttctagaaagcagccaaagcctgtcctgtagccacaactttcaggaggcggtatgagcctgaa

SEQ ID NO: 71893 - DNA, 330 bp, Homo sapiens
  chr11:101918176-101918506
  hyper
aggcatccacccagccgagagcacgatggctactggggagctcggggacttgggtggctactacttcaggttcttgcctcagaaaaccttccagtctctgagctctaaggagatcaccagccggctccgccagtggtgaggaaccgaggcacagggagagaagaggcccttggtcttcgcggctgtggaggcgcaggccgggcgtcgaggggcccgcgcgggtcggcgccattctgagtgaaccctgaggcttcctgagtgaaccccgaaccacccgggaagggcggatgctgtgggtgggatcggttatcggtgcgctctgagagggtg

SEQ ID NO: 71894 - DNA, 330 bp, Homo sapiens
  chr11:101981634-101981964
  hyper
cgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggtaacctcgttgcccctctccccgtttccccgtcgggcgggcctcagaccgggggggcgctcgg

SEQ ID NO: 71895 - DNA, 89 bp, Homo sapiens
  chr11:101982771-101982860
  hyper
tacagtcggctgaaacgcttttgaattagccacatctgtacgttgcgcaggaactgagttgcgctttacagtaccgaggttttaacaca

SEQ ID NO: 71896 - DNA, 20 bp, Homo sapiens
  chr11:102158481-102158501
  hypo
gcgcccggcccctgtttact

SEQ ID NO: 71897 - DNA, 96 bp, Homo sapiens
  chr11:1024000-1024096
  hypo
gggcgtaggcagccacggcatcgcacagacactcacagtccccgccactgtcacacccacatgcgtcgcgcacgcaggcctcgtagtagggcaggt

SEQ ID NO: 71898 - DNA, 344 bp, Homo sapiens; identical to SEQ ID NO: 42870
  chr11:1024866-1025210
  hypo

SEQ ID NO: 71899 - DNA, 308 bp, Homo sapiens
  chr11:1025881-1026189
  hypo
aggtgggctgtgagtcgttgacaccacagacgtcctgcagggagagggcgctgaggaggagccctggaggccgtgcctctgggtccccggcccctgcggcctggcacccgatggttaccgtggccaggatgtactcgcagttgccgtcgaatacgaagcgctggccgtcgaaggtgatgacgtggccctccccgtagagggtgcaggtggatgggcagtgggtgccctgctgacaggcccacctcccccttgagcaggagctgtggagacagcaggtgtgggtggtgggcctgcggccctcctgccat

SEQ ID NO: 71900 - DNA, 305 bp, Homo sapiens
  chr11:1027283-1027588
  hypo
tgacagtggactgctcggccaggatgaacttgtaaccctccagtatgcacgggcactgggccttgcgcacacactcgcccttttggttcaggtaggtgccatcggggcagttgcaaccgtccacgggcacggcgctgtggtggcactcggtggcacggtccgacagcgacaggcaggtgcgctcacaggcttggctgttgtagctgaaggtggtgttacccgtgcaggggatggctgtgggggacccgggcatcagactctccgggagggggcggccgggagggcaatctcgggttcccctgcct

SEQ ID NO: 71901 - DNA, 125 bp, Homo sapiens
  chr11:1028245-1028370
  hypo
caggggtcagtctcacgctccagagcggccggacagttccccgcccgccaggagtccacaaacagcgaggcggtgccctcggcgatacccatgctagtggtgaagtcatccgttgtgtccccgtt

SEQ ID NO: 71902 - DNA, 447 bp, Homo sapiens
  chr11:1029178-1029625
  hypo
tggggtcaccgggagcgcccctccccacgggccacagggctcgtcctacctggaggaggatgtaggtgcaggtgccgtggaagcggtagggcctggcgtcaaatgtggtaacaaaggagccaccttccagggagcagtgtccggggcacggccgctccgtgcacacccagcggcccagggtgcaccggctgtgggtgggcgtgggggtagcggcatggtgggcagggccgctggagccagacagcacacccctgcctgccctaggccagtggaacccctgccggccggccagagccccctccggcgcctcactcaccaggtttggcaggcagctattgtgacctccccgggggcatacatggcgccgtggagcacacaggggcactgggtgacgggcacgcaggtgtggttattggagaggtcattcaggaccgtacctgcaggaga

SEQ ID NO: 71903 - DNA, 31 bp, Homo sapiens
  chr11:102961347-102961378
  hypo
aaagcatttctcagtcgggcgaggtggctca

SEQ ID NO: 71904 - DNA, 66 bp, Homo sapiens
  chr11:102980422-102980488
  hyper
caacttcttggatgacggcaaccagatgctcctcagggtgcagcgatccgacgcaggaatctcctt

SEQ ID NO: 71905 - DNA, 177 bp, Homo sapiens
  chr11:1030131-1030308
  hypo
gtgggtggggtctgacgtccccttgtctctgggttctctctaggggtcccggggagagagagtgcctgcgactgccctcaccttccgggcagaagcacccgaaggtgcaggagctggagcagctgtgctgcgggttggagcaggtcttcacgcaggccgagccgcactcctggtaca

SEQ ID NO: 71906 - DNA, 30 bp, Homo sapiens
  chr11:1030716-1030746
  hypo
agggctccttggacacgctgcactcagggg

SEQ ID NO: 71907 - DNA, 30 bp, Homo sapiens
  chr11:10326950-10326980
  hyper
cagtcccctctgctccgtcagccaagttcc

SEQ ID NO: 71908 - DNA, 96 bp, Homo sapiens
  chr11:103327717-103327813
  hypo
tcatgcactgcataacgatgtttgtcaatgacaggttgcacatactacagtggttccataaaattataatgaagctgaaaaattcatattgcccgg

SEQ ID NO: 71909 - DNA, 36 bp, Homo sapiens
  chr11:103327933-103327969
  hypo
tagtacataatacttgataaccgttcatgctttatg

SEQ ID NO: 71910 - DNA, 712 bp, Homo sapiens
  chr11:104034042-104034754
  hyper
actgctagattgaaacgcacgatttctcctctcactcgtaaaaataaataaataaataaataaaatttaaataaacgtctatcacccagggaaagctactcttgactccttccacctatcaaaattgcctaagaaaggttgagtctgaccaaggggcggcgcagcttgcaactttcgccaactccgggatgaggcaccgcatcctggtaccagaggcttggacaccaaaatgacttctctagggtgcagcaaggtgagccacctggcttatcctatccccatcagcacgcgtcccacacctctcagtcccattccggaaatggagctctctcaggactggatacaggcaggagacctccctccccaaacaatgcattcagcccgagttcacattcaagattcaaaaagaaaggggaaaaacatagaaagaacaataacaatagcaaacatgatttttttttcagttaaaaaataaaatgagtctcttaccatctcgcctgaggttggcgttgcgcaaagctttgatggatgcgctctgcggggttgcagaagtgtcccgacagctgcaaaagtttgcgcagattagagtgtagacaaagatgagccggtgcatttgggatcagcgactagagacagcgtcgctccaagaaaaagccgggttctgctcccgggaccgacgccgcgccgccctgcgctctcgccgcctgcgctc

SEQ ID NO: 71911 - DNA, 463 bp, Homo sapiens; identical to SEQ ID NO: 3788
  chr11:104034755-104035218
  hyper

SEQ ID NO: 71912 - DNA, 25 bp, Homo sapiens
  chr11:10405168-10405193
  hypo
tctctctctaggagtcgtcatttat

SEQ ID NO: 71913 - DNA, 21 bp, Homo sapiens
  chr11:104099607-104099628
  hypo
agccaccgtgcccggctattc

SEQ ID NO: 71914 - DNA, 51 bp, Homo sapiens
  chr11:1043870-1043921
  hypo
tgctgccacttctcccggcgtggactggctggatcacgtggttggcgtctg

SEQ ID NO: 71915 - DNA, 84 bp, Homo sapiens
  chr11:10468369-10468453
  hypo
gaagacaaacctctacgatttttttttcagggattttccaagtcatgcaatacttagttgtgtactttttaaaaattatttttt

SEQ ID NO: 71916 - DNA, 495 bp, Homo sapiens
  chr11:10472027-10472522
  hyper
ctgggaaaagttgtgcggggaggggaggacgtcgggcaagcccgggcggcacggggagcggtgtggaagcccggcggggccagcgcagttgaggtctggggagcccggctggcatctgctccgggctgcggcgcgggccccgcggagcccaggaggcggcgggtgcttccggccaagggccctggcggccgccgcgcccctgctgctctcaagtttcccgttggcggcgcggcccgggcgcttcaggtagcctctcggctctctctgctccgctccgcgcccaggtagggcaccgacgggggctgcacgcggctggccggcttcctccctgctgaggcggccctccctcctcccgcggggccctcctggccggggatccgcagcgctgcgccctctgaacgcccggcccccgcgcctgctgcggggcgcggcctggccgggccctggccccggctggcctcagtgcccagcagccccgctccgctctgcccagcg

SEQ ID NO: 71917 - DNA, 46 bp, Homo sapiens; identical to SEQ ID NO: 33630
  chr11:10472557-10472603
  hyper

SEQ ID NO: 71918 - DNA, 214 bp, Homo sapiens
  chr11:10509593-10509807
  hypo
tggttttgcatccttcgggatcatgtggatttaaagaaaagcctctgatatgctcagatctctgcctctcttctcccaccaaggggatggcagccttgtccggggctcctggcagtctccgcctgcaggggccgcaactgcggtaggagcgaaggttaaatgatcatggccctagcctttccattctcttttgctgaagcgctgtgcagtgagg

SEQ ID NO: 71919 - DNA, 39 bp, Homo sapiens
  chr11:1053231-1053270
  hypo
gagcctgcacccctacgcgggggacgcctgggcagctcc

SEQ ID NO: 71920 - DNA, 66 bp, Homo sapiens
  chr11:105480721-105480787
  hyper
ggctctccagattcccgggctgtttgctggtgagaaatctttgctgcagcgaggaccggagtcccc

SEQ ID NO: 71921 - DNA, 459 bp, Homo sapiens
  chr11:105480858-105481317
  hyper
cgtcctcctcacgaacctgcaaggatgcggcaggggcctgggggcatggggaggtactaaccccccggagcccccgattggggcttgcagacctggcccgtgggcggattttctgcctagcgcagccgagaagcagaggtgccaggaaaaccaagagaggggcgctgggggtgcccatccccagagtcggtccctctgcgaaccgaggaagaaaagaggagggagtcagcgagtggtcagaagggaaaacctgacaccagactggctccggagcgtccgggagactggggcgctccggtgagcacccagggggtgaagccagccgagcggtgggcgaggggcgtgcggagggagtgcgcgctcgaggaggggacgccaggagggcagcgatgctccgggctggtgcaggcttgctgggggatgtcggctgatgcgagctggagagcgcgtgtggcggcc

SEQ ID NO: 71922 - DNA, 1 bp, Homo sapiens
  chr11:105481318-105481319
  hyper
c

SEQ ID NO: 71923 - DNA, 2 bp, Homo sapiens
  chr11:105481320-105481322
  hyper
gc

SEQ ID NO: 71924 - DNA, 554 bp, Homo sapiens
  chr11:105481323-105481877
  hyper
ccagtgtttgtgtgtatgtgagaaagcaaggggcgagcgcgagtgcgagtgaggcaaagatagagcgcatgtctcatccctgcgagcagccactagacgctccaccaccatcttttgcatgtgcaacatttgcagccggacagaaaacctctcccagggctatggagactgcgggaaaaatctggcggctcgcgatggattgctaaggagaactagtcataatcttaaaccaccgaaacctctttccttttttttctttcttttctttcttttctttttttttttttttttttggttgattttaattttagcgccatcgtcttcaatgcttctctgaacagcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtaaggtgtgctccgatggggtgtgcatgtggctggttgtagcagatatccgaaagtgagttaaa

SEQ ID NO: 71925 - DNA, 30 bp, Homo sapiens
  chr11:1055284-1055314
  hypo
ggaccagggtcaatccggggtgccccaggt

SEQ ID NO: 71926 - DNA, 30 bp, Homo sapiens
  chr11:1056507-1056537
  hypo
ccctgtcgcaccagccgcctgcccacacag

SEQ ID NO: 71927 - DNA, 808 bp, Homo sapiens; identical to SEQ ID NO: 34035
  chr11:106888283-106889091
  hyper

SEQ ID NO: 71928 - DNA, 798 bp, Homo sapiens
  chr11:106889400-106890198
  hyper
cgttgctgtcctctgcgcgccctccctgctccgaggaggtgcgcacaggagctcgggtcggactgagggccccaaccccaaacgccttatcctcggccctcgggagcagatgggtcccggcggcgctggtggggagaagggctcggggctggggggcgagaggcctccccctggagccaccttggggaaacctgacagtgtgaagtgggggttagggtccatgttgtcctttctccgagtttatttaggaagttccgaggcaaaagggaaaggccaagcgtccagccagcccactccagaggagacgctttcaggggaagggaaggacaggggcaacattttggcgcccatcctgctggagcagctcctggggacttgtgttccccgcctcgtgcgaggccgtgtgggcgcggagcgagcccagaaaggggcggcagtgaggacagcgtctgctctgacaagacagcactgttgctgagcctcagccgggcggggtgcgcggggctcccggctccgctggctcctcactagtgctggacagctccgcttgccacctatagccgcctttgcaggcgttgagaactggagaacagttcctcctcaaacgacctagcacctggcccgggggaaaccggggaatgatcccacgtccctcatcctcagggctctttgcgccaaatatgcgatctgtttgcacctgactgcaaatgctgctcagaaagctaaggggagtagggataaatgcttctcgaactgactcgccacagcgcgagcatgtcttgccgcgagttttcagct

SEQ ID NO: 71929 - DNA, 30 bp, Homo sapiens
  chr11:107047782-107047812
  hypo
cgcgggcaagcacagcgtgggcaatattgc

SEQ ID NO: 71930 - DNA, 1339 bp, Homo sapiens
  chr11:107461396-107462735
  hyper
aaaggcgggggctgccggttggggtgagggatagggttctgcagtcccgggaaggcaggtgaagggtggggatcaggattggaagagtcactgggtgctcggtgagacgagggaggttggagctgaactaaaacaaagtttgacttctggacaattatccagggagagggcggggaacacaccttgcccggactgtctgggaatcccattgacaggtcatctcaggttcaccatcttcctgtcgtgggctcctccagggaggccacccgggagcaattaaactgggccacaccagccacctcccacagcagcggggtccgcagatttaaccctttccccccagattccggcactgggtgccgcgctctctcccccagcaccgcgcccgcgcccccggctcccggactgggcatgctcagtagccgcccgcttcgtgctcccagggaagcctctgcacgccctcccccgctgctctcggtcgcctcctcgccgccagccgccccgggtgcatcccggcttgctccgctccacgcgacccagattcctgccccgcccccgccccttccgcgcccgcagccagtgcggcagccgcggccgcccctgtccagcctcggcgcccgggaccgagcgcgtcgctcgccgccgcggagcgcgtagccggagcgcctggggaaggcggagatgaagaccacgccgccgcgcgccgggagctgctgagcctaccgccgccagagtccaggtgattggcgaccccagaggagcctagggagtaggggcgaatgcccttggggaggagagaggtgcggcgaggacgcgaggcatcacgcaagctgcgctgtgcctgggaggcagcagaaatgctaagcatcgggggcagagagggaacgggaatgaaagtgcactctgccttggtgcaggggctccggggtcacccaggacagtgatttccccttctatcctgtcctcccaattaacacccgagaggctgcaggtcggcgcgagaggctgtttgcatctcggcccgggcgtaggtcgcctagcgacctaacgccgagggctcggggaagggatcccagacagagccaaaatggaaggcgggacaagggcggcctggctggggcgaggggctggtctgggtccctgggaaccccttgccttgtgggcttcggtctccagggaggagctaggcagccgggctgcggggccgccggactgtggggtcctccgcgcagcgagctgggaggagcggtcggctgggctgttgagctgcgcctcctccaactgctgggaaactccgcacttcaatattggagcatctctttcccgggcaggtagaatt

SEQ ID NO: 71931 - DNA, 212 bp, Homo sapiens
  chr11:1075735-1075947
  hypo
cttccccggcctctgcgactacaacttcgcctccgactgccgaggctcctacaaggaatttgctgtgcacctgaagcggggtccgggccaggctgaggcccccgccggggtggagtccatcctgctgaccatcaaggatgacaccatctacctcacccgccacctggctgtgcttaacggggccgtgtgagtgtggtcggtggcacccctcc

SEQ ID NO: 71932 - DNA, 203 bp, Homo sapiens
  chr11:1077565-1077768
  hypo
acccaagagtgaccccgatgtgcctccgccagggtcagcaccccgcactacagccccgggctgctcattgagaagagcgatgcctacaccaaagtctactcccgcgccggcctcaccctcatgtggaaccgggaggatgcactcatggtgctcaggggtccccggactcgtggggctggtgggggctccgtcaggcctctggg

SEQ ID NO: 71933 - DNA, 1236 bp, Homo sapiens
  chr11:107798867-107800103
  hyper
acgcctgtaagaaaacgactctcacttttcattggctgaccctcccggagttgagaccttgcttcattttccttggttgttgctgctgtcacgtcttcccgccacgcccactttcctgccggcgcccagtgagcgttgagggagagtgatttgcagccggtcaggggcgggagttcgcggcagcaaacctgcttccccctcccacgcgccaccgcccccgccccgcccccgtccagaggccccgcccctagccgggcctggccccgcctctctctcccgagagggcgggcaccaggcggcggccgcagccgcaggaatatgctggaaggcggcgggcgggcgcccgcgaggtgctgaaaggacagttcccgccgccgaacttagcccgcgggtggggcggcccgggagccagcggggcacgtgagcgatggagaccatctggatctaccagttccgcctcatcgtgatcggggactccaccgtgggcaagtcctgcctcctgcaccgcttcacccagggccgcttccccgggctgcgctcccccgcctgcgaccccaccgtcggcgtggacttcttctcccgcctgctggagatcgagccgggcaagaggatcaagctacagctctgggacacggcgggacaggagcggttcaggtagggaccccggggaccttgggcaccgcgccgccccctcagcccgcccggacgccccttccccaggcgtccgccccgccggccctggtcgggagaggctctggcccttccctctcgaaagtgcaaacactccattctcgcttcccctttgcccctcctcttccagggacgacttcctcctccgcaatttctcacttctttctttggcgcccatttcctgcgccccctttccatctttcctttcccgcctgaaccggggtcgtcctcgccgccccctcttccccaactctttcagcccctgtgggtatttttatcccctccggctccccggctgccttcttcccaaactcggcttccctggctgcgcacagcatgacccgaccaccctcctccaagcaggcgccccttttcctaccctaacccagcggctcccacgctgtgtggccggggagaaccgcgagggagggttcccagattcgtgatggatcctttagcttcacagcaaggagcgctccaacccaggttcctgcatgagctcactgggcatggttcacagagaggtggatgcggtaatggtttggg

SEQ ID NO: 71934 - DNA, 18 bp, Homo sapiens
  chr11:1078768-1078786
  hypo
tggggggacactcaccgc

SEQ ID NO: 71935 - DNA, 102 bp, Homo sapiens
  chr11:1079561-1079663
  hypo
ctcaccgtgggctgagagcccttctcggtgcacttcggggtggagcggctgctgtgccccagcctcaccctcactgcgtggcctctgcggttccagccaaga

SEQ ID NO: 71936 - DNA, 126 bp, Homo sapiens
  chr11:1080203-1080329
  hypo
tggctggcagcccctcggtggggattctggctctttctgagccagccggggtgacatcgcctccctggctgtcccaggcaccgtatatgacgacatcggggacagtggctgcgttcctgtgagcca

SEQ ID NO: 71937 - DNA, 37 bp, Homo sapiens
  chr11:10811151-10811188
  hypo
accctaggccgggcacggtgactcacgcctgtaatcc

SEQ ID NO: 71938 - DNA, 29 bp, Homo sapiens
  chr11:10815867-10815896
  hypo
acatttgaagctgggcgcggtagctcacg

SEQ ID NO: 71939 - DNA, 208 bp, Homo sapiens
  chr11:1081640-1081848
  hypo
cccctcaggcctctgcgggaacttcaacggcctggaaggtgacgacttcaagacggccagcgggctggtggaggccacgggggccggctttgccaacacctggaaggcacagtcaagctgccatgacaagctggactggttggacgatccctgctccctgaacatcgagagcggtgaggctcggcaacacgggcgcccccacctagcg

SEQ ID NO: 71940 - DNA, 30 bp, Homo sapiens
  chr11:1082664-1082694
  hypo
ctgcaccgccaagggcgtcatgctgtgggg

SEQ ID NO: 71941 - DNA, 30 bp, Homo sapiens
  chr11:10828053-10828083
  hypo
tgaccatgttgagtgcgtactactttacta

SEQ ID NO: 71942 - DNA, 68 bp, Homo sapiens
  chr11:1083440-1083508
  hypo
gcctggggtggggggcgctgagaggcatcaggctcacatctgcggggaagctgcgggctgtctgtggc

SEQ ID NO: 71943 - DNA, 48 bp, Homo sapiens
  chr11:108540610-108540658
  hypo
agaagctggaaaaggcggggaaatggactctgccgtagagtcatcaga

SEQ ID NO: 71944 - DNA, 30 bp, Homo sapiens; identical to SEQ ID NO: 42882
  chr11:1085664-1085694
  hypo

SEQ ID NO: 71945 - DNA, 30 bp, Homo sapiens
  chr11:108603360-108603390
  hypo
agtggagaagtgccacgagtgatgaagcaa

SEQ ID NO: 71946 - DNA, 100 bp, Homo sapiens; identical to SEQ ID NO: 43016
  chr11:10865202-10865302
  hypo

SEQ ID NO: 71947 - DNA, 57 bp, Homo sapiens
  chr11:109292773-109292830
  hyper
ggcttggagccctggcggtggctgcctgacgtcaccggcctctctggcaataggctg

SEQ ID NO: 71948 - DNA, 353 bp, Homo sapiens
  chr11:109292891-109293244
  hyper
cgcggctcggtctctggtccattcactccacgctttctgcagccgccactgcagccgcgcggcgggggctccctccttgcagccagccggcggtccaggtaagagacaaggtgtgagtaaaggcttctgatggccgggtggcctgacggccaggtgcgagtggggaggacagctcacgcggcctgagcagccacccctggccatagctccagcccccgcccctgcccccggcccctgccctggcttgcttgcgcgctacctcgctactccgcagtgcaacagtttgcagctgcctcttgggagcagcaaggaggctctcctgtgcgctgcgggtctaccggctccagtatgcc

SEQ ID NO: 71949 - DNA, 258 bp, Homo sapiens; identical to SEQ ID NO: 34043
  chr11:109293506-109293764
  hyper

SEQ ID NO: 71950 - DNA, 26 bp, Homo sapiens
  chr11:109293873-109293899
  hyper
cgcggtgccggcgcagaccccatcct

SEQ ID NO: 71951 - DNA, 76 bp, Homo sapiens
  chr11:109294113-109294189
  hyper
caaaggaaaggggagcgtggagacgtgttcgaggtggtatcggcgaggatctctcgggcgccgctcactccttggt

SEQ ID NO: 71952 - DNA, 44 bp, Homo sapiens
  chr11:1094014-1094058
  hypo
aaggcacgttctgggcgcctctctgcccacgaagcttggtcact

SEQ ID NO: 71953 - DNA, 219 bp, Homo sapiens
  chr11:1094942-1095161
  hypo
agatcgcagtagaagcgtctcaggaggcagcagccgtcgagggtggctgtgtccagggcacggcttcccttgggtggcctctgtggggacctccgctgtggggacctccacggggtccagcggctagccctgcctccggatagccctgcctctggacggtgtgatcgtgggtctgtctcccttcgcaggtgaggaggtgtacaacggcacatacggaga

SEQ ID NO: 71954 - DNA, 116 bp, Homo sapiens
  chr11:10952367-10952483
  hyper
ctctgctggaagcttcggcagcggctccgaacgcttcccgccgcctcgcccggccgcagccggttcttcgtgctcctcgctcggcgcccactggccgccgtcgccccgaggctgcc

SEQ ID NO: 71955 - DNA, 118 bp, Homo sapiens
  chr11:1095551-1095669
  hypo
ccgtggaagccacttcggcctccagcctcccggctcagcacccgcccctcctgagcgcagaccaccccatcctgtgccggtccccctgacgtcccttgcctcccgtccccaggagaac

SEQ ID NO: 71956 - DNA, 21 bp, Homo sapiens
  chr11:109661438-109661459
  hypo
ccaccacgcccggccgatatt

SEQ ID NO: 71957 - DNA, 30 bp, Homo sapiens; identical to SEQ ID NO: 43243
  chr11:109880267-109880297
  hypo

SEQ ID NO: 71958 - DNA, 170 bp, Homo sapiens
  chr11:110089331-110089501
  hypo
ttttctagtatttcacggtactaccttctgaatcccaaactttacgttttcaatacaaatgggcagtcccagcacacactccacatccttctgtgactcgatatatttgcatatgcagttacttctttccagaaactttcctatctttgcctcctcgattaagagtaact

SEQ ID NO: 71959 - DNA, 30 bp, Homo sapiens
  chr11:110132980-110133010
  hypo
tacaaaattaaagggcggaacactgtgaca

SEQ ID NO: 71960 - DNA, 240 bp, Homo sapiens
  chr11:1103974-1104214
  hypo
gagaccccagggaggcgagaggccagcgctggccccggaaggtcacccctcactccgccctccccccaggtactcggccaaggcccaggccctggaccacagctgctcctgctgcaaagaggagaaaaccagccagcgtgaggtggtcctgagctgccccaatggcggctcgctgacacacacctacacccacatcgagagctgccagtgccaggacaccgtctgcgggctccccaccgg

SEQ ID NO: 71961 - DNA, 647 bp, Homo sapiens; identical to SEQ ID NO: 34046
  chr11:110581773-110582420
  hyper

SEQ ID NO: 71962 - DNA, 608 bp, Homo sapiens; identical to SEQ ID NO: 34047
  chr11:110582421-110583029
  hyper

SEQ ID NO: 71963 - DNA, 1132 bp, Homo sapiens
  chr11:110583043-110584175
  hyper
cggaggcgcggctgccgtgctcaggcagggagccgagctccgggtgctcgccgcgcgcctcccgtcggggccatgtacctccgcctgcgctcgacaccgcgggctggaggcgagtgcagcggcgacagcccgtcagcgccgcggcccgccccgcctcgggcccgccccctccgctccgggcgccctgcgccggggcccgcccccgcagccctcctcagccctcctccagcctgggccctcctagcctcgtcccagcctgcggcgcgcctggcgggcgtctctctatatatgttagcacaccggccaccggctgaccttttcggtctgtgactccgcgtgggtgcagcccgcaggagctcatcggcctgtgtcacgcacgggggcctctagtgcacggacacgcgcctctcccgccacctgcccactcccaccagaccccatcccttcccgcgccgtgcccgcggcggaaggcgcccctgcagcgcgtgcatccgcggagcggtggcgacctcagcctgagcagaggagttgcagtgattcctgcctcgctttcagcggactgcggagggaatcccccaccccaccccactggggatagggtggcacgtcgcagagtgtcgcagctgtacaaatttggaagcccacagcatcgcctgacctcttgtgcaatcccgaacgctagcctgttcgggtaaccctgagtgggcttctgcagccggtcatgtcagcggcccctgcacatttgcacccgcggtttccgctgtctgcaggctgcagagacgggggcattccaaacgtgaaagagcaatgaaggaaaatgcagacagagcgaggacgccgaaatttggctaagctattgagaaggctacaatatgtggaagtgtttatcagatatctgcgccgagagcataacttcctgtcagcccaaatagaggcaaaaatattttaaaggccaaagaataatcagagggagaggatttggagctgacccgcgttgagctgagtgttgctgcactttgcggggctggttgactggtacggatgattcggtagatggcattcttcccttggagtcaggactagagaagcagtggcggattagtgaggaaggacaccacgctatgatattagg

SEQ ID NO: 71964 - DNA, 30 bp, Homo sapiens
  chr11:111089918-111089948
  hypo
aagtagaaagggagccgaaagtactggaag

SEQ ID NO: 71965 - DNA, 397 bp, Homo sapiens
  chr11:111154359-111154756
  hypo
cttatccagacatagcgatctcagataacaggccaggagcacctcttgttaacagttctatgtatatggagaggtagctccgatgttgtgaaaaagatgcttccttggttaaaatatgaatgccaagagattatttcatttatgtcttcctagcacagcgccggtcaccgggaaggtactcagtaaatgtgaatgaatgaacagacacggtactgtctaaaatgaactcacccctaaaggcgacaatgttttcaaacgttagttatttgggctaatgcaggaatatttcacgcttttcaagacatttctctatttccatgttagcgttggagtcaggcacgcgttagtaacatcgtttcccaggcagagactcagctgcaaccgaggccttgaccgc

SEQ ID NO: 71966 - DNA, 100 bp, Homo sapiens; identical to SEQ ID NO: 43245
  chr11:111156679-111156779
  hypo

SEQ ID NO: 71967 - DNA, 379 bp, Homo sapiens
  chr11:111169972-111170351
  hyper
ggcactatctccaggcgtccaggctgaacgcgcggtcaccctcggccgccgcacccagcgcacttcccggcgcgattcctggacgcacactgcagggtagtggtcagggccggagccgccccggactcctgcggccacctccaccttgaaagctcgcccggctcggcttggcctaacagccagtccccaacctactcactgcggcttttcggggcccggggctgaggctgcccctgctcccagcgctcaggggtccctcccagcgaacccctcttgagcgcgcccgccacctcccgcgagccggggcagtccgaccgggccccgccagccccggggcggcccctaccgaagggcggcctcccggcggagtgcagggtca

SEQ ID NO: 71968 - DNA, 390 bp, Homo sapiens; identical to SEQ ID NO: 34050
  chr11:111383125-111383515
  hyper

SEQ ID NO: 71969 - DNA, 16 bp, Homo sapiens
  chr11:111383516-111383532
  hyper
ggggtcccgctgggcc

SEQ ID NO: 71970 - DNA, 348 bp, Homo sapiens; identical to SEQ ID NO: 3793
  chr11:111383557-111383905
  hyper

SEQ ID NO: 71971 - DNA, 218 bp, Homo sapiens
  chr11:111385246-111385464
  hyper
ctcccccactgactccgacaggacacaacccaaagttgacgttttgactctcccatatccaagatttggactggtcctaaaacctgatcaccgcaggggtgggcttccgacggcccccacgcgcgtggcggatcccaacacctacctaggaaaccgagggcagccggcaggggctggtaccaacttggcggttctcggaggggcggggcaggggcggg

SEQ ID NO: 71972 - DNA, 87 bp, Homo sapiens
  chr11:111411112-111411199
  hyper
cttggctaaggtcagcgggagaggaggggtgagatgtggtgctagttttaggcacactgtgctcgttatcagattgcctaggggccc

SEQ ID NO: 71973 - DNA, 382 bp, Homo sapiens; identical to SEQ ID NO: 34055
  chr11:111411200-111411582
  hyper

SEQ ID NO: 71974 - DNA, 483 bp, Homo sapiens
  chr11:111411821-111412304
  hyper
cgtctgagacccacgccagttcccggagctgcgcagttccctgcgcgtcctggaacgctcgaagcccgttcccagtccagagttatgggggtgggttggagaatgtaggagaggtggggcagtgggcaaacctgccccagtgggtgccccttcggcccgctcctttacacgcatcgaatcagtccttgggaccacccccgcggggcaggcttgccagctggcccccgcctaccgcccgctccgggaggcggccgcagagacagcggggtagggatgctggatccccggtgccgtgggaaccctgcctgttactcctcgtctcttctgcggggttggatggctgggtcgagcgcccggtatgagagcgcttagagatcgggaaagaactccagttagtgtgggacgagccccacctgactccggggaatgactctctgcttccttcctcctgttgtgtcactgcagcctcggatttggacctca

SEQ ID NO: 71975 - DNA, 30 bp, Homo sapiens; identical to SEQ ID NO: 34057
  chr11:111412594-111412624
  hyper

SEQ ID NO: 71976 - DNA, 133 bp, Homo sapiens
  chr11:1115098-1115231
  hypo
caggagtgctgattgcggcgggtggtaaactgcgggtgcccctttgcggtgcccggatacctggcggggagccctgggggctgcccatgaaccagtgcccactttcctgcccctggcacgggctcggcatggg

SEQ ID NO: 71977 - DNA, 30 bp, Homo sapiens
  chr11:1120833-1120863
  hypo
gtgtggtgcagctagcgtggaccatgtccc

SEQ ID NO: 71978 - DNA, 30 bp, Homo sapiens
  chr11:112370516-112370546
  hypo
acaccttgtgggaagcggaggcggccaccg

SEQ ID NO: 71979 - DNA, 30 bp, Homo sapiens
  chr11:112651559-112651589
  hypo
aggcatgtgttccagcgtgattagagctga

SEQ ID NO: 71980 - DNA, 177 bp, Homo sapiens
  chr11:113258642-113258819
  hyper
ctccccgtcttcacccgcgacgacttcgagggcgactggcgcctagtggccagcggcggcttcagccaggtgttccaggcgcggcacaggcgctggcggacggagtacgccatcaagtgcgccccctgccttccacccgacgccgccaggtactgccagcctcgccctcccctttct

SEQ ID NO: 71981 - DNA, 56 bp, Homo sapiens
  chr11:113286309-113286365
  hypo
tggcaatgatgcactcgttctggtctgggggagggagagcccgggcaggcagggag

SEQ ID NO: 71982 - DNA, 744 bp, Homo sapiens
  chr11:113344994-113345738
  hyper
acagggatagggaagcgctctgtctggtgcttagaggtgtctcttgtctccgcataccaccctagaggggctctcggtccatcatagagccgggccgagagccgggcggtcaccctccgctactgccgccaccgtcgcctgcactgccgggtagaaacgggtctggcacccaagcctccctccccgactaggtgtcaacccaagagaaggcgaaggagaacgaaagttcaggaccaaggacagcggcaaccgtgggagcgggagaatccagccagaatctgcctctcccccatccttagcttctgccttagaaactgaaaagggtcaggtcgcaccaacacagagttgccaaaaacagcccttcttcctccggaagaagtcggaaactctggccgcgagccccgggtctcgcgcttgggtgctgggggaagtgccctcccgagattgtggggagcggcctccctcccgccctccgatgccgcggctccgccgtgctgccctgggcgccccgcggggaggctgccccagctgcgcccgctcgtgctcggggagaggattcccttctaagtggcgaggaggctactgagaaggagggagaggggatagcagccgcgggctccagacgccctctgcccccgcccgacggggagcccatgcagagccggatcccaggcgggcgctcccgagcaggcggccaggagtggccgcacaaacttctggtcctggcctcgctccccttggagg

SEQ ID NO: 71983 - DNA, 102 bp, Homo sapiens; identical to SEQ ID NO: 34060
  chr11:113346239-113346341
  hyper

SEQ ID NO: 71984 - DNA, 23 bp, Homo sapiens
  chr11:113373844-113373867
  hypo
cgagactccgtctcaaaaaaaaa

SEQ ID NO: 71985 - DNA, 265 bp, Homo sapiens
  chr11:113552719-113552984
  hypo
agcccatccagctcccgtacgggcggcaggcccttctcttcctcctcctgagtgggctcaaccactcgaagccagcacctataacatgctgagcccgcaccgggctctaggaaccagaaatcagagtgaccaggggaaactgggacatcgatatgcatggcttgccggagtaacactacacctgactcaccttcctagcctcccgcaaattgccagagaagttctgggcctaggagggccaggctgtttgcgcaaaacattaggt

SEQ ID NO: 71986 - DNA, 262 bp, Homo sapiens
  chr11:113560957-113561219
  hypo
atgcatcagcccttccgtccaggtagccagcgcaaagcatgcggggggtgagggctccgctgtacacgcaagagctgttgcagagctgagtgctgaacaagggcaccaccgtgtcctggagcatatccgagctgtaagctatgagagacaccgagaaaaactgcagggcacaaagcaaggcccaggcaggcagagcagcaagaggggaggtaattcgaagtcccagagacagggagacccaaagaggcgagcccagggtggg

SEQ ID NO: 71987 - DNA, 30 bp, Homo sapiens
  chr11:11373606-11373636
  hypo
ctgacatcacattggcgctgctgacgggcg

SEQ ID NO: 71988 - DNA, 93 bp, Homo sapiens
  chr11:113902101-113902194
  hypo
acttaaattaagcctcggaagtcaggggagctccgcagcatccctaatgcggtgctaaattctcagcagcacagtctccgtgttaaagccttc

SEQ ID NO: 71989 - DNA, 59 bp, Homo sapiens
  chr11:113907046-113907105
  hyper
ccttctggcctccagcggacggaggtcaggcgctgacttggccccgggctaagagggga

SEQ ID NO: 71990 - DNA, 525 bp, Homo sapiens
  chr11:113929598-113930123
  hyper
gtttctcccaggactcgaccttggcctccagcaatcgcgacagctaaaaacgggtgtctcgcttcgacaatagatccccgcggaccttctggcacctggttcactagcgcccgcgaactctgcctcgggagacttattgaaatccggatgctcaagccgggaggcgcgcagtaaccaggaggatgagagggccgggtttgggctaggaaagcggccttttaaaacagatgtcagggggactgcagccccgagccatgagaaaaaagttaaaggcgagatgacacgcactgaattggggcaaacattggaagaggagacaaaactgcgtgcttgagcaccggggtgcggggagggggggacaaaacccgtatccagtgcaaattaaaatcttgggagtaggtgggggctgctgcgcgcccttcaccctcagttcccctattaaggattctgagtccccatgcactcctgtcctctggctccttccttcctctccgctcggccggtgagaggcggccgccggcgccc

SEQ ID NO: 71991 - DNA, 434 bp, Homo sapiens
  chr11:113930367-113930801
  hyper
ggggctcggcgttgacgtgggacgcggcggaggcgcagcagccggtggtgatttgctaacctcgcagcagagaggagttgagggcgatgagagcgggtactgcgaactgccgggcgatgctgtcgctgccgccgtgatacggagagcaacagttccccagcaacacccctccccgacacaggcacacaccccccgacaggcacgcacacccaccccacagtgcccggctcggctgcggtgagtgaggggccgggaagaggcgcaccgcccagcgagcgccgcgcgccggggcttcccggggctggagaggtctggggggcgcgcgctcgcttcggccactcggccgctgggcttgtgccttttttatttggcgtgttcccttcctgccgctgcagccgtcgccgccaccggttgggggtcggctagaaggggga

SEQ ID NO: 71992 - DNA, 37 bp, Homo sapiens
  chr11:113931030-113931067
  hyper
atttgtgtgtttattcgccggccggctgggaagctag

SEQ ID NO: 71993 - DNA, 821 bp, Homo sapiens
  chr11:113931299-113932120
  hyper
gctctcggtgggtgccggtctctgcacctgatgcgttcgggatgcctttcccaccctggcgcgcccgccgctagctcgcacagcgcctcgcacactcccgcacgcgcttgaaatgcgcacggtcccgccggcccgcggaaccacccggacgcacggagcgctccgcaccgactcgctcgccgcctccccgagacgctcgcaccgtgcttgggccgggcgcgctggccgctggcgccgctggccagaggcctgggacccagccggtcgctcccagggggtcacggccctgggtcggagagggagggcgggcagaccccttctcgcctttcctcccacaactcgctgcggggcttttgtgcttccccttcgccgcggggcgggtccgcctcccctgccgctctcgccgcggagtccagcccgcccggactgtcgccgttcctccccgtctctttcgctttccctcgtccctagctcagctctccttctttcaggagtctagctcctcgggaaaagttgcttccccaagtttgctgaagtcgtctccaagtctcggtgggggtcgctgggaactgggggggtgtgagagcgcggtcgatccccggagctcgggcgggttatcgccggctcttccccgcgccgcctggctggacgctgcagccagcgccagccggatcgcgggcgccgagcggcgggtgggggagacggctgcccgtgggcgcccagatttccctcaggacccaaaaggcttgtttcagggcgccaagcttccattcttttggctgttccctcctagttctcagaaaccccgatgtctgcgggaa

SEQ ID NO: 71994 - DNA, 112 bp, Homo sapiens
  chr11:1140450-1140562
  hypo
tcccgctctggaggccgcgtctcttccccggcggaccgtcctctacctgcagagccatcgggagcctctgctctccccgactgcctccctctcctcccgctgtctctgtctg

SEQ ID NO: 71995 - DNA, 48 bp, Homo sapiens
  chr11:114112577-114112625
  hypo
gtcttagtaccttgccgccttttacataccacccgacacagttgccca

SEQ ID NO: 71996 - DNA, 87 bp, Homo sapiens
  chr11:114112965-114113052
  hypo
gtccacgcgggcgtgcgcagctacatctgcagtgagtgcaaccgcaccttccccagccacacggctctcaaacgccacctgcgctca

SEQ ID NO: 71997 - DNA, 183 bp, Homo sapiens
  chr11:114115465-114115648
  hypo
taaattcctaaaaatcggatcaaacaaactcctctgtcttaaccctttgttttttaaattgttagggacccctctggaggggaaaggcacaggcagccgcccccttcccccccaccgccgccttcacccccacccggctgggtggctgccgatgtacgttttaattaccggctccagctgaag

SEQ ID NO: 71998 - DNA, 248 bp, Homo sapiens
  chr11:114120983-114121231
  hypo
acatggtgccctcaccgccttctgtctgtcctcactttctcctgccctgtccctccgccctcaggtgagaagccctttgagtgtaagctctgccaccagcgctcccgggactactcggccatgatcaagcacctgagaacgcacaacggcgcctcgccctaccagtgcaccatctgcacagagtactgccccagcctctcctccatgcagaagcacatgaagggccacaagcccgaggagatcccgcc

SEQ ID NO: 71999 - DNA, 173 bp, Homo sapiens
  chr11:1142462-1142635
  hypo
ctactgctgccatgtcgctgcagttcaatgggtttgtgcgttgtgatcacacggtcctgcccacagagctgaatgggctattggggtttccttgggtgagtcccaggctgtgtgtggggtgagtgtggggcctttcttgcaccgtttagcctggcacgcgttgccctctctct

SEQ ID NO: 72000 - DNA, 30 bp, Homo sapiens
  chr11:114314811-114314841
  hypo
atctttgggacctctcgagatcatcttctc

SEQ ID NO: 72001 - DNA, 136 bp, Homo sapiens
  chr11:114494121-114494257
  hypo
ggtaccattgttacccgctggataataagtattccctcatgggtaaccactgttatccggtgcataataattatttcctctcgggtaaccactgttacccagtggataataagtattccctcgtggataaacactg

SEQ ID NO: 72002 - DNA, 30 bp, Homo sapiens
  chr11:11465873-11465903
  hypo
cttactaaaagcctgcgaggacaagtcctc

SEQ ID NO: 72003 - DNA, 30 bp, Homo sapiens
  chr11:114743244-114743274
  hypo
aggcttagcacagcacgtaagaagcattcg

SEQ ID NO: 72004 - DNA, 81 bp, Homo sapiens
  chr11:1148113-1148194
  hypo
ctgtctatctgagggcgtaaggagggcaggccttcaggcactcacatgcggccctggccagggtcccggtcacacctgcag

SEQ ID NO: 72005 - DNA, 54 bp, Homo sapiens; identical to SEQ ID NO: 42890
  chr11:1151771-1151825
  hypo

SEQ ID NO: 72006 - DNA, 249 bp, Homo sapiens
  chr11:1152416-1152665
  hypo
ggacctcagcactgccgagaccgccacatggcccacccaggtccctcgcccagccctgtccccagcctctggccctctgccaggcagtctcagagcaagaagaaccctctcccggtgtctccgtgccaccctccactgtggcctagtcggactctgccccgccgtccctcgtctgtaccaccctcatctcagaagcaggaattctgtcccggggctgctcccaggagagggcggcgctggggctggggt

SEQ ID NO: 72007 - DNA, 1514 bp, Homo sapiens
  chr11:115373239-115374753
  hyper
aagttgtaaccacaccggcatcggctgaacccaattatctcgtaactcataaattaagaattcacagaggaaaaacacataaacaacatccggagacagtggcatggaggaaaaaaaccctcagcgctggaattgacgctgctgccagacgccccccaataggtttcccaagccgagctcctttgcaagcctattttgggggcaagcagccaacccggcgtcccccaaatctcaagctagcacccccacacatcccccgtctcctacagcgtgtctcctgcggtgtttacataactgtgtgtcctctagcgtgtaaacaaaaggcacagcccaagcggagaggcgcccctgaagcagcaccgtggccccaacgctgtgcccgcccgggcctggggctccgcaggtgggggctgagctctcggcgtcctccgccacttgttgctcccgggtcctgcagctctggagctgcaaggaggggctttgcaggctcagagccctgctgcatcccctcctgcatcgccgctcgcaccccgcggccccgtgccactcggtcccggcgcccgcctggagcctgcagcaggggccagaggacgccgcgcggctgccaagcgcggcgaggtggcgggaagggaggctgggtgcagcacagccggcctctccgctgaggaagagctccggctcccttttgttagcaaaagcaaacactgccctcttctttcccgaccgcgccaacgcgcccggcacacgggcagccacacatcgggctccagccgagtgctcggtgtcttcagggaaggcaccgggcgtgcagagccgcccctgggcaaattcccaagactgctcttcacgcagggagcgcgcggaggcccgcagggtgcccgcctggccgcagaggccgcgacgccccctccgccaccctcgggccgccgaaagaacgggcagccgggaaatcccgtgtccccactcgtggcagaggacgctgtggggcgggcgggctgcgggctcccggcgccttcccgcagaggcggcgacagcggccgccccccccgcggggccgggccggggaactttccccgcctggagccgggccaaaaagacccgcagcagagccgagggggcggagggctgcgaacggccggagggaaacacgagaggcgtgcagtttggggacaggggagaaaggcagagcgcgttgggggaaggggcaggggagatcagacaagtctggggatgtcctggggaccggggagaaatcacgccgcgggcggctgggagtcagccaccaggaggcttcggggatggagaactgggggggccctctggagaggtgggggcgaatggacagccctgggaggtgggaggacctgcaagttacggggagaacggcgagtttagaagggtccggaagggttgaggttgtctttgaaccatccccttcccccatgctttacagcccccgggccccccattctcactccactctgcaccccgcgccaagccggggagagaaggtg

SEQ ID NO: 72008 - DNA, 443 bp, Homo sapiens
  chr11:115374991-115375434
  hyper
tggggatcagtgccgcggcggagaagagcaacagcagaagccggagccggagcccgggaggcgccgccgccgccgctgccgccgcacactgggatccgctcggcagcactacactcgccatgtcgggcacctgcctcagactggcggcgttggctgcctccggagcccgagcggacagctaatgagatgctaatgacatgcgctggaggcggagtccgggcagaccaatcacagcgccgcgagcccaacccggctctcggagggcctcgctccctcccccaccccgccccctggcgctggcgttcggcggcgcgcccgcgccacctaggggcggggccaaggggaggggcgtatgcaaatatgtttatgttaaaattcgggttttgctttccccggatcaaggaaaaagtgttctcccgggcgcctggcgtgcaaggactcgg

SEQ ID NO: 72009 - DNA, 62 bp, Homo sapiens
  chr11:115375832-115375894
  hyper
tcgggaaaggtagatcgaggagggtatgctcaggctcctccgcttgtcgagggtctcctccc

SEQ ID NO: 72010 - DNA, 175 bp, Homo sapiens
  chr11:1155055-1155230
  hypo
ctgctgactctggaacgtctcctctggctgcggagcccccgccccacgtggggccgtgcgtgaatcctaccagcccctgtctccgcaggggtcccgctccgtggggcgactgtcttcccatctctgaggaccatccctgtggtacgaggtgagtggagcccggaggcctgggtgg

SEQ ID NO: 72011 - DNA, 114 bp, Homo sapiens
  chr11:115529982-115530096
  hyper
ctcccatctctacagcgactcccctatgaccgtcccccacccggtgctctcgggccacggggaagggacactcgggaaagacaccagagaccgggagggtgcagctgggctctt

SEQ ID NO: 72012 - DNA, 340 bp, Homo sapiens
  chr11:115530221-115530561
  hyper
cgtcccttagccgtgtgggctgtagcacagagggggcaaacacctccaggggcttgtgccaagtaattaccaagcaaattcccggcgatttcctctcctccccccgcccccccgggcagtgcccgctgcgtgttccctgattcggcccccggctgtgcaatcagctccaggtaacctgcggggacccgtaattgctctggagttgcctgcgagtttgcaaggtaagcacgcgcggcgcttctccctggccctggggcgcgcggtggagcgccttgcgcccgcccccgatgggccggatgccggggacctgcggaagcagaggctgcgggggtagagatcc

SEQ ID NO: 72013 - DNA, 203 bp, Homo sapiens
  chr11:1155596-1155799
  hypo
cgtcttccgcttccccggcctctgcaactacgtgttctccgagcactgcggtgccgcctacgaggattttaacatccagctacgccgcagccaggagtcagcggcccccacgctgagcagggtcctcatgaaggtggatggcgtggtcatccagctgaccaagggctccgtcctggtcaacggccacccgtgagtctgggttc

SEQ ID NO: 72014 - DNA, 190 bp, Homo sapiens
  chr11:115587766-115587956
  hypo
cggagggagcctcctcggaaggtaattgcctactcccagggttggccttgctgaaatttatagctccgctcaataaagccattgtgcggctccttaggaagccatgggggtggattattgcttgggagccaggagacatggaacccatgcagggccggggtcccctgctggggcacgtacaggctgagag

SEQ ID NO: 72015 - DNA, 63 bp, Homo sapiens; identical to SEQ ID NO: 34072
  chr11:115630411-115630474
  hyper

SEQ ID NO: 72016 - DNA, 99 bp, Homo sapiens; identical to SEQ ID NO: 3799
  chr11:115630530-115630629
  hyper

SEQ ID NO: 72017 - DNA, 259 bp, Homo sapiens; identical to SEQ ID NO: 3800
  chr11:115630630-115630889
  hyper

SEQ ID NO: 72018 - DNA, 518 bp, Homo sapiens
  chr11:115630890-115631408
  hyper
gcggccgggtcatcagaagcacagtggagccgccccctgctttgggaggagcaaaagagcctctcgcttgcctcccgctcgagctccttctcctcttccttttcctagcgcttctctccctccctcggcggggtccgcagagacagctgggcaggcggaggctgcgcgcctctcgcacctccacgcccaccctcccgccgcccccccctcggcctgaaagatctgcgtccacaccaccctgcacccagggcccgtcaggttttgcagaagtttgctgagggtcctcacagggggtctcccaggggaaggggtggagggctggaggggccgcggtgggaagaggtggcagacgccgcctggcaacggagaccctaccctttctagaaattcagaacgcagagaaaccagtgcccagccctgctcttcagcaaacggtgtatttcagcccgagtttccttccgggggtttggctgtgagtgtgtgtgacctcccagatggcggcacggttcagatcccat

SEQ ID NO: 72019 - DNA, 163 bp, Homo sapiens
  chr11:115733020-115733183
  hypo
gcctgacagagggcccgaggcggcacccagcatggaagagcacaggagtctgaatgtcgatgaaggggaaccatgacagagtgaggacatctggacagctgtcagtgggtgagatgttgatgaacacgcagagacataaggttcatttcgaagggtgtagaat

SEQ ID NO: 72020 - DNA, 30 bp, Homo sapiens; identical to SEQ ID NO: 43252
  chr11:115763341-115763371
  hypo

SEQ ID NO: 72021 - DNA, 30 bp, Homo sapiens
  chr11:115771022-115771052
  hypo
aggcacagacagacccgttagcgacattgc

SEQ ID NO: 72022 - DNA, 30 bp, Homo sapiens
  chr11:1157863-1157893
  hypo
cttgccgagtactcccggcagtgcacccat

SEQ ID NO: 72023 - DNA, 42 bp, Homo sapiens
  chr11:116146911-116146953
  hypo
ctggagggacagtgccgcagccgtgctcgtcaggggtgcgag

SEQ ID NO: 72024 - DNA, 66 bp, Homo sapiens; identical to SEQ ID NO: 33631
  chr11:11642602-11642668
  hyper

SEQ ID NO: 72025 - DNA, 288 bp, Homo sapiens
  chr11:11643016-11643304
  hyper
gcacatacacgctggcgatgtagttggtgacccagcccacgtagagcaggcagatgatgttagtcatgccgctcaggatcacgcaagtggacaccaaagttttggtcttcctggtgcacaccattctgggctccttcctccatatagagctcccgggggcccttccttgtcgtgcgccccgaactcccccgcgctcgcaccccgtagcacgtccggagccgctgggcacctcagcacctgagtcccgaggttctccaaagcccggtccgctgccggtgtagccgccgt

SEQ ID NO: 72026 - DNA, 64 bp, Homo sapiens
  chr11:116451313-116451377
  hyper
agacctggagctttgcggttcgcggcccgggttggagtggccgcacacccgtatcagctgtgtg

SEQ ID NO: 72027 - DNA, 30 bp, Homo sapiens
  chr11:116453617-116453647
  hypo
gcccactctgtgtggcgctgcaagccccct

SEQ ID NO: 72028 - DNA, 596 bp, Homo sapiens
  chr11:116706286-116706882
  hyper
tcgtaagcagccaggcgtccagcaggtcctccaacgtcgatcttggccctaagacgtccagtctgggcacggagttgttgagatccggcaggaagtccctgctccagggccaaaggccccacccgggctcccccggatgtccccgcacccccctctattctcccaaaagaaagaagctgcttcccactttggaaacgtttattctgagcaccgggaaggggggcggcggcgggcgcctcactgggtgttgagcttcttagtgtactcctcgagagcgctcaggaagctgaccttgaagctctccagcacgggcagcaggccttggcggaggtcctcgagcgcgggcttggccttctcgctgagcgtgctcagatgctcggtggccttggcgtggtactcggccagtctggcgccgccgttctccttgagagcctcaaggcgcgcggccaagcgctggcgcagctcgtcgctgtagggggccagatgcgtgcgcagcgcgtccacatgggcgcgcgcgcggtcgcgcatctcctcgcccagtgggctcagcttctcttgcagctcgtgcagcttctggcgcgcgccctcttggagct

SEQ ID NO: 72029 - DNA, 32 bp, Homo sapiens; identical to SEQ ID NO: 15607
  chr11:116890012-116890044
  hypo

SEQ ID NO: 72030 - DNA, 75 bp, Homo sapiens; identical to SEQ ID NO: 43254
  chr11:116952331-116952406
  hypo

SEQ ID NO: 72031 - DNA, 30 bp, Homo sapiens
  chr11:116976981-116977011
  hypo
tgaaaaccacaaacccgtataggagccaga

SEQ ID NO: 72032 - DNA, 39 bp, Homo sapiens
  chr11:117010334-117010373
  hypo
ataccatcatttgagttctctaaacgtgaattctttcta

SEQ ID NO: 72033 - DNA, 30 bp, Homo sapiens; identical to SEQ ID NO: 43256
  chr11:117054963-117054993
  hypo

SEQ ID NO: 72034 - DNA, 37 bp, Homo sapiens
  chr11:117068532-117068569
  hypo
gcggcgtttataatccgctcagcgtgcaggccgaggc

SEQ ID NO: 72035 - DNA, 62 bp, Homo sapiens
  chr11:117186235-117186297
  hyper
gcctgaccaccttaccgtctgcggggggctgcccacggtcatctccacgtagtagccctgcc

SEQ ID NO: 72036 - DNA, 43 bp, Homo sapiens
  chr11:117307989-117308032
  hypo
caggtccccttgggccggtactccagaacgatggctgtgatag

SEQ ID NO: 72037 - DNA, 30 bp, Homo sapiens
  chr11:117344740-117344770
  hypo
tttttgatgagtgcacgcagagggaggaga

SEQ ID NO: 72038 - DNA, 190 bp, Homo sapiens
  chr11:117376155-117376345
  hypo
tgtccctgctcaccacgcacgatgagctggcgctcccggctcacggtggcggctgcgttgctggcgatgcatgtatagttgccgttgtgcttgagggagacgctagagatctgcagggagctcatgaattccttgctctcgatggtcacgcccgagcctgagatgatcacctgtccgtccttcctccagg

SEQ ID NO: 72039 - DNA, 1130 bp, Homo sapiens
  chr11:117667010-117668140
  hyper
gtccaactggccaggcgcggaagcggagaatctcgcatcttggggcgcgctgcccgaggtggccacggtggcgcaccaagccggggctaaagccggggcagaggggtggggtagggccgggggagggtgacctctgggtttggagaacaaacttgctatccgagggacctccagctctcgggactctcactatccccaccctgcctccagccaatgcgcggataagcgccatgcggtgcgccaacattcgcgccagggctggggtccgcggcgggagagggacgcacggacatagcggaggaatcagccgccgagtccgaggcctgaataagcaaggactcctaggtcaagagtcacggcctgaggacccctcgactcggagggcactccggggtcccagtgccaccaagccgcaggaagagggcaaggggctgggggaggggtccagggcagaactgccgccgtgcagggagcagggagatgaggggctcctttgccaccacccctacgggcgcgccccaaaacggcagacgcgggtggctggcggagcggtcgggggctgactctcactcggcccctgtcagggtgcctgcccctccccgctgcgccccacccggggccttgcaccccggtcggttcccccacgcacctggagcccgccgggcaccccgcctcgccgccagccgcgccaccctggccccgccgcctccgccgcccagccgcccgcgcaggtctcacctttgtgtaaagagtccaggagcaggaggaaagttaccagccacatgccataaagaggccctattctccggggaggtggtcctgtggccggccgtgcggcagcgcctctcccccgctcagcgcgctcccagccgcccgcactcggcgccccgctctctctgctcctcagcccagcgctcggctgcggcggcggctcctccctcctcggctccccggctcctgtcatccgcggggctgggctaggcggccgctctccccgcccccccgcggcaccccgggtggtgagcgccgcgcgagcccggagcccagacggaccccagccccacaagcccaggaacaggagcggcggcccgggccagaccgccccgacccggctccgctgtctgagaggc

SEQ ID NO: 72040 - DNA, 178 bp, Homo sapiens; identical to SEQ ID NO: 34080
  chr11:117746361-117746539
  hyper

SEQ ID NO: 72041 - DNA, 62 bp, Homo sapiens
  chr11:117747138-117747200
  hyper
ttcccgctgcccaggcggggaccgcggcgcagctgaccgcggaggaccgcacacacccactg

SEQ ID NO: 72042 - DNA, 257 bp, Homo sapiens
  chr11:117747499-117747756
  hyper
ggggacagcccactccgtgctgccgtccgctggcttctgggtagcggccgcgcgcagaccccctctcctcctctccctgtccgtcctcccgctctgtgctcgcgcgcgtcctctgctcctctctcctctcgaggggcggagagatttttccaaagggcagtcaagctccgagaagcaacaggagactgccgccgaggaggcgtgcaagcgccggagcggatttgccatcagctgttgcttttcggtttccctctggt

SEQ ID NO: 72043 - DNA, 30 bp, Homo sapiens
  chr11:117973031-117973061
  hypo
ctctcaacagccctgcgaggcagatattat

SEQ ID NO: 72044 - DNA, 48 bp, Homo sapiens
  chr11:118023387-118023435
  hyper
tagtcctgttctctccggagcgcgcgggggtcgcggggatgggatact

SEQ ID NO: 72045 - DNA, 450 bp, Homo sapiens
  chr11:118023775-118024225
  hyper
tgccgcaccccgcctcgcggtcccggagccccgggaccacgccgtgcccccaactccctctccagtggggctgggctgctgcggctggcactgcagggccggcctgcagccacccgcatcatcccatgcgctgagctgccaattaggagcatagttcggggggagtagaggtggagcttttcggttgctggaagactgttttgctttgcttgggggaacacgggaaggttagcggctccctctcccaggaccgccaagggaccgctttaaagtccgcagcggacgctgccgcaacgggtgggcgtgtgcgggcttgcccactgcagcttgcgcctcctcggtggcgtgcgacatggcgcgcgtgcagcctcgggacccgctcccgccaccttctgccccatcgctcagcaactccggcggttgttttaggaagcccggaacagagctttc

SEQ ID NO: 72046 - DNA, 254 bp, Homo sapiens
  chr11:118663050-118663304
  hyper
gagagggtagcaaaccgagagagcgcaccggggtggtggggggagaagctggactgtaaggtgaagagttagtagggcgcaaccgtcttctcctgccctcgaagggcaagactgaagaaagtaggggcggaggaggccgggccctccactaaagggagggaagctagtgaagcgtcagttataatagaaataggaattcagtaaggaaatggagaagcttaaggcaaagggtgactctccggcctgaccctcac

SEQ ID NO: 72047 - DNA, 32 bp, Homo sapiens
  chr11:118663788-118663820
  hyper
aatcaagtgatgggtcgcggctgactcttgcc

SEQ ID NO: 72048 - DNA, 52 bp, Homo sapiens; identical to SEQ ID NO: 43257
  chr11:118768516-118768568
  hypo

SEQ ID NO: 72049 - DNA, 30 bp, Homo sapiens
  chr11:118769490-118769520
  hypo
gggaggttgggaggccgagagggagtctgc

SEQ ID NO: 72050 - DNA, 41 bp, Homo sapiens
  chr11:118769734-118769775
  hypo
cacccggtgggtatgcgtcgcccatgcgcccagccatggct

SEQ ID NO: 72051 - DNA, 30 bp, Homo sapiens
  chr11:118780738-118780768
  hypo
cccaaagagaaaactcgtgacttggggagg

SEQ ID NO: 72052 - DNA, 32 bp, Homo sapiens; identical to SEQ ID NO: 43258
  chr11:118781045-118781077
  hypo

SEQ ID NO: 72053 - DNA, 40 bp, Homo sapiens
  chr11:118997065-118997105
  hypo
aaaaaaaaaaaaaaaaaagcacctacggcaaagggtggtg

SEQ ID NO: 72054 - DNA, 30 bp, Homo sapiens
  chr11:119040119-119040149
  hyper
gatccgaggttaaaccggaacctaggcttt

SEQ ID NO: 72055 - DNA, 30 bp, Homo sapiens
  chr11:119058038-119058068
  hypo
gcacatgacgtggcccgagctcagctggga

SEQ ID NO: 72056 - DNA, 515 bp, Homo sapiens
  chr11:119191642-119192157
  hyper
cggacctcaggcctccggcacccagggcctccacccaggggacccggccgcggcgggaaggcgccggcgctaagctccccaggagccggcctcgaggtcccgcccggcggaggcagggggcggggatccggccgctcgccccaacccaaacattaccataaatgctcaggcggctgcgggtggatgggcgcgcggggagcctggggctctccggaagccccagatccagtctccaggcccgacccagcgcgagcccgcgcagtgattcggtctgaccagccgtcccctttacaaagcggtgcagccggggatggcagagctggggtgggcgcggggacagggtggagaaaacccaggccgcagggggcgtctcggggctgcctcctgggtaggcaatgaggctgtgacctctggttaaagaaagagtggggccctctagctagatggcagcgtcggcgccgcggggaggcggctctgtctccctgcagctctgcgggccccgctgctgtcagcgg

SEQ ID NO: 72057 - DNA, 810 bp, Homo sapiens
  chr11:119210435-119211245
  hyper
tctcggagcgcttggcgctgaaggcggatcgcggaggcaccgagcactccccggcaggcccggtgggccccgcgggtcccgcctctcctcgcggcccggggtcccctcgaggtcccggcagtcctgcggggtaagcggggcggcagggtgagagtagcggcggctcagcccgcagcggggcggcgactctaaggtcaccgtacccctccccgcccctgcctgagcttcggccagcgcctcctcccgcacgggtacctcctccaccccttcccgcagggcagatctggggggctggccaagggggctcccgccgcctgggcccctcccccgctcagggctgcaaagcgcggggagtggcgccccctggcgggagacccgagtcccggacaccgggagctggagctgcggccgcgcctgctcggacatcgccaccgatagccgcggcggtgccttcttacccggcctcccgccctcgcctttctctcccggagccccgggcgcgccgtcgcggccgtcgcggccatcgcggcccggcaagccctggctgccatggtggcccggcgtgcctggaaggccggggtgccccgggcagaggctggggatcttgttgtcgtccagtgggggcgagccggccgccaggcccaggagcagcaggacgaggagtggcctcatagcgctggcaccgggagcccggacgccggggtcctctcgcagtctgtggaccaggcaggactggagtcgggacccagaatcctgggacctgcctctctccccaccccggcgcggcccagtcggtccccaccccactgc

SEQ ID NO: 72058 - DNA, 378 bp, Homo sapiens
  chr11:119234569-119234947
  hyper
tgagcaggagccccacgaaggtggagagcagcagggacggggagagaggggagcgcggccgcagctccttggcgagggcgggaaagggggcggcgggggggtcctcgggcagggtcacggtgtacgaggtgcgcatgctggggggcgggcggcgggctttggccctcgcttaacgttggcagcgggggcgcggggggagtccccgcgcggtgccacagtccggacgccgaggccggcgagaccgctacaggacagcgtccgcggcgcccgaacgcgcgctcctccgcctcaacctccccggcgtgcgccgccaacagcccgggtcccggctctcgcgctccggccgactggcggccccgccggcgcctcgggccccgc

SEQ ID NO: 72059 - DNA, 158 bp, Homo sapiens
  chr11:119292746-119292904
  hyper
aggccacagaaggggcgtgcacccgcgagagcgcgcagggcattgcctcggttgagtgcgcccgggtgcgcagggcgcaccactagacgagttcagggtccctggcgctcagccccttgacgggtgaggctaggatcccgcggcggctgcagctacaa

SEQ ID NO: 72060 - DNA, 15 bp, Homo sapiens
  chr11:119293305-119293320
  hyper
agctctcccctcccc

SEQ ID NO: 72061 - DNA, 33 bp, Homo sapiens; identical to SEQ ID NO: 11021
  chr11:119293352-119293385
  hyper

SEQ ID NO: 72062 - DNA, 686 bp, Homo sapiens
  chr11:119293386-119294072
  hyper
cacccagcccgccgcgaggtcacccggcagattccctctagctcgccatcctccatcctctccccgcagtttcatccgtcctcctccccgcctctgcgagctgggtttggggacgtctgggtggaatgtagacccacaggctgtccttggtgcccttcctccctgttctccagcgccccagccccagacaccagtcccccagcgggcgaaagcccgggagcgccttccccgaaagacatcagggtgccacgcggcccctgccctgcagaagcatccccctcccgcccctgcctggaaagcaggcccctccctaagctctgcgcccttcttccctgggcgccctcggaccgtggcccgaagcctagtgttgggaagtcttgcatgggcgcctgacggcggtccccgagccccaggtcccaccggctccagttcccacctggactggggtcttccgctgctgcagcctcctccagacgcgccgccgcctccggttgctgcacccagctcggagcccgcagttttcaccggggatggaggagagggggagcggggagccgggggctcagccaatcagaggcggagattgggggagaaaggacggcagggtggggtggggggtggggaaggaagagaaggcggtcccgcattggtgtgagagtggcaggttgcggcggaagggggccctc

SEQ ID NO: 72063 - DNA, 30 bp, Homo sapiens
  chr11:119354677-119354707
  hypo
ccctgccgcctcctgcggctctaggaccca

SEQ ID NO: 72064 - DNA, 30 bp, Homo sapiens
  chr11:119487017-119487047
  hypo
ttgcatcccagcaatcggtaaagcaccagg

SEQ ID NO: 72065 - DNA, 46 bp, Homo sapiens; identical to SEQ ID NO: 43259
  chr11:119524180-119524226
  hypo

SEQ ID NO: 72066 - DNA, 37 bp, Homo sapiens
  chr11:119600611-119600648
  hyper
aaaattgaagcaccccgcgccccgcccttgcccaaac

SEQ ID NO: 72067 - DNA, 143 bp, Homo sapiens
  chr11:119608970-119609113
  hypo
gcgctcagggcatgccgggggctcacacagcccaggcagctgatgattaacaaacaattatactaatcggcctaggaacaggaaggcaggtgtgcacccctatgcatgtgaatgcacacacatgcatgcgcacacacattcag

SEQ ID NO: 72068 - DNA, 30 bp, Homo sapiens
  chr11:119609728-119609758
  hypo
atctcatttgatcctcgcagcagccctgtg

SEQ ID NO: 72069 - DNA, 234 bp, Homo sapiens
  chr11:119612034-119612268
  hyper
gcatggacaaatgcacgaatgaatgagactgcgggaatgctgcccccacctcctctccgcctccccacctcgcctccaggtaccctgggcgcctgggaccctgcggggcctcctggaggcgggacgggcacggcgccacctagcggtcgtgggccgcggagagagcgtccctgtccttccccgtgtgggacctgcaaccgccccatagcgcagagtccgggaggctccagccac

SEQ ID NO: 72070 - DNA, 109 bp, Homo sapiens; identical to SEQ ID NO: 34093
  chr11:119612323-119612432
  hyper

SEQ ID NO: 72071 - DNA, 27 bp, Homo sapiens
  chr11:119612791-119612818
  hyper
aggcacacacagaggcgcacacacaca

SEQ ID NO: 72072 - DNA, 446 bp, Homo sapiens
  chr11:119612998-119613444
  hyper
tacaccccgcctcctgccgcgcctgacactccgcagggcccgggggtgggtgggcaggggtgcgagggggcgtggggctgggcgcgccggcctggggggaaagccccgcctcccggatgtcgtctcttcgccccctactagctcttgtctcctccccaacccctcgccccaccccctgcctaatttttgccagtggatcatcggcctttggatgaatccgcagcaaatggctcattcggggcgggcccgcctccccatccccccagtgtgcggtctcctctccccagcaaagatgttcggtggcacttacggcccctttttaacaccaggcgaagccaatattgttaggaaggaagaactgctgtggcagctgctgcaaagacaaatcatatgcagtaatgcatcacgggctgagggagggtctgagtgtgcggcagggcagcgcg

SEQ ID NO: 72073 - DNA, 147 bp, Homo sapiens
  chr11:119884295-119884442
  hyper
aagttgtgctgctgccggtgctcggatggaccccggggagcagcagccactgctcagagcagtctgttttgcctgttgccggaggctggggggtgcaggagcagccctggaggggcttggcactatcagtggcggaggggtctgtgt

SEQ ID NO: 72074 - DNA, 652 bp, Homo sapiens
  chr11:120008071-120008723
  hypo
cgggcctcaaagtcccggatgggctcgagcagctggtggtctcggaaggcggcgccctccaggtggggcttgagatgcagctcgcagaaggaggcctggcacaccaggcaggacttgaccgccttctgcttgttgccgatgcaggagtcgcacagcacctcctcggagccggacttggaccgtgaaaaaaggcccgtgtcggcccgggggtagctgttccgccgggtctccccgggctccatgatggacaccgtgggcttccgggactccgagaaaatggacttgcgcagctcgcccttttcggcaaaggtaacgggtggcttcttggcagcccccagctggagccctgcgtacggcgacctcttgccttccatagagtccatgctgaagtagttggagttcttgtcgtccccggactcgacaaactggatgatgggtcgccgccactcattgcccgcgaacagggcgctcctaccttcccctggcttcagggcgctgcccaggctcttgccctcagctgcctccccgccgtgcccgttggtggtcttggcatccttgccgtcagccttggtgccattctccaggctgccactggggcccgacgggctccgggcatccctggcttctgggctcgacccgttgctcctggagg

SEQ ID NO: 72075 - DNA, 222 bp, Homo sapiens
  chr11:120039752-120039974
  hyper
aatgcgggcaggatgcgagcaaaagacccggcaaagagggcgccgagggggcgcagccggggcgctgggcggacccagaggggacatggagaggaacgcggaaggtacgcggtagagacggggaggtggcgcgaggcgggacatggtgagcgacccgaggggcgcgcggactgggctcgcggacggggctcgcggacgtagagcagtcgaggcgcggagggg

SEQ ID NO: 72076 - DNA, 30 bp, Homo sapiens
  chr11:120081073-120081103
  hyper
tgaatgcgggaagcacgggaggcaggactg

SEQ ID NO: 72077 - DNA, 118 bp, Homo sapiens; identical to SEQ ID NO: 34096
  chr11:120110849-120110967
  hyper

SEQ ID NO: 72078 - DNA, 380 bp, Homo sapiens
  chr11:12029892-12030272
  hyper
cccgcgccgccagggcgcacccacctcttccaccgcgctgcgcaatttgtgctgcgtgtcctccatcagttcctcaacctcgcggaacatctcattgagggtggcctcctcctgcgggtagctgagagccgggccgggcttgactggagccgaggtcgccgtcggagcgggcgcgggggccgtggggaccgccgccgccagcagcaggcacagcagggtggccccaagccgctgcatctccgctctgcgcccgcagccgccgcctgtgtgtcccggaacgcgatcagaggcgcgcggaccacccccctcgctgggcccgccgccccgccccgttccgccccgccgcccgcccctggcgcccctctttcccgcacccgccc

SEQ ID NO: 72079 - DNA, 288 bp, Homo sapiens; identical to SEQ ID NO: 33634
  chr11:12030273-12030561
  hyper

SEQ ID NO: 72080 - DNA, 172 bp, Homo sapiens
  chr11:12030834-12031006
  hyper
gagcgcggcggggtgcggcagcgccggtacccgagggagcccgcaagacgcgccccgcccgcccaccaggctccctctccgcccccgccccgagccccgcccgcccaccaggcccaccccgccccgcggaggggccgcagcccggccattggccagccggggcgccggccac

SEQ ID NO: 72081 - DNA, 93 bp, Homo sapiens
  chr11:120367603-120367696
  hypo
ccctctactgtccatcgtgagccctcttccccagtaaggcttaggctcctccaagtctccccacctcacattctaggccgggactccaccttt

SEQ ID NO: 72082 - DNA, 80 bp, Homo sapiens
  chr11:120382368-120382448
  hyper
agttccccagctgcccgccgggcggcgccccgcgcctcgctgcgctcctcccgcgctccccgcgccgggctcgctcgcag

SEQ ID NO: 72083 - DNA, 131 bp, Homo sapiens; identical to SEQ ID NO: 34097
  chr11:120382817-120382948
  hyper

SEQ ID NO: 72084 - DNA, 148 bp, Homo sapiens
  chr11:120383999-120384147
  hypo
ccgggaaactgcgggcgtggtatctccggggagagaggccgcctgggttggtagtgggcatctgagagacaaatccggtcctgcctgactccctgactgtctgtgctcgcgtggtcaggggcgaggggcttgtcgaggtccactgtgt

SEQ ID NO: 72085 - DNA, 30 bp, Homo sapiens; identical to SEQ ID NO: 43264
  chr11:120410117-120410147
  hypo

SEQ ID NO: 72086 - DNA, 15 bp, Homo sapiens
  chr11:120434954-120434969
  hyper
cgggggaaaatgctc

SEQ ID NO: 72087 - DNA, 787 bp, Homo sapiens
  chr11:120435208-120435995
  hyper
gacccaggaaggagacgggtgcctcccagagaggaccccatcccctccgaggtccgggcggctcccggcctctccctggggtgccgtagcccccctcgacccgccttcccgcagccgcagtcgttcgggcctggaggtggccgggcatcggtgccgacgccgcgagggcagcgcccgcggcgggaatactaatgcaccctaaagggcacggccgccgccgcagcaggtaattagctggaccgcggcggagcgcgcggaggtggctgctggctgcaaggactgcgcccagcctccgcctcgcccctcgaggctcccgcgtgggccggcgggcagtgcgtgggccacaggaagcgggctgactggacccggctcaggacttcgcacaagggcagctctttgtttacagctcctctcccagctccccgctttcctttcgcccaccgcctcccttttccggcgatcggctccgccggctgcgggggggtggggggggtggggtgtcctgtgtagccgcccacctcctgtcccggcctcgtgctcccgctggggactgtttgcggtgagtctgtcgcacgcacgtcagggccgaggcagtgatgcggggcagcgtgggaggacgggctgcggagcccgcgtcatcctgcctgtggggagcgctgtgcctgctctcctgccagcgcgcccagctgtcccggccgccgccacgcgggactgcctgccatgtcgccaccggctgctgacctcattaggcctcatgtcatggaggagccggcgattaaaggactct

SEQ ID NO: 72088 - DNA, 30 bp, Homo sapiens
  chr11:120449384-120449414
  hypo
tcagccactgcccctcggccttgggagctg

SEQ ID NO: 72089 - DNA, 109 bp, Homo sapiens; identical to SEQ ID NO: 43265
  chr11:120748772-120748881
  hypo

SEQ ID NO: 72090 - DNA, 321 bp, Homo sapiens
  chr11:120772435-120772756
  hypo
ccagcctctcagagccgggaattacaccgtgcttggagttctggcacagatccacagctacgccaagtccacagggtcctgttgctagtctgggaaagtcaccctgatttgtgcatgtgtgcacgtgtgcttattcacatacgtgcacgtgctcatgaggggtggggtgcaggccggacactggtgtgtgaggtgacatttaacaacatggtaagtacaactcaaacaactattagccttggttcttttcttgcgcgtgtgtgcctacagtggctgatccaattcgatagctcttaccaggaatgacgatcttaattcagt

SEQ ID NO: 72091 - DNA, 30 bp, Homo sapiens
  chr11:120773074-120773104
  hypo
ttgggctttccaacgcgtctccaagaccgg

SEQ ID NO: 72092 - DNA, 179 bp, Homo sapiens
  chr11:120837755-120837934
  hypo
tgggctcgccccacccgctgcatctgtctgtcccctctcgaggtgaaagcaggcagggtggccaggaggtgtgccgggaaggggagcagagtgacacctaacagggcattcacaacctgtgtcctgggctctcccgtaacccccgcaggctcggttttccgggacgagtttgatctggc

SEQ ID NO: 72093 - DNA, 30 bp, Homo sapiens
  chr11:120937707-120937737
  hypo
acagccttcctagctcggttccccgagctt

SEQ ID NO: 72094 - DNA, 231 bp, Homo sapiens
  chr11:120998602-120998833
  hypo
cagcaccagccagtgcgtccctctgcacaagtgcggctgcgacttcgacggccactactacaccatgggggagttcttctgggccacggccaactgcactgtgcaatgcctgtgcgaggagggcggggacgtctactgcttcaacaagacctgcggcagcggggaggtgtgcgccgtggaggacggctaccagggctgcttccccaagcgggagaccgtgtgcctgctcag

SEQ ID NO: 72095 - DNA, 30 bp, Homo sapiens; identical to SEQ ID NO: 43269
  chr11:121000904-121000934
  hypo

SEQ ID NO: 72096 - DNA, 209 bp, Homo sapiens
  chr11:121023611-121023820
  hypo
ccattacgagagctgcgtgagtgtctgccagccccgctgcgccgccatccgcctgaagagtgactgcagccactactgcgtggagggctgtcactgcgacgctggctacgtcctcaacggcaagagctgcatcctgccccacagctgcggctgctactccgatggcaaatattacgaggtatgggaggccagcccggccttttcctcct

SEQ ID NO: 72097 - DNA, 139 bp, Homo sapiens
  chr11:121152146-121152285
  hypo
gtgtgcttccagagctcggggacttcgcagcctccatagtagcgttcactccctggagccactttatgtactcttaacttgtcttgtctcattcctttgactatgccagactttgtagcccccacggcctggtgttggg

SEQ ID NO: 72098 - DNA, 30 bp, Homo sapiens
  chr11:121192536-121192566
  hyper
tacagtgaagaaatacgatgactggttggg

SEQ ID NO: 72099 - DNA, 316 bp, Homo sapiens
  chr11:121297857-121298173
  hyper
cacactagagagccacgcattctcctgtttctggaggaggcttctctgaaggcagctcacatgagtaaaagtcactttttcaggtcgcagtcccgcgcaaggggcggaaggggcggcggcgcctgcaaacgccgcgggagggcgagcgcgcggtcgcagagctccaagaccaggtcccggccccgcagcgcccggcccagcccggcccgcccacctcgcgcggaaacttcgagctgcgcagccgccgcgccggcgcctccccagcaaagctccgctaagtgcggccggcgggggtgcggggcgttgggcacctgac

SEQ ID NO: 72100 - DNA, 350 bp, Homo sapiens
  chr11:12131862-12132212
  hyper
cccgcttaccaacaccgggggtttcatctcgcagcgccaccacgccccactcccagcagccctcccctggtctccgccctgtgcgggtcagggtgggagcgcccggccactccctgcgttctgggccgggctacagcccacgtgcgccggcggcagcggcggtgacagccggccccacgggggcggggcgggctccgtgctgtcctgtcattggccgcgccgctgtcgggggcgttccccagcccggtccaccgcgcggcgcagaaccgcaggcgctcggctggctaagcctgcgccgggccgcctcgctcgctcccagctctgtcagtggcccgcggggcccgatcgct

SEQ ID NO: 72101 - DNA, 112 bp, Homo sapiens
  chr11:12132499-12132611
  hyper
ataaaagcctcccaccggcacgccgaactacctcttactccgctccgcaacacccaaaccctgcagttccaagcctagaaaatcgcaagcgccaaaacggggtgggagtgac

SEQ ID NO: 72102 - DNA, 319 bp, Homo sapiens
  chr11:1214648-1214967
  hypo
aaccaaggggtgccccggagatcgggagaggccggaccctgcaggtctctgtgcttctgcagaaaggtgagacctgggccacacccaactgctccgaggccacctgtgagggcaacaacgtcatctccctgcgcccgcgcacgtgcccgagggtggagaagcccacttgtgccaacggctacccggctgtgaaggtggctgaccaagatggctgctgccatcactaccagtgccagtgtgagtggagcgccgagcgggacccagggcagccggggcagccactccccacccaggtggaaatgggcggggcagaggaggg

SEQ ID NO: 72103 - DNA, 34 bp, Homo sapiens
  chr11:1215395-1215429
  hypo
tcctggacaactgcacgtacgtgctggtgcagca

SEQ ID NO: 72104 - DNA, 202 bp, Homo sapiens
  chr11:121546780-121546982
  hypo
ggtgcaaagtgctggcggcatgagctgggaaagggcccttgaagccttctcccatgccttgctggagatgcagtaaacagatctattcggtgtctagccctcacctggagtttgcagctcatctctgccatgccttggctgagagtcccagttgttctacatacttgccaacatttggtattgtgtgcggtgataatttatt

SEQ ID NO: 72105 - DNA, 329 bp, Homo sapiens
  chr11:1215733-1216062
  hypo
gtcagccccggcttccggaaaaacggcatcgtggtctcgcgcatcggcgtcaagatgtacgcgaccatcccggagctgggagtccaggtcatgttctccggcctcatcttctccgtggaggtgcccttcagcaagtttgccaacaacaccgagggccagtgcggtgaggccacagggctcccgggcatcgtctggcattcgcgggggcgggggtgccgggcaggggcgaggccaccacgtgccgcgtgtgccggtgtctctgctttctggctgctctgctgagtgcaggccacaggcatgaggcttacgcctgccggtacctgcagctc

SEQ ID NO: 72106 - DNA, 257 bp, Homo sapiens
  chr11:121593379-121593636
  hyper
gggagcgcagagctccgccaggagagggccgggcctgcgcactctaatttttcactgcagtttaaacactccgtgaggctctcaggaagcggcgggggtggggggcggccggagagaaggggcccgcgtctccgccgcttccatcaccgccctggaaatagcatctgaacgcgcacggcccgaccaggcttcccccaagctgctaagatttcatttcacctccgacaggcttcatggggactcgctgttaaaagatc

SEQ ID NO: 72107 - DNA, 120 bp, Homo sapiens
  chr11:1216277-1216397
  hypo
tagggggacggtggtcgcttcctgctccgagatgtccggctctggaacgtgagcataccctgaccagccagcctgccaccggcctcacccgacgcccaccacggtcgggcccaccacagt

SEQ ID NO: 72108 - DNA, 50 bp, Homo sapiens
  chr11:1216937-1216987
  hypo
tgtgtggaaggagcccgtccggggatacaggagggcggccacacaccagt

SEQ ID NO: 72109 - DNA, 35 bp, Homo sapiens
  chr11:1217246-1217281
  hypo
atcgattggagaggccggaccggccacatgtgccg

SEQ ID NO: 72110 - DNA, 30 bp, Homo sapiens
  chr11:1217534-1217564
  hypo
gatgttggtgcccagcggcccgcgttgctc

SEQ ID NO: 72111 - DNA, 30 bp, Homo sapiens; identical to SEQ ID NO: 43272
  chr11:121910451-121910481
  hypo

SEQ ID NO: 72112 - DNA, 161 bp, Homo sapiens
  chr11:1219739-1219900
  hypo
ggctccggggggctccgggggactttgcctctcctggcaccacagcacagccaggcctggatcccacggctctgtcctgagccggctgagtatgtggccctgcagagtgtgtggccttgttgggcaccccatccaagggggtgcagcgtggggctctgctc

SEQ ID NO: 72113 - DNA, 173 bp, Homo sapiens
  chr11:1221703-1221876
  hypo
tgctgccaggagctgcggacctcgctgaggaatgtgaccctgcactgcaccgacggctccagccgggccttcagctacaccgaggtggaagagtgcggctgcatgggccggcggtgccctgcgccgggcgacacccagcactcggaggaggcggaacccgagcccagccagga

SEQ ID NO: 72114 - DNA, 30 bp, Homo sapiens
  chr11:12231039-12231069
  hypo
gtagaaattggctggcgggcagaatttctc

SEQ ID NO: 72115 - DNA, 30 bp, Homo sapiens
  chr11:122311181-122311211
  hyper
tgaggtttcctaaaacgacaaagaaataaa

SEQ ID NO: 72116 - DNA, 157 bp, Homo sapiens
  chr11:122402591-122402748
  hypo
agtagtgtttgaaatcgcaaaacattgcaaacaactggcctggcaatagagtatgggttaaattattgtatatgcatccaatagaatattaagcatctcttaaagaagaatgaggaagccttttgtgtactgatgtgaaatgtgtttcaagacatat

SEQ ID NO: 72117 - DNA, 98 bp, Homo sapiens
  chr11:122511898-122511996
  hypo
tatttttcagactaacggagacaagcagcagtatgggcttcattaatatctggcttgagccgggcgaggtggctcacacctgtaatcccggcactttg

SEQ ID NO: 72118 - DNA, 75 bp, Homo sapiens
  chr11:122575506-122575581
  hypo
gtgccccgtcaacaattttttttttaatagaaaactttattatgaggtttctttaagggccgcactttctcgaag

SEQ ID NO: 72119 - DNA, 30 bp, Homo sapiens
  chr11:122659896-122659926
  hypo
gcagaccagcaccagcgagggttggatcta

SEQ ID NO: 72120 - DNA, 139 bp, Homo sapiens
  chr11:122752920-122753059
  hypo
gcatgcacaggagcacgcacttcttagggtaaatacctaaaagtgaaattgctggatcccaaggcatacatatcctggctaatgtcaaaccattttccaaaatggttggttgcatcggttctcacgtccgcccgcagaa

SEQ ID NO: 72121 - DNA, 473 bp, Homo sapiens
  chr11:122753630-122754103
  hyper
ggaggatgcggggcccgtccgggtcgcggccgcggaggagcgccgggcaggtgacgggcggtggcctcccggatctggggtgggcggcgcgcccggggagggaaacgggaagggcttactggggatggggacggcaggaaaccacccaagcaagctggggaggagccggcgcgggagccttcgggacggagtggggagcgacaagggggcgaggccgcgacaaggggctggggggccgccatgcgaggcttcggcgcccgggcacccagagcagccctgttcccggtcaattaggaccggtcccgggcaccaggcccgccgacttgtcacttcctggacctccaaacgccccttgtgacaggccttgttcctcaggaacaagcaaaggtagaaaaccgaacgcctcccctgggcagcttccggcctgtttcaaaccagggttcgttcctttttctttacgattcatcttggtg

SEQ ID NO: 72122 - DNA, 1184 bp, Homo sapiens
  chr11:122847129-122848313
  hyper
taatgaaaggttattcgcaagttcatttctacagggactaggaaactgcctagggccgaggggagggggcgtacgcgtaggagaacgcggtggcaaaccattcctggaaacgcgtgatcattcccagttttgccctgcgagcctacaaacccggtaaaagaataagagacctcccaggggaaaaggagaggggtaaagcgcaaagtcaatcagacccccgccccatctattccccaaacaggtgcacgcccggaacgcctttagccttaaccctttggccttcatcttgatttcctaaaatgcactgagaatgaatatttccacacacaacccgaggaacactcacttttaaaatatcagtagcccgtggaacgtggaagcgttgcgggacaggagcgcaacaagttcgggaagcagaaattgctctaggggttttctgtgcccaagtttcccgccgcgcgctggcgccgcgcagtacgcgggaggcagggcgtaaggggcgtctgcgcctgggggctacaaactcaggaagggtgccaggatgcagaaccgcgagctctagaggagaacagggacgggagaggatggaagcgccgcccagagaaggagggagtcgccttagtatttgagtcagagatgggactctggggatgggggatgggggcgagtgggaggttagtgacgagcagtgcacgagtctgtcctgaaactggacgttttaaagatcagattgtggttctatctggatctcggcggagcggaggccccagagacctggtccctttgcagccaaacggactgcccaagaacgggcaaggacttggcgtggagaggaaagaacagagctaggggcaagttgctgaaaggcgagggagaaaggggtctatgatcggagaaaacagagagccgagagctgaatttccagtctgggacgcggtacttgggctggtccctgaccccaaggacgacggacgcaggaaaatgggcgcccgggcgcacagtctcccgtggctgggaccgggagggctagaggggaggcgggaggccgggccgcgggccgtgctggctccgcaccggcctggaggacaggtgggttttgtttgtcttccaggagcggatttccaaggcccgccacgagactggagtctgagtcttccggtccaggagggaaccgcgctcggccc

SEQ ID NO: 72123 - DNA, 402 bp, Homo sapiens
  chr11:122848368-122848770
  hyper
cggccctgagcccagctccccctcgtctccaatgtccacctcgtcctctggctcggtcagcacgaagggaccggcgggcaggctcagccgagcctcggcggcggtggcggcctctgaaccgcgggggctgccctcggggctttctggcccgtctggtgctttgggttcgtcttggcttttccgcagttgctttttatgcttcatccgccggttctggaaccacgttttcacctgatttcggggagataaaaataaaatcatgtcattcctccaaatctgagccatcgctggggtttaggaaaatgggctgcagtccgttgatgaagtatccaagagcggtgatagcctcaactgctcataagttatcgccttaagccgaatgagaatcgaacagtctgaggc

SEQ ID NO: 72124 - DNA, 317 bp, Homo sapiens
  chr11:122849807-122850124
  hyper
ggccaggtgtaggtaattttacgaaagctcttgggaaaggcttagaataagcgtcagcggggtctatttctactcgaactccacaaggtcccgaaggtattaagacttgaaggcagagaggaacgaagcagagatcagggcctccctctcctcccgcccacctgcgtctcggacaggctgagggccgtggccagctccactcgttctggcgtggacaggtagcgctggatctcgaacctcttctccaagcccgagagctgcgagtcagagaaaaccgtgcgggctttgcggcggcggcagtgcttccccggcagctc

SEQ ID NO: 72125 - DNA, 1144 bp, Homo sapiens
  chr11:122850148-122851292
  hyper
cgctgggactggcatccctgcagagagaagagcaaccaagtgggcagagcgtgggtcgccggagagcaatctccgctccgctcccctcccctcccctagcccccagtgccttcctccgcccctcgcctccgtcagtctgctcgccccaaagcccctcaagcctttctctcaggaatccagggcagaggaagaaaaaaaaaaaaagccgcaagaatagcgcttggagatctttatctggaaagtcatctagaaatacaaacaacaaacagtaaataaaacagaaaagaaaatcggaaaatagatccggaggctgtttaaaaatgtcttcttggagagacttccgtagggtcggccagcgcggagtcttcagttgcgcctggccaagttttttgcaaacgtcaaatggcccaggagcagtcctgtccccagcccccacctatcctcctagacccctgatgacactcattgctgttctggggctggtagatgcatggatataatcttgcctccaaaccttactgaaaaatacctttctgtttcccaagccacccctatccccctgcagccaaagggagagcaaaactgccttatccggagaagccccggagccgaaacagaggagcatttctcgcctctcacgtctcctcgtccgtttcggggtcgcgctagggacccagctacctaatatagtcctcattctttttctcattctttccctctcactccaagcccagcgaagcagaagggtttgaggggtttttccatggccgggtccggggagacttgtctttcctgaccctcgcaggcttgactctgtctgagacgcaccaagcagagagaagctgccacaagcaacatcggccaatcccagagaaaataaacaaacataacaacaaccagtgcgggtacttagggctttggccactgctgtatgggaggaccaccggagcagctgagaatagattgtcaccggcgggtggtgaagccagtgcagagatgcggacctggatttacaaacacttttagctttgttctggattccagcgcgcacaaactgcctcctgtcttgcccccagcccctccaccgaccatggttgttgccgcctctgagctatgagtctggactcaacgaattattctattc

SEQ ID NO: 72126 - DNA, 482 bp, Homo sapiens; identical to SEQ ID NO: 34105
  chr11:122852370-122852852
  hyper

SEQ ID NO: 72127 - DNA, 30 bp, Homo sapiens
  chr11:122854391-122854421
  hyper
aggggccaggggtgtcggtccacacttcac

SEQ ID NO: 72128 - DNA, 114 bp, Homo sapiens; identical to SEQ ID NO: 11039
  chr11:122854915-122855029
  hyper

SEQ ID NO: 72129 - DNA, 27 bp, Homo sapiens
  chr11:122855030-122855057
  hyper
ccccgcctctgccggggccccaggagg

SEQ ID NO: 72130 - DNA, 137 bp, Homo sapiens
  chr11:122855295-122855432
  hyper
ggtgccctgaggaaccgcggcggggactcgccgctggcagcctgcgggtcctggtgccagcgcgcatgggcgggctgtgcggacgtggctggtcctccaaaggtttcagatcccgtccgggccgctcagtcccttaa

SEQ ID NO: 72131 - DNA, 97 bp, Homo sapiens
  chr11:122855721-122855818
  hyper
cgcgggccccagggctgcccagggaaggagtacatttttagacatttttagatagcttgcaaaggttgtctgtggcagggaacggggacagggaaac

SEQ ID NO: 72132 - DNA, 53 bp, Homo sapiens
  chr11:1228830-1228883
  hypo
cctcctctcccggggcgtctcagctgtccccggggccacgtccccccctcact

SEQ ID NO: 72133 - DNA, 30 bp, Homo sapiens; identical to SEQ ID NO: 43017
  chr11:12288561-12288591
  hypo

SEQ ID NO: 72134 - DNA, 36 bp, Homo sapiens
  chr11:1229945-1229981
  hypo
cccctctgccagcctcgcaggcgctaagtcaacatc

SEQ ID NO: 72135 - DNA, 768 bp, Homo sapiens
  chr11:123065429-123066197
  hyper
gacaatctcgatggccgactgggcggccctcggttgccagatgtgctcctccgtggccaggaggcagggactgaaaagccggctgactccaggggctgcagggacacccggtcagaaccggcgtctttcccggacgcagggctgcgtttgcccacggccatccaaactcccgccctcccagaggcactcacctagcaagaggagaaggaggagggacatcccgatccccggacgcgggcgcttccccgctcagctgctgcttggctccggggcggccgggcgcctccgacggacctcgggcgagctgggcgcggcgcctcggggtgcgcgcgaggtggctgcagccatgtgccgggcgggagccggccccgcgccccgtgcccctgggggcagatgggctcccggcgctcgccccaccagctggcgcccggacgggagccgggaccagggtcagggaggaaaacgcgaggcgaaaaggcgctaccgcttcgtggaacacttttccctgtttggaaagaaaaaggagtgaagaaagagagagggaaaaaaaaaattcagctggaaccacatggttgcctcctaccgcagcccctccctctctctctcgctgttccctccttccctccctccctcccgcgcggcgtttggggtttgcggtgggggccggtcggggagaagcgtgagctggccgggcagggagggccgggggagacctggggccgtgcagaggcgggtgggttgagaggcgccgggcgtaggattgattct

SEQ ID NO: 72136 - DNA, 63 bp, Homo sapiens
  chr11:123066400-123066463
  hyper
ttgcctctccctcctcgtctcctcatgccctctcccctctgtcctctgcgctcttctcgcctc

SEQ ID NO: 72137 - DNA, 183 bp, Homo sapiens
  chr11:123169348-123169531
  hypo
agtgggaggcacagccggaactgcgccctccatggagcaggtggagctgggaacaggtgggagggagccctgcctccttccgagttggcagggtgggaacccctccctctgtggctgcagacccagggatcgctgcgctctcagggacctgggaagccccccttcccccgcaggctcagaagt

SEQ ID NO: 72138 - DNA, 409 bp, Homo sapiens
  chr11:123172454-123172863
  hyper
cgcagcgggcagggacggaggcgcccaggggcaggcggcagcacgggaagaggccagcaggtggcgcggtcgcccaacccggccgccccccgggcgccgagggaagcgggtcaggggcgtccccacctgcccaagcgccggctctcccaggcagcaggggcggcggcggcctggctggctgcgctgcagagcggagagcaggagcggcgtgggaggaattcggagcactttcgccgcctgcctccttttactgctggttgccctcaaaggagccctctccctccacacgcctttgggccttaccagccgccggaagcggcggcatccatcccagcaaagcgtgcattccatcctctggaaaaaaagtctttgagcttcctttacagtgaccttactttggggactgaac

SEQ ID NO: 72139 - DNA, 114 bp, Homo sapiens
  chr11:123172915-123173029
  hyper
cgtggttgacgaagccattccctccttgctacttgccttgtgtgatacactgtcacggcccgggcttctggcttggtggaggggacaccaccgcggctccggctgcggacttcg

SEQ ID NO: 72140 - DNA, 93 bp, Homo sapiens
  chr11:123228623-123228716
  hyper
cagatgcttccccatcgtgaagatcctccgggtcacctatgcactcctgctaatctctgccatttgccttcttacaccctttccataccttcc

SEQ ID NO: 72141 - DNA, 392 bp, Homo sapiens; identical to SEQ ID NO: 999
  chr11:123228788-123229180
  hyper

SEQ ID NO: 72142 - DNA, 226 bp, Homo sapiens; identical to SEQ ID NO: 1000
  chr11:123229181-123229407
  hyper

SEQ ID NO: 72143 - DNA, 130 bp, Homo sapiens
  chr11:123229461-123229591
  hyper
cgcccgaaccgggtgtccacatgagtgcctctcccagcagatccaggtaagaacttcctgaccttcctgagccctaggaggaacacacatggatgccgagtgatggtgagggatccgggtgaaactggag

SEQ ID NO: 72144 - DNA, 144 bp, Homo sapiens
  chr11:123300811-123300955
  hyper
cctttacttggaggtcgagtccctccccgagggaatccgtgtacagttacactagcggtcgctgccagtgctagcccattcaggatagcccccctcaccccgcccccagcccccgctcctcctcctccttttttgtttttatcc

SEQ ID NO: 72145 - DNA, 14 bp, Homo sapiens
  chr11:123301015-123301029
  hyper
ctgcctcttcctcc

SEQ ID NO: 72146 - DNA, 1037 bp, Homo sapiens
  chr11:123301082-123302119
  hyper
cgcaaaccgctgagagtttgctgcaccgccccctggggcccctggctgccgagtcccgctaaggcaaagacgccagcaagcgaggaagcgcagcggaagaaaaacaagcgggcgcgcgaggggagccccaggagggctgccgagtggctggcaggcggctcccgcccctcccgggtggcctcgccggcggctgacggcccggaggacgcgcgctccgaaaagttagactccgggcggcggcgcgctacgccgcgtcccctcgcgtcccttcctcgctgcgctccgggaaaggaacttgttccttcggccccaggattggggagtgtgccgcggggccgagggtggggaacagccagagggagacgcgaaccaggccgctggcggagggctcagggggagcgcagaggcgacggcccccatgccggcggccaacatgatggagaaccggccgctgcccgccctgcaggtgcccgagccgcagggtgcgcccgagggcagcccggtctggtccagttcgtcgacccccacgcttcgccgccggcgcttcaagatgcgccgcatgaagaacgtacaggagcagagcctggaggccgggctggcccgggacctgcccgccgtcttggcccccggcaaggagttcctgcagctgccgtccatcgagatcacgccctccagcgacgaggacaccccgtggtccaactgctccacacccagcgcgtccccgcgccgaaaacgcttcctcctccgcaagtggctgagggtgagggagcggaaggagtgcagtgaaagcaggtacgtccccgttccgcccgtctccttcccttccctcccgtcctctccagagccgtccagggccccggggcattctgggggaaacgtcctgggggagaacaggagcccgtcaccagaggcgcttctggagggcgctgcgcctggtcccagggatggtggcattcagcttccacgcgtgccacccgctccccaactcagggtgaggggcttcatgttgcacgacacgtttacgtggggctttacgc

SEQ ID NO: 72147 - DNA, 74 bp, Homo sapiens
  chr11:123443648-123443722
  hypo
tggctggggcaggggcgcaggtagaccccgatagctgaggcagaggcgcagataggccccgatggctggggcag

SEQ ID NO: 72148 - DNA, 47 bp, Homo sapiens
  chr11:123457217-123457264
  hypo
tctcctggactcatgcggtccctctgggggtccgccctcgggtgaca

SEQ ID NO: 72149 - DNA, 439 bp, Homo sapiens
  chr11:123524538-123524977
  hyper
acagagagattccctcggtcaaggactgcgccctctcagattctttcgaggaaaccctttgggacgaactgcccccagggggcgactttctgaccgaaggaagggccgagcaccggtgcctggggaggccctgggagcttttggagccgggtgggggctttgggccctaagcgaccccactggacctccccagttcgagggagccgatcagccgctccgcgcccgctctcgccggcgctcagcaccacggacagtcgcctccccgcccaccccggaactccagcttccactcgcgcccctgcctcgctcgtttgcgcccagggtaagctcagctcggaagggagtcgcactgctggcctagcagccaggctgtggaagggtccaggttgattcacctctcgcctccccaggatcggttgcgttccgactggaatcctcc

SEQ ID NO: 72150 - DNA, 79 bp, Homo sapiens
  chr11:123525394-123525473
  hyper
ccctcccaggcccagcgccgcgccgagcgggggcggagccgggagcggcgcagacacttccagccgggatatctttgct

SEQ ID NO: 72151 - DNA, 30 bp, Homo sapiens
  chr11:123543339-123543369
  hypo
gcaaatgagaaaagacggatactcaagtgc

SEQ ID NO: 72152 - DNA, 78 bp, Homo sapiens
  chr11:123885065-123885143
  hypo
tccataacactgctgcgaggcacaatgtcataaaactcactatcatttatcaagcagttattacctgccagggatagt

SEQ ID NO: 72153 - DNA, 59 bp, Homo sapiens
  chr11:12398995-12399054
  hyper
ttccagggcagagggcggcgcgagggagggagcgagggagggagcgagggaagggaaag

SEQ ID NO: 72154 - DNA, 106 bp, Homo sapiens
  chr11:12399277-12399383
  hyper
cttcttggggaaactcggagggaccctggcccggaggaagaaagccaaggagggtgagtgcggccaggccggccgggcgggcggtaggagccgggggtgccgtagg

SEQ ID NO: 72155 - DNA, 30 bp, Homo sapiens; identical to SEQ ID NO: 42898
  chr11:1241768-1241798
  hypo

SEQ ID NO: 72156 - DNA, 30 bp, Homo sapiens
  chr11:1243139-1243169
  hypo
ccccatggggccggacgaggccacaccacc

SEQ ID NO: 72157 - DNA, 199 bp, Homo sapiens
  chr11:1244348-1244547
  hypo
ccaggatgggtgccccgagcgcgtgccggacgctggtgttggctctggcggccatgctcgtggtgccgcaggcaggtaagagccccccactccgccccctctcgatgctgtcttcacggcgggggtctctgcaggtcgcttgcctgggagcttctcctgcagagtgcacgggcagatccccctacgactccctgagtgt

SEQ ID NO: 72158 - DNA, 30 bp, Homo sapiens
  chr11:124522134-124522164
  hypo
tgttaccttgcatggcgaaaggcactttgt

SEQ ID NO: 72159 - DNA, 30 bp, Homo sapiens; identical to SEQ ID NO: 43276
  chr11:124526915-124526945
  hypo

SEQ ID NO: 72160 - DNA, 68 bp, Homo sapiens
  chr11:124588270-124588338
  hyper
ccacacacttgtcagcggcggtattattgttgtggtttagcgcctggcagcgccgcctccccccgctg

SEQ ID NO: 72161 - DNA, 20 bp, Homo sapiens
  chr11:124629399-124629419
  hyper
ctcggccctctgcctcggag

SEQ ID NO: 72162 - DNA, 63 bp, Homo sapiens
  chr11:124629499-124629562
  hyper
cgccctaggagagccaggctgaaggcctctaagggctgggagccgatccggccaggatgcaag

SEQ ID NO: 72163 - DNA, 408 bp, Homo sapiens
  chr11:124631502-124631910
  hyper
gctggggaattgacacgaagtgcgtgtgtcaagcctggggaccaggggtatttccccgggggatcttcctcatcagcttgtatgtggggtcggggatgagagggggctagagttaagtccttaagctctttagccagtgtctcatctagcggctcagctcatccggctctgctgggtggggggtggggagtggacagggtgaggaatggttccgataactcaccccagaggtatccaggtcttccgagagatgcccttacctccccccgccatccgcccccacacccaaactgggggctgtccccgacaaagcgagaagtcagcgccagccagtgatgccctggagtgggattaggaggtcaggggaggagggcgagtcgtgggacccagttccgcagcagtggccaa

SEQ ID NO: 72164 - DNA, 30 bp, Homo sapiens
  chr11:124639029-124639059
  hypo
agacttttcctgctacgttctcataccttc

SEQ ID NO: 72165 - DNA, 46 bp, Homo sapiens; identical to SEQ ID NO: 34126
  chr11:124709117-124709163
  hyper

SEQ ID NO: 72166 - DNA, 374 bp, Homo sapiens
  chr11:124709482-124709856
  hyper
cgcctaatccccgcacgcggacacctgggtgggagcgcgggcgagtggagggcgcgcctgcacgcaggatcccgggctgggcaacggcctagaccgcctctcgccaaacctcccacgccagcgccagtccgacgaacaggagctggtccagcgaacaataaaaggccccggggctggggagggatggaagcgcccttggagcgcgcaggctacgggcgcccccggcagcgcccccgcgccttcccctcccgccccgcggccgctgattgcctattgtgcgtcccctctgcggccgcccgcgcgatgcactctgcgagctggccccttcgtttctaaatgagcagccagcgccgcagacacgtgccaagggaagg

SEQ ID NO: 72167 - DNA, 156 bp, Homo sapiens; identical to SEQ ID NO: 34128
  chr11:124712781-124712937
  hyper

SEQ ID NO: 72168 - DNA, 336 bp, Homo sapiens; identical to SEQ ID NO: 34129
  chr11:124713057-124713393
  hyper

SEQ ID NO: 72169 - DNA, 30 bp, Homo sapiens
  chr11:124733379-124733409
  hyper
ggcctggtaccaggacgtggggtttctatc

SEQ ID NO: 72170 - DNA, 349 bp, Homo sapiens
  chr11:124735003-124735352
  hyper
cagaagggcagagtccgacagagcctcgtccctcatcttgggtgctttgagacagggaaaatctctcgccgcgtccagaacggaacgctgggcttggggtgcggggcggggactccaactcgcgcgctacgctactcgtgtctcctgctcggatagtgactgtagaggtaagggtgggagggtggagggaggcggattaatcccttaattacgccgtgatcggcgtggcacctgctttccgcctgcccagctcccaggggactccggcactagggggtggagagaaggacgagggaaggaggagggcacgaagaggcaccgaccgtacccaggcgcaccggcaggagag

SEQ ID NO: 72171 - DNA, 1083 bp, Homo sapiens
  chr11:124735374-124736457
  hyper
cgcagaggctgtggaggggcttacggctcccagcccacgggtctcagacccaggggctgggcccccagcccccagtcccgatcccagctgggtcgagccatgctgcgctacctgctgaaaacgctgctgcagatgaacttgttcgcggactctctggccggggacatctccaactccagcgagctgctcttgggcttcaactcctcgctggcggcgctcaaccacaccctgctgcctcccggcgatccctctctcaacggtgagaccctgcctcttggggatatgggatcctgggatggggatgaggtgagagggcggcgtggaagggaaggagaagcgctcctgtcccgaggtccgggattgagtggcgcctcccagcgcctccctgggtcgtggggtctaagggataatttggagcttcgagcacatgagtgggggtacccgcgggaggtcgagggcttgggagaagatggctactgagtctttttacacctccttcccttcccctacaacgcccaccccaggtgagaagaaccgttgctggtaacgggcagggaagtccgagctaagaaaggcccgggcccagcgcagggagggcagaggagggggcacagtctcccgccggcctcggccaagccaggtcactcggtgacccacccaggcagctggtcttcggaaccccgaagtttcccaagaactcacttaggaccagaggaagccaaaatgctggatgtgtttgctacggaggggataggggcggcgatcattttaaggaaacttagaagtttgtctttcagcggcgggactctcagccggcccaccccggcagagctgtggcgggcgggcggagctggcggcgaggtcgttaccgctaattacggtgattaataaatgactgggacagcgcgctctcccctagcgccgcggggaagctgcgggagccggccgccgccagcctgcggagaggccggagcgcgccccctgcctgccgcatcgggaacccccgctttaccgggcgctttcgcgtgtggttccctccaggtgcacgcggtccccatccctctgcctcgacccactcgagtc

SEQ ID NO: 72172 - DNA, 579 bp, Homo sapiens
  chr11:124738445-124739024
  hyper
tagaagtttgtgtcccgatccctctactaaccggcctgtctgtaggcatcttcctttgagacgaggaacgcggaacgtctgccaataaggacatattggatcctgcagagggagagggtaggcaggtggggactgagctccgcagagaagcataggagatggaacgaccagaggattctctttccctctggagcctcaatctctccccacaatttccctgtctgaacgctctgcgccaccccctgtccccagggtcaagggtaggaccggaggacgctatgccccgcatcgtggagcagccgccagatctgctggtctcccgaggcgagcccgccacgttgccctgccgcgctgaaggccgaccccgacccaacattgagtggtacaagaacggggcgcgtgtggccactgtgcgggaggatccgcgtgcgcaccgcctgctgctgcccagcggcgccctcttcttcccgcgcatcgtgcacgggcgccgcgcgcggccggacgaaggtgtctacacttgcgtggctcgcaactacctgggggcagcagcgagcagaaacgcctcgctggaagtggcag

SEQ ID NO: 72173 - DNA, 247 bp, Homo sapiens
  chr11:124739234-124739481
  hyper
aattccagtctgcagcgatcaaccccttcccaagacaacactttccctgtgtcctcagccagttatgtcactctacaccctgcttatttcgccccccaccgccccgcccagtcctccgtgatgatttccggcagtctcctggaaacgtggtggtggcagtgggggagccagcagtactggaatgcgtgcccccccgcggccacccggagccttccgtgtcctggaggaaggacggtgcaagactcaa

SEQ ID NO: 72174 - DNA, 151 bp, Homo sapiens
  chr11:124743216-124743367
  hypo
gggcttctacagctgcgtggccaagagttccacaggggaagccacatggagcggctggcttaagatgcggggtgagttttttctttcttcccttattttgataataccttcctccaaacctgcttcaacaggtagtcgatacctcctcaaa

SEQ ID NO: 72175 - DNA, 337 bp, Homo sapiens
  chr11:1247782-1248119
  hypo
caggggaggctaccccgtggggggctggcatggggatgggcctcatcccgcgctccccacagccctgaacccggcgcacaatgggcgggtgtgcagcacctggggtgacttccactacaagaccttcgacggcgacgtcttccgcttccctggcctttgcaactacgtgttctctgagcactgccgcgccgcctacgaggacttcaacgtccagctacgccgaggcctagtgggctccaggcctgtggtcacccgtgttgtcatcaaggcccaggggctggtgctggaggcgtccaacggctccgtcctcatcaatgggcagcggtgagccggccac

SEQ ID NO: 72176 - DNA, 39 bp, Homo sapiens
  chr11:124791254-124791293
  hyper
gagacacggagtagccgggcgggccgggctccgtcgcgc

SEQ ID NO: 72177 - DNA, 315 bp, Homo sapiens
  chr11:124933396-124933711
  hyper
gagatcaccccagatcggccccggcgtcgccgcgtggccaggggtgctggggggacttggtcccgagctcctccagcggcgcccgcctcggaggttgataaccctccctgcccaactccgcccgcgctcccccagaccccgcgacgctggctcggtgacactggggaagaacaggctgccagggagggtctccatcgtttcccgtttccatcctcccctcctaacacacatccggggcgccttcagagcgcctttctgtcgttgggcagctggggaacctgggctcgaaggctggggaaccgaggccaggggatg

SEQ ID NO: 72178 - DNA, 30 bp, Homo sapiens
  chr11:1249828-1249858
  hypo
ctttgcggagtgccacgcactggtggacag

SEQ ID NO: 72179 - DNA, 140 bp, Homo sapiens
  chr11:125034165-125034305
  hyper
gaaggatttcttgcccgttttaagtttcatcatttctggggagttctcttggggtccacagaaaatctcacctcatctcggtcccctcagcaccggtgatatcttggaactcggccccggttgttcgctaaggaggactt

SEQ ID NO: 72180 - DNA, 354 bp, Homo sapiens
  chr11:125034624-125034978
  hyper
taggctgtgttgtcacgccggtgtcagtctgatgaagattggcatcaggtaagctgtcattcatttccatgtcagagacgcttttgcaggcggcggcggcggcgcggcggcggctgctgctgcgggcggctgcctcagagcgcgtgtgttttattccagtccccaagccagagtattattcattgcgacagggcaaggaggagagagggagagagggaggcagcagggaggagagagagggaggcagcagggaggagggaggcagggagcagcgagggacggcgggagcgtgcagagagaagctggggaagcgccgggagagcgcggagcggagcagcgcgaggggcggcgagg

SEQ ID NO: 72181 - DNA, 979 bp, Homo sapiens
  chr11:125035358-125036337
  hyper
ggagatgctttccagcggctggaggcgggagcggtcccaggctggggccaggtgaccggaggagtcgaggagccgcggccgcggcctggggaggcagggcgaatgagggtttgcagacggatcagtggagacaggggaacaccggcggggcccgggaagccaggatccgaggggctacacgcacggaccctcacccagggaggagcgagaatgtgtagggtcaccggctttccatgattgctggggatctttggtgaggcgggcgtaggggcccgcgcgaggcttgggaatcgggagcccttctggctcgagaactaggggatgagttcgtaaaagagggaactgaaagcgatcgagagcggagagctgagggggatggcgcaggatcccgaatctgccgctcaaagtttgcatttctttcgggttaggagacgggctttcctggctcccgatccccaggaagaaacgagcgaaatgggccgtcctttcccggggctcttcacgggggagccgggggtttccgcgcggtggggagactcgggttgggaattgaggggtaggggcttgtggatcggcctgaattagggctgggttttaggaccagtctagagttcggtttataggatccagactgtttacggaatcgggatcgaggggccgataagtagtttacacgccggccagagcagagggctggaggtcggagttgggggctggaggaacgggtggcgtttttaggattcagtaacaggatcacagctttttcttgtggtggaagctattggaatttggggagggtagcacgaggggtcctgcagctccgcgtgtgaaaaagcgtttaggtaggcgatgaaagtagttgatctgagccatggcaggcgagccccgaatttttgctgcttccccctgaaagtgtttctttaggaggagaggacttgggccacacaggacccggtcctaagagagcgattccgggaag

SEQ ID NO: 72182 - DNA, 571 bp, Homo sapiens
  chr11:1250780-1251351
  hypo
gagtgcagctcagggcgggggcggtgtcctggagcaggaattcctccccaagggaggcagcttgtccccaaggccggtgtcttctgaccttggtgtcccccgtgcatgggccggccctgcctcacgccgcgccccacaggcacggtgctggatgacatcacgcactctggctgcctgcccctcgggcagtgcccctgcacccacggcggccgcacctacagcccgggcacctccttcaacaccacctgcagctcctggtacttatgagcccaccagcctccgcctggggtggggtgtggagctcctggtatttatgaacccgccagcctctgcctggggtgggggtgtggagctcctggtgtgcacccaccagcctccgcctgcggtgggggtgtggagggtggggcccacctcctcccgacatgccggttctgctcacggcctccctccccagcacctgctccggggggctatggcagtgccaggacctgccgtgccctggcacctgctctgtgcagggcggggcccacatctccacctatgatgagaaactctacgacctgcatggtga

SEQ ID NO: 72183 - DNA, 52 bp, Homo sapiens
  chr11:125133192-125133244
  hyper
cagccgctcccttcccgtccctagcagtgggggaagccgcatgaggaggagc

SEQ ID NO: 72184 - DNA, 33 bp, Homo sapiens
  chr11:1251802-1251835
  hypo
gacgctcagcctggacggcggggacacggtgag

SEQ ID NO: 72185 - DNA, 182 bp, Homo sapiens
  chr11:125220500-125220682
  hypo
ccatagtcacaagcccgagtctgggaaagtacaggagtagaccggcattccctgcctctttcccttccccaaggcctccaggcagccaccctggggctacagtctgaggacgggtccaggccgtcctccgtctcacagtctgaggacgggtgagccctggggaggggcgagcttggtgcttg

SEQ ID NO: 72186 - DNA, 30 bp, Homo sapiens
  chr11:125221866-125221896
  hypo
cagatcagacacagccgccccccaagatct

SEQ ID NO: 72187 - DNA, 182 bp, Homo sapiens
  chr11:125259900-125260082
  hypo
gaggcctcaggccagcggcattcagagacttagccactttggccttcagtccgggctctctttgcctagacaggagcagaaaatcccacagacaccaggaaagggaaaggaaatgggaatcctcaacgctagtaataatgaacatttatagagcacttaccaggtgccgggtaccgttccaa

SEQ ID NO: 72188 - DNA, 16 bp, Homo sapiens
  chr11:125271700-125271716
  hypo
gcgggcacatgcattc

SEQ ID NO: 72189 - DNA, 255 bp, Homo sapiens
  chr11:1252832-1253087
  hypo
cggggcctggactagcgccaggctgcagggaggggcaggcagaggcgggcaggggaccggggagggggctgcccccagggcatggcggagatcctggtgccagcgcaggacaccagcattggaccagcggccccggaagcagccagctgggaggatggagcgggcagccctgccctggctcaggccgactttgcacaggggctggctttgcacaggggccgactgcacaggggcgccccccgccagggcttatct

SEQ ID NO: 72190 - DNA, 42 bp, Homo sapiens
  chr11:125304472-125304514
  hypo
ccatcttttcaaccacgctgccaactgaaagtgggtttcttt

SEQ ID NO: 72191 - DNA, 1267 bp, Homo sapiens
  chr11:125365065-125366332
  hyper
ctcctccccccagtccggtggggtaaagaaagcctcctccaggcagcacaatggctggcactctgaggaagccggactcatcccgtgcaggccgcatacacactccactgcccttccggccaaacaagcccggacacgggagagggatgagagtcggggatgcctagcggcgaggagagaagggataggcaaaagggaagaagagcgggctgtgatacctcctcgacgccgtcaaacactgctccccgcattccagagcccggggcccacccgacggcagcgcgccccgccaccgcgcagccgccccggtcccttctcccgcccgtctgtagtaaaacaatcgctctcccggcgtctgcggccgctgccagcggttctgacactgcaggaatgcgcggtctggggaaggctccgcactctggggaggggcacgagcggggtcgggggtaagtttttagggacaaagatgatcttggggcgtttacggtgactggaccagataacggtcccgggacgaggtaccgacccactgccccagcgcgatcgggcggcgttcccttcttcccccagcccccatacctcgccgccctgccttcacacgcgcgcacacacgcgggcacacacacgcggacacacacacacacacacacacacacacacacacaccaggcctggctggagggccgatgctgagatgatactggaagtgcccatcatcccacatctccagggcctggcgcggcgtcccagctgcgctccctgaagggctgggcaggaaggcgacggcctcccgttgttcctttctaatcccagaatgggaccaggtgaggggagctgcggcgaccccagaccgtcctgtcagagaatcccggggcctccttaccacccccaccagaccccacccccagcagtgagtcgggtcctaactaaagtcaacccccgcgacggcacctgtgcgggtcctggcggagggaggcggatcccggggctcagccggacacccccatccacgggccgcgggagcggccggagcgcagcgcagcgcagcggagagccagccagccagccagccagcgagcgctccccgcgcagctccggcggcgcccggctccgctcccgcctccaccccaccccttccccgcgctcgtgcccgggctccgggggcgcgcccgcgctcgggcacccacccaactggcacgcgcgggagctggacgtcatcccctcgttaacattcatagccttcctccgagcacgtgggcttgccttt

SEQ ID NO: 72192 - DNA, 30 bp, Homo sapiens
  chr11:1253832-1253862
  hypo
ggctggggtccctgacgccccgatgcctcc

SEQ ID NO: 72193 - DNA, 84 bp, Homo sapiens
  chr11:1254339-1254423
  hypo
ctgcagcgtttccttcgtgcctgtggacggctgcacctgccccgcgggcaccttcctcaatgacgcgggcgcctgtgtgcccgc

SEQ ID NO: 72194 - DNA, 321 bp, Homo sapiens; identical to SEQ ID NO: 42904
  chr11:1254973-1255294
  hypo

SEQ ID NO: 72195 - DNA, 164 bp, Homo sapiens
  chr11:1256353-1256517
  hypo
ctgcctgggcacctgcgtggcctacggggatggccacttcatcacctttgatggcgatcgctacagctttgaaggcagctgcgagtacatcttggcccaggtacgccgccccctcgcccactcctgcaggccgggcacactccagcccgcggccagcagcttgt

SEQ ID NO: 72196 - DNA, 158 bp, Homo sapiens
  chr11:125755569-125755727
  hypo
ccaacccccaggccacggacaggcacctaggaaccaggccgcaaggcagggggtaagccgtaggagcttcatctgtttctacagccactccccatctggcattactgcctgagctctgccttccgtcgcatgaacaggggtgttagagtctcacaaga

SEQ ID NO: 72197 - DNA, 36 bp, Homo sapiens
  chr11:125757373-125757409
  hyper
tcccgggcatgctcccgccggcggagaaggcccaga

SEQ ID NO: 72198 - DNA, 31 bp, Homo sapiens
  chr11:125759609-125759640
  hypo
gcgacagagagagactcgtctcaaaaaacaa

SEQ ID NO: 72199 - DNA, 256 bp, Homo sapiens
  chr11:1257652-1257908
  hypo
cggtggcgagagggccgggtggggacccaccctacaagatacgctacatggggatcttcctggtcatcgagacccacgggatggccgtgtcctgggaccggaagaccagcgtgttcatccgactgcaccaggactacaaggtgagctcgggccgtgcactcctaggccctgcaggaccctctcacagtgacagaaaccctggtgccaggtggggtctgtgggactcgctgacccgtgggtgcgtgagcctggctgg

SEQ ID NO: 72200 - DNA, 399 bp, Homo sapiens
  chr11:125773662-125774061
  hyper
ggaatttggttctttcgtccaaattgagcggtcattaaatcattagtaccagggatccagggatctataccggattatgcaaacgcatgtaggacgtagaggttataccgaaaggtaatgtttttaacaagagaccacatttcagaataaaagctttaaaaagcctatgtggaacatcacaggtatctagggcaggaacagcagttagagcttgaacagttctgcttcctttccgcaactgtggcattcgaggtcattcgtcatatcaaattcatcagattttgtctccactttgctaaccaattcgctaacctttctgacatcttgtgatgtggaggcggaaatttccagggaaaccgacacggggcgtaaagcgcggcggggagtccggggggctcc

SEQ ID NO: 72201 - DNA, 327 bp, Homo sapiens; identical to SEQ ID NO: 34142
  chr11:125774122-125774449
  hyper

SEQ ID NO: 72202 - DNA, 42 bp, Homo sapiens
  chr11:125774480-125774522
  hyper
cgccaccgagccggggggccacagccgcgggggtggagctcc

SEQ ID NO: 72203 - DNA, 30 bp, Homo sapiens
  chr11:1260620-1260650
  hypo
gtgagggctggtgggcgcctccttagcctc

SEQ ID NO: 72204 - DNA, 184 bp, Homo sapiens
  chr11:126083469-126083653
  hypo
ctgaagttttgacatcgggacttaaattcatatcattacattaattaaaaacttgttttgggtacaggacttttatggttttgtgtcggggatgggagaggctgtttctaccctaaccttatggcattcaagaaactacacctgttcttgcagagttggccttctgtggcgggaaacaaaatga

SEQ ID NO: 72205 - DNA, 94 bp, Homo sapiens
  chr11:126083885-126083979
  hypo
tccttaatgtttctccggtgagtctaggcacttggtgatttaaagtagagttgttctcagtataaagaatttatgtggccgggcgcggtggccc

SEQ ID NO: 72206 - DNA, 215 bp, Homo sapiens
  chr11:126085129-126085344
  hypo
acttctctttcagcccgaattagtgggatttatttcagatttatcttgaatacatttagcattgatactaagaaactggattctgctcttgtccccagaatttaactttttgccactgagctaatgtttatgtttggaggttacttcattgagtggtgttggaatatacttttaagatttctggccaggcgcggtggcttacgcctgtaacccta

SEQ ID NO: 72207 - DNA, 28 bp, Homo sapiens
  chr11:126154206-126154234
  hypo
gcgtgaaccactgcgcccagcccttcat

SEQ ID NO: 72208 - DNA, 30 bp, Homo sapiens
  chr11:126225281-126225311
  hyper
gcatacccaccctggcgccattcacaggca

SEQ ID NO: 72209 - DNA, 109 bp, Homo sapiens
  chr11:126226052-126226161
  hyper
cacctccagcatcctcgagcgatggtttctcccacaactaccccggtcaggtccagcacttgggagctgactgtgctggaggtgacaggctttgcggggtccgcctgtg

SEQ ID NO: 72210 - DNA, 231 bp, Homo sapiens; identical to SEQ ID NO: 43282
  chr11:126273042-126273273
  hypo

SEQ ID NO: 72211 - DNA, 584 bp, Homo sapiens
  chr11:1263180-1263764
  hypo
tccacccttccaacacgctcagcccttccagggacgacggggagcttgggcacatggcgcccctcacagccacccacgctggccccaacaacaatggcaacctccagagctcgcccgacaggcacagccagcaccgcttccaaagagccgctgaccacgagcctggcgccaacactcacgagcgagctgtccacctctcaggccgagaccagcacgcccaggacagagacgacaatgagccccttgactaacaccaccaccagccagggcacgacccgctgtcaaccgaagtgtgagtggacagagtggtttgacgtggacttcccaacctcaggggttgcaggcggggacatggaaacttttgaaaacatcagggctgctgggggcaagatgtgctgggcaccaaagagcatagagtgccgggcggagaactaccccgaggtaagcatcgaccaggtcgggcaggtgctgacctgcagcctggagacggggctgacctgcaagaacgaagaccagacaggcaggttcaacatgtgcttcaactacaacgtgcgtgtgctttgctgtgacgactacagccactg

SEQ ID NO: 72212 - DNA, 30 bp, Homo sapiens
  chr11:126320587-126320617
  hypo
tggtgcgtgcatgtgcgagtttgtgcatgt

SEQ ID NO: 72213 - DNA, 30 bp, Homo sapiens
  chr11:126713464-126713494
  hypo
gctagtgagtgggaccgtcagaggtgtttg

SEQ ID NO: 72214 - DNA, 30 bp, Homo sapiens
  chr11:126719627-126719657
  hypo
gacagaaggtggagacggtgtgaaatgggc

SEQ ID NO: 72215 - DNA, 30 bp, Homo sapiens
  chr11:126786457-126786487
  hypo
tcaaactcaactgatcggtacagaaagcca

SEQ ID NO: 72216 - DNA, 255 bp, Homo sapiens
  chr11:126870174-126870429
  hyper
ccattttgttgcattcgcaaaggcgaagaggcaatgccagagcatctcagcccggcaccgagagacgcatccatcagtccgagttcccgaagcctgcccacgttcctgcccacagcctcccgcgccctgacaacccagccgactttcttccaactccagcagcgcaggggtcctaccttgactgaagaggaagaagcagacgaagagcagatcgagctggaagggtttcattccttagcgcagcgaaggaaagcc

SEQ ID NO: 72217 - DNA, 71 bp, Homo sapiens; identical to SEQ ID NO: 34147
  chr11:126870430-126870501
  hyper

SEQ ID NO: 72218 - DNA, 227 bp, Homo sapiens
  chr11:126870524-126870751
  hyper
cgtccgtgggtccctccgggtggcttcggtctctttgtgcctctgggtatctgcagccagccgacacaaactgcctgttcttagccgcctcgggaagccgggattgtcagcaatgtccccactcggagaagatccattctctggctcttggcatcccaggcacacggcttcctcaggcgggctcctcccacagtgagcgagcgagctagtgacgagtgacagaagga

SEQ ID NO: 72219 - DNA, 30 bp, Homo sapiens
  chr11:126870952-126870982
  hyper
gactttttgtccacacgatgtcctgtttaa

SEQ ID NO: 72220 - DNA, 764 bp, Homo sapiens; identical to SEQ ID NO: 34149
  chr11:126873058-126873822
  hyper

SEQ ID NO: 72221 - DNA, 97 bp, Homo sapiens
  chr11:12695399-12695496
  hyper
gctgggaatctggcccggagacggcgtccaccgcgctcgagagcaacaatctgcatcaccagaaaggcaacttctctaccctacacttgcagacttc

SEQ ID NO: 72222 - DNA, 1116 bp, Homo sapiens
  chr11:12695572-12696688
  hyper
cgtcgcgcgcaactcccgcctcggcgcctgccccctggaagaaacccaggcttccagagttcttcgcgcgagcgcagggacttccaagccgcgcagctcccgtccgccccgccccgccccgccccggctcgggacaaagcccggagcccgcgccgggagacggagggcggctcccgcgcgagccacgctcccccgtgggcgcgagactccgcccagctgccgaaagcccgcgccccaacggcgaagcagccgcgccggtccgccccgattccccatgacgtcaccggcggcggcaggccccgcctccagccccgggcggcaggccgcatgacgtcaccgaggccccacccctccggagcgagttcggtcctggcgttcatttcattcctgtcctcattccgaacattcttagcatcgctcgcgccgcgccgcgccgcctgagccgagccgagcctctgctgccgccgccgcggccccgccgcccgccgcgggcgcccaccaagcactttgcagactcgcttccaccctgcgggccattccgcgcggcggggcccgggcccggggcggccgcgtccaggcacaggccatgcagtgacgcccccccacccctccacctttgcccggagcgcgggcagcagcccagcgcgccagccggccccggggcaggagcggtgctaggcaggggtggggtggccgggcccagggaccgggagccggggagggagccgggcaccgagcagagggcgggggaagcggcgccgaagtttgcctcggactcgccgggcgctgcggtggctccctgggccgaggtaagttggcgcgcggggcggatgctggggtgcggggggcgcacggggcagcggggggccggcggcgcgtccctcgcgggccgctctttctttgcgggctctgctttgtgtgcgacggcgggcgggcacgcggagggccgcggccgggcccccacacccgcctccccgcgccccctccgaggtgagcggccgggcgccgccgcgcgacttgccaggacgccaagttgggccgcgcgctgggagcccgcgcggcaacaggcggcccccggccggccgcgccgcgccccccgcgcgccccctctcccgc

SEQ ID NO: 72223 - DNA, 30 bp, Homo sapiens
  chr11:127009561-127009591
  hypo
caaagatcttgttttcgtctctagaactcc

SEQ ID NO: 72224 - DNA, 30 bp, Homo sapiens
  chr11:127013703-127013733
  hypo
aatatcggtcaccctcgtccaggaggataa

SEQ ID NO: 72225 - DNA, 30 bp, Homo sapiens; identical to SEQ ID NO: 33642
  chr11:12715647-12715677
  hyper

SEQ ID NO: 72226 - DNA, 44 bp, Homo sapiens
  chr11:1273678-1273722
  hypo
accgccagtgtcctccgccccgctgtcctcgccctcccctgccc

SEQ ID NO: 72227 - DNA, 281 bp, Homo sapiens
  chr11:1274002-1274283
  hypo
tggtccaggtgaggacgtgcatgttccctgccccaggtgaatgagacctggaccctggagaactgcacggtggccaggtgcgtgggtgacaaccgtgtcgtcctgctggacccaaagcctgtggccaacgtcacctgcgtgaacaagcacctgcccatcaaagtgtcggacccgagccagccctgtgacttccactatgagtgcgagtgtgagtgcgtcggtggccgcgggattaccccgggggcaggtggagcagagtgcaccgtcggctaggctggcag

SEQ ID NO: 72228 - DNA, 30 bp, Homo sapiens
  chr11:12745696-12745726
  hypo
ccacactgtcccctccgcaacaaacactga

SEQ ID NO: 72229 - DNA, 152 bp, Homo sapiens
  chr11:1275246-1275398
  hypo
cgctggctgccatgacgcctggggagcgagggcaccaccacggagcctgccagcccgtccatctctgtcccgcaggcatctgcagcatgtggggcggctcccactattccacctttgacggcacctcttacaccttccggggcaactgcacc

SEQ ID NO: 72230 - DNA, 119 bp, Homo sapiens
  chr11:1275636-1275755
  hypo
aggccgactgcaggccggggtgacccaggtgccgcagcgatggcccagtgcccaagacagctcccagggggcagggaaggcctgtggagccgcctaaggccgagcgcaccctgtggcct

SEQ ID NO: 72231 - DNA, 509 bp, Homo sapiens
  chr11:1276280-1276789
  hypo
caacaaccagagggacgactgtctccagcgggacggaaccactgccgccagttgcaaggacatggccaagacgtggctggtccccgacagcagaaaggatggctgctgggccccgactggcacaccccccactgccagccccgcagccccggtgtctagcacacccacccccaccccatgcccaccacagccgctctgtgatctgatgctgagccagtgagtcctcccctcgggggttgcaggccctggggcgcccccgcccgcccgcatgcacgcacgcacgcagctccctggggctgggggccctccgtcctgatcgctttgccccacagggtctttgctgagtgccacaaccttgtgcccccgggcccattcttcaacgcctgcatcagcgaccactgcaggggccgccttgaggtgccctgccagagcctggaggcttacgcagagctctgccgcgcccggggagtgtgcagtgactggcgaggtgcaaccggtggcctgtgcgg

SEQ ID NO: 72232 - DNA, 232 bp, Homo sapiens
  chr11:1278648-1278880
  hypo
tcactctgggccactcgggtaccagcccgagggagggggtggctggacagatgcccagggttgacctgtgtctgtccaggagccctcagggacccccttgatccattccagcccggggagcggtgggtcagcaactgccagtcctgcgtgtgtgacgagggttcagtgtcggtgcagtgcaagcccctgccctgtgacgcccagggtcagcccccgccgtgcaaccgtcccg

SEQ ID NO: 72233 - DNA, 30 bp, Homo sapiens
  chr11:1279716-1279746
  hypo
caggggccctggacacgtcagagctgggac

SEQ ID NO: 72234 - DNA, 23 bp, Homo sapiens
  chr11:128110182-128110205
  hypo
tacaaaaaaattagccgggcctg

SEQ ID NO: 72235 - DNA, 173 bp, Homo sapiens
  chr11:128419104-128419277
  hyper
tacaggctgtccctgcggcgcagcccgcccccaccctccactctcacgcgcccctcgcccctcgcccctcgcccctcgcccctctcctgggctccggctcccacctcatcggcccacccgaagatgtccattcacccagtgccgcggccggagccgagcggggcctgacgcca

SEQ ID NO: 72236 - DNA, 124 bp, Homo sapiens
  chr11:128556976-128557100
  hyper
atgtgtgcatgcgtgcgcctgtttgcatgtgggcgtgtgtatgtggggttgtgtgcgggtatgcgggcgccacgcgcttctcctacaggtgagacacgcgctcagtcctcgagcccaccttctt

SEQ ID NO: 72237 - DNA, 423 bp, Homo sapiens; identical to SEQ ID NO: 34151
  chr11:128562763-128563186
  hyper

SEQ ID NO: 72238 - DNA, 482 bp, Homo sapiens
  chr11:128563336-128563818
  hyper
cggttttcgtccgagtcttccccggcagtaggcgctgggttacccgcagccctagccaactctccctccataccccccctaccccacccccaaaaagtttgtctccggctggaaaaagcattaatgaacgtatctgtgggaagaaacggaaagtgaatgagtcaggagggccaccttcggccaaccgcctcaggaaaagcaaagaagccaaaggtctttggctttggattttgggggaaggtgatggggggaggttcagacttcgggaatcagggcgcggacgctgggcgtggaccccgtcattgttcccggctagctcttatctcccaggagcaagtatcctgtgtgcgcagcgcatgaatgtgtctgggcatctccgcgtatatttatatagtgtgtgatgcgaaaagcaggaccagcaggggaggaagagggggtgtggggggggagggaagacgagggagagcagaggggagagaaga

SEQ ID NO: 72239 - DNA, 666 bp, Homo sapiens
  chr11:128563878-128564544
  hyper
gagagagagataggacttcctccccgattcgcaaagtgaagtcacttcccaaaattagctgaaaaaaaagtttcatccggttaactgtctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggtaagcggcggggcaacggacgcgggcggcggggaccggccggggaggcgaagcggcgggcgggtaggtgcggggcccgcgtcccggaagacgtggcctctctcccttccctccgcgccccggcttcgcgccggctcctccggcgctcgggtggcgagtcctactcgcgggccagccggccaggcgcccgcattgagggcgaccctcccccgaaatcccagcccccaaagtggagccccggcccccctcccacctcgctgcccgccggggctgcaggaggggacggcgggaaaccgggggaccccagggtacggaacggagtcaagggcgagagacctcggggtccaccactcccaccgacacccggggctcc

SEQ ID NO: 72240 - DNA, 272 bp, Homo sapiens
  chr11:128564602-128564874
  hyper
cgggggctgcagtcgcccgggctcgggtccctgcctggtgggccctggggtgggtaagtggcctcgttgcacgagggtaggggtgcaagtgagtgtgtcgggggatctatctgagcgggctcctccagatggaagcccctgtttacatgtcagcgctttcccttcctctcggcactcagtcgcccggctctaggcgctggagagccgccggctccgcgggactcctgggccggcctcgccgcctctccggcggggaaccttccccagccccc

SEQ ID NO: 72241 - DNA, 2 bp, Homo sapiens
  chr11:128564875-128564877
  hyper
tc

SEQ ID NO: 72242 - DNA, 542 bp, Homo sapiens; identical to SEQ ID NO: 34156
  chr11:128564991-128565533
  hyper

SEQ ID NO: 72243 - DNA, 98 bp, Homo sapiens
  chr11:128634531-128634629
  hypo
agccttcttcacaggcgccagctgcctcattaaagagcagccttttatgctgggcttcacctgtacccaccctgagcggcagccgtggagccccatgg

SEQ ID NO: 72244 - DNA, 34 bp, Homo sapiens
  chr11:128634871-128634905
  hypo
ggagaaacaccctggcgggcgagcggccaaaccg

SEQ ID NO: 72245 - DNA, 30 bp, Homo sapiens
  chr11:128635204-128635234
  hypo
gccacctgtgcctaccgtacatggccataa

SEQ ID NO: 72246 - DNA, 182 bp, Homo sapiens
  chr11:128647566-128647748
  hypo
agccttgcaccctcccgctcctgcacactcagccagagctgttgatatagcagtgcagcccagagaaaagagagacctggattcaataggctggctgtgagggggcactggtgaattctatggtcacagcgaggcaggagacaaaggctttggcactgggacgcttgcgccccctggcccag

SEQ ID NO: 72247 - DNA, 180 bp, Homo sapiens
  chr11:128657932-128658112
  hypo
ctgacctcatgatctgcccgcctcggcctcctaattacagtatcccgctaattacagtatttttgagggtttaccagatgttaacaccgtaccaagggtcgtgaaggatactatacatagatagccaagctgctttaaaacttattcgggggccgggcatggtggttcatgcctgtaatc

SEQ ID NO: 72248 - DNA, 37 bp, Homo sapiens
  chr11:128665419-128665456
  hypo
gagttctgtaggatgcgttagaatatagaaagcaatt

SEQ ID NO: 72249 - DNA, 462 bp, Homo sapiens; identical to SEQ ID NO: 34157
  chr11:129242780-129243242
  hyper

SEQ ID NO: 72250 - DNA, 339 bp, Homo sapiens
  chr11:129243304-129243643
  hyper
cggacggcgatgccagggctgagcggtgagctgtcccgggtcccgcgctttgaccgcggaccagcctcagggtcccgccgcggaagcagggggcgcgcctggggccagcctgtagaccccagagtccggcggcaggacccccggcgccacccggacacctggcagcagttctcgcctgccctgcagccgcctctgcatggagaaagagaatgaaagaaaacaattctagatggagaggaggggaggggaggccagtttgcaaatacttcgggaatgaagttcctcaaagacgcgttgcgggccttgtctaatgctaggctgtgacttggcctcttaaca

SEQ ID NO: 72251 - DNA, 358 bp, Homo sapiens
  chr11:129243943-129244301
  hyper
ctaacagcctaatgattagtcctctgggcgtgtccctccctcctagtttaatcaccggcccaggcgccctcatttacttgcttccgcggccaccagggccccctgggcaagcagctccgcagagagcccgccggcactcgcggacgcttctaggctgggagcggggaggaaatgtcaccggccccaaactcggccctagggaaggccatccgcgtctatacttctcagtgtccctgtcgtgcgttttccttccaaccccatgcacactcattccaacataaagtcgtggaaacgggcgtgcactgggctgttcccgccgaacaccgggcgcgactcaggctgccggaggcttcccggg

SEQ ID NO: 72252 - DNA, 223 bp, Homo sapiens
  chr11:129244440-129244663
  hyper
cgactctctaacccggtcgtatcgcgagggatccggatattgaaagcccctttgccggaagactcgggcgctgggagaagcccgcatgggacaggctgccccagtgcccgccggctccctagaatcgtgcagctctgaccctttccaacgaggaaaaaatgtttttataaacaatgttttaaaaaaaaccgcacacttttttaaaaagtcagaatctcgctct

SEQ ID NO: 72253 - DNA, 127 bp, Homo sapiens
  chr11:129245832-129245959
  hyper
gcggggcccaggccccgccgtcgcgccagccccgcggccccagcgggccgggcactcgcagccgcgctcgggccggcggacgctcgcgccggctcaccatgcactgccacgccgagctgaggctgag

SEQ ID NO: 72254 - DNA, 206 bp, Homo sapiens; identical to SEQ ID NO: 34162
  chr11:129565510-129565716
  hyper

SEQ ID NO: 72255 - DNA, 32 bp, Homo sapiens
  chr11:129685906-129685938
  hyper
ctgcgggggaggggacgcggacagggaggggc

SEQ ID NO: 72256 - DNA, 30 bp, Homo sapiens
  chr11:129732116-129732146
  hypo
aaaggcccatttccccgcactgcatcctac

SEQ ID NO: 72257 - DNA, 66 bp, Homo sapiens; identical to SEQ ID NO: 43284
  chr11:129866993-129867059
  hypo

SEQ ID NO: 72258 - DNA, 40 bp, Homo sapiens
  chr11:129907763-129907803
  hypo
gataaatgaattatgtaaatattgtcggggcttggtaact

SEQ ID NO: 72259 - DNA, 207 bp, Homo sapiens
  chr11:129993552-129993759
  hypo
gcctcgttggtacttcgacctctccaagggaaagtgcgtgcgctttatatatggtggctgcggcggcaacaggaacaattttgagtctgaggattattgtatggctgtgtgtaaagcgatgagtaagtcctgcctcgcgctggtcccgtgcggcagcaccgtcctgtctggcgtccgtctccctgccgtcttcgtggctgcatctgt

SEQ ID NO: 72260 - DNA, 120 bp, Homo sapiens
  chr11:130017420-130017540
  hypo
gattacaggtgtgagccaccgcgcctggctgggggcatgacattcttgaggaatctgtcagagatctgtggccaagatacaagataacccagatctgattgatttttttttttttttttt

SEQ ID NO: 72261 - DNA, 55 bp, Homo sapiens
  chr11:130058066-130058121
  hypo
tggaaaagcatggcccggggcgctgggtggtgctggcagccgtgctgatcggcct

SEQ ID NO: 72262 - DNA, 120 bp, Homo sapiens
  chr11:130059618-130059738
  hypo
ccgctctctccccagcgagggcagcgtcatcgcctactactggtctgagttcagcatcccgcagcacctggtggaggaggccgagcgcgtcatggccgaggagcgcgtagtcatgctgcc

SEQ ID NO: 72263 - DNA, 149 bp, Homo sapiens
  chr11:130060258-130060407
  hypo
tgaggtccacacccacggggtctcagggtcctcccccagctctgcccagccctgcccccacacgtgccctccttcttgtctcctgcgcagacagctgcagctttggcctgcacgcccgcggtgtggagctgatgcgcttcaccacgccc

SEQ ID NO: 72264 - DNA, 60 bp, Homo sapiens
  chr11:130079328-130079388
  hypo
ctccccaggcactggcgcgctgatcctgcaaaagggtgagatccgcgtcatcaaccagac

SEQ ID NO: 72265 - DNA, 51 bp, Homo sapiens
  chr11:130089830-130089881
  hypo
accgctgggatcctccgaataacgcctggagggcagcgaggtgcagggagg

SEQ ID NO: 72266 - DNA, 30 bp, Homo sapiens; identical to SEQ ID NO: 43287
  chr11:130090184-130090214
  hypo

SEQ ID NO: 72267 - DNA, 24 bp, Homo sapiens
  chr11:130242942-130242966
  hypo
tacaaaggacagatgcgtgaatta

SEQ ID NO: 72268 - DNA, 39 bp, Homo sapiens
  chr11:130285847-130285886
  hypo
actaatctaaattagcgcagaactcggctgctggaagat

SEQ ID NO: 72269 - DNA, 30 bp, Homo sapiens
  chr11:130286135-130286165
  hypo
acagcggtgccatcacgtggtgcttgccca

SEQ ID NO: 72270 - DNA, 973 bp, Homo sapiens
  chr11:130297447-130298420
  hyper
gctctcagtcctacctgcaggtcggccccgtagaaggcagccatggacgcatcggccaccagcagcgtctccacgaagcgcgcctcagacacaaaccgcttggtcctactcgtggcccccaggggcggtggcggctcgctagcgccttctgcctcctcttcttggctctcctcctcgctgtcctcctggtggtctcctctctcctgcctctgaccctctcccgtctccacctcccactcgggtcctcgcgggagggggcgggctccggcgggaccccagcgctgcaggcggtgcggctgagccagggagccccccgcgccctgcggctggatggtgaactcctcgccgtccagcaggaaggagccgctcagcccgcggcacaggctgaccgccgccagcgactcgggctccccattcacggtgccggagaagaagcagccgcgcagcccccgctcgcccccggtcgcccggccggagcccccgaggcgctcgatcttgaactcgggcgctaggaagctgtcgtcgggcgccaggcgcagcacgaagcccttgccgaaggcggacaggtggagcgcgagctcgcccgcgctgccgggcaaccgcgtgggcaccaccagctccgaggcctgccccccggctgcgggccgggccggggcgccgcgggccagcggcagcagcagcagcagcagcagcaggagcggaggccaccggggggcggcgggggcggggagcatgggggctgcggcggtggctgcgcgcaggagagggaagaagcccgccaggcgcgggcaggtgctggcggcccgagcgcggcccggccgctctctccaggaaaagcggaatcaatcgggtgcaaggccgactcggcccgcggggcccggcggcgggagcgctcccccggcggcccctctggctggcgcagcccgctcctcccgcgccgccgcccccgagccgagcgcgagcagctggcccc

SEQ ID NO: 72271 - DNA, 397 bp, Homo sapiens
  chr11:13030293-13030690
  hyper
aatattgcttcctgtcgagaaggactgggaggccttccgctttagaggcagcgcttatagcgctagctggtcgtggaatgcgattacagcgtctccattggagaccgctgagtgcctcggtttccctgtctgtgcaaagtgcactccccagacgccgctgcctcgagggaccaggaaatgcgtctgggggcgccaggaaagatgagaagataaagtcacgatgcgtccagctagctatagacacaagcagaggagccagtaggccaaaggagacgcacagctgatccgtgccgaggcgcgggctccactccctgaagtggagggacccttgaatctttccttgcgtaggcgcgcggcagagcagcgatttggcgaaaagggccgagactcaggatgc

SEQ ID NO: 72272 - DNA, 380 bp, Homo sapiens; identical to SEQ ID NO: 33644
  chr11:13031244-13031624
  hyper

SEQ ID NO: 72273 - DNA, 932 bp, Homo sapiens
  chr11:130318226-130319158
  hyper
agagtgaacgctgtccgcgggggcagaagcgagtgaggcgtcgggacagtggggcataaccaagagcaaaacgcaaactgagacttcagcgccggtttctcgggccagcccacgcctcctgcctcagctcaatgccactccctccccgccaagtggctctccgctctggaggcgggaccgagttctccggtggcccctggaggctccggcagcgagctctgggaggctgggaggggagtgaggggaggggcgctgactgggccgtccaaagaggagggggcctttaataggctcgcccagcgcctggcttgctgcgctgcgagtggctgcggttgcgagaagccgcccggcaccttccgctagttctcggctgcaaatcttcgtccttgcacttgacagcgattgtacttaagctcccagggcgcgctttgcttggaaaggcacaggtaggaagcgcgggctgccgggtgcacgctcgccgccctgggaggagtctccctcccttggctctcctttctgggaactgccggctgtcccgtagcgttggcggttccagagtgcgggctgcacggagaccgcggcagcggccggagagcccggcccagccccttcccacagcgcggcggtgcgctgcccggcgccatgcttctgctgggcatcctaaccctggctttcgccgggcgaaccgctggaggctctgagccagagcgggaggtagtcgttcccatccgactggacccggacattaacggccgccgctactactggcggggtcccgaggactccggggatcagggactcatttttcagatcacagcatttcaggaggacttttacctacacctgacgccggatgctcagttcttggctcccgccttctccactgagcatctgggcgtccccctccaggggctcaccgggggctcttcaga

SEQ ID NO: 72274 - DNA, 116 bp, Homo sapiens
  chr11:130319517-130319633
  hyper
cgcggtacgtggagacgctggtggtcgcggacgagtcaatggtcaagttccacggcgcggacctggaacattatctgctgacgctgctggcaacggcggcgcgactctaccgccat

SEQ ID NO: 72275 - DNA, 59 bp, Homo sapiens
  chr11:13031956-13032015
  hyper
ggttggggcaggcatcgagctcgacgggtccagaccgggagaggagccagaagaggtgg

SEQ ID NO: 72276 - DNA, 219 bp, Homo sapiens; identical to SEQ ID NO: 33646
  chr11:13032093-13032312
  hyper

SEQ ID NO: 72277 - DNA, 104 bp, Homo sapiens
  chr11:13032656-13032760
  hyper
gcggggggcggggggcgggaacagggggattcttttttcttgcagaatgcagtgggccagccggctcgcggacttgaaaccaggctgttgcgagcccagagctc

SEQ ID NO: 72278 - DNA, 17 bp, Homo sapiens
  chr11:13032789-13032806
  hyper
cgcgctcatctggctcc

SEQ ID NO: 72279 - DNA, 192 bp, Homo sapiens
  chr11:130515653-130515845
  hypo
taaaatcctagactccgcttctgtttcggtattcagtatctaccacagtgcacggcacacattaggccctcaacaatatttgctgaatgaaaaaaacatgggaggaggcaaaactcagaagtggcagagccaggaattaaaaccaggacctcttactcctgaccccatgttctcccgcggacatcccccaag

SEQ ID NO: 72280 - DNA, 30 bp, Homo sapiens; identical to SEQ ID NO: 15616
  chr11:130717573-130717603
  hypo

SEQ ID NO: 72281 - DNA, 226 bp, Homo sapiens; identical to SEQ ID NO: 43290
  chr11:130785458-130785684
  hypo

SEQ ID NO: 72282 - DNA, 48 bp, Homo sapiens
  chr11:131068439-131068487
  hypo
cacacaggatgtgcccgcagcaagacagcactccgatttctgtgctct

SEQ ID NO: 72283 - DNA, 30 bp, Homo sapiens
  chr11:131422789-131422819
  hypo
attcattcaacggaacgtcaaacagcattg

SEQ ID NO: 72284 - DNA, 112 bp, Homo sapiens; identical to SEQ ID NO: 43291
  chr11:131522754-131522866
  hypo

SEQ ID NO: 72285 - DNA, 30 bp, Homo sapiens
  chr11:131542213-131542243
  hypo
tgaaggcagaggcggcgacttgagcaaatg

SEQ ID NO: 72286 - DNA, 64 bp, Homo sapiens
  chr11:131558038-131558102
  hyper
tgcagctccccagaacggccaccggagggcacccgcgccccccgagccgcgaggctgcctccac

SEQ ID NO: 72287 - DNA, 39 bp, Homo sapiens
  chr11:131564961-131565000
  hyper
gtctgccaggggaaacgcacgatgcgttgtccaggacat

SEQ ID NO: 72288 - DNA, 169 bp, Homo sapiens; identical to SEQ ID NO: 43292
  chr11:131631013-131631182
  hypo

SEQ ID NO: 72289 - DNA, 88 bp, Homo sapiens
  chr11:131766898-131766986
  hypo
aagaaaaaggtttcactcacctaaatgtctggcaggcatttgacgtccgtggctgaatagccatgcgttgctgcgtctctaacctctg

SEQ ID NO: 72290 - DNA, 71 bp, Homo sapiens
  chr11:131780260-131780331
  hyper
ttcctaatttggaagcgcgtaaatggttaaactcctggcctgggctgggctggtgcacagcctgggcccgg

SEQ ID NO: 72291 - DNA, 203 bp, Homo sapiens; identical to SEQ ID NO: 1012
  chr11:131780876-131781079
  hyper

SEQ ID NO: 72292 - DNA, 42 bp, Homo sapiens
  chr11:131781293-131781335
  hyper
gcaccccacccacttcctgtgctcgcccggggggcgtgtgcc

SEQ ID NO: 72293 - DNA, 15 bp, Homo sapiens
  chr11:131781572-131781587
  hyper
tggtttgtatggggt

SEQ ID NO: 72294 - DNA, 153 bp, Homo sapiens
  chr11:131799626-131799779
  hypo
tcgtgaaggtttcctcgaaggatcgtgaaattccacgaagtccgcttgctttcctgggtgaataaacaccaggccgctccctggactttccttgtcgtttgtgatcaaaggctcagctacctcgtgctcatggtcctgcgatggctgaaatcc

SEQ ID NO: 72295 - DNA, 30 bp, Homo sapiens
  chr11:131996346-131996376
  hyper
gctgacaaaatgaggcgatcagattggaaa

SEQ ID NO: 72296 - DNA, 30 bp, Homo sapiens
  chr11:132031455-132031485
  hypo
cgggcactgtgcacccgggctcatgcgtcc

SEQ ID NO: 72297 - DNA, 32 bp, Homo sapiens
  chr11:132311339-132311371
  hypo
gcgtgagccaccgcgcccggcccaccaaggac

SEQ ID NO: 72298 - DNA, 48 bp, Homo sapiens; identical to SEQ ID NO: 43295
  chr11:132484374-132484422
  hypo

SEQ ID NO: 72299 - DNA, 30 bp, Homo sapiens; identical to SEQ ID NO: 43296
  chr11:132792371-132792401
  hypo

SEQ ID NO: 72300 - DNA, 139 bp, Homo sapiens
  chr11:132813619-132813758
  hyper
ccggtcggcgactcgcggccagccgggggagcgccgcccggcgcaggctccgggcgcacggggagctgggcggacggcggcccccgcctcctccggggacgcggcacgagacgcggggacgcgcggacgccacgctcag

SEQ ID NO: 72301 - DNA, 342 bp, Homo sapiens
  chr11:132813907-132814249
  hyper
cgcggactgcgcgctcatcccgacgggcgggcgcccaccttaacctccgccgcgcccaccgggctggggatgcctgcggggatgagcccgcaccgcgcccacttcgctccgtcccgacacccgcgccagcggagagaacgcggcgcccctcgcagcggcttcccctacagaggggcggggtggggggagcggggagggagaggggagggcgggagagggagttctggggaaagcagcaaactgaaaactgacactggcaccttccctcgccgatgccagcgcagaagttgacaaaccccgccctggagagctgaactaccctgcccacgccagatggggcac

SEQ ID NO: 72302 - DNA, 141 bp, Homo sapiens
  chr11:132864068-132864209
  hyper
aaataagattcagggcgggagtccccgcgccgcagcggctggtgcgctcctgccaggagccggcgcgcgcgggagcacgtccggggcttttacggccggaactcgggctattaaaaagcccaggcgcgattttctaattaa

SEQ ID NO: 72303 - DNA, 30 bp, Homo sapiens
  chr11:132933115-132933145
  hypo
acacatgtcatacaacggcggagagaagca

SEQ ID NO: 72304 - DNA, 95 bp, Homo sapiens
  chr11:132934044-132934139
  hyper
gagtgaggggtggagcggagcccagccgagggagggaaggagaggaacgccggcccactagccgaccccagcgcaacccagcgcggttcccagac

SEQ ID NO: 72305 - DNA, 468 bp, Homo sapiens
  chr11:132934140-132934608
  hyper
ctgccgggtaactgatgccgccggcacagcttctgttctcacttgtggagctttgtctcccctcgctgggcagcccctggtaccgcaacccgcctggccgccttcccggctgaggcccccgggcagagctcctccgcagggagcattcccgtggacaaacacccctttccctggtagctgtggcaacagttgatctgtggcagcggaccaggaggagggtcaaatgggagaagggacggccagctggtcctaccagagactgtcgctggcgtcctcaggggccgctgcagggccaccttgtgtgcttgccctttccccacggtagactgccccgggagggggactgtgctgcctgaattcttgtccgggtgggactggcctcggtgaaggatccgggaatgggacttccgggccgggccggaggggaagtgtcaggaagagctcaggctttagcgagcctggagggaa

SEQ ID NO: 72306 - DNA, 497 bp, Homo sapiens
  chr11:132952506-132953003
  hyper
ccctcttactacccccgccccaccccgttctgcgccgagtggcacagccctcggcacggcacggccctgtcagctacgaagccgggcgaggggctcaaggcccctctggagaccgcttctcccccgcggcccgtcccgccgctgcggaccccatgcgcggcctccccgccccggcgcctgggcctcctcgcggcccgggcggggcccaccaacccggagaggtcgccagcctgcagggtgccgggggcccctccgagccgacctcgtcccaggcagacgcgctgcccggagaccgccgcaagggggcgccaggggccggggcggacgtcgcgccagtgcctcgccgggaccgcacctcgtccgcgcggccgccagagggcgcccgtcagcgccggagcccgcggcggacgccccagccgagcccagccactgcctggtggagccacagggcacccgcccggaaacaccgcctgcgccccgacggcacccgtgtgcgc

SEQ ID NO: 72307 - DNA, 88 bp, Homo sapiens; identical to SEQ ID NO: 34177
  chr11:132953232-132953320
  hyper

SEQ ID NO: 72308 - DNA, 281 bp, Homo sapiens
  chr11:13300434-13300715
  hyper
gaaggtagaggtgaacgtcgaccttgtggggcgcatgttagcctccccgaggggtcgcgagagccggcagcggggtgagctcaggtgcccgccggcaggagctggggagggaaggggagtgctggacaccggcgcctgctgtcaagttctcgccggccggtgagagacccgctgccgccgcgcaccccgcacctcctgacccctctcccctctccgcctcggccccttcccggtcacctagcgttgttttggcgctttggcgcttgcggtctcttccttct

SEQ ID NO: 72309 - DNA, 194 bp, Homo sapiens
  chr11:133231266-133231460
  hypo
ctggggccagcccaacgtcggggtcactgtgccaggcaccccctccaggtcctggcggtgtcgatcaggacaccaccaatgcgttcttgcagacaaaatgcacctatgctgtgggaggaagagcaagcggttcgcccgccgcgcatcagtgcacccgtgtcccggcgcgcagacaggtccggggcacctgcagc

SEQ ID NO: 72310 - DNA, 104 bp, Homo sapiens; identical to SEQ ID NO: 15619
  chr11:133231728-133231832
  hypo

SEQ ID NO: 72311 - DNA, 101 bp, Homo sapiens
  chr11:133309666-133309767
  hypo
taagtcttataataaaaccaaactaaaggagcacttttctttctctaagattcctaaataaaatatgagcaagtccaatccagctacgaattaaaagaata

SEQ ID NO: 72312 - DNA, 30 bp, Homo sapiens
  chr11:133374504-133374534
  hypo
cccccagctttgttgcggcgatgtttttct

SEQ ID NO: 72313 - DNA, 192 bp, Homo sapiens; identical to SEQ ID NO: 43298
  chr11:133386010-133386202
  hypo

SEQ ID NO: 72314 - DNA, 303 bp, Homo sapiens
  chr11:133401987-133402290
  hyper
gtgagtgtgtgtgtgcgtgcacacagcaagcctacctctttcactcacatgcatctcacactccctgtcctcaccccttcctccttgcctctccatctccccactgcctctcctgctctcacgtcgtacaatcaccccagggagagaaaacacccttcccctgtacggtacctgggatgaagagcagggcagttgtcgccgagaagacgacccagtaggcaggatggtacatctcgacgctgcggtgctctcagctgccgggcttgctactgcttctgctgctgctaccgctgctgccttcct

SEQ ID NO: 72315 - DNA, 37 bp, Homo sapiens
  chr11:133519102-133519139
  hypo
catgattgattcactcgccgctcgtctgctcagccag

SEQ ID NO: 72316 - DNA, 33 bp, Homo sapiens
  chr11:133559539-133559572
  hypo
atgagccaccacgcccggcgaacattgacaaac

SEQ ID NO: 72317 - DNA, 30 bp, Homo sapiens
  chr11:133703684-133703714
  hypo
tgggtgtctaaactccgcctctcgggatgg

SEQ ID NO: 72318 - DNA, 30 bp, Homo sapiens
  chr11:133773053-133773083
  hypo
gaacctgccctagttcgcaaaataaatcca

SEQ ID NO: 72319 - DNA, 62 bp, Homo sapiens
  chr11:133777783-133777845
  hypo
agtcggcaggcagcacgtggtgagtgcgggaaagccacaggcggctccgcacaagtggtaat

SEQ ID NO: 72320 - DNA, 90 bp, Homo sapiens
  chr11:133790279-133790369
  hypo
ggacagggcccctgccgggcgacttgcctgcccaacccttcggtgcctccagagacaggatgcccgggtaggccgcgggcacctgcaggg

SEQ ID NO: 72321 - DNA, 30 bp, Homo sapiens; identical to SEQ ID NO: 43299
  chr11:133805206-133805236
  hypo

SEQ ID NO: 72322 - DNA, 330 bp, Homo sapiens; identical to SEQ ID NO: 34179
  chr11:133825189-133825519
  hyper

SEQ ID NO: 72323 - DNA, 183 bp, Homo sapiens; identical to SEQ ID NO: 34180
  chr11:133825520-133825703
  hyper

SEQ ID NO: 72324 - DNA, 955 bp, Homo sapiens
  chr11:133825704-133826659
  hyper
tctcccccagctcagacccaggaaagcggaaagagaaaatcccccctccgctcggattcacagcgtggggacccccccttccccgcccctcccctcccccgccgccgcccccagccagctctgcctcgcagcctggggagggcggcgtggggcccgcgcggctgcggcgcgctcccggggaacttttgcctggccggggcccaggtgcggctgagaggcgcgggggccggcggggtccagccaaaagcggacacacctcgaagctggcctcatcaatcctcctctcaccgggcgcccctgctagggggatccgacctccagctgccaagatgtgtgggcaggaggggcgcgagcggagcgatggacgcccgcagggccgcgcgaacccggggccttagacgcgggtgccgccagtcccagggatcctccgggtcgcgcctccctgcaggcgctcctcgcggcgcggggctctagcgtgctgcagcctgcccggagaccgcaaactcccgcagccagagtttcccgcagctctgggaggcggccgccgggcaggaggcgacgggctaggcgcgccggtgtgcaccgtggggcccgtggtgggcgaagtcgacccaggttccactgcgtcctttccccgagtgcccggcagcccgtgggctctggccccttcccgcccgcccctccagcccacggcccccaggccctccccggcaatgctcccgggccgcctggcccgcgtcggagcccaagcctcacccgcgggaaggcgcgccggggagctggggaaccggggggccaaggagccgggaaaccgaggggccgggcgcgaggggccgagggcgccgggaggggcaggggagggacgccgcacttcaactcaccttcagccgcaagccctcgggtgccgatcacacttgctatgaaagtggccacataccaaatcatagtactaccg

SEQ ID NO: 72325 - DNA, 738 bp, Homo sapiens
  chr11:133826702-133827440
  hyper
cgcacgcgcctcgcgcccgagcgcccgcctcgcgcccgcctcgcgccgcctacgccccgcgccggtgctcctgcagcccgggtggccagctctccatccctcctaggctccgctcggctcggcgcgcgcctccccggccccggcgcagcggcacctgcactactcgcccgggcggagcgcagccaggtccacggtgaagcctagccgggccgggcctccggaaccgcccccgccgcccgcctattgggcgccgcccgcaagccgggggtccgattggctcagccttccgcccgtcgcggcgcgaaggaggcgagcccatttcaaggtgcgttgaagtgtggcgagcacagagccgcagaatcatgcgcattgccggggagaaggtggtatagcgtctctgcccgcttctctctcggctcacactgcgtggcaagtttctggtgagggaaatggtagcttctaacgggaccctggcgggtctcaattaccccggacaggtctgagggaagtggagcccccgcccactcatggaacccaacatccggtttccatccggcaaaaagcagttcccgagaggaccatgctgattctatgatggggaaacccaggagccggcggcccgggagagccggggaacgtccttcgccggagatcttttcaaagaggtcacgcgccgcctccccaccccgtctccctccgcacccagacacgtccccagagcagcgcaccaccccctcc

SEQ ID NO: 72326 - DNA, 173 bp, Homo sapiens
  chr11:133845226-133845399
  hypo
agcgacataaagctgcggggcgtgttttttaccctaccacaaacagagctgttgtttagatgccagtgaattctgccctgtgtggtgggacctgtgcactgccaatgggcaccagggcacggcacagggaagacgccccactctccctgaaagctctgcgtatcttctgagta

SEQ ID NO: 72327 - DNA, 408 bp, Homo sapiens
  chr11:133906570-133906978
  hyper
ccgaaacctcagtcccgagcagatcaattgccgctgataacatttaaattctggcctggaggtgccgaggcggccctgggaaagaggaagggaaaggtggcacggatttcaagggagggactcggagttaacagatctgatccttccgagcctgcagtctctagccgcgcgcccccgcccccacccccaccgccaagccgaaaacccaatcctgggcccacccatttgcgtggatgccacagctcggccggaaggcttcagcgtgggagggggtgggggtgacaccagggctgccccttgagagcgacaccggcctgaaccccgtcctccccgcgccccccagccccgcctcgctgcagacggttcgccttgtccactcttctcgactcttctcgactcttctccact

SEQ ID NO: 72328 - DNA, 30 bp, Homo sapiens
  chr11:133912264-133912294
  hypo
gagaacacgagccttcgttactccagacac

SEQ ID NO: 72329 - DNA, 16 bp, Homo sapiens
  chr11:133938772-133938788
  hyper
agagaacccatgtgcc

SEQ ID NO: 72330 - DNA, 275 bp, Homo sapiens; identical to SEQ ID NO: 3830
  chr11:133938789-133939064
  hyper

SEQ ID NO: 72331 - DNA, 372 bp, Homo sapiens; identical to SEQ ID NO: 34186
  chr11:133939065-133939437
  hyper

SEQ ID NO: 72332 - DNA, 50 bp, Homo sapiens; identical to SEQ ID NO: 34187
  chr11:133994694-133994744
  hyper

SEQ ID NO: 72333 - DNA, 61 bp, Homo sapiens
  chr11:133995063-133995124
  hyper
tcgtgccgccgccaccgccgctgcacgggcagccaaaagcagctcccgccccctcttctct

SEQ ID NO: 72334 - DNA, 219 bp, Homo sapiens; identical to SEQ ID NO: 43300
  chr11:134011075-134011294
  hypo

SEQ ID NO: 72335 - DNA, 130 bp, Homo sapiens
  chr11:134011733-134011863
  hypo
gtacacatgcaggctcgtgcatgagtcggagcctgtggagttctcagagaagttgagagttgagagggatttgtggaagcagctccaacacagtcttgctttgggttctcagtgtcgccgggagcctgag

SEQ ID NO: 72336 - DNA, 953 bp, Homo sapiens; identical to SEQ ID NO: 34188
  chr11:134145474-134146427
  hyper

SEQ ID NO: 72337 - DNA, 232 bp, Homo sapiens; identical to SEQ ID NO: 1015
  chr11:134146444-134146676
  hyper

SEQ ID NO: 72338 - DNA, 419 bp, Homo sapiens
  chr11:134146677-134147096
  hyper
tcccgggctgcccaccaccccggcgcgtgcccgggagcctccaccctccccgggttctgtggccggccacgcgccccaggcacgcgccgcgccgggccgcgccaccaagcccgctgtccccagctttcctcggcagatcccctggctacccccaccctgcggaggggccgttcaccagatgccagaaaatcagggtggggcacgcaggccaggggctccagcggctgggcaccgtgtccttcccgaacctggtgctggaagtgcgcccgcctccgcctctcccaggcacccaccggcactgcccagccctgtctggagggtctaggactgaacgtctgtccccggccttcatcctggctgcagaggactggccgggtgatgccgcgctgtcctggccctgggcccgcctggaagacccg

SEQ ID NO: 72339 - DNA, 118 bp, Homo sapiens
  chr11:134201431-134201549
  hyper
gttgcccctgctttgcggacgccttttgtacgttcttcctgatgtagcgctgcgaggggcgactttacctcggcgtttgacaggtacgcagcattcccgcacccgcctgcgcctcgcg

SEQ ID NO: 72340 - DNA, 364 bp, Homo sapiens
  chr11:134201790-134202154
  hyper
gcctagggctgcaggcgcggagccgcgagccccagccaatgagcgccggcgggccggttgcccaggcgaccagtgcgcggctccgccccccgcggcgaggctcccgcgcgcggctgagtgcggactggagtgggaacccgggtccccgcgcttagagaacacgcgatgaccacgtggagcctccggcggaggccggcccgcacgctgggactcctgctgctggtcgtcttgggcttcctggtgctccgcaggtgagagagagcttcgcgcagcacctgccggaccccacattccccagccctccgcacctcgggttctctcctcccgcgacccgcgaatcccgagttcccggggggagcagccc

SEQ ID NO: 72341 - DNA, 38 bp, Homo sapiens
  chr11:134274891-134274929
  hypo
gtcctccccgtgccacgagcggccgtctctcccactct

SEQ ID NO: 72342 - DNA, 208 bp, Homo sapiens
  chr11:134281335-134281543
  hyper
ccctgactcctcatccggccaccagaaaccacctgctgagggggccgggaactgacgactgagagcccgggccgattgttagaagctgctgagaaccagctcttcccctaatcccggtcgacgagggcaggctgtgccgggttttgtttcgcagcccctcggcagcagcgcctcccagcccgagctcggttctcggccccctttccag

SEQ ID NO: 72343 - DNA, 40 bp, Homo sapiens
  chr11:134281603-134281643
  hyper
gcgcgcgcccgggaggacatggcgtgggcaccgatgggga

SEQ ID NO: 72344 - DNA, 104 bp, Homo sapiens
  chr11:134281706-134281810
  hyper
cgacgagtccggagcgtctccggtgcggtccatcgcgggcaacggcccctacgccccggccccggcgcccctagaccgctgccctgggccgcgtgcggctccct

SEQ ID NO: 72345 - DNA, 30 bp, Homo sapiens
  chr11:134282306-134282336
  hyper
gtatcacctccccaccgccccccaccctcc

SEQ ID NO: 72346 - DNA, 82 bp, Homo sapiens
  chr11:134282850-134282932
  hyper
cccgggcctctgccgcggtgtgttggtcggcgggggacggaggccagtgagtgggcgcgcacttggacgtatgtgggtgcac

SEQ ID NO: 72347 - DNA, 69 bp, Homo sapiens
  chr11:134395375-134395444
  hypo
actcctcggatgttccgagaccattggcccctcctctgaagccacacccagcttcgtgctctttttccc

SEQ ID NO: 72348 - DNA, 202 bp, Homo sapiens
  chr11:134458477-134458679
  hypo
cgagtgctgcacctgcgatgtgaacctgtgctggattccctgccgagagctgcacctgcgatgtgaacctgtgctggattccctgccacgtgctgcacctgcgatgtgaacctgtgctggattccatgccacgtgctgcacctgcgatgtgaacctgtgctggattccctgccgagtgctgcacctgcgatgtgaacctgtg

SEQ ID NO: 72349 - DNA, 32 bp, Homo sapiens
  chr11:134526234-134526266
  hypo
aggcccggaggctggcgcgtaggaggctaaag

SEQ ID NO: 72350 - DNA, 117 bp, Homo sapiens
  chr11:134534227-134534344
  hypo
tgaaggtcacccacacgccgtccaccgagggcaggtcgcccacacgccgtccaccgagggcaggtcgcccactcgccgtccacagagggcaggtcgcccacacgccgtccaccgagg

SEQ ID NO: 72351 - DNA, 77 bp, Homo sapiens
  chr11:134607452-134607529
  hypo
gacaggaggcacaggcggtcatcacctgtgggatctcctgggagggacaggcaaagtcataccgaagcctcaggctc

SEQ ID NO: 72352 - DNA, 200 bp, Homo sapiens
  chr11:134608540-134608740
  hypo
tccttgagctcacagcgatggcgtgtgtgtctgtgtgagtctgtgtgtctctctgtgcgtgtctgtgtgagtccgtgtgtctctccatgagtgtctgtgcgagtctgtgtgtctctccgtgcgtgtctgtgcgagtccacgtgtctctccgtgcgtgtctgtgcgagcctgtgtgtctctccgtgcgtgtctgtgtgagt

SEQ ID NO: 72353 - DNA, 30 bp, Homo sapiens
  chr11:134670064-134670094
  hypo
ctcttcttatcaacacgctaagcccggagc

SEQ ID NO: 72354 - DNA, 98 bp, Homo sapiens
  chr11:134909746-134909844
  hypo
gccatgtctttccttcgtggaaatgtccaaagcaggccaggtgaagctaagaagagaagagtacctgagttggcatttccccatcaccaggtgtgtcc

SEQ ID NO: 72355 - DNA, 30 bp, Homo sapiens
  chr11:1357330-1357360
  hyper
ggtggggagggaggtcgcaagcaatgccat

SEQ ID NO: 72356 - DNA, 3 bp, Homo sapiens
  chr11:1358384-1358387
  hyper
gtc

SEQ ID NO: 72357 - DNA, 37 bp, Homo sapiens
  chr11:1359722-1359759
  hypo
ggaggtgactggatcatgcggtcgggtcccccatgct

SEQ ID NO: 72358 - DNA, 81 bp, Homo sapiens
  chr11:1368283-1368364
  hypo
agagggcctagacaccgggataccccagtaccaaaggaagcacagggtgcaggtctcggtccccgacgtcaccctccagtg

SEQ ID NO: 72359 - DNA, 19 bp, Homo sapiens
  chr11:13687132-13687151
  hypo
agtacgagactccttctca

SEQ ID NO: 72360 - DNA, 30 bp, Homo sapiens
  chr11:1371601-1371631
  hypo
ccaggcccacctgaccggtcaggctcaaac

SEQ ID NO: 72361 - DNA, 155 bp, Homo sapiens
  chr11:1374898-1375053
  hypo
tcacacccagacacccgtccctgcctctgccccagcacctccgcctggaatgtgaatccgcagctacctgtggagccggcgccttctctccgtccttctcacactgaggggcacccccagagaggtcaccatggcccgaacgtctatccccagaa

SEQ ID NO: 72362 - DNA, 30 bp, Homo sapiens
  chr11:1375352-1375382
  hypo
tcctggccacaaaagcggcagggcctgccc

SEQ ID NO: 72363 - DNA, 183 bp, Homo sapiens; identical to SEQ ID NO: 42915
  chr11:1382225-1382408
  hypo

SEQ ID NO: 72364 - DNA, 30 bp, Homo sapiens
  chr11:1392807-1392837
  hypo
cagcctggctctggccgtcctcccgggggg

SEQ ID NO: 72365 - DNA, 120 bp, Homo sapiens; identical to SEQ ID NO: 42916
  chr11:1393300-1393420
  hypo

SEQ ID NO: 72366 - DNA, 250 bp, Homo sapiens; identical to SEQ ID NO: 33583
  chr11:1410104-1410354
  hyper

SEQ ID NO: 72367 - DNA, 92 bp, Homo sapiens
  chr11:1411442-1411534
  hyper
cgggcggacgctgggcggcccctccctgcccgcgcgcccgggcgcccctggccggcgccgggccccagagcgatgacatcgacggggaagga

SEQ ID NO: 72368 - DNA, 236 bp, Homo sapiens
  chr11:1411549-1411785
  hyper
cgcgcagtatgttgggccctaccggctggagaagacgctgggcaaggggcagacaggtgcgtgcggccggggcggggaccggggccggggaggccgcgctggcagcgcgctgggtggggggcgcccgagggaggccccggccgcgaagccgcaggcccggcccgggccccggccgcgaacaatgggcggcccgtgcgcccccgtccgctcgtgcgccccggttccgccgcggatcc

SEQ ID NO: 72369 - DNA, 518 bp, Homo sapiens
  chr11:1411841-1412359
  hyper
cggggcgcgcaggcggacaggggcgcacgggacggcgcccctcgggccccgctgcaggtgcgcggcccgggccgcattgtgcgccccagcgaccgggcccattgtgccgcgggaggagggggccgcgcgggcgcccatctgccgtctgccgcggccgcgctaataggcgtgctgcccgagcagctgcgcccccggcgggactcccacctccgcgcgccggccaccggggcctccgggcaggcccgatctccctccgcggtgggggcgggagagtgcggggacctgcagagggctggacagcgccttgcgctgctccggctcgggctcgggcgggcggagcgtctgtgacctgcattcccacggggcagggagaggccattggtgctgggaccagaagtgcgtgggacctgacccgtggagcagccccgcggcctgccggtggagggggcttcccggtggggcctggctgtcattctagggaacaggccgggtccctgcggggccgaacccaggccaga

SEQ ID NO: 72370 - DNA, 30 bp, Homo sapiens; identical to SEQ ID NO: 42917
  chr11:1420766-1420796
  hypo

SEQ ID NO: 72371 - DNA, 78 bp, Homo sapiens
  chr11:1422084-1422162
  hypo
cctccccaggctcctcgtggtgctgggaccctgtggcgtctgctcctctggcccagtggctgccggcggcggggccgt

SEQ ID NO: 72372 - DNA, 512 bp, Homo sapiens
  chr11:1430689-1431201
  hypo
tttcccccagttcaccggggctcccctgctcagggtgtgccgggggctttgagtcacttctgtgtctccttggaggctgtgtggcgtccgcggaagttggtgtctgtgcggtgtggttctgtttatgggtgttgtagagaaggcgccgtccagagacagagccactgctgaggtgggtggggggtgtatgaagggcacaaggacgctttgggggtgtcaggtatgatggccctcaggtcatggtttcacacgcgtgtgctttaaatgcgtgctggctgtcacgtgtcagtcgtgcctccacagagcttcaggaaccaccgagatggggagcctgccggagacacaggttttctgagcgcaccagcggctccaaaagcagagggaagagccctgcgtgcaggtggggcgctcatggcgtcggcctcgcagagcggtgacggacacagagtccgtgtttgggggggtttgggacgtcggcctcgcagagcggtgacggtcgcagagtctgtgtt

SEQ ID NO: 72373 - DNA, 288 bp, Homo sapiens
  chr11:1432883-1433171
  hypo
ctggccagggcccctcgagggaggagtgtgttcatgtgtgagggatgcagcccccacggcagggacgggggacctcgccagcactggtgggctgcacctgctgggagggccagctgtgcgggttcctacgctggcgctgcctgcccctatgtggagaggcgcctgcccctatgtggagaggctcctgcccactggcccggcctggcatccgggccctcatcttgccctcccaaaaagagctctgccccctgtgctgccccatcctgtggggaacgtggccttggtcac

SEQ ID NO: 72374 - DNA, 193 bp, Homo sapiens
  chr11:1433665-1433858
  hypo
gtggagtctcagctgcgccgccccgtcctgtggtgggtggagtctcagctgtgctgccccgtcctgtgattggtgaactctgagctgtgctgctctgtcctctctggtctgtgaagtctgagctgtttggtaggcggggccgagggagcaggcgccctcagaaaatgcgagacagggtcgggttgcggggagg

SEQ ID NO: 72375 - DNA, 41 bp, Homo sapiens
  chr11:1434266-1434307
  hypo
catgttaggagcctgcgttcagaacccgcattcctggggag

SEQ ID NO: 72376 - DNA, 160 bp, Homo sapiens
  chr11:1442699-1442859
  hypo
gccaggcagaggcagcggagcggctgcagtgcgtgtgaaatgcttcagggtggcacgaatttaactagagaggttcttttccaacgtgagcagttgtctcccaagagatgcgccgccccttccctctgcacctggcactggtgggcggtggaggctgtgg

SEQ ID NO: 72377 - DNA, 373 bp, Homo sapiens; identical to SEQ ID NO: 42923
  chr11:1444579-1444952
  hypo

SEQ ID NO: 72378 - DNA, 70 bp, Homo sapiens
  chr11:1446330-1446400
  hypo
tgatgggaagcctgacgtctgcatcgtcctgcgctgcgtggccggtcggtcccggcgctctcagcacttg

SEQ ID NO: 72379 - DNA, 135 bp, Homo sapiens
  chr11:1447374-1447509
  hypo
cccagctgcatgggacgggcagggccacgtggccatcagggcctggatgggggcctggcacacagcgggcactggggatgtgtgtggggcgtgctccggggatgtgtgtggggcgtgctccggggatgtgtgtgg

SEQ ID NO: 72380 - DNA, 24 bp, Homo sapiens
  chr11:1450725-1450749
  hypo
gccctgctgctctgtcgccagcat

SEQ ID NO: 72381 - DNA, 33 bp, Homo sapiens
  chr11:14520450-14520483
  hypo
gcatacgttctcagccgccgtcatggtttctgg

SEQ ID NO: 72382 - DNA, 18 bp, Homo sapiens
  chr11:14542771-14542789
  hypo
gggcggaggatcgcttga

SEQ ID NO: 72383 - DNA, 87 bp, Homo sapiens
  chr11:1455198-1455285
  hypo
cacagatgaaactgacggaaagggcaaaataaagctaaaagccgatggggccgggggaatggaggtttgacgcgtgagacaaaggat

SEQ ID NO: 72384 - DNA, 75 bp, Homo sapiens
  chr11:1455520-1455595
  hypo
atctgggtgtctgggcgcacctaggagtggggtcccctgtgataacctgggccggctctgcgtgtctgggggcac

SEQ ID NO: 72385 - DNA, 23 bp, Homo sapiens
  chr11:14558164-14558187
  hypo
tttttatttttgagacggagtct

SEQ ID NO: 72386 - DNA, 124 bp, Homo sapiens
  chr11:1456146-1456270
  hypo
gctcaggggtgtggccgggctgtcctgggcaggggcaagtatctggctgtgaaaagagtggggagaggagaaagggagggtgggccgaggcgcggagggggaccgggaccgtgtgcccagccaa

SEQ ID NO: 72387 - DNA, 79 bp, Homo sapiens
  chr11:14564357-14564436
  hypo
atctttgcaggttggcgaagctaatggattccttctcagaatgatttttttctttctttcttgagacggagtctagctc

SEQ ID NO: 72388 - DNA, 54 bp, Homo sapiens
  chr11:1459467-1459521
  hypo
agtgtctgtggggagcgatgcgtgccccagccctgtgagcgtgatgttctctgg

SEQ ID NO: 72389 - DNA, 65 bp, Homo sapiens; identical to SEQ ID NO: 42929
  chr11:1461955-1462020
  hypo

SEQ ID NO: 72390 - DNA, 35 bp, Homo sapiens
  chr11:1463756-1463791
  hypo
gagaagaacaacatccgcatcgcagactttggcat

SEQ ID NO: 72391 - DNA, 794 bp, Homo sapiens
  chr11:1464177-1464971
  hypo
ctcctcccaaaagcccgcctggggatgcagggaatgtgggggcgtctggcaccacagccctggaggcctccttgagggccctgcggtgcaccatcaccctggggggagggcctggcagcgcccggagccccgccgctgacctctgcccttgcccgcaggtccccccactacgcctgccccgaggtgatccgggtgagtcagcgccgccgcgtgcagctctgtggggcccagggtggcggggacctgaccctggtgggaccccagcctgccgcacccccaggtgctgctaggctgcctgtccccgggccgactccctctgagcccaggccctccaaggcccccgccctgccctgcgccccccaacagcccgggcactgctgtccacagggggagaagtatgacggccggaaggcggacgtgtggagctgcggcgtcatcctgttcgccttgctggtggtgagaccctggccccctcaaccctgccctggcctctccccaaacctgcccccccacgctgacccccacacccggccgcccgcagggggctctgcccttcgacgatgacaacttgcgacagctgctggagaaggtgaagcggggcgtgttccacatgccgcactttatcccgcccgactgccagagtctgctacggggcatgatcgaggtggacgccgcacgccgcctcacggtgcgtgccctcggagcggggcggccccagagcgtggcgggggggcgcgggggcgggcgtgtgcctgtgtgtgcacaggtgtgtgcccagacgtgtgggcacccag

SEQ ID NO: 72392 - DNA, 198 bp, Homo sapiens
  chr11:14665073-14665271
  hyper
cttctctttcagtcccggtgggtcttcggactgccgccgccgcgctttcctcggcctgggcacgctgggtcggcgtggtcccggctcgcgtccctgttgggcggccgcggcgcgggtggcggcgggacaagtcgtgagcgcgcgctgggcgcgcgcccggccggggcagtcgcgggggaggagcgcccgcccgccgct

SEQ ID NO: 72393 - DNA, 34 bp, Homo sapiens
  chr11:14665617-14665651
  hyper
agccatgaggagggacgagcgagacgccaaagcc

SEQ ID NO: 72394 - DNA, 30 bp, Homo sapiens
  chr11:14666026-14666056
  hyper
ctcacccggaccaagcggggacccggcccg

SEQ ID NO: 72395 - DNA, 35 bp, Homo sapiens
  chr11:14666496-14666531
  hyper
gaggaggtccagctgcgtgtcgttaggagaaactg

SEQ ID NO: 72396 - DNA, 508 bp, Homo sapiens
  chr11:1466703-1467211
  hypo
ctcccgggtggggcacggggcctgaggtgggagcgctgccccggaggagccggcggccccgtgtgccagcgcgtctcgcgcctctcgcccgctgtagggagaaccaggagaagatgatttacttcctcctcctggaccggaaagaaaggtacccgagccaggaggatgaggacctgcccccccggaacgagataggtatgggtccaggggtggcctccagcccggcctgcactgccccaccggggtccgggggctgtctggcctgaccttcgtctgtactcagaccctccccggaagcgtgtggactccccgatgctgaaccggcacggcaagcggcggccagaacgcaaatccatggaggtgctcagcgtgacggacggcggctccccggtgcctgcgcggcgggccattgagatggcccagcacggccagaggtgtgtgtgccccgaggctgctgggcctccctccctgggccctggctgcgcggcactgccgcctggctcatcgc

SEQ ID NO: 72397 - DNA, 510 bp, Homo sapiens; identical to SEQ ID NO: 42933
  chr11:1469123-1469633
  hypo

SEQ ID NO: 72398 - DNA, 136 bp, Homo sapiens
  chr11:1471324-1471460
  hypo
gcctccccaccctcccgctcccgcctgtttctttctggtcctcctgtgccgtgtgcatgcgggggactggggtgcatgtgccgcgcggctgcccccaccccgctcgctccctgcgcctccccgtagcctattagga

SEQ ID NO: 72399 - DNA, 193 bp, Homo sapiens; identical to SEQ ID NO: 42935
  chr11:1471865-1472058
  hypo

SEQ ID NO: 72400 - DNA, 150 bp, Homo sapiens
  chr11:1473510-1473660
  hypo
ccagtggcctttctgcgccgatcaggtggcccttccagctgggtgcccaggtcggaggtgtgtaggtattgtcgcaagcccagatgcacagggctcagcagacttgggaaccttccgcctaggccctgacattgccgtttctgctgctac

SEQ ID NO: 72401 - DNA, 108 bp, Homo sapiens
  chr11:1475964-1476072
  hypo
gtgggcctgcctggccgccttcactggacaggcgctctctcctgcccaccctcgtgagggaggggtcactgcccatctggggtgcttggcctgcggagggagtcaggg

SEQ ID NO: 72402 - DNA, 595 bp, Homo sapiens
  chr11:1477752-1478347
  hypo
tctcaggtgagctggcgcccccagggcggctccgggcccaggcccgtccagggcataaccccctgtctcccctaggccccagccgtcgcttcaagagggtggtggagaccatccaggcccagctgctgagcacacacgacccgcctgcggcccagcacttgtcaggtgaggcgggctcagctccggccaacctgcggcctgcgagtggggcgtggccagctggtgctgcgcggacgggaggcgtgaggacccgggcgcagcctcctggcccctcttgacggacgcccccacctccctgccccgagctgtggctgcacccctcagggagcagagcccctccctggcctggcgggaccacccgcctcgcctctgcacgccagggacatagggcgcagccgcaccacactgaaaggcgcctcttgtccaccgtagaaccccccccaccagcgccaggactaagctggggtgctgggcttaagggccagaaggtggccaccagctacgagagtagcctctgacgctggcaggtaaggcgcccggcctgtgctggggcggggaggggctgcgggcaggtcctcggcggagccaggctggc

SEQ ID NO: 72403 - DNA, 47 bp, Homo sapiens
  chr11:1482019-1482066
  hypo
ccccgagtggacccgcggccgcgccgcccgtccgtccagactgttct

SEQ ID NO: 72404 - DNA, 432 bp, Homo sapiens
  chr11:1483506-1483938
  hypo
caggcgggcacagcccgggtgcggcggccgtgggggacggcgggtctgatgcatgcctctgccatggagtcgtctgtctgcttcggtgcctgcccctgcctcccacccacctcgtgtatagattttaacgcttctgttaacattagacctctgccacaggctgggatttctatacataagaacaaaagcaaacacctaggacagcaaacgccaggcggtacaggcgggaaggggctctccacggagatcgaggacacgaagcaaactgcctcttgcttgccttccccttttgtgcttcggacacacgcggactccagcaggcgccacggaaatgggcaagcccctgcagtgtacccctgtcataactgtgagcagctgcagctccggaacaataaatcccttccgcaaagacagcgacgcaggtcttcatct

SEQ ID NO: 72405 - DNA, 84 bp, Homo sapiens; identical to SEQ ID NO: 43021
  chr11:15084438-15084522
  hypo

SEQ ID NO: 72406 - DNA, 413 bp, Homo sapiens
  chr11:15136043-15136456
  hyper
cagctccaagggaaacgatcgcggcacattcccttcccctctccagatgttggcatgcggggcaccttgtgggcgaccccgcctggacggcttcgcggctcccgggcgatcaccctggtgcctgccgcctggcccgggggagcccggtctctaattaggcctgaccgcgtccccattccagcgctcctgcagatgggagggagggccatgtttccccccccaggggcaccgaaatagcctcgtagtcccgcggagacagcaggcagccgtggctgacgcgggaccaaggcttggcagggagcgcgctgctgtggaaggtccttgggaggctgcgaccgcctcggagagggcgggcgggggagaacggggcggggggtggggcgggggccaggggcggcctctcgggctgggcc

SEQ ID NO: 72407 - DNA, 101 bp, Homo sapiens; identical to SEQ ID NO: 33651
  chr11:15136457-15136558
  hyper

SEQ ID NO: 72408 - DNA, 30 bp, Homo sapiens; identical to SEQ ID NO: 42940
  chr11:1517598-1517628
  hypo

SEQ ID NO: 72409 - DNA, 36 bp, Homo sapiens
  chr11:1536547-1536583
  hypo
ggcactgatgccagccggcgccgactcaggtgagca

SEQ ID NO: 72410 - DNA, 154 bp, Homo sapiens
  chr11:1553679-1553833
  hypo
ggagttaggagcttccgtagacggtgcaggccaaaccccgagacaacagccccacctgggctcctgagattgcattgctgtggggatagggtctgccagcccacagcctgcacagccaccatgtctggaggggaaaaggcgctgctgaaagggt

SEQ ID NO: 72411 - DNA, 35 bp, Homo sapiens; identical to SEQ ID NO: 42942
  chr11:1560806-1560841
  hypo

SEQ ID NO: 72412 - DNA, 148 bp, Homo sapiens
  chr11:1585143-1585291
  hypo
tgtctgcggccagcacgctggcgtcccgcgtgctctggtcatagaccaccacgtcctgtggctccgtagcctccacctgggggccatggggcagagatcagcatgccgcctccacctatcgatgccctggccccgtcccagatatgct

SEQ ID NO: 72413 - DNA, 23 bp, Homo sapiens
  chr11:16255262-16255285
  hypo
aacataaaacaggcccggtgcgg

SEQ ID NO: 72414 - DNA, 214 bp, Homo sapiens
  chr11:16625964-16626178
  hyper
gaagaccctagtgggcgggagtagaggggccctctctcatctctactcccccgggttgctggctgggccgtgcagccagggccaaagcccggccgcaggagtacgcggctagcaccggcgcccgggacgcggacgtcatccgagcgcccattgacagtacagcgggaggtccggagcccagcccagtttgccgcaaggacggcttcgggccacc

SEQ ID NO: 72415 - DNA, 57 bp, Homo sapiens
  chr11:16626439-16626496
  hyper
tatcttaaagctctgcggagcgccggggaagcagcccggcaccgagctaatctgccc

SEQ ID NO: 72416 - DNA, 46 bp, Homo sapiens
  chr11:16627364-16627410
  hyper
ctccgaacactgtggcgtctcagtcacacagcgaatcaacccaaca

SEQ ID NO: 72417 - DNA, 606 bp, Homo sapiens
  chr11:16628305-16628911
  hyper
tgccttaatgtcctacgcacagttatctacggctacaacatgtgttttctcagggtggattttttggaggggaggtgaaggggagaaaaacagacccccgccacgcagatctgtcactccggaacaaggcgcaactctccaagagggggacgcatcctcgggatcagcgcgtccaccagcgagcggcgggcgcccgggcccctttctctccctccactccccctccgcgtcggcccctcggagcgccctcctcccgctcctcctcctcctttcccctccccagccaagtacgcaaacccgccccggcccggcagccgcggctcccggccacccgcgccctctcggggctccgctcgctcggctctcgtccctctgcctgtcctgccccagcccctcggtcccagctcacagaaactaaccctggagtgcccggaagggcaggagcggaagacgccgggggacggcggcccggccctgggctcctgccccctgccccctccggcgccccaacaggtagctcacagcgggccgcgcgccctggctctgcctccctcgctctcgagatcgctcgctccgtcccggttacctgggcgggctccaggatgg

SEQ ID NO: 72418 - DNA, 156 bp, Homo sapiens; identical to SEQ ID NO: 33655
  chr11:16629373-16629529
  hyper

SEQ ID NO: 72419 - DNA, 15 bp, Homo sapiens
  chr11:16632413-16632428
  hyper
gctcggagaagttcc

SEQ ID NO: 72420 - DNA, 157 bp, Homo sapiens; identical to SEQ ID NO: 33656
  chr11:16632513-16632670
  hyper

SEQ ID NO: 72421 - DNA, 313 bp, Homo sapiens
  chr11:16634139-16634452
  hyper
ggagtggggggatggcgatgaagaaaaggagaaaaagcctggagtatactaccttgctcaaaaagctcccaaaggcagcgtggagcggcacagacacgaactaagacaatgtgtgtctgcggagcctgtacagggtccatttctcccccacgtcaccctcctccattcccctctaatgagacgcggatcaccctccactctcaccgacactgcagctctgcacaagggcagctggaatctgggaaccttacctgcagcaccaatacctaagagaaatcgcgcttccctgacactaacacgccatgccatcccc

SEQ ID NO: 72422 - DNA, 30 bp, Homo sapiens
  chr11:16635126-16635156
  hyper
cccatcaccacttcccgctgcctccacgcg

SEQ ID NO: 72423 - DNA, 132 bp, Homo sapiens; identical to SEQ ID NO: 33658
  chr11:16635795-16635927
  hyper

SEQ ID NO: 72424 - DNA, 222 bp, Homo sapiens
  chr11:1669519-1669741
  hypo
aaatgctcctgaaggcggggaggcggcccggcccgcactgagcttctcaccggccagagggcgcagccacccggccttcccgaagcaggacagcggcctttccaagaccgcggagtccccgtgagggatggtgcctccggagcctggcatctcgggcggatgagaagctgagcgcggtcagatggcccgcagggtcccactgcgggccgagccctggctggg

SEQ ID NO: 72425 - DNA, 21 bp, Homo sapiens
  chr11:16762253-16762274
  hypo
ccacctcgcccagccagtact

SEQ ID NO: 72426 - DNA, 30 bp, Homo sapiens
  chr11:16935834-16935864
  hypo
ataattagaaaacatcgacatttaaagtgg

SEQ ID NO: 72427 - DNA, 219 bp, Homo sapiens
  chr11:16978351-16978570
  hypo
acctgaggtctctggcggttataatgttctgcaaggactggccagccctgtcaactcaatctaaagcagtttaaccagtcaatgcaaaagttacactgccttgaagaacagaaagataaagacagcccagatgatcccaaggaaagtggtaggtttaagttttgtgtaatgtgaggcattatcacctccccccgtggctttaggcgcagcattagtcac

SEQ ID NO: 72428 - DNA, 108 bp, Homo sapiens; identical to SEQ ID NO: 43023
  chr11:16988399-16988507
  hypo

SEQ ID NO: 72429 - DNA, 21 bp, Homo sapiens
  chr11:17037323-17037344
  hypo
tcgcgccgctgccctgcaacc

SEQ ID NO: 72430 - DNA, 154 bp, Homo sapiens; identical to SEQ ID NO: 43025
  chr11:17100671-17100825
  hypo

SEQ ID NO: 72431 - DNA, 279 bp, Homo sapiens
  chr11:17373126-17373405
  hyper
tctcaatttactaagcgaacccagaggatgccccgagtcctggaccgcagagccgctcgcgagaggcaccggggctgtaaccgcgcaacctcgtgccgcgggcggaggcgagggaggattccccggccggtgcccgcccccgggctaaagtgcggcgcgggtggggctggtcacgcgcctggcttcctgcagtgcgaacctgggaaatccaggcgacttcgcagttgccgaagggatctgaagaagtgggatgtgcaaaagcgccggctggaaatcccg

SEQ ID NO: 72432 - DNA, 30 bp, Homo sapiens
  chr11:1742866-1742896
  hypo
tgaactcctctcttgcggccccatgattcg

SEQ ID NO: 72433 - DNA, 73 bp, Homo sapiens; identical to SEQ ID NO: 33659
  chr11:17497448-17497521
  hyper

SEQ ID NO: 72434 - DNA, 152 bp, Homo sapiens
  chr11:17497545-17497697
  hyper
cgcagagcctgagaagttgcgctctggagacacatgcccgggtggggtggcgggggaagggaatccaagtccctagctctcgcctctcctcgcccagggcgcgggcctgggactgtcagagatcacggaccactgcgcggctcagcccggtg

SEQ ID NO: 72435 - DNA, 314 bp, Homo sapiens
  chr11:17497951-17498265
  hyper
gtccgctgtgtttggcgcgggatcgggggcaccgggggagtgaagggatgagctggtgtgcgagtgcggggaccggcgggcaggacacagggcaggggaccccgggaacgaggcggacggcggtcgcgggccggaaggggacgccgagcggtgcggcgcgcagcgcctcctcctccctccctgctctcccgtcccctcctccgcggctcgctgcgcgcactcaccaatgaagaggatggggaaggtgatgaagagtaggaagacgtgcggcaccacgttgagcgcgtccacaaagcagccgttgttgaggaccc

SEQ ID NO: 72436 - DNA, 218 bp, Homo sapiens
  chr11:17565786-17566004
  hyper
cccagaagcctggggcgccctgcagctctgaccttatgccggaattctcgggccacttttcggtccatggctgggccaggtccagctgcgtcgttgcacgacccgttccttcgggtgcccggctgccaggagctggaaagagccgcgaccgcgaccgggccagccgccctcggagctgggggcggggcctgagcgcggaggggcggggccaggcctct

SEQ ID NO: 72437 - DNA, 98 bp, Homo sapiens
  chr11:17566237-17566335
  hypo
cggaaactatttacacgggcggggggcggggcaatctagtccgttttctctggatattctttttttttcccccccgagacggagtctcgctctgtcgc

SEQ ID NO: 72438 - DNA, 46 bp, Homo sapiens
  chr11:17591817-17591863
  hypo
cgtgcgggtgctctacgaccgtgaagggctccgactgtacctgcaa

SEQ ID NO: 72439 - DNA, 84 bp, Homo sapiens; identical to SEQ ID NO: 42944
  chr11:1760346-1760430
  hypo

SEQ ID NO: 72440 - DNA, 117 bp, Homo sapiens
  chr11:17633792-17633909
  hypo
ggtgctgctccccctcgctgtgggatcctgggcctcgccgtgcgggtgggtggggaccgctgctgcccactctgggagtgtgcctgtgagtcatgggatcagcggagcctcctgcat

SEQ ID NO: 72441 - DNA, 30 bp, Homo sapiens
  chr11:17653699-17653729
  hypo
ggccctgactgtgtacgtggccatgtgcca

SEQ ID NO: 72442 - DNA, 457 bp, Homo sapiens
  chr11:1770262-1770719
  hyper
cgcgcggccggaccccctgagcctcggtgcgcgcgtccttccgccgtcccgcgggccgctgtctgtccactgatccgcctcccagcggcccaaccttgagggggtggggagcgcgcggggctcggcggcggcgccgctgcctcccccgccgcctgcgctccctccgcagcgccagaccggccgcgcggctgcagcccagagcctgactcacggcggcagcgggcacagccacctccccgcctccgcctcctcctgccaggagggtgggggcctcggaagccgcgaccctggggagttgcaaggtcccgcagggatgggacccctacagcccccgaccagggtgtccgcgccacctccatctccccggacccactgcgtcttcctccccaccccacccggccccatccctctcgcggagcccccagccccgtggaagactggacgctcccggaaccct

SEQ ID NO: 72443 - DNA, 465 bp, Homo sapiens
  chr11:17717315-17717780
  hyper
ggagagacgggggtgcgagcacagggtcagtgggcggggagggactggagagcgctgggcagggcgaggaggtgggagccgcgctagagcgtggggaggggacccgcagtgggcgcgcggccttagagaggggccagggccggggccggggccgggccggggctgcggtgaggggaggcgcgtggccggccgcccccagctgtggcgtcgttcaggcccggcttagcggtgccggggcgagggattaggggcagtggccgcacctggcggggcggccgcagggctaatgctgtgtgaccgccgcggccccgcccgacaactggcttcatcccgccctggaggcctgtgggctcgttagccccgccggcgtgtgcgcggggtgcggctgcgggcggcgagtgcacgtgtgccgcggggggccctgccgctggcgctgacggccaccggctgcgcccagctccaggg

SEQ ID NO: 72444 - DNA, 806 bp, Homo sapiens
  chr11:17740381-17741187
  hyper
tttagcagcaatctccgattcctgtacaaccatagctgggtttctaagcgtctagggaagaaggactgggcccacgacctgctgagcaactcccaggtcggggactggcggaatatcagagcctctacgacccgtttgtctcgggctcgcccacttcaactctcggggtctctccgcctgttgttgcactcgtgcgtttctctgcccctgacgctctaagctttctgctttctgcgtgtctctcagcctctttcggtccctctttcacggtctcactcctcagctctgtgcccccaatgccttgcctctctccaaatctctcacgacctgatttctacagccgctctacccatgggtcccccacaaatcaggggacagaggagtattgaaagtcagctcagaggtgagcgcgcgcagccagcgtttcccgcggatacagcagtcgggtgttggagaggtttggaaagggcgtgccggagagccaagtgcagccgcctagggctgccggtcgctccctccctccctgcccggtaggggacctagcgcgcacgccagtgtggaggggcgggctggctggccagtctgcgggcccctgcggccaccccggggacccccccaagccccgccccgcagtgttcctattggcctcggactccccctcccccagctgcccgcctgggctccggggcgtttaggctactacggataaatagcccagggcgcctggcgagaagctaggggtgaggaagccctggggcgctgccgccgctttccttaaccacaaatcaggccggacaggagaggga

SEQ ID NO: 72445 - DNA, 70 bp, Homo sapiens
  chr11:17741528-17741598
  hyper
cggcggtgcacccggccccgggcgcacgtgaggacgagcatgtgcgcgcgcccagcgggcaccaccaggc

SEQ ID NO: 72446 - DNA, 84 bp, Homo sapiens; identical to SEQ ID NO: 949
  chr11:17741806-17741890
  hyper

SEQ ID NO: 72447 - DNA, 532 bp, Homo sapiens; identical to SEQ ID NO: 33668
  chr11:17741952-17742484
  hyper

SEQ ID NO: 72448 - DNA, 10 bp, Homo sapiens
  chr11:17742518-17742528
  hyper
cgcccagcgg

SEQ ID NO: 72449 - DNA, 32 bp, Homo sapiens
  chr11:17742779-17742811
  hyper
taaccgagccctccccgcgcagaacccaggcc

SEQ ID NO: 72450 - DNA, 32 bp, Homo sapiens
  chr11:17743213-17743245
  hyper
agggcaaggacacagcgcggttttttccacgc

SEQ ID NO: 72451 - DNA, 76 bp, Homo sapiens
  chr11:17743716-17743792
  hyper
atccggaggaaaatccgcaaactgggccagctgtccctcagcgacgcctgtaggcggcaggcggattgcaaggagg

SEQ ID NO: 72452 - DNA, 431 bp, Homo sapiens
  chr11:17756235-17756666
  hyper
ctttttaggacccagcgcggcgccttcctccgggggcgagtgcggctgcgcgcgccgtgtgcccgtgtccggagagcggcgggctggacgcggaccgcgcgaacgagcaggcgacgggcgagcagcaagcggagcagcagcccgggcggcagcagcgtcgcggcggcggcggcagcggccgctccgcgcctcgcctcaccggcctcgctggcctcacctcgccgcgcccggacccgccacccccgcctccccgcccgacctccgcagcccccgtctcggccggcagcgcccaccgcctgcccgaagcgaggagcggagtgcggggcgcagaggcaccggagccagtgcccgccggccccgcaaatcaaacccagccaggagaacccccgcctggccccgtgcagctccgcgaccgccgggagctgtccctt

SEQ ID NO: 72453 - DNA, 86 bp, Homo sapiens; identical to SEQ ID NO: 33671
  chr11:17756886-17756972
  hyper

SEQ ID NO: 72454 - DNA, 150 bp, Homo sapiens
  chr11:17756993-17757143
  hyper
cgaccacctcacagaggagcgcgaatttcccggccctgtctcctcccctccccctcctgggggctggcctctagtccggccccgggagcggctgacctttcccccaaaagctttgtgccgatttctccattttcccgcggagatggggac

SEQ ID NO: 72455 - DNA, 77 bp, Homo sapiens; identical to SEQ ID NO: 33673
  chr11:17757704-17757781
  hyper

SEQ ID NO: 72456 - DNA, 28 bp, Homo sapiens
  chr11:17758041-17758069
  hyper
cctggcggcttttggcgccgctggcagc

SEQ ID NO: 72457 - DNA, 44 bp, Homo sapiens; identical to SEQ ID NO: 43028
  chr11:17784927-17784971
  hypo

SEQ ID NO: 72458 - DNA, 30 bp, Homo sapiens
  chr11:1788149-1788179
  hypo
cacctggggttatcacgtgctttccagtgg

SEQ ID NO: 72459 - DNA, 59 bp, Homo sapiens
  chr11:1788433-1788492
  hypo
gggccagaagcacaacgtggcagcgagctgtggggtgtgtgggccggtgctagccaggc

SEQ ID NO: 72460 - DNA, 62 bp, Homo sapiens
  chr11:1790206-1790268
  hypo
tgaggcaaagggagccggcctggaggtggggaggaaaggaagcagtccgaggtcagagagag

SEQ ID NO: 72461 - DNA, 91 bp, Homo sapiens; identical to SEQ ID NO: 42946
  chr11:1795195-1795286
  hypo

SEQ ID NO: 72462 - DNA, 30 bp, Homo sapiens; identical to SEQ ID NO: 42947
  chr11:1801108-1801138
  hypo

SEQ ID NO: 72463 - DNA, 39 bp, Homo sapiens
  chr11:18033384-18033423
  hypo
agccagccagactaccgcaggtcacgccatgctctccct

SEQ ID NO: 72464 - DNA, 30 bp, Homo sapiens
  chr11:18231515-18231545
  hypo
ctacacttgcacttacgtttggtctgtatg

SEQ ID NO: 72465 - DNA, 141 bp, Homo sapiens
  chr11:1824116-1824257
  hypo
gcctagaagcatttgcggtggaggatggaggggccaggctcgtcatacgcctgcttgctgatccacatctgctggaaggtggatggcgaggccgggatggagccgctgatccacgcagagtatttgcgctcgggaggagca

SEQ ID NO: 72466 - DNA, 102 bp, Homo sapiens
  chr11:1825171-1825273
  hypo
agtccttctgacccatgcccaccgtcatgccctggtgtctggggcaccccacgatggaggggaagacggcccagggggcatcgtcgtcggtgaagctggcct

SEQ ID NO: 72467 - DNA, 30 bp, Homo sapiens
  chr11:1826914-1826944
  hypo
accagcgtagggaagcgtgatcaccacctt

SEQ ID NO: 72468 - DNA, 36 bp, Homo sapiens
  chr11:1829914-1829950
  hypo
gtaaccaagaacatgtacagtcggtggtaggataga

SEQ ID NO: 72469 - DNA, 62 bp, Homo sapiens
  chr11:1847259-1847321
  hypo
gcctgcacgcagtgacgcctacatgcagtgatgcctgtacgcagtgacgtctgcccacagtg

SEQ ID NO: 72470 - DNA, 47 bp, Homo sapiens
  chr11:18512392-18512439
  hypo
ggagtattcatgcctcgttctgtgactgccttcgtgactacagccat

SEQ ID NO: 72471 - DNA, 57 bp, Homo sapiens; identical to SEQ ID NO: 42949
  chr11:1856532-1856589
  hypo

SEQ ID NO: 72472 - DNA, 335 bp, Homo sapiens
  chr11:1857210-1857545
  hypo
ggaggtgaagggccccgctgcgcaggaccagcggttctgcgagtttccggaaagggtgacgggggaagggcagaccccatgccctgggtggtggggagctgacagggcaggggcccttggctgagcccaccccgctggctcccagatcagggtgggcctgaggcaggcagccgacctgaggcctgggggcaccgtggacccctatgcccgggtcagcgtctccacccaggccggacacagacatgagacaaaagtgcaccgaggcacgctctgccccgtgtttgacgagacctgctgcttccacgtgagtcagggatggtcggctgggtgggcct

SEQ ID NO: 72473 - DNA, 60 bp, Homo sapiens
  chr11:1857873-1857933
  hypo
tgccctatgggccatcggaaagacaggcctgatgggcagcattttcgggggtctgagccc

SEQ ID NO: 72474 - DNA, 63 bp, Homo sapiens
  chr11:1858589-1858652
  hypo
gccagggaggtggaccgcatgctggccctgcagccccgccttcgcctgcgcctgcccttgccc

SEQ ID NO: 72475 - DNA, 30 bp, Homo sapiens
  chr11:1862756-1862786
  hypo
gaagatgtttgagtccgagtcctaggccac

SEQ ID NO: 72476 - DNA, 30 bp, Homo sapiens; identical to SEQ ID NO: 42952
  chr11:1863098-1863128
  hypo

SEQ ID NO: 72477 - DNA, 30 bp, Homo sapiens
  chr11:1864366-1864396
  hypo
cgagacctggcctgtcggggggaagctgcc

SEQ ID NO: 72478 - DNA, 30 bp, Homo sapiens
  chr11:1864932-1864962
  hypo
taagtgagaggcctgcggaaagcaaaccag

SEQ ID NO: 72479 - DNA, 43 bp, Homo sapiens; identical to SEQ ID NO: 43029
  chr11:18656839-18656882
  hypo

SEQ ID NO: 72480 - DNA, 123 bp, Homo sapiens
  chr11:1867693-1867816
  hypo
acatggagatgagagcgcctgcctcactggaccaccaggtaggcagggacccagctggcacctcctgcctccctaaactcctctcctatgtgccccccagagtcagcccgactctcccccagc

SEQ ID NO: 72481 - DNA, 271 bp, Homo sapiens
  chr11:1868053-1868324
  hypo
catttgttcactgtccgtctcttcctctgggagggaaaatccacgaagtcagggacctggagttatttgcagctgtgtcagtgctgctggggcgaggcatacacctgtgacgggacctcaggacggggacacgggtctgcatgaggattgtctaacagtccctacaagacgctggggccaccatgtacactggagtcctctggcagccagtgttccccgttgtgcggggctggccgtgaccacgctggaaaccccccgatccccttgttgc

SEQ ID NO: 72482 - DNA, 81 bp, Homo sapiens
  chr11:1868863-1868944
  hypo
ccccggtcactctgacgccgccaaatagtggagacaacaccaagctctaaagattttcaaagggagagagacaaaaaaaaa

SEQ ID NO: 72483 - DNA, 30 bp, Homo sapiens
  chr11:1869458-1869488
  hypo
caaggccttttgtgccgaccgacgcccatc

SEQ ID NO: 72484 - DNA, 515 bp, Homo sapiens
  chr11:18742646-18743161
  hyper
ttcagctgaagagcccggagcccctgaccctcacccctactctacggcgagtccctccggcacctcgccacccacaatggtcccgccctccatggctacgcccaccgtcttggtcccgcgttccttttggctcactcgccttgtggacacgccccttcgcttccattgcgtcccgccccgccacgttctggctctgcccctgctctgctctgccccgggggtactttgggtcctctgctcattccggcaatatcccggttcctgactcggcctctcttatcctgccgcgcctctcgggcaatgacagctgcttttcccactgcccggctctcgggccgccgttaaggctctcatcggtgagaagactggcggcccgccctgggggtccctgcctctggccttctcggtaactggacttgggcttggcccccgcaccttcagcacgtgttccttgttaatgctgtcgtagaatatcttggcggactccttgatggggatgccgctctccctcttcc

SEQ ID NO: 72485 - DNA, 103 bp, Homo sapiens
  chr11:18743474-18743577
  hyper
gttgaggcttctccacgaactcagggacgctgtcgcccgcagggatgtttgagctccgggtcactaagctgaagaactccactatgctcgaggacttcctcct

SEQ ID NO: 72486 - DNA, 30 bp, Homo sapiens
  chr11:1878638-1878668
  hypo
tcagttccctgagaacgtgccagagggatg

SEQ ID NO: 72487 - DNA, 986 bp, Homo sapiens
  chr11:18812557-18813543
  hyper
gctgggggaggggagcgcgctaagcttgtattctaggggagggtgggacgcgggaggctaaagctaaagggtcggtggaggcgaagcaatgggaaggctgggagccgcgctttagaggccagaaggctagcggcgatttccaatctccctcaggggcttcaggctccggagaggcgatgcagcccagagccgcgcaccagcctccgccggccgcagaggctcagaccccaaaccactatcccgattcctccccggaaccgcgcacgggcttcgtggggagtggctgccgctccctcccggctaccaagcgacaagccccctcctctgcatgggggacccctcccccagcatgcgggcgcccagagccccacgggggcgtggcgggggcgggcgccggctcctcggccgggagggctggagaaggtgtcagttgcggggccgcccgaaggagggacccgcgccctccaccttccggctccgcacacaaaggcgcagacggaggcgccgcacttaccggccagagcgggctccgggcgccggcgagcaggcgggcaggctggcgggaggatgcgcgcgcgagtgtgcgtgtgtctgcgtgtgtccctgcttgtgtctgtgccagtgtgtatgcgacgggggccgcgccgagctctgtgcgtctgcgtgtgcgggggcgtccgtccttcggtgcctccgtccttcggtccgtccgcctggcgctccgtcccgcgctccgtgcgcgctccctcgcccgaccgcctcaccaaatgcgcttcagctgcagagtcgctggcgcagccgccgggtgggtttggcaccccccagccccggctccgccccgcccccgggcgggcttccgccgctcgccgggaattgcgcagggctggcggggcgggggaccgggagagcggcctgctcccggggcacgaagggggccggatcacagacccttaacccctgacctcatctcaggtgcctccctctcc

SEQ ID NO: 72488 - DNA, 442 bp, Homo sapiens; identical to SEQ ID NO: 33677
  chr11:18813609-18814051
  hyper

SEQ ID NO: 72489 - DNA, 80 bp, Homo sapiens
  chr11:1884451-1884531
  hypo
attcacccgcttgcccgtctgctcacagcctcacccttgcttccctcagtgttcccaaggtgctgcgcaaccccaactcc

SEQ ID NO: 72490 - DNA, 51 bp, Homo sapiens
  chr11:1889039-1889090
  hypo
tcccccctgccccgtcgccccccacccctgccccagcgattctccttgtct

SEQ ID NO: 72491 - DNA, 30 bp, Homo sapiens
  chr11:1891550-1891580
  hypo
ggtgcccgcagcacccggggacatacaccg

SEQ ID NO: 72492 - DNA, 214 bp, Homo sapiens
  chr11:18950386-18950600
  hypo
gtgaatatcacaaaacgaacaccaacccctatcacttcaaggccacaaaagttaatgctcattattccgagtactccagtcttgtgattctatttaagatggatcttgccaccatgaccaaatacatggggtgacacaaggaataaaacacatgtatgaattattcaccattccccaaaaaactctatgcttttattaacggtgccactgtaaa

SEQ ID NO: 72493 - DNA, 152 bp, Homo sapiens
  chr11:1907948-1908100
  hypo
tcctcctctgcagaccgctggccggacccccaagctagcccgccaggcctccatagagctgcccagcatggctgtggccagtaccaagagtcggtgggagacgggtgaggtacaggctcagtctgcggccaagactccgtcctgcaaggtaa

SEQ ID NO: 72494 - DNA, 22 bp, Homo sapiens
  chr11:19137286-19137308
  hypo
ccacgcccggccagaaagctct

SEQ ID NO: 72495 - DNA, 632 bp, Homo sapiens
  chr11:19263417-19264049
  hyper
gaataaaatttggcccgtccggggctcgcgggctgggccgcaggcgccctgcgattccccgcttggggctatctcacccctgcccagccccaggccggctcacctgccctcggactccagccggacctctcccccttgcacccctggcatgcatgattgtgctgcccaccgtctgccccgtgcctcgcagaaactggcgcgaggagggagaagcttggctactggtgcctaagctccgtgggctctgggccttggcccagcggtgagaactcaggtgtaggaggaagaggaggaaggcggaaaaccctccaaccctgtcctcgccgtctttcctcagggtctcccacccactcctccctttctcttccctgttgtctttccctctttttccggtctccgagcctcaggcagctttagcctggttccctgtagagccctagcagggtcggggagacacttcgatccttcgtcctcactttgcagaacgggacaccgaggcccggggcggcggcgctgcctcggctgcacctggatcatttgcgcccgcgttggctccctttgctctcctctgccttagacttttctgcggactggtgctgagtgttgcccaaccgcgccgagatctgggcgcc

SEQ ID NO: 72496 - DNA, 30 bp, Homo sapiens
  chr11:1934662-1934692
  hypo
accgcgcccggcccccgctttctgatataa

SEQ ID NO: 72497 - DNA, 78 bp, Homo sapiens
  chr11:1935022-1935100
  hypo
cgttccagtcctagacgcctcaccccgcgctctgcggtgagcacgagctgtgcactgggatcgcggactccttttccc

SEQ ID NO: 72498 - DNA, 483 bp, Homo sapiens
  chr11:19366652-19367135
  hyper
ccggggtggcgaggccgccgattggcagcgaggcgccatgtgaactgcactggttggctggcgggagggaggaggaggcggtttcccgggtaacgggagggcaaggagcggctgcagcggcagcggccgcggctgagaagcgcgggccggagtgcagtgcgagaccggctggaggaggcggctccgcgaagccggtgtgggcgcaggtaggaaccccctatgctgcctcccccaggtcgggtctggctggactgcccggcggcgggaccggcctgggaaagtttgcggtgcaactgggtgggcaaggaggagaggacttggggatgctctgtgctgagctccggggtccagagcagggtggggactgccgttggggagagggccggcccctcattgagaggctcgggggccacacctctgctgcgggactctgaccgagggccagggcctctcaagccacccggccgcagcatagataccggg

SEQ ID NO: 72499 - DNA, 92 bp, Homo sapiens; identical to SEQ ID NO: 10731
  chr11:19367267-19367359
  hyper

SEQ ID NO: 72500 - DNA, 127 bp, Homo sapiens
  chr11:19367810-19367937
  hyper
ctgctgtgcttgtgtcggtctgtgcctctttgctgtgcctgtctgtccatacgtgtgtatgtgttggtgggggtggtgtaggtggatcggatccgagccaagccgggggcaactaggccaggcctgc

SEQ ID NO: 72501 - DNA, 39 bp, Homo sapiens; identical to SEQ ID NO: 10733
  chr11:19367938-19367977
  hyper

SEQ ID NO: 72502 - DNA, 120 bp, Homo sapiens; identical to SEQ ID NO: 33684
  chr11:19368011-19368131
  hyper

SEQ ID NO: 72503 - DNA, 88 bp, Homo sapiens
  chr11:1940385-1940473
  hypo
tccatggggggtctccgaggcctcaggctgcttcctccccgggggagacagcgaagggcctggggcattgggccgggcggcgggaggg

SEQ ID NO: 72504 - DNA, 298 bp, Homo sapiens
  chr11:1945862-1946160
  hypo
ggaagggtcttcgtgcgacatgtctctgaagacccctcagtgccagccttgtttccgggtgcactcagagccggggcttcccgcaggccctgtgggttctgtccccgttctcacttgtgtcacctgcagagcaggacttaacaagggcccccgtgcacaggcgcctccaggcatgggaataccaggcccccaggagggtgggaggggcctcagaacccctctcaggggccgggcccagcccagctgacagtgaccagctctgctggtgggagtccgtgctccccggggctggccagag

SEQ ID NO: 72505 - DNA, 34 bp, Homo sapiens
  chr11:1947562-1947596
  hypo
gtcttgctcgctccccgcacgcaccccaccctcg

SEQ ID NO: 72506 - DNA, 39 bp, Homo sapiens
  chr11:1949943-1949982
  hypo
gggctgcacccaccccggctgcaacgccctcttggtgga

SEQ ID NO: 72507 - DNA, 284 bp, Homo sapiens
  chr11:1950350-1950634
  hypo
caccgcagaggaggacgcggaaggtaagggcccgtccctgccgccggaggtgcaggaccctggctctagccgacgcgagggaaagaggacaggctggggtctctcgctgccctgcctcctcctccctctgtcctctttctcttcccctggcacgggggcctcggagggccaggccttgctgctccgcacggtgccgctggggtcgagctgccagggcctcgcgggtgccaccgctccaagtttctgccacacagcggagggggagtaagcgggaccagccagca

SEQ ID NO: 72508 - DNA, 240 bp, Homo sapiens
  chr11:1955151-1955391
  hypo
tggctgcaggagaagcgccgtgcagagagagcggagcagcagaggattcgtgcagagaaggagagggagcgccagaacagactggcggtgagggcaccatccgcactgctgcctcatcagagaatgagccccaggcccagagaaatgcagggggctgaggccttccttctcccggggttcccattgtcattggccaatgatcagaaccactggctaaggccccggcgccctgcagaaccc

SEQ ID NO: 72509 - DNA, 179 bp, Homo sapiens; identical to SEQ ID NO: 43031
  chr11:19567961-19568140
  hypo

SEQ ID NO: 72510 - DNA, 1139 bp, Homo sapiens
  chr11:1957221-1958360
  hypo
gggctggccctgagacgggcttcacggcacaggacccaggtccttcccatgctgtgttcccagagctgaatcagggacccactggctttggatagatgcggccacagcgggcccccaggggctccagagcctggagggccatcaccaggccaagctagcccacagccgggcctcgatgccccagccgcccatccagccttgtaaccatcttggtctttctagatcatgaatgtccgggccagagtgcagatgctggccaagttgtaagtagccgggtccgccctgggccaggcccgtgggtgtgcgttgcacggtgaggtgaacctctcgcatggcaaaaacctggatcgctcaggatgctggcggcagggggcctggagccttcctcctgcccccgctctcccctcgtgcctgcagccgggggcttcccagtggccgctgccctgttggcaagcgaggaagggcccccaccttcccaggagctccgcctcaagccagcagcggccacagagtgcccctgggcacaggcacgagggcgggagcggctggcccaggagcagcagggccgttcggagctctgagctcagcggctgaagggagctggagctgagaaggaggggtccgcaggcctcacctgcaacccctccccagccccatccgtgctccgtaccccccgccccacatcctgccgcaggctgaaggtaagtggccagctacgggctgctgtgtgtggcagtccaggccagtacaggctggcgagagtaagtccaggcatgagcccaggggccacgggacggtgtccccctgcacaaggagccaggagacagtaagggagccgaggagccctcatgggggcccagcagccctgggtcgcgcagcccagcccaccctgcggtggagacaggccttcacccagtacacgcaggcctggccctcgggtcgtcgcagtgagtcactcatgttgttcacagatcaccacgctcaggagccgcattgaccaggcccagaagcagtgagtagccctgccgtcctcgctccgcactgggcacaggggcccttggggccagccgctgtagccagtccctaacaagggccggtggtggctggcctcggcagggcagtaacgagactaacccggc

SEQ ID NO: 72511 - DNA, 605 bp, Homo sapiens
  chr11:1958714-1959319
  hypo
cctcatccataaaatcgtgtccctgggggctgtgggatcccttgacacagctactcgaccacctgcatggggctgcacccagggtgcccccggcgatgccacgctggggatcctgtcatggagcccagctgcacagccagtgccatttccccaaggatcgcagtgtttgggggctacttggagtttcgatgttttctgggattcttctccctcctcctgtcgccttggcttccctgcggcgcccagggcgggctcctccgtggtgcacgtgacctcacggcctccctgttgtgccgtcaggggtcattgcagacccctctgagggtgggcagtcggcgtggtgtgcatgtgcctgcgtgtgtgcatgtgtgcatgtgccgagagtgcccaggaacgtgtgtgagggcacggcctttgccagccaggtgtcctgctgagcagccgcgtctgaatggggccggcctcgcgggccgaagcactcctgtcctccacccgccttcacccctcacccgcacccagctcctcccggctcgtggccacatgaagacctcagacaaatggggcaggctcctgggcccctcagaggccaccgtctggaggggcat

SEQ ID NO: 72512 - DNA, 123 bp, Homo sapiens
  chr11:1959951-1960074
  hypo
tctgcatgggggccccggaggacacgagaggaggcaggtaggggctagccaatggcacagcgtcctggtcatccgcggggccagctcaggagggcactggccagtacgcgcagggccagctca

SEQ ID NO: 72513 - DNA, 30 bp, Homo sapiens
  chr11:1963030-1963060
  hypo
ggcatggcaagtgtgcggggtcagcacgtg

SEQ ID NO: 72514 - DNA, 93 bp, Homo sapiens
  chr11:19734973-19735066
  hyper
gagaggtgtgagacccggcggcagcatccgtccaggtgggacccgctgagcgccgtggccagtcccccattcccatcccggcaccccaaaggc

SEQ ID NO: 72515 - DNA, 80 bp, Homo sapiens
  chr11:19735404-19735484
  hyper
agatccccctgaaatcgcaggtgctgcaggggctgcaggagccagcgggggaggggctcccgctgcggaagagcggctcg

SEQ ID NO: 72516 - DNA, 51 bp, Homo sapiens
  chr11:19735709-19735760
  hyper
gccttaagagctcttcgagacctgggatggcgggcacgtctgcagcatctt

SEQ ID NO: 72517 - DNA, 30 bp, Homo sapiens; identical to SEQ ID NO: 42838
  chr11:197439-197469
  hypo

SEQ ID NO: 72518 - DNA, 105 bp, Homo sapiens
  chr11:1975964-1976069
  hypo
aactccagaacaaaccgctgccgccagctgggccgagctccgtgctcggggctccggcctccaggtccaggcaggcggcagcccccagggcgccctgggattcct

SEQ ID NO: 72519 - DNA, 30 bp, Homo sapiens
  chr11:1977320-1977350
  hypo
cattccaggcagggacgctgccccaggagg

SEQ ID NO: 72520 - DNA, 35 bp, Homo sapiens
  chr11:1980528-1980563
  hypo
tctccaagagccctgcgtgccgcacccatggagct

SEQ ID NO: 72521 - DNA, 335 bp, Homo sapiens; identical to SEQ ID NO: 42963
  chr11:1981002-1981337
  hypo

SEQ ID NO: 72522 - DNA, 30 bp, Homo sapiens
  chr11:1981581-1981611
  hypo
ctgcagtgccctgtgcgtggtggccagggc

SEQ ID NO: 72523 - DNA, 30 bp, Homo sapiens
  chr11:1983138-1983168
  hypo
ggccggctccacagacgtccctaccgtgga

SEQ ID NO: 72524 - DNA, 61 bp, Homo sapiens
  chr11:1983778-1983839
  hypo
gactgctggggcccccgtgttccagcctctcctgcgcctccagatacggctgcttcctggg

SEQ ID NO: 72525 - DNA, 30 bp, Homo sapiens
  chr11:1984105-1984135
  hypo
attggccctggcctccgtggacgctggggc

SEQ ID NO: 72526 - DNA, 76 bp, Homo sapiens
  chr11:1986000-1986076
  hypo
agagagggggagggccgagcccggcctcgcaggtctcatttcccgtctgcgcgtgcgtgggcgcgagtgaggggtg

SEQ ID NO: 72527 - DNA, 30 bp, Homo sapiens
  chr11:1992236-1992266
  hypo
gcctcctgagcatcccgatccgggccaagt

SEQ ID NO: 72528 - DNA, 35 bp, Homo sapiens
  chr11:1993637-1993672
  hypo
ccccgcaccccacctcgtgccgggcaccgccatgt

SEQ ID NO: 72529 - DNA, 116 bp, Homo sapiens
  chr11:1996568-1996684
  hypo
aaaggcccacattgccgggcacacaccagggtggccagggattggtcactgcctgaatgtccccggaccgatgcccgtgtgcccttgggcagccttcccctcggacaggctgtcca

SEQ ID NO: 72530 - DNA, 30 bp, Homo sapiens
  chr11:2000619-2000649
  hypo
agcacccctccctcccggcaggccggtctg

SEQ ID NO: 72531 - DNA, 30 bp, Homo sapiens
  chr11:2011824-2011854
  hypo
ctttgcctccagggccggccccactctgtt

SEQ ID NO: 72532 - DNA, 673 bp, Homo sapiens
  chr11:20153534-20154207
  hyper
caatacccctccctccgacaaccagaaacaaatacccagcgcccagatccacaccagcagcaacccagagctccagtctgaggatgagactgttccagggccacagaaaagaggaaaacctcgggcagatggtgagggaagggaacctccgtgttcaggacacctccgcccatccacattcggcctggcaccgatcctgcggaatctctccccaacgcacggtttctacactggaacgattgaaactaagggggtgcgccaactcccccaccttcgcgggtcccctggcaggagacctggtccttgccttaccgcagtaggtgtggctgtgactgaagggagcggcatccctgagcacagtcggagacaaagggaggcgagggccaaccccagcccggaaactctgccctgtaactcggccaaaggagacgccgcattggagcggctgttccgcagcaccatgctgtagaaggtacgttcctctgatgccctgtgcgcaaacccctagccagccttcccacactgccaggataacccttttgaaacctcccctgtttgggacaggccgtgctcccaccttttattggagacgaggcgaacctgggcttagggcgccacctagagccaaaaaagaggaagcgacctggccgcgaagcttcgctaggcaaggatg

SEQ ID NO: 72533 - DNA, 250 bp, Homo sapiens
  chr11:20177593-20177843
  hyper
tctctttggggctaccgcagggccggtggcgccctcaatgaggtgatggtttctaccgtcgggagaggcagcatctgggcacggggacaaagtgaatgcgcagactggaccccacctcttcgatttcaaagcacttaaaaatagtactctggcgtgcgagcggcttctaggacacggtgatttcctcctgttcctcgccctcctcttcctcctcggaatctgagaagtccgaaggtttcccgggactgct

SEQ ID NO: 72534 - DNA, 910 bp, Homo sapiens
  chr11:20178093-20179003
  hyper
cgtcggttctggaaccagattttcacctggaatgtcccggccggcgagaagaagggagaagcagaggtcagatcaggggctccgggggacgcacgggggcggggagtggagtcgggtgcaggctctgtccttcgggctgtgtcctctccccacccccagaaatgagttccggtggattcccgcattgactccgcccccgcctcagctcgcggttccgtttgcctcatccgctgccaccctgccccgaagggcggggttgggggccggtgaggccgggagagaaggcggggagtcggggtggggagagaagagggctatcctgcggagcttcgagggtagtggcccgtgtactcactccctctctaggcctcggttttcccatctgtacagtgggacctaagccgtttccgaacccttgcaattgacgggtgcgccggggaggggtgaagggcgggggcggggggggtgctgtggaggaaatgcgctcacctgcgagtctttcaggcccagcttggccgccagcttcttgcggtcgggcttgctgatgtacttctgcttctggaacatcttctccagcgccttccgctgcacgtcggagaagactgctcgacgcagcatgccccgccgaggcttcccgcgcgcggccagcggccaggagaaggtcccggggatgggcaccacgctggaggaagctgcagggtggggggaggtggcgagtgagtgggcgtacgccccccagtcccaacacggctctccctggctttttgctctgatcccttcatctctttaaaacgctcctttttctccccctggagaataggccacgaacctacaaacctgcgagagtgaaaggcgctttccgcccaaacaactttccctttcaaccgtgcaaacccggattaggtaaaac

SEQ ID NO: 72535 - DNA, 30 bp, Homo sapiens
  chr11:20179512-20179542
  hyper
actgaggacaagcagcgaaagccatatatt

SEQ ID NO: 72536 - DNA, 506 bp, Homo sapiens
  chr11:20180320-20180826
  hyper
tggagggactagggccggtctgtgtgtggctgcccggaggagctgaccaattggtcatggtgctgaaacctttgtggggaatcgtggccaagtgcactgactctgtgggaaaacggcggcgtgaagggatgccaacagctcctcgccgggaagggaaccgcctcaaattgggaccatgacaattcctgctaatttgtagagcagggaattggtgcaaagtgtcaagcagtcactgcttgtgctcaatagggcatcaaattggcgcgacggattcatgaatgttatacgcctcgcaacctctgaaccagagcataaccccgaggggtggacggagaaatacggcttcggagcagggagcgatgggccggggctggggcgccgccctgcctcgcgcaaagaagggggacgagacctacctgggaaataagaagatctgatgaaaggctgaaaagacccttcgaagtagggaaaggcgaaggtcttgggagggacgctctggagcaagg

SEQ ID NO: 72537 - DNA, 459 bp, Homo sapiens; identical to SEQ ID NO: 33694
  chr11:20181185-20181644
  hyper

SEQ ID NO: 72538 - DNA, 353 bp, Homo sapiens
  chr11:20181724-20182077
  hyper
cggctgatgcggatcagatcctccaccaggaagctggagtggccggaaaatgccgactgcaaggactggggcagcgtcaaggtgggcgtgggccgcaggaggctagggtacccggcggggggcgcgaggaggccggggaacatcatggtaggcgcgggcgggcgaaataacccttctttcagtggccggagggtaaacgcctcgcttcccgcccctcccgcccccacagtgtcctctctcttgggcttagcaaacgtctccaagtaacaatcccacttgggcgtctgcgagtcctccgtggtcctctcgtcgaggtgatggttttatagtggcccgcccgctaaagcactttg

SEQ ID NO: 72539 - DNA, 280 bp, Homo sapiens
  chr11:20182831-20183111
  hyper
ctgcaaggggctgtccgcacctcaccttgcgggaggagcggaggagagcggcgctgggctgccgagcggcaggattccgcttgcaaagagcttaggctgaccggaaactgcctcgggcaagggtatccaaaggctgtgagtgctatgctggccgttctccaaacacagggagctctcggcagtttaagttgaaactcacagccctgacattttaagccatagcagcgaaggtccagacgtcgtctggagagaaccctaccacttgcggggcccttaactt

SEQ ID NO: 72540 - DNA, 382 bp, Homo sapiens
  chr11:20183391-20183773
  hyper
agaagtgtgcagccccgccaggccgccctgatcctattaaccatgaactaactgtcaccttcagctggttttcctttttgctttttaacacaaagctttctcaaaaatcttattaaccagctttatttctctcgatggttttgttcggggtgttttgtgttgatgatctccatgtcgctgctttaaccattcaataaaagtgcatctgcgatttatatcacattaaaccagaaacggagccggctaaaactctcccttgattcaaattaaaaagttatttagggcccagctccagaggcgaattaatgctagaagatgacgtaagtgcggagtttctgagcccaagaccgctcatgctcatgggcagcgggagaaaaccaat

SEQ ID NO: 72541 - DNA, 35 bp, Homo sapiens
  chr11:20184112-20184147
  hyper
cagttcccagaaggacgcgccgggggcttcaggat

SEQ ID NO: 72542 - DNA, 987 bp, Homo sapiens; identical to SEQ ID NO: 33700
  chr11:20184500-20185487
  hyper

SEQ ID NO: 72543 - DNA, 30 bp, Homo sapiens
  chr11:20185714-20185744
  hyper
aatatagcttggcctcgctgaccgaaacaa

SEQ ID NO: 72544 - DNA, 379 bp, Homo sapiens
  chr11:20229217-20229596
  hyper
gccttggcctcccaaagtgctaggattacaggcgtgagccccggggccctgccagaaaggaggctttttaccaacaaattttaaaaagaaacaacaaaccaaagaattttgccatggacagtggcaaagtatctgctgtgctgtttctgaccctccataaaaatcatgttcagaaatggtaaaaaggctaacgaagatcaaacaagaagagacagaatcacgggcgaagggggcgcattcagggttttctggacgtcaggaagggaccgcggtggggtgctttagaagtggccggagcccgcacctgcatgcagctcgcgcagaaagcgcctggacgctcccttaggaccgtttgcattctggccgctcgacaaaaaca

SEQ ID NO: 72545 - DNA, 120 bp, Homo sapiens
  chr11:20229900-20230020
  hyper
agccaaagaccgaagcggcgccctgcaagttcttcccaagtcctcttgggaaaggcgagcctgagagggagaggcgcttttcaccaaaaggtgttttgcagagggcgggagggagctccc

SEQ ID NO: 72546 - DNA, 112 bp, Homo sapiens; identical to SEQ ID NO: 33702
  chr11:20230398-20230510
  hyper

SEQ ID NO: 72547 - DNA, 205 bp, Homo sapiens
  chr11:2036933-2037138
  hypo
cggagaggcctgagccgggagggcacacctgcctttctctcctgccactccgcaggagccacttctgcccatcccagaaccagccctcagggcaggcttggtgccaccgctgtgctgggtgtgcacgatgcccgtgggccgccggctcccctccgtgctaatgccaccctccaaagccatggcttcctctcgagccttgggtgtc

SEQ ID NO: 72548 - DNA, 81 bp, Homo sapiens
  chr11:20386484-20386565
  hypo
cttgtgtctgtaaatcggatattcccttcactctaagttaaaggtttttttttttttttttctgagacggagtctcactct

SEQ ID NO: 72549 - DNA, 182 bp, Homo sapiens
  chr11:2040029-2040211
  hypo
cctccagaggggccccgccacagtccatccccttcgcccaggtcccctcggatcagggcctgccagggtggtgtggcaaaggggcctgcatcgcgccaacctctcgcagctctccagcgggtgcagccaggctctggcccccacacgcttgggctttgctcccttcccgttttatgaggaat

SEQ ID NO: 72550 - DNA, 249 bp, Homo sapiens
  chr11:2042252-2042501
  hypo
actctgcccgcagcccgtcttgctgcagttaccattggctcctgcgtctggggcacccacgtcacacccttcatctgctcagtcagcccgaggcagctcccagcctcaggaaagcccagaagcaattggaagagtctgggggtgggaggcgcgaggacatcggacagacctggcgcggccgggcggtgcaggcctgcttcagccttctttggcctgggcttgaaggcaggcctgcgcctgaggggtctg

SEQ ID NO: 72551 - DNA, 30 bp, Homo sapiens
  chr11:20486737-20486767
  hypo
caatgtagccagaaacgttagattattaaa

SEQ ID NO: 72552 - DNA, 83 bp, Homo sapiens
  chr11:2048975-2049058
  hypo
gactaggcaacatctcgccactgcccacgccagcaccaaggcctgtcctctccaggcggtgccctcgccggtcctgctggctc

SEQ ID NO: 72553 - DNA, 36 bp, Homo sapiens
  chr11:20595699-20595735
  hypo
ccatagagacagcaccggggaaagtgagagtttcag

SEQ ID NO: 72554 - DNA, 211 bp, Homo sapiens
  chr11:20618182-20618393
  hyper
ctggctaattcagaccgaatggctgcgcggtgatggatgcggatttacggcctccttggctgcggcgcgctgggcctgattatcactataaacaggcgtccgcggagggcgggggcggaggcccgcgtctagaggacgtgcggctggtcttcttcttcttcttcttctttttttttgtttttgttttttaatactgcggttccatcctctg

SEQ ID NO: 72555 - DNA, 503 bp, Homo sapiens; identical to SEQ ID NO: 953
  chr11:20618422-20618925
  hyper

SEQ ID NO: 72556 - DNA, 755 bp, Homo sapiens; identical to SEQ ID NO: 33705
  chr11:20619219-20619974
  hyper

SEQ ID NO: 72557 - DNA, 54 bp, Homo sapiens
  chr11:20620247-20620301
  hyper
cattgctgggcatcccgatttggacggtctctaaggtcccgcgctgccaaatca

SEQ ID NO: 72558 - DNA, 260 bp, Homo sapiens
  chr11:20621539-20621799
  hyper
aatgctggctgaagccgaggtacctagatttgtgcaaatcgaggagttctattctgcgtgtttgtgaaagggggttagacgagaggagtgcggtggaggcgaagataataggattattcttacagtgtaataataattattggtgctaatgtttaggaagccgtgaaagataacacgaggggagaaagtggatagaaaaaccaccgctggcagttcttttcatttgaaagtgaattgggaaaaagcgaataaaaattagt

SEQ ID NO: 72559 - DNA, 215 bp, Homo sapiens
  chr11:20622578-20622793
  hyper
tctggacctgagttgcgaacgtctccatatctagatacaggtattttaaaagctgttgtgactttgttttgcacgaacttgacattgtgtttgcaggattgcagtgctcccaaggaaatgaataaactgccagccaacagcccggaggcggcggcggcgcagggccacccggatggcccatgcgctcccaggacgagcccggagcaggagcttcc

SEQ ID NO: 72560 - DNA, 370 bp, Homo sapiens
  chr11:20623258-20623628
  hyper
cgcgagagaggccagccgggccgtggcgggtgcacgtatgctgatggggaaaccggttggcagtgccaggtgatggatgcgggaggcggctttggggcttcggaagctcgcactgcgctggggtcggcagttcagggcgcgagggctgcagtgaccctgccagaggggccacgacctgccccttcccagccttggcggtagcgggaatacaggtccagatccacgaaagagttgaggaagatagattccacccttttatgcagacagactccctctcctgccaatgactgtcttttcttttcaaaaataatttcttaattaaacaaaaagagggttaaaattcagaacaaagccacgtggtggtggctgg

SEQ ID NO: 72561 - DNA, 19 bp, Homo sapiens
  chr11:20672510-20672529
  hypo
cagacgcctgttcttattg

SEQ ID NO: 72562 - DNA, 490 bp, Homo sapiens; identical to SEQ ID NO: 33710
  chr11:20690388-20690878
  hyper

SEQ ID NO: 72563 - DNA, 104 bp, Homo sapiens; identical to SEQ ID NO: 33711
  chr11:20690982-20691086
  hyper

SEQ ID NO: 72564 - DNA, 40 bp, Homo sapiens; identical to SEQ ID NO: 956
  chr11:20691121-20691161
  hyper

SEQ ID NO: 72565 - DNA, 218 bp, Homo sapiens; identical to SEQ ID NO: 957
  chr11:20691162-20691380
  hyper

SEQ ID NO: 72566 - DNA, 185 bp, Homo sapiens; identical to SEQ ID NO: 958
  chr11:20691431-20691616
  hyper

SEQ ID NO: 72567 - DNA, 1210 bp, Homo sapiens
  chr11:20691747-20692957
  hyper
cgcagagggagcgcttccggctggcgggcgcggccggggcccgggagggcgcggtgcggcgagggcagagagctgcgggagaaccctgggatcccgcgatctcctcctgtgccttcctgactacccaggagaactccaggagtattctcctccgcctgtctttgctcccaagggctgggcgaacaattatctgagggaaatagagcagtggagacaatctggggaaattttctcaagctcaaaccagttttctcttgccataatcgcagggttccgtgtggggaggggggagcaaggatgacgcttgattgtctgaagtccccacttcgttctgcctccggagacgcagttgtgaggactctcagcgcatcttcttccttctgcttccaccggctcccttgcccaaaagtcccctggggttcggagactggcttgcagccgccttcttcaaagagctagtagtagatgcggggagactggggtgaggtgaggtggggtgagatgtaggaaattggcaaaaatagggcctgtcaactggggggagtgtcggaggtttgcaatcctacccagccatcctccgtacgcgctgcaccccagaatctgtgtggtcattccctttccctttattctcccccctttaccatccttatttccttctttagaggcgtggccttctctctaggccaaagagcaagttcatctggagagggctaagaaggggcgtctgcacttggttggctcaaaagttccctccgcttgcgcccaggcgcccctctttggcagttagcccgctggaagatctagcgtctaggagctttcagagggcccttcccacttccccaggactgagcaggcagcggctttcgtctggttaagaatgttgaatatggatttctcaagggacaaaagaaacctcccattccgttccttacctctatccgagcttcccaggctgcggagacgccaaggctcagtctagcttagaatagttgcttcttgagttcaggcccatccggatgggttagtcttttaaaaccaggacacgctgaaggagtgcgcgcaccccaggaagatcaggacaggcaagactagtgcagagcgtgggctactggctctgagcgcgagagtctggtgctcgtggacatcttacagaggaaccgcagacaggaagaagctaggtagggagggggcaacccgttagtgagttcac

SEQ ID NO: 72568 - DNA, 27 bp, Homo sapiens
  chr11:21017124-21017151
  hypo
aaaaaaaatcagcgtctataaattgct

SEQ ID NO: 72569 - DNA, 55 bp, Homo sapiens
  chr11:2108054-2108109
  hypo
cccaaagccagaccacggcaagcgctgggcgtgggggagtcggagctgcctgtgc

SEQ ID NO: 72570 - DNA, 30 bp, Homo sapiens
  chr11:2109282-2109312
  hypo
ctaggggagggaatgcggagtcggtgttcg

SEQ ID NO: 72571 - DNA, 132 bp, Homo sapiens
  chr11:2109525-2109657
  hypo
agtgatcaggttactcgatttggtgcagttagaaaagttcgtcactgtttaagcaaataggaaagccgtttatcctgcctagctgtgagaaaatcccctagcgtctttgaaactcttcgggagcgcccccct

SEQ ID NO: 72572 - DNA, 30 bp, Homo sapiens; identical to SEQ ID NO: 42969
  chr11:2110642-2110672
  hypo

SEQ ID NO: 72573 - DNA, 132 bp, Homo sapiens
  chr11:2122361-2122493
  hypo
tacagagccgagcagcgggagggaccaccctgccaggccaagggaggaagacccggggcctccagacacagtgtaccagaggagaacccttcccatccagcatggccaagcgggacccgtgtggcacttgaa

SEQ ID NO: 72574 - DNA, 153 bp, Homo sapiens
  chr11:2131777-2131930
  hypo
tgggtaaacacacagcggtacctctatgccgaggaatgttattcggtgctaaaaagaagttagctgtgagccgcaagaagacatggaggagcaccaaatgcatgatactaagtgagagaagccactctgcaaaggctacgcccgtaggattcc

SEQ ID NO: 72575 - DNA, 61 bp, Homo sapiens
  chr11:2133266-2133327
  hypo
aaacaaagcaagttccgtgagaagagtgagatgtctttgcactttgcgaatctctgtggct

SEQ ID NO: 72576 - DNA, 58 bp, Homo sapiens
  chr11:2150685-2150743
  hypo
acgcaaggggctggtcggcaagtgcccccgggaacacccactccggcgaggcagaata

SEQ ID NO: 72577 - DNA, 170 bp, Homo sapiens
  chr11:2151064-2151234
  hypo
aggccgagtccctgccgcagccctaggcgccgcggtggtggctgctatggcatcaccagacccgtgggctccggggcccaagcaacctggtcgatgggcagacctggcagctctcctgctctgtgggctcagacccgcctgacctccctactccccggcctcaccccacc

SEQ ID NO: 72578 - DNA, 322 bp, Homo sapiens
  chr11:2152269-2152591
  hypo
gtaagtaaggtgtatcgggaatgggtggggtatggggagcatcgtggctcacgctgcgggggccgtggggacaggcgccaaggaggccagcctcacaagggcatctctgtcatggtggaaagatggaattaggcctgggacacaccccgcccaccctacgggtgtatcccaaatgccgccggccgcacactcaggccgcaccatctgagccccctcctctgagaggcagggcacagacagggccgaggggcagtggagatgggaacaggagcggggctcagaccatgaaaacattggagaatcttagcgggactttggcctg

SEQ ID NO: 72579 - DNA, 95 bp, Homo sapiens
  chr11:2156024-2156119
  hypo
gaggaaaggctgaagcgtccttgaggtcagcaggtgggcaccccccacggcagccttggggcccaaggaggcgcatgcaccgctcacccctgcca

SEQ ID NO: 72580 - DNA, 82 bp, Homo sapiens
  chr11:2187516-2187598
  hyper
ggtggcagcacaggccgtgggaggctccgctccagccccgccctatgccgcgcgaccctcggggcgccgagcctccttggcg

SEQ ID NO: 72581 - DNA, 572 bp, Homo sapiens
  chr11:2209843-2210415
  hypo
aacaggagaaaatgccgcaaatcacacacctgatcggggagtagtacccggaacccacagagaacccctaaaacacaaccgccaaacaccagattcaaaagtgggcgaaggacgtagacgggcgcctctccagggaaggtgtatccaggacagcagccgcagggaaaggtgctcaatgccacgaatcattagggcaatgccaatcaaaatcacggcgcgacaggattccacacccgttagggtggccaccgtcaacaaacccaaacaatgcagaacacaaaatagcaagtgctcacgagaatgtggagaaatcagagcccctgcggtgggtcgtgccgcagggcagccgctgcggacagcaccctggcagctcccccgcgggttaaagaggcactacaggctgccgcaatcctgttcctacgtggatgcccagaagaaatgaaacctatgtccacccaggaacgtgtgtgtgactgctcacaacagtgttattcactattgctggaaagtggaaccaacccagtgtccgccggctaagagcaaaatgtggtccacgcatacaacggggcacg

SEQ ID NO: 72582 - DNA, 1061 bp, Homo sapiens
  chr11:22214360-22215421
  hyper
gccggccaacagggccggggggcggcgggtcccgaggagggacgggaggctgcatgtccggaggaggtgcgggaggcggcagagcagggacctggggacggcttgagcggagaggagggggccagcgtggagccagccgggccggggggcggggagatggcggtctccgagggtggggcgccggccggtcttgcggtctggaggcggggaaagaggcgtggaaacagggacgcagcgaaggggaaaggaaagctgccagagggcaggagtggaaaggatcctggcgagcaccgggaggagtggcggctgcgggatcagctgccgagcaggcacagggacaggtgcctggagaagtactgggagagcgcccaggagcgctaccggctgagggtggggaagcgcagggccaagcgcgcgaagcaggttgtgggggaccgggtcgagtggaagtacccgccggagaggaaggccggctggctgtggcgcccagagacggtggagtccgaggaggaggagaaggaggcctgcagaaggaagagcaggcccttagaagtccagcagcagcaactccggcggcccacagtcagattcagcacctgcctcagatctccacgtctgtctcagctgcccctctcctgctgcctctcaggcaccagtgccattaacgagctggcgaagatgggcgacccggatctcctggaagtgttggcggaggaaggtaggaccgcgccaagaggcgtcaagggagagccaggctggctgcctgcacccctccacccgcggcgcagaggccccgggggacgttggcggccctgcggcctgagtcctagggaggttcgctgcgtggcgtgctcagcgcgaaaccgggactgcggggcagagtcccccgcctggggtgagtggggttggtttcggcgccccacagatttctctgctgctcctgcgcgccagggacctgcgacctgtgacccctatggttccggaacaccctccttgctcccctgcaggcctgggaaccgccgagtaattcagggctgctaggctagcgctgcagtgcttgg

SEQ ID NO: 72583 - DNA, 139 bp, Homo sapiens
  chr11:2224689-2224828
  hypo
tctgtcagctgcaggcgggtggcgggcggccgctctgataaggcctggtccctgcccctgtgcctctgtggggtgccggcacagcaagcctgggacctggccgccggcccctccgccaggtcaccgggaggcctggggg

SEQ ID NO: 72584 - DNA, 30 bp, Homo sapiens; identical to SEQ ID NO: 42976
  chr11:2226048-2226078
  hypo

SEQ ID NO: 72585 - DNA, 246 bp, Homo sapiens
  chr11:22359172-22359418
  hyper
ggtttccatagcatccgttcctgaagagcccccgtatggtccttggtcagggcgatccgcccagctcccctagaaagttggcaacctagctagccaaaagaagagtcccctattcctgaaacttactctgtccgtggtgctgaaacattgtaccgagacccgcccagacgggcgctgtcagccgctgaaaaaaaaaatcttccccgaggctgcccaaatcagaactgtgtatcttttatttactca

SEQ ID NO: 72586 - DNA, 15 bp, Homo sapiens
  chr11:22359485-22359500
  hyper
cgtgatgggaggaga

SEQ ID NO: 72587 - DNA, 136 bp, Homo sapiens; identical to SEQ ID NO: 33720
  chr11:22359746-22359882
  hyper

SEQ ID NO: 72588 - DNA, 92 bp, Homo sapiens
  chr11:22361451-22361543
  hyper
atgaaaaaaaaaaaccgcattggctgaatttttttctcccagtaaaaataaattgcaatgttttctaacattgtgatcggactttaagaata

SEQ ID NO: 72589 - DNA, 30 bp, Homo sapiens
  chr11:22361815-22361845
  hyper
tctttgtttaaatatcgaaagtatcaatcg

SEQ ID NO: 72590 - DNA, 708 bp, Homo sapiens
  chr11:22362501-22363209
  hyper
gcggaataccagcatcgtcaacctggaaagcttcaacttgctagaaacggaaaaggcagcgcgggtgggaaaggctctctagttgggcccgcctgcagcggagcagctctctggtgctgtgttgcaggaggacaccgcggtagtcagggtaaagccctgctgggcgcgtgtaggagtgggaggcgcctactcaggtgcagaggaggcgctggtaacccctgccctcacaaaatgcagaccctgcagatcctgcaagaaagttaggcccaagcggcctgtgtatctcaatcagagcgcccaggggtggatcccgagatggggactcgctaccttaggcctaaaggtgttaaagttgaagagacgccgccgccgcggccaagggcacctgcagaatgtgagagagcctgggaggtcttgcagcttggtgtcaccccaccaccctaatccccgagggtggggggaggtcgacggccctcctcccaaccccgacgggtcctgaaaaatgggaatgggtcagcatcgggggtacctaagccgccaagtccttgactcgcccctgctctgccgcgcagggtgctggagaagaagcaagacaccggggagacaatcgagctgacggaggatgggaagcccctagaggtgcccgagaggaaggcgccgctgtgcgactgcacgtgcttcggcctgccccgccgctacattatcgcc

SEQ ID NO: 72591 - DNA, 815 bp, Homo sapiens
  chr11:22364799-22365614
  hyper
aattcaactgggacccggaaaccgtggggatgatccacggttccttcttttggggctacatcatcactcagattccgggaggctacatcgcgtctcggctggcagccaacaggtaatgcgccaggcgggactggggctcggggcgtggtgtttgtttcctccgaaggggcagcagaagctggagcagagacaacagcccagaggggtttgaggactcccgggcgaagtcttctagtcccttgacacaccctctcagggctggagctgctggtgactccttcctgaattagtcgcctaaacgaatgtaggctctctgggaccagcgcacgcggcctccttccctctgctgtggctgaacttgcttttggcgaaataatcgacgtgctgtatggcctgacaggagctgagggcagaccgggagcaggcagagcagggacagtgcgcctgagtgcacaaaggggtgtagaacggcagatgctgcgctctctcctgcactccccgcaggctcccaggctccccgagggtctgacctcctggcaaggcgcctcgaagacctggccccgtcccccgcccagttggtgctctgggtatgaagtatttgtttctaggggggcaggcaccagcgatgcgatttcacctgttaatgagctgcgtaggggcgggcgttgggggagccctcagctgctttcagtggcctcctgccttgctgcggtgtccacaaccaaggtcctagcgccagttcccagaagcgccaccaacggcacctggagagacacccctaaagcataagacctaaggaccgatggggtggaggt

SEQ ID NO: 72592 - DNA, 482 bp, Homo sapiens
  chr11:22688123-22688605
  hyper
tgtcaactgcatttgcgtccaccaaaaaaagtaagcattttacttccgctcggtctatgaggactgatgaaatgtaggaaatctgtttctggcagggagaaaaaatcgttttcccaaacagcactaaaaggagccatcagagaagtatgaagaggggtagtgcggctgtagctgctgccgctgccgccaggctggtggggtgcggggagcggctgctgcaggacctgtgcctggagggggccggccccgagaagctgcaggagcccagcccggagcccaagcgcctctgagagccgccagcagcccagctcgggacgcgggggtgagcacgactggctggcccagttctgcgccaacgccgccgcagcgtgcgcgcaccgcagccggggctcacgggagcccctgcctgtctactgcacccggggcggcgggggaggggagaggtcattaaaaaataacctcaggaacgaggcggggaagag

SEQ ID NO: 72593 - DNA, 517 bp, Homo sapiens
  chr11:2278322-2278839
  hypo
aaaggtggtttcaggcgctcaggtgaagtggagcagaaacagaagttggaatccagccccagcgggcgggcggcagcagcagtgccggccctgcccagaacaggttcgacctgagccggcactgcccggctgccctggggctagggaggctgagacagagaagggaagccagagggtgggggtgggggcccggcactggcagagctgcctgccctcaacgaccgcccctgccggagacccccgccccacccgctgtggttctgctggcccaggtttcgctgggcccactcccagggtttggcatcactggagcccagggtcccccccgcaccctccccacagccttggccctgctgctgcctgcctcctccagggtaccccgaggcccacgtcaggagacccgcctcaggcagcagtggcccggtggctgcttctgcctagcccgcagcacgtgccaccctgggcgcactgccttcccgaaggctctcctccctccccggggcgctccctcccactc

SEQ ID NO: 72594 - DNA, 30 bp, Homo sapiens
  chr11:2287971-2288001
  hypo
tcctttagaggcacacgtgaaacatgacgg

SEQ ID NO: 72595 - DNA, 96 bp, Homo sapiens
  chr11:2289204-2289300
  hypo
agggcctccccagtgcgggcaaaacccaaagctagcgagagggcagcctccaggcacctctcactaactcctcccagaggccgttgaggtgggtct

SEQ ID NO: 72596 - DNA, 81 bp, Homo sapiens
  chr11:2290937-2291018
  hyper
ctcctccctgcctcccggctgttacctcataggtcgagggcgctcagtagccccctaaccagctggagaagtcgagtagct

SEQ ID NO: 72597 - DNA, 422 bp, Homo sapiens
  chr11:2291072-2291494
  hyper
cggaacgcggggagccgggctccgagctgcccccgcggcccggggacgaagaagcgcgggagggcgaggcggcgaccggggtggtccctggcggcccgcggggcgcagacggccgcacggcctgcggcctcagccctcccgccagcgcgttgcgcacggcgtcgtgctcggccagcaggcgctgcagcgcgcggatgtactccacggctgagcgcagcgtctccaccttgctcagcttcttgctggcgccgccgtgcggcacgtgctgccgcagcgcctggaagcccaagttcaccagcttcacgcggttgcgctcgcgctcattgcgccgcgctacggccgctgcgccgcctccggtctctgcggtggccggtcgccgccgccggctgcagcgcaacagttccggggacgcgggtctccgc

SEQ ID NO: 72598 - DNA, 125 bp, Homo sapiens
  chr11:2291800-2291925
  hyper
ggactctcccaggtctccgcaggcgcggcgcaggcggctggtttttaaatgtatagataaccctcctccgcgccgccgccgtcgcctttctcacgccctccttccttcgcctcgccctcccgcca

SEQ ID NO: 72599 - DNA, 114 bp, Homo sapiens
  chr11:2291944-2292058
  hyper
cgcgatcacattctgtaaggcccaaagcgtgcgcatgtccccctagcccatcccccggacgcagtccacagatccccagtgcgcccaactggcgaaatctgcgagttcccggtg

SEQ ID NO: 72600 - DNA, 255 bp, Homo sapiens; identical to SEQ ID NO: 10680
  chr11:2292105-2292360
  hyper

SEQ ID NO: 72601 - DNA, 387 bp, Homo sapiens
  chr11:2292391-2292778
  hyper
cgcccggccccattgaggaagcgcgtacgcgtggcgcgtggctcacggggagcatcgctaacaaagctgggttcctgctgggccccgccctgctcctcgcccccgcgactgggctgggcgcgctgtcccctagcgcagctatgtcccgagcgcgcccccacctgtgcgttaatctactgggaatgggggtggactgcgccttacctggggcggggtggggcttaaggagtggtcgagactgaggcggggtgggaggttcaggttcccggggcgccttccccaacccgccccgctttccccgtccctccacgcgcaccctgcctgtggtttccgtgcgcccccggcctgagggctctgggcggcaccttaacccggagggcctggagg

SEQ ID NO: 72602 - DNA, 94 bp, Homo sapiens
  chr11:232918-233012
  hypo
ggagaaacaggcacccgagcctccgtgggagaaaaagaatgtgtgcgactcacagagggctcacctctctcaagcccatcgatgttctgcgtgt

SEQ ID NO: 72603 - DNA, 30 bp, Homo sapiens
  chr11:2329497-2329527
  hypo
tcaggcagtggggagcgggactcagaccca

SEQ ID NO: 72604 - DNA, 30 bp, Homo sapiens
  chr11:2329892-2329922
  hypo
ggccccccccagcagcgaccagccccccgc

SEQ ID NO: 72605 - DNA, 50 bp, Homo sapiens
  chr11:23326514-23326564
  hypo
ttaactcttaccttgcggtgagctgcctgcatgtgcggtggcctgctggc

SEQ ID NO: 72606 - DNA, 137 bp, Homo sapiens
  chr11:2398257-2398394
  hyper
atgcctgtcctcaggcgcggccctgctgccacccccttgggggctcggagcgcgacagcagcttggggacgcctcccgcgcccagcacggtgcacctgggccctgaggtcctggccgaaacgcgccaagttgggggt

SEQ ID NO: 72607 - DNA, 30 bp, Homo sapiens
  chr11:2425909-2425939
  hypo
ggcacgttttctgcccggggagttgtgcct

SEQ ID NO: 72608 - DNA, 35 bp, Homo sapiens; identical to SEQ ID NO: 42979
  chr11:2428079-2428114
  hypo

SEQ ID NO: 72609 - DNA, 192 bp, Homo sapiens
  chr11:2435222-2435414
  hypo
aagctgggcccagctcgcccgcccaccccaccccctggcagctctcctcgaggacagctggcactcacctgaacgccgtcgtgggcaaagaaggccttggcgtcagcctcggtggccaggtgcaggcaggtggtcttgctccagcagcggttccggcgcaccagcagggcgaaggcgcgggcctcactgttg

SEQ ID NO: 72610 - DNA, 42 bp, Homo sapiens
  chr11:2435972-2436014
  hypo
gcgcgtggctcgggccgcctcggcctccgtctccaggtgcga

SEQ ID NO: 72611 - DNA, 190 bp, Homo sapiens
  chr11:2436421-2436611
  hypo
gtacgcgggagacctcgtgcagggagaaggccggtggccccgcgggtggctcccgggcctgctgggtgcccaggccggccagcgtcagccgggcctcctcctgcttccgctgcagcaggtcgaagagcaggctcttgcgtgacacggagcggtagagctcctgcagccgcccatacgtcaggaagtcggc

SEQ ID NO: 72612 - DNA, 291 bp, Homo sapiens
  chr11:2437920-2438211
  hypo
acacccttcccagagcgtcccctcaaggtgtccccagcccctgcttagcagtgcctctccctgctggggctgtgtctgcctgccagcgtccagcccttcagcacgcgttcgtctccagcaaaaagcacatcaaatgctcatcaaaattttccatcagcgggtgaacagacgcatcaaccacggtctgtccacaggctggaacctgactccgccttacaaaaggaatgaagcatggaatggcatacgcttcaacacggaggaaccgtcaaaccctcccgctgcctgcaggga

SEQ ID NO: 72613 - DNA, 119 bp, Homo sapiens
  chr11:2439088-2439207
  hypo
ccgcctcagccaggacgggggcagaggcaggccgtggtagacaccagcgtaggcacaggcagcgtccccaggtgagccttgcagcctgcatgcccaccgcccaccgggcccggcctggg

SEQ ID NO: 72614 - DNA, 45 bp, Homo sapiens
  chr11:24518383-24518428
  hyper
catcctggggagcagcgggaataaatgatccgcccctggccagtg

SEQ ID NO: 72615 - DNA, 3 bp, Homo sapiens
  chr11:24518643-24518646
  hyper
gtc

SEQ ID NO: 72616 - DNA, 23 bp, Homo sapiens
  chr11:24518677-24518700
  hyper
cggaagagcgctcatcactggct

SEQ ID NO: 72617 - DNA, 24 bp, Homo sapiens
  chr11:2465424-2465448
  hyper
ggccctggtgggaagcgacccgag

SEQ ID NO: 72618 - DNA, 59 bp, Homo sapiens; identical to SEQ ID NO: 33594
  chr11:2465461-2465520
  hyper

SEQ ID NO: 72619 - DNA, 390 bp, Homo sapiens
  chr11:2466441-2466831
  hyper
ggagctggcggagggcggcccggcgggcggcgcgctctacgcgcccatcgcgcccggcgccccaggtcccgcgccccctgcgtccccggccgcgcccgccgcgcccccagttgcctccgaccttggcccgcggccgccggtgagcctagacccgcgcgtctccatctacagcacgcgccgcccggtgttggcgcgcacccacgtccagggccgcgtctacaacttcctcgagcgtcccaccggctggaaatgcttcgtttaccacttcgccgtgtgagtatcgccaccggcgacggccggcacgaaggtgcttcctgagagctggtgtgggggagctctgtcccagcgccacctgccccgtcggagctgcgaccccggagcagaggaggg

SEQ ID NO: 72620 - DNA, 140 bp, Homo sapiens
  chr11:2491342-2491482
  hypo
accacgcccggctgattgttaaattttttgtagagctggggtctggctatgtcgctgacaatcaaaatgaggacttgaagcatactcctcaaatcatcgaggtttattgagccaacgtgagggcacgcccaggaaaaact

SEQ ID NO: 72621 - DNA, 24 bp, Homo sapiens
  chr11:24945189-24945213
  hypo
ccaagatcgcgccactgcactcca

SEQ ID NO: 72622 - DNA, 161 bp, Homo sapiens
  chr11:2541198-2541359
  hypo
gcacgggagtgatgccgccacccacccaggacgcgggagcccgcagaggctggaaggctgaaaagggccctgtcgcccccaccccccaggatgacgtatggcctgatgtggcattcctgcctcaggaccatggcaccaagtggtggcgctggggcccctgg

SEQ ID NO: 72623 - DNA, 202 bp, Homo sapiens
  chr11:2543263-2543465
  hypo
gtgttcccgggcacccggggctgagatgttgaaatgatgtcggataattcaccgggtgccttcggggctggtactcgccgtcactgctcctgaggcctatttgctgtcaaggggaacaagtaggaggttgttttctggggtgcggtgggctccccgctcatgcagctccccgccccccgcatgaccacgccctcttgggagc

SEQ ID NO: 72624 - DNA, 30 bp, Homo sapiens
  chr11:2547325-2547355
  hypo
ggccctgaggtgggccgggctgggcacagt

SEQ ID NO: 72625 - DNA, 79 bp, Homo sapiens
  chr11:2554518-2554597
  hyper
ctgaaaaagccatttcgggaggaatctggtctcggctggggtccggccggcaccgtgaacaccacgtgaacaccacgtc

SEQ ID NO: 72626 - DNA, 145 bp, Homo sapiens
  chr11:2569001-2569146
  hypo
atggaaggggaggggcggcagttctcagtggagcggccgggctgcgagtctctgtatggaggtgaaggtccagatgttggggtttcagggtcaagcattcctggcagagagcatggcacgtgccaagacccggatggggcgtgtg

SEQ ID NO: 72627 - DNA, 313 bp, Homo sapiens
  chr11:2596433-2596746
  hypo
acctgtgcaaacatccgcccgctggccgggaacacggcccctttgtgcccggcttggcatcagtgccccggcccacaccgtcagctgcagcccgagcctcggccatcgcgcgccctggcctggccattgttcccgccaggccccgcgcccctggtcgccctgggccccccaccgcccagggctgtggggcaaacagctcccattcagctgccctgcagctgtctggggggagcggcccctgaggcctgagttatgggctgtgttcctggcatttctcggacaaacagaacttgagaaacgcaagaaggggcag

SEQ ID NO: 72628 - DNA, 32 bp, Homo sapiens
  chr11:2603413-2603445
  hypo
gcagttctgggcagtcgcgtgagccgtgtgca

SEQ ID NO: 72629 - DNA, 36 bp, Homo sapiens
  chr11:2612777-2612813
  hypo
taacgggcaggtgggcgtggccgggggctggggacc

SEQ ID NO: 72630 - DNA, 30 bp, Homo sapiens; identical to SEQ ID NO: 33725
  chr11:26353691-26353721
  hyper

SEQ ID NO: 72631 - DNA, 30 bp, Homo sapiens
  chr11:26472646-26472676
  hypo
aggagccaagatggccgaataggaaccact

SEQ ID NO: 72632 - DNA, 32 bp, Homo sapiens
  chr11:2745363-2745395
  hypo
agatcgccagggggccgcgacaaggagaccag

SEQ ID NO: 72633 - DNA, 136 bp, Homo sapiens
  chr11:27495243-27495379
  hypo
gcctaatagaccccacggaatcattacctgtaccaactacggctttaagggtacttcgtttcttgctctctgccatggcgttgagtcgttttactctataatggagacatttttaatgaatacattaaaacaagca

SEQ ID NO: 72634 - DNA, 75 bp, Homo sapiens
  chr11:27495679-27495754
  hypo
aaaaaaaaaaaaaaaaaagcaggatttaaagataattatcatataaagttgactagccatcgtatgtaaataaaa

SEQ ID NO: 72635 - DNA, 276 bp, Homo sapiens
  chr11:2753764-2754040
  hypo
ccgggcagtgaggagcgcaggcgaatgttacagcaggcgcgagcgaaggggcccgaggcaccggtgcttccgacggggcccgagggccgtctgacctttccggccacggggcagcagttgcgtgagcaggaacaatcgccccagtgtgcaaggcacaagcggccttttcttcctcaccgggccggcgcacacagctcccagcctggcttcccttgaacaaacatatttattgtggccgccaccgaggcctcgccttgcagccggagcctgggggcc

SEQ ID NO: 72636 - DNA, 39 bp, Homo sapiens
  chr11:2758828-2758867
  hypo
gagtgaatttgactccgttcacggcgaagaagctttgtg

SEQ ID NO: 72637 - DNA, 30 bp, Homo sapiens; identical to SEQ ID NO: 42988
  chr11:2770653-2770683
  hypo

SEQ ID NO: 72638 - DNA, 50 bp, Homo sapiens
  chr11:27720970-27721020
  hyper
gtcaagaatcccccacgtacatcccaaccactccccgaaagtcaaaactc

SEQ ID NO: 72639 - DNA, 115 bp, Homo sapiens
  chr11:27722537-27722652
  hyper
tacggagcttgcgaacgcgagcacacaatgaaatcgcacagagcatgggggctattggtttactctgctgccttaaacacgccggcttaaacagagttcgcgcactgacctctct

SEQ ID NO: 72640 - DNA, 220 bp, Homo sapiens
  chr11:27739988-27740208
  hyper
gggaagggtgggtggcgatggtgatgcgggcgccttggagttcctttgcagcacgcttggaattgcatcagactgatcagaaatccccccgcccccaagctcagcccctcccgccacgctcccctgcccgcccctcccctcccctcccttcgcgtagatctgactgagaaaacgactggatctcggaacaatctgtgccccattcgctgcaggcttgctc

SEQ ID NO: 72641 - DNA, 30 bp, Homo sapiens
  chr11:27740463-27740493
  hyper
gggaggagtccagaacgaccaaaccctggg

SEQ ID NO: 72642 - DNA, 88 bp, Homo sapiens
  chr11:27740898-27740986
  hyper
tgtccagccgccgcacggagctaaaagtgttcttctccaccgcctccagccgcccaggccccctcgcccggcccgctctctggctctt

SEQ ID NO: 72643 - DNA, 30 bp, Homo sapiens
  chr11:27741900-27741930
  hyper
cggcttacaccaccccggtggctagatcct

SEQ ID NO: 72644 - DNA, 30 bp, Homo sapiens
  chr11:27742185-27742215
  hyper
actacctgggggtaccgccacctcggacaa

SEQ ID NO: 72645 - DNA, 125 bp, Homo sapiens
  chr11:27743048-27743173
  hyper
atcatgtgagaagttcggctttgctcagtggatcgcccaccacttggtgtgacttatgaatctaataaccctttgcaatatccgcaagcttaaactctcaaccaccttggcgactacagaagaca

SEQ ID NO: 72646 - DNA, 1138 bp, Homo sapiens
  chr11:27743419-27744557
  hyper
actcagcctgcacaccgctcccttgcccactacgcaggtcacacctggggctccggcgaagctgaattcggctcgggagatttccctgtcgccaggtaagaaaaccttcgccttgtcaggctagggcgggaagaccgctggggaacttgttgcttatcagcgccggcagactaccgctttaataataataccagaaaagcgcagcagggagggggtggggggcggcaacggcgacgactaacctcgctgtttacgtgaccgactcactgtgactctctgggtaaaaaaaggaaacttcttagaaaagttcgtgcccctccccctcccccatcatgactaagggtctccagccgatgaggtcgtgagtgatgatcaaatggggactggggggaggggggcgagtaagtgacttgtccttgggaacatctgcatgcgtcgaagcgcgaaccagcccaacaactttcccttttcctcttaggtactgatgactaggcgagaggcaccaaggcgagccactagttgcccacaggaacctgtgtaagccgagctctcgagcggctgagttgaatgaagttatgactgcgtttgctctaatgggttatggcttcccaaatgtgagttaacagccccggtgcgcagctaggtcggaaggcgagccgcggagagcggagccgcgggccaaggcagggacgggaggggaggcggcaggttgggcgctccgctgctgctcggtgctgcttccccggagccgcttcctcatcctgcgggggctgccccgccgccggggtgccggggtgagcgcggcgggagccagggctggggtggcgaacctcggagggggctctcccaggaagccctgcggttagcgcccgcgcttccccaccagtggctgcgcaagctgggaagcgaagaggtcacgtgttggcggaaagtaacttggaggcgaaaggatgaactttgagaagaggaaaaaaagcacaatgaaacaaactacccccttggagtgtctaatagagggggaggcgggagggggggcggaggggcgccgctctccgcgggagatgtggggacgactccggaaatctcgggaaataggcaataactcgagctttggcaacgtcccccagcctagggaggc

SEQ ID NO: 72647 - DNA, 186 bp, Homo sapiens; identical to SEQ ID NO: 33732
  chr11:27744558-27744744
  hyper

SEQ ID NO: 72648 - DNA, 114 bp, Homo sapiens
  chr11:279418-279532
  hyper
tgcgcgacgtgggcccggacggacgcagcatcccgtgggggcggctggagcgcgcggacgccgtggacctcgcggagcagctggcccagttctacggcccggagcctgccctgg

SEQ ID NO: 72649 - DNA, 111 bp, Homo sapiens
  chr11:280108-280219
  hyper
cgtgctgcagctgcacgctcgggtgaaggagaggaacgcccgctccgtgaagatcaccaagcgcttcaccaagctgctcatcgcgcccgagagcgccgccccggaggaggc

SEQ ID NO: 72650 - DNA, 35 bp, Homo sapiens
  chr11:2812777-2812812
  hyper
gggaggggacctggccgtgccggctgggctgggaa

SEQ ID NO: 72651 - DNA, 199 bp, Homo sapiens
  chr11:2818195-2818394
  hypo
caagggccagagaggcgaaattagatccgtggggagagattttacaacgtatgggctggtggcaagtggcggcaaaccgtccccacggggccacaacggggcattgttcacggcctcacctgggctgtctccagcaccccaggatttacgaggactcggcccagagcctcgatgccggccgctccgggcagacctgggg

SEQ ID NO: 72652 - DNA, 30 bp, Homo sapiens; identical to SEQ ID NO: 15520
  chr11:2829204-2829234
  hypo

SEQ ID NO: 72653 - DNA, 50 bp, Homo sapiens
  chr11:2868750-2868800
  hypo
tagggactcccagcacgcacgggatggactccaatcggcacacatgcaca

SEQ ID NO: 72654 - DNA, 430 bp, Homo sapiens
  chr11:2883606-2884036
  hyper
cgacccccagaccttcggggtgcccagtccgagcctgggccgctaggggccgcgggcctggcgggcggggcgggggccggggtcgggggtccggcgagctttaatgcgcgcacaaagcctcatttgcaggtcaatgccgcggcacactcgcctctcccctcgcccggcgccctttgtccggccgcgcccgctcctcgcgccagatggccgcggaaatgctaatttcgggcgcccctgcccccccacccccgcgtttaattgcgcctttgcagatgggccgcgagtgtgcgcttcatgcagatgagcgcggcctcgccgccttcctcggacctccgggagccgcggccgggcgtgctggggccgagggcagggagggggccgctgtccctccactcgacgcgccgccgggcacgggcgggcacccagcggc

SEQ ID NO: 72655 - DNA, 47 bp, Homo sapiens
  chr11:2884253-2884300
  hyper
tcagccctgggccggcggcacttggaggcggccgggcaagacggcag

SEQ ID NO: 72656 - DNA, 118 bp, Homo sapiens
  chr11:2905392-2905510
  hyper
agggcggggccggcccggagacccgagagggggccgggagagggcgcggggcgcgggccggccggggtgggggcgccgtccccgcccgcgccgaggtccgcggcgggtcagctttgtt

SEQ ID NO: 72657 - DNA, 177 bp, Homo sapiens
  chr11:2905859-2906036
  hyper
ggggccgggccgggccggggcggggccgtgcggggctcaccggagatcagaggcccggacagcttcttgatcgccgcgccgttggcgctggcggccgcggtgccggccgcgggacgtcccgaaatccccgagtgcagctggtcagcgagaggctcctggccgcgctgcccctggttc

SEQ ID NO: 72658 - DNA, 275 bp, Homo sapiens
  chr11:2906305-2906580
  hyper
actaggcagctgctccggcgcctcctcgaggccgtcgagggactcagcggccggctcgaggggcgggctgacagccaccgcgaccgcgacgggccgcggcgccagcagcaggcggcagcgccccacctgcaccgtctcgcggtagaacgcgggcaccgagtcgctgtccacttcggtccactgcaggcgtccagggccccgcagcggcatgtcctgctggaagtcgtaatcccagcggttctggtcctcggcgttcagctcggccaggcgggcct

SEQ ID NO: 72659 - DNA, 190 bp, Homo sapiens
  chr11:2906781-2906971
  hyper
gagaggaggagagggcggaggccgggcgcaagggagaccccgcgccgcccgactctgcgtgtgcgagggacgcggcggctacctggctgtccggtggtggactcttctgcgtcgggttcgcctgtctcgtccggacggcagccgcgccccctcgatgcctgctggctagctcgctcgctcaggcctggcc

SEQ ID NO: 72660 - DNA, 235 bp, Homo sapiens
  chr11:2932722-2932957
  hypo
cagggtgaggaagggcgtgaggagggcacggggaggagcactgggccccagcaggtggctgagctgggcggctgccatcccagggtgctgcccacccccaggtactctgccggctcagggcccagccgcctgctgccgcctccttccctggccagccttcctcacctatgaaatgggccctcccctgcccttactcacccacaacgatgctgggagggtccgagctcgctcaggc

SEQ ID NO: 72661 - DNA, 135 bp, Homo sapiens
  chr11:2933495-2933630
  hypo
cccacacctccccctcgggggctcaccgaaggcagtggggccaggtgccagccaggctccaaagcctggtgccccatggcaagggccagccccctggccctcttggtccagctgccccaacgcctgcagcctgtt

SEQ ID NO: 72662 - DNA, 30 bp, Homo sapiens
  chr11:2948107-2948137
  hypo
ggccaggccatgtaccgttgccttcccagc

SEQ ID NO: 72663 - DNA, 460 bp, Homo sapiens
  chr11:2949947-2950407
  hyper
cagcctgaggggccccgagaccctgacgcgagggggccagcgcgattgcggggcgccgggtcccccaaggaggtgcagcgcccccgccccgccgtctggggttgaagtggtttttcccaaaggccccggtcccggctgttagggcgcagggctcgccgggacgcgggcagtcactcaccgcggcgggctcatggcgtgcggggtttgggctgcggggatggcctggagggctccgagggctcggagggtgcggcggccgcggcagccacggcgtcctcggcgggtgcggcgggtgcggtgcgttcctggcggctgcgaaagtcctgcagggcgcggcggttctggaaatcgatgagcgccagcgcgatggccgcgttccagcagctctcgcccgcgcagcggaagtcgatctccttgtggtcggtggtgacgatggtgaagtacacgtacttgcccgtgc

SEQ ID NO: 72664 - DNA, 81 bp, Homo sapiens
  chr11:29581595-29581676
  hypo
tgcttcctggtacaccggagcggtgattacctggagcagctctttcccctcaatgttgagaggcattttaagtttcatata

SEQ ID NO: 72665 - DNA, 39 bp, Homo sapiens
  chr11:299379-299418
  hypo
caagtggtctcgaggcggggggtgcggggcccccagtgt

SEQ ID NO: 72666 - DNA, 138 bp, Homo sapiens
  chr11:30037614-30037752
  hyper
aaatatacacttcaacgcacgccatttatgcagcccctatgtatgttgctcaaatgctcggaaaatgcacgcaaatccaaacgttggaagaggcagcaattcagacccgttcaccggctgttcccaaaagaagggaac

SEQ ID NO: 72667 - DNA, 112 bp, Homo sapiens
  chr11:30037883-30037995
  hyper
cgcatccccgggtttgggaaaataacaactgttggccccccggagcgccgcgcagcatccgcacctcccttctcccacctcctggtttatttttaaccgccttccattcatg

SEQ ID NO: 72668 - DNA, 1239 bp, Homo sapiens
  chr11:30038294-30039533
  hyper
ttctgttgcctggcccgaggggtgcacagagtcctcgcggctggagcctgggggtgggggttggggctgccccagagaagaccccaagactcctggttcctctggagttcagcacaggagggattgcctgggaaaggaagtcaaggttcccccgaaaagaaacaaaatcctagacagcagcgatcacttgttaagcccgaattcctcctccaacatccatccctctctcgctctcgctggctgcgggagcagcacacgcctcccctggccgcgaacgcgctctgggcgggggcggggccagggccgaaccgagggtgtggcgttcgcgacggtcgccaggggcgcctcccggcgcggcggggcgggtgcagtcacgacgccgcgactccccgcaccccggctgggccccccgactcccaggatctgggatcgattccaggagtctttggctgtggtccccacaggcgaggagcaaatcctggagaagtgtccccgttggggccggaataggggtttcgacggcagcgcgggagtccccagagggcttgggagcggggagctccaatgggaggtgcagtcccgaaaatggggtcctctgggacatctcctctacctaacttgctttctctatatctcccctcgagccccgagccccgtcttcttttccccaccccatcccctcccaaagcgggtttgttgggttgggagccgggtgcatctccggcgaggccacgggcggggagccctcctgtgcctgccagagcgcccagatccctcagtctccgtctcctttgcacacaggagttgggaggcttcagcgccggggttgggcctcaggggcgcggaggagaccgactttcaacctgtattcaatcccgggcaggggaatgttacagaaattggaatcaggcccaggctaggggctgcgcacaggaggcagcagttctaggggaggagggttggagagatgagtaagttgcagggtgggccaggggctgagggctttggaaggcgggggaagagcccgcagccaacctgttgctgcaaaaacaaatacggctctggtatcgactccctgagggctctttggatccttcaggacagaaatcaagggatatcgcagcaaaaagcaagtttttttggttttctttctttctttcttttaattaaagcttgtgcgcacaagggagctaacaccaagaaaaaaaaaagtgggctgttcctcgaagtcagggtgtg

SEQ ID NO: 72669 - DNA, 152 bp, Homo sapiens
  chr11:30040150-30040302
  hyper
gcgacggggtctccctagacacctctcccagctcgcccgatggaccaagcaggcagtggcagcgctatgccccggactgctggagcaaatccgaccttgggctggttggttggcgccaggactgtcactgtcgtcctcggggcggcagcttt

SEQ ID NO: 72670 - DNA, 40 bp, Homo sapiens
  chr11:30409640-30409680
  hypo
gggaagggcctggtgcgggtgggggcggcctaataaagca

SEQ ID NO: 72671 - DNA, 44 bp, Homo sapiens
  chr11:30605841-30605885
  hyper
ggtggtgggcagttgcgcgaggcggggtggggggtgctttatga

SEQ ID NO: 72672 - DNA, 81 bp, Homo sapiens
  chr11:30605945-30606026
  hyper
tctaggctcacggctggctcttcccggctacaacttccccttccttcctgaaacaccagcgccttactcgctcagtccccc

SEQ ID NO: 72673 - DNA, 134 bp, Homo sapiens
  chr11:30606027-30606161
  hyper
ttgccacctccgtcacctcctcggccgccgctcctgctggcactgctggcgctagcgctggcggccccgggctccgctggacgcctatcttttttctctccctcttccctagctctggattgattgatgaccac

SEQ ID NO: 72674 - DNA, 194 bp, Homo sapiens
  chr11:30606215-30606409
  hyper
cgtccccgacctcagcctcccgggcgcgttggcatccccgaacccacagcgctgagcccgagcccggggccgccgcctcctccctgctctacgcctgggcgctgccaggttccttccctggaacggcggagaaaggaagggagggagccagcgagcgttggaagggggtgtggaggccacgggatctccccctc

SEQ ID NO: 72675 - DNA, 104 bp, Homo sapiens
  chr11:30606651-30606755
  hyper
cttcacctcctaggccgcaaaaccccggaattcaaaggctttacaaagataaccttgttatacgtaaatagcaaagaaactcctgcctctgtagagaagaaatc

SEQ ID NO: 72676 - DNA, 967 bp, Homo sapiens
  chr11:30606795-30607762
  hyper
cgcctagcctcgaccccagcttgggtcgccgggtcgctccgcaggctgcgagcgcggagacccaggcagcggcggagagtgaggttggggcgcggggacggggtgagaaagagccccgagcgagagcggcgcgcgcgggcggccccgggggcggccgcggggcgcagccggagcacaaagctgcgcggtgccttcccctcgtcactgcacctggcctcgggccgccgcgggagcccggggatcgggccaacacaatgcacccaggcctaggccggggcggctcgaacacatcaccccgggactttctagtaaacagctcgctgagccctcgtccccacccccatccccgccgcccggcttccccagcttctcgccgataccccctcctctcctcctaagaaatcctggcggaggagggagcgaagaggtggggacccccagaggtcgggggactgatggctggagggggtggagaagagaagaggcgcaggatggggagtcggagggaagacacctcctaaaaaagaatttgctttcgctcaggggttgaaaatcagccctccccgagcgccgaattgcccgggaggcgcccgctcgtgcggatgtcaggggcaccggggcagcccgggtccgcagcctccgagcccctcgcacgcgcctctgacaaggcacctctcacccgggctccgctttgtgtgtgcatttttttcccttcctctagtgctcggcaccgggctcccggccgcctcctccccctcccccgccctccgcctcccttcccggggcggattacctttcccgggctgcgctccggatcccggggatgccttcagcgcccggcgagcaggcgatccatagccgagcggcccgagccggctggaggagcgctgggggcgcgcgggggcggcgaggggcgcgagcgggccagaaccttcgaccccggaggtcccgccgcaggctggggctg

SEQ ID NO: 72677 - DNA, 121 bp, Homo sapiens
  chr11:30608098-30608219
  hyper
gcctgctggtgctcccgggtcaagcaggcggcaggaagctgagctgcaagttcatcatcatgagtgcgatctgcgtaaaaaatgataggggaaggaaggcgggctacggtgccccaggaaa

SEQ ID NO: 72678 - DNA, 56 bp, Homo sapiens; identical to SEQ ID NO: 33569
  chr11:308110-308166
  hyper

SEQ ID NO: 72679 - DNA, 36 bp, Homo sapiens
  chr11:308230-308266
  hyper
cggccagcctcccaactacgagatgctcaaggagga

SEQ ID NO: 72680 - DNA, 36 bp, Homo sapiens
  chr11:308326-308362
  hyper
ccacatccgcagcgagacctccgtgcctgaccatgt

SEQ ID NO: 72681 - DNA, 100 bp, Homo sapiens
  chr11:3102365-3102465
  hypo
aggttccaaaatttccgttagacaggaggagtaacttccacgtataacatggtgactaccgttaacaacaatgtattgacagggcgtggtggctcacgcc

SEQ ID NO: 72682 - DNA, 32 bp, Homo sapiens
  chr11:3110963-3110995
  hypo
gatgacaaccccagccgcggcctcctggcctc

SEQ ID NO: 72683 - DNA, 30 bp, Homo sapiens
  chr11:3114134-3114164
  hypo
caggtggaacagctgcggcttccagggcat

SEQ ID NO: 72684 - DNA, 30 bp, Homo sapiens; identical to SEQ ID NO: 42992
  chr11:3150813-3150843
  hypo

SEQ ID NO: 72685 - DNA, 177 bp, Homo sapiens
  chr11:31533680-31533857
  hypo
atttgactcaagttgcgacaagcctaatatgactatattgtgacaaaaggtaatgataataggatgttatggtgttagaacggtaaaactatactgtaatattgtgattattgcctgaatatattatgtggttactgtgtaacaagtaaatattatagcttccgtgtagtacggtga

SEQ ID NO: 72686 - DNA, 402 bp, Homo sapiens
  chr11:3164552-3164954
  hypo
gggctgcactgtgggcgaaaacgcacggacgcgacacacccaagagaaacaagcacacgcccccaggtggtccgcgcacgcacgctcccagcagcatggctcagggccatcagagagcggacacagccagacatccacatgggtgaacggataaacatggatcacatctgtgcaacggatggaagaacattcggccttcaggaggcaggaagcacggcactcacacatgcgacgacacggatgagccgcagagatgcaccaagtcaaagaagccagataccaaaggccacatcttgtccgcttccacgcccacgcagtgtccaggacgggcaggtctggacacggaacgcagactggtgcttgccagggcccggcccggttctgtcccggtttcctggggct

SEQ ID NO: 72687 - DNA, 99 bp, Homo sapiens
  chr11:3169788-3169887
  hypo
aaccggcttccatgacggcagggcgggggcaccgtcctctgcacttttgtacatctttgacattttctatcatacgaagccaaacgggagaggacacag

SEQ ID NO: 72688 - DNA, 61 bp, Homo sapiens
  chr11:31818452-31818513
  hyper
gacgcgctccgctcacgtgtgcgggcacaagcgtctgtgctaatttactgccccaagtttc

SEQ ID NO: 72689 - DNA, 26 bp, Homo sapiens
  chr11:31818570-31818596
  hyper
cgctttattttcgggtttggtgaaga

SEQ ID NO: 72690 - DNA, 1059 bp, Homo sapiens
  chr11:31819302-31820361
  hyper
ctagaagttggatctcgactcccccacccccacgataaacctaagtggtggacaattaagatatcttcttcaaaaggcgccccctcggagccgcgcaaagcaggggccttcagtgggtgccgttcaccttccagcctaatccgtgagaaagcgagtgaaagcgcctcccattatcccagccccaggaccatctgacgatgggaataggatttgtttcctggaaggaggtgagagagagagagagagagagagacagagagagagttgctgggaaataaaatcattccttagtttcttagtgtcttaatcagtgaggcggaaaacaagcaagaaaagatagcaacccggttgcggcaccttttcagctctggagcgcggatcaaaacattgtagcatctgttgaaagagaggctgactaaatcctatagagggcttgggtattatggggggtgggggtggggtgaggggaggagataagaaaaagtgtctccgtgatccctaaaaccaccaaatcgccggagaattggggctggatagagttgtctcttgttgttgtcagcccacgtcgtcgcgattttattcaccgccgcatggcgttgatcagatggaaaccatatttgtctccctctgagacctaacccccgccttatgcttttggagtatggactctttaaaacccaagaaaggcttcctgggctgggaaagggggctagggagggagggggaccctcttagcaccaaaaagtctgaggattccccgggaacgtgaagcgaagctcaccaccggtgcccgctacccccacgccggcaactctgtgcttcgtttggcccacgtgtcctccccacgcaactaggggcgacggtcctgtgcctgaggtgacaatcaccccccaaaaacctcacttgcgggtgggggggtggtgattgccagttgacccagaattttctagcaactaggcgcgttaaagtgaaaagcccctggactagctccacctccggccccaaccatcacaggcggaccctagctgatttgactctcacttcccgccctcagactgc

SEQ ID NO: 72691 - DNA, 928 bp, Homo sapiens; identical to SEQ ID NO: 33746
  chr11:31820460-31821388
  hyper

SEQ ID NO: 72692 - DNA, 389 bp, Homo sapiens; identical to SEQ ID NO: 33747
  chr11:31821389-31821778
  hyper

SEQ ID NO: 72693 - DNA, 706 bp, Homo sapiens
  chr11:31822002-31822708
  hyper
cagccaccttcataccgctcctgacatacacaaccctcacattcccaggccaacaaaatggttcaacaaacaccacctacatacaatgtggtcgatgtgtcccaggccttcaaatgcagtctcacccatgacattccccaagcatggaagccctgagaggaaatggttgggagagtaggggacaggcaaagggatgcacatatggagagctgcgtggatggctgcttgggttttaccttgcgtaggttgccctggcaccgaagtccccggataccaaccagggcgggtgccccagcttccggtctgcccgttcaacatccttagtttatcatacatgccgtctgcgcccatctgttgcttttcgctagccaggttgcgaagaactctgtttattgatgacacctgcaaatcaaaccaaaatcaaaccaaatggtagtgtctcctgaagacacagtcacccatctcagctcacccacaaccttaaaaagcaactctcaacccgttaaaaagctcccagccaccccgggacagtgggtggatttgcagatacaccgtggaaaaaatgatagctatcactttgggcatggaaatttagttggatagagaattgggcggagggggtccttcaccattgcttggtgtctctggtgacctaactcacacggttgctttgctttgttaaaagactgcccgaaaataaaaacta

SEQ ID NO: 72694 - DNA, 87 bp, Homo sapiens
  chr11:31823165-31823252
  hyper
ccaagcaaagatggacgggcactcccgcttatactgggctattttgcttacaacttctggagtcgctactctcggtttactaccacc

SEQ ID NO: 72695 - DNA, 810 bp, Homo sapiens; identical to SEQ ID NO: 33751
  chr11:31824154-31824964
  hyper

SEQ ID NO: 72696 - DNA, 29 bp, Homo sapiens
  chr11:31826042-31826071
  hyper
acaggcgtttgggggatctgggctccggc

SEQ ID NO: 72697 - DNA, 198 bp, Homo sapiens; identical to SEQ ID NO: 964
  chr11:31826106-31826304
  hyper

SEQ ID NO: 72698 - DNA, 325 bp, Homo sapiens; identical to SEQ ID NO: 965
  chr11:31826408-31826733
  hyper

SEQ ID NO: 72699 - DNA, 407 bp, Homo sapiens; identical to SEQ ID NO: 33755
  chr11:31827113-31827520
  hyper

SEQ ID NO: 72700 - DNA, 457 bp, Homo sapiens; identical to SEQ ID NO: 967
  chr11:31827597-31828054
  hyper

SEQ ID NO: 72701 - DNA, 480 bp, Homo sapiens
  chr11:31829116-31829596
  hyper
taacttctcttttggcgtttagatcttcacccctttaactgtactgtgacacaccctgtctacctcgcctcactgctttaaaaagtacgaacaggagggggtgagcgtggtcgacaaagccgacagacggcaaacaatggcttctattctccagctttcctcgaacccaaggagcaaaaccgagtctccctaaccagcaacacagcttccaaccaaatgtaccaacaacccaccaactcacaaagggaacagagggacgcttctagcttcataagccctgacccagtgcaggggtccccgaggctgctcccgtacgaacacctccctacctttcccaaaggaaaaaaaaaaaaagtcttttgggtgagtggagaaaatagaaaagtaatttcttgttgtaaatatctggaggtaattgtgttactggtgtgagttgttaggggctgtaaaaagatacaacggcaccgtggggagctcaat

SEQ ID NO: 72702 - DNA, 99 bp, Homo sapiens
  chr11:31830319-31830418
  hyper
aattacttaagtaaacgtgaacactaagtgcagaagcaacccgggaagtggggcacatcgacacccggaagcagtcctgtgcaccggagaggtcagacc

SEQ ID NO: 72703 - DNA, 660 bp, Homo sapiens
  chr11:31831479-31832139
  hyper
aagagccccagcctccgcaaggcaagggagatgagagtcgggggaagcctggggagcagagagttttcaagttccgagctcagcgctccagtggagttgggggcaagagcccgggggctgggtggaagctgacagtcctcccgctcggctctgagctccctcggagcgcgcgttccaccgccttggcctggtggcttccttcccggctcgcgctagctcgctcttccctctacctccagcgtgcggctgccttgccgactgactccactcgggctggtggcgggcgcggtgcccccctcggcgctcgagtgccggctgactcttctgcgccggagcccagtgcggcacaaagcccgagggccggcgggcgggcggagacgcggcgagcaggttccctcggcgctccctcggcgagtcctcggagcgcccgctctctgcgcgttcgctgggcctcgggctggacaaagcagccggcagcggttgctctctgcggccgttccagggccttgggcaccacagagcctcttcgtcttttcccgcgggtcgggagcattgggcgacgctggggctaggagccgcggctgctgtcgcgcctggagtctcccttcttcccgcgagctcagcccgcgctggcgctggcgctggcgctggggctgagct

SEQ ID NO: 72704 - DNA, 566 bp, Homo sapiens
  chr11:31832589-31833155
  hyper
aaaatgggctgtcagcggctggagagtgagagataaagagtgtgggtgagggaagtggctgcagccagcacacctatgctgattggtgatggctcaagtgtgttaatgtgtgtgtgccggcgcccggcctcgcctccaccgctcctcactggcccattagcgaagcctgacctctgtcatcatcctccagcaaaacacttcctcctgcgcctgaaccagagcgggaaatgaggccgagccacggttcccttttcaaacccactaatcactccgcaacatgcaaatgcaccgctcgctctcacacaaaatattgctttatgcaaagcagcgccggggcctcgcgccagccgattggatgctccctctccccgcctggtgcaattggtccgtttgtttgaatatgaatacacttgttttcggctccgccggtgggtcccggctcctctccccggcgcagggcccccgagcccgggctctggcgctcgcctgcatctccccgctccgcgcacgccgagattcggcgcggcccgccctgctgccgcgaacttgagcggtcaagtgaaggt

SEQ ID NO: 72705 - DNA, 248 bp, Homo sapiens
  chr11:31833517-31833765
  hyper
ccaaatcctccaccccgctctccccgccctttcttctctcctttctcctttcggaagccgcggtgcgcagcggagcagaggcacagctctggctggagaggcccgagtaaacacgccacttactttgtgtacagagggttcttgtgaaaagccctgaagagtcctcaccaaacactcaccaacttctcccacgtgccatttgttgactaagtgcggctgcttttcgcagcgcccgagaggaggggaag

SEQ ID NO: 72706 - DNA, 156 bp, Homo sapiens
  chr11:31834086-31834242
  hyper
ccatttgttgaatgccgcacgattaggacacacctcagtacactccaaaggcgcccctcggagcctgcagttaaggtgacaggagagcgagcggctgcctggtcctgcgctgtcccgagctctctcggcggcttcgggccacggagccgggaagga

SEQ ID NO: 72707 - DNA, 375 bp, Homo sapiens
  chr11:31834473-31834848
  hyper
caagccgccctgggccgccgggccacatgtgggcctcaccctctcgttcctgcctgggacccagcagccctgcgaccaaggagcccgggcagggctcccgggaagcaaaggcctccccggccctagccagaggtggggtcgcataaccctctcccctccccgggctggggagggctgccggctctaacccttccccgggagctcgcagcgccgggaggaaacctgggtcagaggtgaaggaggtggcgccgggtgtccaggtccgcggcctcctgggcgaggtttcatttcgcaggagcgcgactttcggaggatgccggcaagtggggccgcggccctgagtcccagaccagcgaaagtcggctttctctttct

SEQ ID NO: 72708 - DNA, 1337 bp, Homo sapiens
  chr11:31835180-31836517
  hyper
agtgaatgccactgacgtcattgggtggggaagggggctccgggaaagactcctggaaactcctccgcacaaacaaaaaacaaaaaggacttggctgcttcccatgtgtcaatatttggggaggggagttcaaccccagaatgaggccgagttttcaaagtttaaggagagaggggtgagagtgagatttcctcgttctctctggactggtctcaaggaaggtgggggtgctgttctacctcgtggggagcctcactccctctgccaagtaccggctctgggggcgaagcggcctaggggtgtgggggccgagactgaggtgcgggcgcggttgccagaggtgtgtacaaaaccgagacaactcgcaggtcgccattttaattgcggctaccaacacgcccgaggcccacttgctgccctccaagacgcgggggggcggcggggattgcgctttaggttctgtctcctttccccgcctccccacaggcccctgttcccccctaccctccgccccctgtggccagagggaggacctctcaggccggcgggtgcgttcccgcgggggccgccggggtcgtcccacccggtagcggggctgtctgcgtggagggagtcccgctgggggaccgtggctcgccagagcctgcccagagcttctagccagtattgatgcgtcaacatgaggtgaggcaagcatctcacccgcaccgatccctggcattcccctgtgcccaccccatcaggccttcggggaggcaaagaagtgcccacttctggggggaagtgcctccagctcccagcttcagaaccaagagcctcccatccggagttctgacagttctgacacctccaaactctctctttccccggtcaagcagaggcgcagcgccggcgcgctggaaagggtgaagactggcattttttggagaaggaaagtcttggcagacacctgcgtcactttgtagtgccccaaacgtctctctttttgcagaccctgggaaggtgggatcccttgtccgcggagctggcaaacgggtccagtgagccctaaaggcaaaggctcccatcccggccgcccagtccctggtgcctcccccacttccaggcctttgtccctctcctttctccagcaacctgccggttcccgctaacccggcagcctcgccgagcccagagcctagaaaagccaagaagatcccagagccgccccgtggcaccttcaggctgtggccactgctcggcttggggggaagccgcggtgccctcgcccttcctcgcctcctgccaaatggccagtgctaggggctccctgggttcagtcctcagtcctcttccgt

SEQ ID NO: 72709 - DNA, 30 bp, Homo sapiens; identical to SEQ ID NO: 33767
  chr11:31836824-31836854
  hyper

SEQ ID NO: 72710 - DNA, 159 bp, Homo sapiens; identical to SEQ ID NO: 969
  chr11:31837354-31837513
  hyper

SEQ ID NO: 72711 - DNA, 2405 bp, Homo sapiens
  chr11:31837541-31839946
  hyper
cgagaggaaagggaatgaaaaatgaagcaacaaatgacaccacccaggctggcagccctcgttcccggccagaccccgctcctcaggcccggctctggcgccgggtggcgtccagcccctgcacgcgcggcgcggcccgcgggaaagtttgtgcagcgagagtgactgtccttccgcctcgcgcgcgctgcccccttctgccccggaggggcgttgggttcccttcggttttcctttccaattctaaaataaataaataaactccgggccctggggaaatctgaatagtaattccagtcatccaaattctatgagagggtctgaggaaaaaaagacaagcctatcacgggcgccctccgatcacgaagggcacgggcatgagaaggcgacagaggaggtcctcggctcgccctgggcgcggagcgaggactctggtcagaggtaattatgtcaccgcgttttctcgccgtgacagccgaataaacacgatctccaataaacatctctaatgagggaggaggcccgaggatggctgggtttgatttatgactggaggagaaggtccacttcccactgcgaagcaggcgacctgctcgccgcccagctccagggagaggaacccgcggaggagaggatcccggcccaggtaaggcgtgcggccggactgccactgcgctcgtcccccgtttccaggtgaggtgagcagggggcgccaccgctcggagtcgggcggaggtcccaacacctgtcacaggtgactgagctccgaaggtgctcccagaagacctagaaagggggcgcaggagcgcgagtgggagtgggggttgggggctagccggggcctggcccagaggccgccccaaactcccgggcggggttcttgggtgccccgcctaagccggcctgggcgtctccagctgcttttagggccgggctcccaggactttcgcccggctgaaccacaagttagtctaagtttgggtcgtcccttccctgactcactaaggggacacttccgggccccggctctggccctccaagggccgcagggtggtgggcgcttctctttcccgggcttggcggcccggctcccatggcgcccgcgcgcttcccgccgaggcagccagcgcagcgcccgcagtaaccggagcccgcgttctagctcagtgagaatcgctaattattaggtcttccgaagtgaagctcaaatcacacgctgggagctttacgcgctgcccagctctgtcggccgcattctttcgtactccgcgtctttctgagaaacgaaccccatctctagactttgttgcggtccagccatctgcactttgcaaccgcgggaaacttctgctgcacctcgcccgacccgcggcagggtgtctttaagcgctccaggcgcgggtacggactttcccaagcgtggatgtcgtgaactgcgatgcagaggaggtctggatgcaaagtgcgtccccacctcctgcatttttcgcggtcgcgagtggctttagcagacagcagcagcagactcccgccccctactcccagctcagggccggactggaagtccactcttaggagtggaacattttgctacttttgcagaagagcacactcggcaaagacaagtccctcctccaccccccttcctatccctccctcagtaactcgcttccatctttgtatgcctccttttaaaagcaaaaatcaagccccggggccacttggggcgggctttgatttggggacagcagtcgctggcagcggagaggccccgcgggccccgagccgggccggggccggagcccgggcggttacctgggagcggagggcggggaggcaggtgagcctggcagcgccggttcccacacttctcaccgccgctcggcaggggaagtggcagatctgacagccgcgttctacgcgaggacctgccccagagtttaaatgtcaatgataagaaaagagggtgctcaggcaggcgctaactttccttaatatccacgccagcgccgtcctcattggctgcccggcccgcgtgacgtcatggcggctagagttgggcacagctctgcgccgactagttttccggccgggcgggagcctgcttctccccacccagggtccggccggctccaacccctgctttggccttccttggcccggcctgtgactgctctagcccggcccggtccagcctgggccgccgtcctgtatggcgtagagtcgatccccaggaaactagtcttgccgagtgcgctcctccgcaccttcgggcactagggccccaagatctctgcccttaggctggccagctacctctctgggtaatcaccctgtcccctcctccgatccccaagggagtcccttcatcggagagacccgaaggccgcgccgggatggagagg

SEQ ID NO: 72712 - DNA, 132 bp, Homo sapiens; identical to SEQ ID NO: 3732
  chr11:31840041-31840173
  hyper

SEQ ID NO: 72713 - DNA, 102 bp, Homo sapiens
  chr11:31840878-31840980
  hyper
gacttgattttttgtcttgctcagcccgtcgaggactggagggcagagtaggggtgggagtgggggtaggggtagaggtgggggtggcggtgaaggtgggga

SEQ ID NO: 72714 - DNA, 315 bp, Homo sapiens; identical to SEQ ID NO: 971
  chr11:31841774-31842089
  hyper

SEQ ID NO: 72715 - DNA, 102 bp, Homo sapiens; identical to SEQ ID NO: 33773
  chr11:31842174-31842276
  hyper

SEQ ID NO: 72716 - DNA, 62 bp, Homo sapiens
  chr11:31843422-31843484
  hyper
tgacaaggccggcttcgatctacaattgtatttgaatgggcaatgagcggaaagatctctca

SEQ ID NO: 72717 - DNA, 280 bp, Homo sapiens
  chr11:31845075-31845355
  hyper
aaaggaaagtttgggcgggaagcgagcgtccccgggtctgaggctgctgggtggaaagctggcctaggagggcgagtagggagcaaaatagggcctggtccttgcggggccggggagctagaggccgcaggaagctgggagggccctttccaggcaggcagggcagcctcctggcgcggcccaaggcgcgaggcagccgctggctagggaggtccagtctcctgcaggccagggagggcttcctctgggtgcagccgtctccctccgctcctcagcttgg

SEQ ID NO: 72718 - DNA, 30 bp, Homo sapiens
  chr11:31845607-31845637
  hyper
ggaattagttggaagcgggcgcattcccca

SEQ ID NO: 72719 - DNA, 58 bp, Homo sapiens; identical to SEQ ID NO: 33775
  chr11:31845842-31845900
  hyper

SEQ ID NO: 72720 - DNA, 1140 bp, Homo sapiens; identical to SEQ ID NO: 33776
  chr11:31846162-31847302
  hyper

SEQ ID NO: 72721 - DNA, 343 bp, Homo sapiens; identical to SEQ ID NO: 33777
  chr11:31847370-31847713
  hyper

SEQ ID NO: 72722 - DNA, 104 bp, Homo sapiens; identical to SEQ ID NO: 3735
  chr11:31847769-31847873
  hyper

SEQ ID NO: 72723 - DNA, 76 bp, Homo sapiens; identical to SEQ ID NO: 3736
  chr11:31847895-31847971
  hyper

SEQ ID NO: 72724 - DNA, 285 bp, Homo sapiens
  chr11:31848318-31848603
  hyper
cttgatggcataactcgaaccggagaagcgaggggagcctgagtgactggggcgcacatgacccccctcctggggcctttgggctcaacccttacttttaacttgttctaacaggaataatggagtagtactactaatgcatggtcagaaggggcttttctgtctagaacgcaggcggcgggagttgcaccgccacagcccgggagaccaaagagtctccactccccgctcccggcgcctcctcgccgaccggagccccgagcccagtgagcccagccggtccca

SEQ ID NO: 72725 - DNA, 353 bp, Homo sapiens; identical to SEQ ID NO: 3738
  chr11:31848722-31849075
  hyper

SEQ ID NO: 72726 - DNA, 30 bp, Homo sapiens
  chr11:31849540-31849570
  hyper
tgccctagtgattgtcgaattttaaggact

SEQ ID NO: 72727 - DNA, 83 bp, Homo sapiens
  chr11:3186228-3186311
  hyper
tccccagctccccagcgcgcgaccggccccgcggcgtggttccccgcactggctactgccagggtccgcggggctgcggcgcg

SEQ ID NO: 72728 - DNA, 170 bp, Homo sapiens
  chr11:3186601-3186771
  hyper
ggcgggaggaggaggcgcggcggccgcaaaacccgggccgaatcgccgcgcggagcgggcgcccaggggctgccccccaccggctgccgcttctcctcatcccccaaccccccgcgcgcgctccggggctcacacccacccgggcggccagaggtcgggacactccgctg

SEQ ID NO: 72729 - DNA, 48 bp, Homo sapiens; identical to SEQ ID NO: 42995
  chr11:3187905-3187953
  hypo

SEQ ID NO: 72730 - DNA, 127 bp, Homo sapiens
  chr11:32009000-32009127
  hyper
cgacgccatctgctctgcgaagcagaaacggcggcagctgcgcgcccagtccctccgcccgcgccccgcgcgccgagtccggatccgccgcccggcggcaccgcggacagcgccagccccggggtgg

SEQ ID NO: 72731 - DNA, 1 bp, Homo sapiens
  chr11:32009269-32009270
  hyper
c

SEQ ID NO: 72732 - DNA, 100 bp, Homo sapiens
  chr11:3209774-3209874
  hypo
acagagcgagactccatctcaaaaaaaaaaaaatctctcacaaaagctcataacagagtgacagtatgaatgcgtgggtgggggccggcagggtgctggc

SEQ ID NO: 72733 - DNA, 67 bp, Homo sapiens
  chr11:3224699-3224766
  hyper
gctctgctgcctgtccgggtgccggaggcacgaccgctcccctccaggccgacgggctgctccagac

SEQ ID NO: 72734 - DNA, 23 bp, Homo sapiens
  chr11:32269881-32269904
  hypo
actgcacccggcccacatctaca

SEQ ID NO: 72735 - DNA, 23 bp, Homo sapiens
  chr11:32281902-32281925
  hypo
accgcgcccggccagtgctgcat

SEQ ID NO: 72736 - DNA, 68 bp, Homo sapiens
  chr11:32354892-32354960
  hyper
caggtgcacggaaggcggcccattctggacagaaaagctttcgtttgacccaaagctcccccttccgg

SEQ ID NO: 72737 - DNA, 339 bp, Homo sapiens
  chr11:32354999-32355338
  hyper
cgagcaggcggcttctcctgaccggggagacgcgggaggtttgcaaacagaccttggcctgggctgcgcagggacaaagtgttcaagggcagcaggggaggctgagggagtacacggctgggaacaagggacactgccgcccccagccacgcaggagcggtgtctgcaccactgaaagtcccccggggcccacagctctatccaggcggaagggaagcagccaggccgccgcggatctgaacttgaatcccgggtggaccggacgccccggccggcgctcctgacgcgcggaggagctggcgagaacctgcagatctcagggctcgcccgcggtccggc

SEQ ID NO: 72738 - DNA, 447 bp, Homo sapiens
  chr11:32448447-32448894
  hyper
ggacagtcccccaggcgcggccactcccccacccaatctcccagggcaggcgcttttccttccttcatgacctcactacctccttcccttgacgtcagccccgggtccccgcgcggaggggagggaggatggggatgggtttgggggcagccggtgtcaggatccccgagcaccagggaggagggggctatgaggtcatgcgcgcccaatcccgggccgcacaggcctcgcgctgctgctccccggcccccgccccaacttccagccccgtgcgggctggtgtgcgccgcagttactaggcaaccctatcgcagacgcgggcggccggccaagttcacccaaagttgaagaaaaaatttgggggagagaaggtggagcgagaggcgagaagaggaagcacggagcggggaaaagcttggaagggaatgaagctggccttgggcctcc

SEQ ID NO: 72739 - DNA, 131 bp, Homo sapiens
  chr11:32449434-32449565
  hyper
gtccgccggctcatgcgtcccctccggggtcccaaggacccagacgcagagcccagcgccttcctacctgctgtagggcgtcctcagcagcaaagcctggctgccggtgcagctgtcggtgggggtgtggc

SEQ ID NO: 72740 - DNA, 1170 bp, Homo sapiens
  chr11:32455276-32456446
  hyper
gtgggcgggcatcggcgcgggatgagaaaccaacctgatacttatcgtgtgccgagttccctccttgtatcctgactaagcacagcgaataaccctgtccttgttctaaccccaggtcttgaagaaatactgtcccagctgagccccgcgtttacaagatgaagaggcgccccagatgcgctgaaagaaaggccaaagctcgtgcctccttccactgcctgcggtagaacctggtcccgcatagcttggactcggataagtcaagttctcttccatccccagaacctgcgtggccgccgcctgagcgaagcccagtgaagatccacttctgtattaccatacgcgggagctatccacggacacgacgctgttccagaaagccatttagttactggaggtgcatgtgctcattctagttctctacgatacttaatgtgcacctaagtgtgtgccaacaccgtattataagggctggaggtgctcctggacattttagcgctgcggaggcagcacagcacaggcgctcacccccgcgctggtcccactccgaatccagagtccagacgtctgaaaagcgctacgcttggtgacaatttggcgtttccttaattaacaaaactctccccaaggcagagccagacactgcgccggtctcctggttccactcccgtggggactagcagtcccggaatctctcggactctaaggggccccagacgccctcccggctcttgcgaacagtcaggctcctagctctgcctggctttggaggatgtcgggggccagtgcctgcgtgcactcccactctccggcctcctccccagccgccgcttccgctatcctcacggcccttgggaagcagctgggtaagagctgcggtcaaaaggggtaggagaggggggtgtcctagagcggagagtccctggcgccactgccccgcgcgtagggggcgctccccggcctacttaccctgattgcgaatagcgggctggctctcgaggcagctgggcaggtagggcgcgttaggaaacatcctggcctggccggatgacgcctggctgggcggaggaggaccgaagggcccgtagcgacaggctccggctgtgccagtgaactggccggaaaagtggacagtgaaggcgctcaggcactgctcctcgtgcggctccg

SEQ ID NO: 72741 - DNA, 154 bp, Homo sapiens; identical to SEQ ID NO: 3740
  chr11:32456758-32456912
  hyper

SEQ ID NO: 72742 - DNA, 286 bp, Homo sapiens; identical to SEQ ID NO: 33789
  chr11:32456913-32457199
  hyper

SEQ ID NO: 72743 - DNA, 1564 bp, Homo sapiens
  chr11:32457219-32458783
  hyper
cgccctcgcagctggggtgagggcgggtccgagggagcgtccctctcggagacaccctcctcttcaacccaacacgcgctctcagctggccggtgtggcacaaccctccccccacctccccttcttggccttcgccagtgtgggagcctcgtctcactggagagtccgttcaggtaagcagtgagtccgggcagggtcgaatgcggtgggagtagagatggggttgttaatctaaaagagtggtttggagggaggggcaggtaggctccaagagggcgggaacttcaggaaagcgcagaaagaactcagtcaagcttcaaagaagcgtatacccttgctttgcacccttgagtctggctcttgcttctagaactgtcgggtaggggagtggccatgatcttggggtcactggggaaagaggtggccctttgtgggttccagaggtcgggactgaaagcgaacgtccctcagttgggtggccgggagttgcaccagttataagccgggcgtatttcgatcggctagtagttgtttacttggtgaggtttgcgccaggcggaaggcggttgccgcctacctaaaattggagtcagcagcacttagtttccctttccagtgaggaatatctaattcttctacggttaagccgggaaaacagcggctagtttaggagggaagaaaacccttgggcaaacgcccaaagcctgcgtatattccggccggagcatcctggcgcccagtttggggaggaggggtgaaggggagggtttggatacgaagcccggcagggagcgggtaactcctggagccactccgccgagcactgcctgtggccctggtcgaggataccattctggttgctcagtgattgaccaggaggcggaagccagttaaggggaccaaggagtggagtagggagaacctccatcggcccacgggcgcgagttagtgttcgaatctttgggagctcgaagagcttcgctaaatctgactcccttcgtctagtctctgtttggcagcccccgcgccccagagcaggtgtttggggcgggtagggggtgttttggtttggtttttggatcttctaaaggagtcagtatctattgggaaacaacccctaggcaaggagaagaaccgggggccggagcggagcgtgtttcagaggtgcgtataaaatcccaggggcgccaggaggcagcagcgacggcgcagcgtgggacggccaggcgcgacgggagggaagcaaccggttgcagtccggcctcctgtacctggctggcccgggctggggctgcaagctttccagccaaacttatgtgaagcaaagtagttgcagtttgacaaagaatggcgtttcaataaatgacatagtaattttttacgctttggtttttagcttgcattgcataaacgttgtcgccattaaattctggctgcggacccgaagtgtgtgcgggcccaggacttactcgaagggcgcacttcttgggaatgcgcatcccgtaggcgcaggagaccctgagggtaaagatgcggcacttgagccctccgcttgcctcccagg

SEQ ID NO: 72744 - DNA, 44 bp, Homo sapiens
  chr11:32459407-32459451
  hyper
ggaggggaagagcaccggtgcgaaccccggggtgccccctcgcc

SEQ ID NO: 72745 - DNA, 299 bp, Homo sapiens
  chr11:32459576-32459875
  hyper
cgaccccaacggatccacatgcccggaagcccaggcgacactaagccagcgctggggaactgacgtactcctgcagtcgcagggcgctccatgcctctctgtcctcttctttgttgtgggtaacgttctctgcgggagacctgaggttttccaagggggacatgccagctacactggccttggcgccctgagctaagcaccaggactcacagcctagcacgaaggcaggtagcaccttcacccgccgcggacgataggcgctctcctgtacctcctttagctcgcgaggcccgcccttc

SEQ ID NO: 72746 - DNA, 30 bp, Homo sapiens; identical to SEQ ID NO: 33793
  chr11:32460192-32460222
  hyper

SEQ ID NO: 72747 - DNA, 47 bp, Homo sapiens; identical to SEQ ID NO: 33794
  chr11:32460468-32460515
  hyper

SEQ ID NO: 72748 - DNA, 164 bp, Homo sapiens
  chr11:32460744-32460908
  hyper
gacagccacactgcgcgcggggcccgcaggccgtaataaagagtggctcgacctcgctgctgcctgtcgcgggagaggaacaagctttcgactagcgcctctccccggggcccgcgccccgagccccacgcgcaagacagcccaacagctgttcctcccctccc

SEQ ID NO: 72749 - DNA, 32 bp, Homo sapiens
  chr11:32461289-32461321
  hyper
tcagtgaaaggattccgcggcactgcctctat

SEQ ID NO: 72750 - DNA, 265 bp, Homo sapiens
  chr11:3249604-3249869
  hypo
caggtggtcaggtggcgtgggcggcggcacgagtaccaggctgggaagagggcggccaggcactgctccacgctgacggccgccaggagactcaggcccacgatgtagcagaagaagcgcagcgttgccaggctggtctgcacgaagcccgggaagtccagccggccttgcagcaagtcggggacgatggccaccatgtggcagccaaggaagatgagatccgcgcaggccacgtccaggaggtagatggcgaaggggtttctgt

SEQ ID NO: 72751 - DNA, 153 bp, Homo sapiens
  chr11:3251585-3251738
  hypo
catagctggtcttagcggcttcttcccacctcaaggttgtgctcagaacccctgctgtctccctccagtgataggagcacccgagaccatgcagggggacgctgcggtgctgggatgctggggagaggtggcccggggcggggctatcgctga

SEQ ID NO: 72752 - DNA, 82 bp, Homo sapiens
  chr11:3254436-3254518
  hypo
gtctgatgaatgtgtcgcgctggtgtctgacgtccatgcggggctggtatctgacaggcagcagtgccgcttgctgagttgt

SEQ ID NO: 72753 - DNA, 22 bp, Homo sapiens
  chr11:32604850-32604872
  hypo
tccactgcgcccagccaaagct

SEQ ID NO: 72754 - DNA, 195 bp, Homo sapiens
  chr11:327113-327308
  hyper
tgcctcagtgccccacggacagggggtgcgatctgagcagaatgaggtgacgtcactgggtcagcggctcctgtggcatctggccaaggacaatgtgctgagaagtttcccctgaaaaaatcagaaacaaaactcacctcaggagaggcccctgcaccctccaagaggaagtgggagtcacgtgaggctcgtctt

SEQ ID NO: 72755 - DNA, 210 bp, Homo sapiens; identical to SEQ ID NO: 43034
  chr11:32728943-32729153
  hypo

SEQ ID NO: 72756 - DNA, 30 bp, Homo sapiens
  chr11:3277135-3277165
  hypo
ctgcttcttcagggccgtgaggccatgctg

SEQ ID NO: 72757 - DNA, 17 bp, Homo sapiens
  chr11:32859995-32860012
  hypo
tccggaaaaaaaaaaaa

SEQ ID NO: 72758 - DNA, 37 bp, Homo sapiens; identical to SEQ ID NO: 43036
  chr11:32935022-32935059
  hypo

SEQ ID NO: 72759 - DNA, 173 bp, Homo sapiens; identical to SEQ ID NO: 33796
  chr11:33037467-33037640
  hyper

SEQ ID NO: 72760 - DNA, 104 bp, Homo sapiens; identical to SEQ ID NO: 43037
  chr11:33181185-33181289
  hypo

SEQ ID NO: 72761 - DNA, 18 bp, Homo sapiens
  chr11:33184321-33184339
  hypo
ctccgtctcaaaaaaaat

SEQ ID NO: 72762 - DNA, 137 bp, Homo sapiens
  chr11:33202679-33202816
  hypo
gaggtctctgcccaacgctgagtcgcaactgccacattcaggacacatgtctccaacacttacataaaggacttttaggctgggcgcagtggctcacacctgtaattagccgggtgtggtggtgggcgcctgtagtc

SEQ ID NO: 72763 - DNA, 15 bp, Homo sapiens
  chr11:33262877-33262892
  hypo
cgcaaagaaattaat

SEQ ID NO: 72764 - DNA, 224 bp, Homo sapiens; identical to SEQ ID NO: 43040
  chr11:33269863-33270087
  hypo

SEQ ID NO: 72765 - DNA, 23 bp, Homo sapiens
  chr11:33277687-33277710
  hypo
agccaccgcgcccggcctccttt

SEQ ID NO: 72766 - DNA, 107 bp, Homo sapiens
  chr11:33397535-33397642
  hyper
gagcccggccgggcgcgcgggagcggggagcgcgcggtggctccgcgcggggctgcgcgcgcgcgccggcctcgcctcctcgcctcctcgcccgttccggaggctac

SEQ ID NO: 72767 - DNA, 16 bp, Homo sapiens
  chr11:33430482-33430498
  hypo
gcgactccatctcaaa

SEQ ID NO: 72768 - DNA, 18 bp, Homo sapiens
  chr11:33655887-33655905
  hypo
ctgcgcttactgctctga

SEQ ID NO: 72769 - DNA, 36 bp, Homo sapiens
  chr11:33721908-33721944
  hyper
gcaggggaccaggggcgaggcaaccacctcaggccc

SEQ ID NO: 72770 - DNA, 46 bp, Homo sapiens
  chr11:33721966-33722012
  hyper
cgcagaggctcgtaggggatggaggccaggccggagggccagggcg

SEQ ID NO: 72771 - DNA, 198 bp, Homo sapiens
  chr11:33801487-33801685
  hypo
tggggctgtgttcctcggtggagacagctcctgtcagcgccctctttcctacctccagctcactcagctctgatgatactgttccctccctccagctgctagaactgtgcctcttgctttttcagggttggtaacggcttccctcccccaccccattactaatccctgggcacctcactgtcccgcattggttccctt

SEQ ID NO: 72772 - DNA, 44 bp, Homo sapiens
  chr11:33850913-33850957
  hyper
ccccacacctggacccgcggacacctgggcggaaccccaagccg

SEQ ID NO: 72773 - DNA, 25 bp, Homo sapiens
  chr11:33858438-33858463
  hypo
aaaccgaccacgccccttattattc

SEQ ID NO: 72774 - DNA, 39 bp, Homo sapiens
  chr11:33874033-33874072
  hypo
ctcaagctcttcttgcgaggaacgcgtgggtgaacaagt

SEQ ID NO: 72775 - DNA, 180 bp, Homo sapiens
  chr11:33874405-33874585
  hypo
tgtatttattgatggagatggctctcagtggagaggggagctggagaggggacgggacaagcagataatcttccctgagatctggcgttctccagccggctcttctctgaagttaatctctcctctgaagtccagctctccctctgaagtcaagtcgcctctctccagtcaagctgcttc

SEQ ID NO: 72776 - DNA, 186 bp, Homo sapiens
  chr11:33880881-33881067
  hypo
agatgcccggggactcgggcctatatcatcccattgatcttagtccactcgtagatgtcctgttcgcacactatgtcagagttgatgaggaggtatctgtcacctacacagaaatgcttctgacaggcggcgcatttgaaacattccaggtgatacactttgtctttcacccgcattgtcatctca

SEQ ID NO: 72777 - DNA, 452 bp, Homo sapiens
  chr11:33890181-33890633
  hyper
ctctgctaaaaactacgagactctactccccagaataattcacctatacacaaaatggtgcattaactttcgaggttcacatgtccccatcggtggaccccgaggaggggtacacctactcagatttactccggatttcgctgctctagaaatccctggaggcccagagccagctccgaggtggacggtcggacccctcacccgcccgttatccgcaaggctggcagcggctccacctgcggaccgggaaggcggccgttggggaccccggaggccgccacttggaatgttcccctttccaagaccaaatggacaaagagaaaggaccgagaaggagagggaagaagggagcagagtcaagcccagaacgctctccggactgcacctgcgcgcctccaggctctcctcgtgcctgctcccgtgcaaactttctggcccgtggtggctttggg

SEQ ID NO: 72778 - DNA, 168 bp, Homo sapiens
  chr11:33891959-33892127
  hyper
tgcactgggatgccccggacagcgcggctctgcgggctgcgggctacgggctgcgggccccaggctgcgggctccgggctgcgggctccgggctgcggccgcgctctgcagaggcgatggtggtgcgccagccgggactgcacgggctggggacgcctagagcagagc

SEQ ID NO: 72779 - DNA, 48 bp, Homo sapiens
  chr11:33928255-33928303
  hypo
cagaccgtggagctccgggtcaccagcctgaaccgcttaatgcacatc

SEQ ID NO: 72780 - DNA, 31 bp, Homo sapiens
  chr11:33951209-33951240
  hypo
gaaaactcatgaggccgggcacggtggctca

SEQ ID NO: 72781 - DNA, 52 bp, Homo sapiens
  chr11:33976639-33976691
  hypo
aggattgtggtgccacgtgggagcacaggctcagtgccgacagatctttctg

SEQ ID NO: 72782 - DNA, 30 bp, Homo sapiens; identical to SEQ ID NO: 42997
  chr11:3398724-3398754
  hypo

SEQ ID NO: 72783 - DNA, 35 bp, Homo sapiens
  chr11:33993944-33993979
  hypo
ttttaagttttctgccgtaaacatacagcacgtgt

SEQ ID NO: 72784 - DNA, 30 bp, Homo sapiens
  chr11:3429178-3429208
  hypo
tggagccgggtgggccgggctgcagtttag

SEQ ID NO: 72785 - DNA, 45 bp, Homo sapiens
  chr11:34378277-34378322
  hyper
catagggctgcaagacgccccagagctcggcgtcgttgttgatga

SEQ ID NO: 72786 - DNA, 30 bp, Homo sapiens
  chr11:3446939-3446969
  hypo
atacttaaaaccaaacgtaaaattccaggt

SEQ ID NO: 72787 - DNA, 46 bp, Homo sapiens
  chr11:34517683-34517729
  hypo
ggggcctcaaggattcggagaaacgcccaggcggggagtcggcccc

SEQ ID NO: 72788 - DNA, 35 bp, Homo sapiens
  chr11:34534277-34534312
  hypo
ccaaactgaaaactccggcccgagaataccttaga

SEQ ID NO: 72789 - DNA, 204 bp, Homo sapiens
  chr11:34535044-34535248
  hypo
ctctctgaggcaagccgtcacatccgtgtcaaacagctcccggaggccctgggactgcacccagcgcaggtgccggccctggagctggagatggacgagcagacccaggccccaggccgagcctctgagccctgacaccccttacgattcatccaaaaaagcaaagaaaaggcgcttacgtgagggcagcggtggctaggtcca

SEQ ID NO: 72790 - DNA, 30 bp, Homo sapiens; identical to SEQ ID NO: 43050
  chr11:34536053-34536083
  hypo

SEQ ID NO: 72791 - DNA, 26 bp, Homo sapiens
  chr11:34577250-34577276
  hypo
aactcaaatctgaagcgtcctggctg

SEQ ID NO: 72792 - DNA, 163 bp, Homo sapiens
  chr11:34847311-34847474
  hypo
ctggcagcaactggtcgtacctgttttagagtcagtacattgtgtttgctggagagatgaaggagagcagcacacagcaccatctcatcatcgcaaatgccatttcaggttaatgattaccacgtacagtattactgtagtcaaaatgcgcacaccaagggcc

SEQ ID NO: 72793 - DNA, 28 bp, Homo sapiens
  chr11:34920681-34920709
  hypo
ctgggattacaggcgtgagccactgagc

SEQ ID NO: 72794 - DNA, 166 bp, Homo sapiens; identical to SEQ ID NO: 43052
  chr11:35134173-35134339
  hypo

SEQ ID NO: 72795 - DNA, 399 bp, Homo sapiens
  chr11:35440486-35440885
  hyper
atcccctcacccttccgtagatgccatggtctggggaacgccccctcctcttcagcactatccggcagctgtgggcgagggagaaagcggacgccggggtgagcgcgaagtgcggccgggagcggtatttaagaggagcctctgcccgcccttccacccgcctccggggtaagccctttagcgcctcaacgggcgcaggaggctcctgcgggcgctaatccgcgtcccggctctccacggcgcgcgacccgcgctcccctccgcccgcggggatggcgcttggcggggagctccgggggctccgagggtggcttccccgagagagcgatgcgcccagggctgcaggagggcgcacgccggcgatgcgcccctgcagccgctgccacctgtgctttgctg

SEQ ID NO: 72796 - DNA, 822 bp, Homo sapiens
  chr11:35440936-35441758
  hyper
cggtgagcgtgcgtgcgcgtgtgcgggtgtgtgcgcgcctggggaggcggtggaggccgctgcgctctggctcggcgccggccagggagggattgcaaggtttagccccgccggagctggggatttgcaggcgatccctctctattttcgtcgagagctgacatcacccgcgccgccgcctcgggcaactcctttaaccgccgccccccgcccccatctccagtcgcggtccctcctctgccatccctccccccagcctctcgccataaattagccaaataagaaaagaggccccgccgctcgtccgggaaggcttgggcagccggtggcaggagcccaggatctaaggagtagctattgtttcccctgaagcccgcgtggccccaggtcaccccgtgcggggtgaagcgcaggcgaccgcgcggagacccgggatgcccctccgtctccgcctccctggagcagcccctggcgctccctcctcactccccggagcacccgcttcagctcacactcacccccaaactcacaggcaggcacacccaccccatcctcccacgtctgggggtcccaggtccagcggagtcgagcggctgaaacacgcgggtggtgcagcctaaacgcggcccagctgcgctccctcccccgccgaagctcgaataaatctctggccttcaattattcagcgagattaatattaatgcagctccctgggggcggcgggcggggtgcaggggaggccgggattttttttttttttttttaggccgagagaggtcggcctcgtgggtgccggctgagaaggcgcggagagttggccga

SEQ ID NO: 72797 - DNA, 30 bp, Homo sapiens
  chr11:35547097-35547127
  hyper
agtgagccccaactgcgtccagcaacccag

SEQ ID NO: 72798 - DNA, 240 bp, Homo sapiens
  chr11:35547335-35547575
  hyper
ctgccttaacccttgcggggccccgggaggtgtggccacgcctggagacccgcggacggcggctgcaaaggaagctgcgggggagggaggccagcctgggtacaggtggggtcccagtgttgggtgctgggaggaggggccataggaccctgggcgggagcagaggtacccagggctgcggggcgctcaggtgaggccgggagatcttcctacgggaggctgagacgggagctggctttg

SEQ ID NO: 72799 - DNA, 89 bp, Homo sapiens
  chr11:35639567-35639656
  hyper
ctgatcctagcctggcggagctcggaaagaggtggaaatctgtctgaagtttgcaggagacccgcgctgcctaggcaaagggacccggc

SEQ ID NO: 72800 - DNA, 149 bp, Homo sapiens
  chr11:35639657-35639806
  hyper
accaagacacccccgcgagggcccagggcgcgtccctcccgccaggccccagactccggctctgcgccaccccctcctacgccccggcgcgggcgcagccagtccggcttcctccaggcccccaagtcccggaccgagtgtggggccgc

SEQ ID NO: 72801 - DNA, 1118 bp, Homo sapiens
  chr11:35640499-35641617
  hyper
tcagccaggcagccccggccggaggagagcgccgcggtgcacgggggcgtcttctggagccgcggcctggaggagcaggtgcccccgggcttttcggaggcccaggcggcggcgtggctggaggcggctcgcggcgcccggatggtggccctggagcgcgggggttgcgggcgcagctccaaccgactggcccgttttgccgacggcacccgcgcctgcgtgcgctacggcatcaacccggagcagattcagggcgaggccctgtcttactatctggcgcgcctgctgggcctccagcgccacgtgccgccgctggcactggctcgggtggaggctcggggcgcgcagtgggcgcaggtgcaggaggagctgcgcgctgcgcactggaccgagggcagcgtggtgagcctgacacgctggctgcccaacctcacggacgtggtggtgcccgcgccctggcgctcggaggacggccgtctgcgccccctccgggatgccgggggtgagctggccaacctcagccaggcggagctggtggacctagtacaatggaccgacttaatccttttcgactacctgacggccaacttcgaccggctcgtaagcaacctcttcagcctgcagtgggacccgcgcgtcatgcagcgtgccaccagcaacctgcaccgcggtccgggcggggcgctggtctttctggacaatgaggcgggcttggtgcacggctaccgggtagcaggcatgtgggacaagtataacgagccgctgttgcagtcagtgtgcgtgttccgcgagcggaccgcgcggcgcgtcctggagctgcaccgcggacaggacgccgcggcccggctgctgcgcctctaccggcgccacgagcctcgcttccccgagctggccgcccttgcagacccccacgctcagctgctacagcgccgcctcgacttcctcgccaagcacattttgcactgtaaggccaagtacggccgccggtctgggacttagtgtcaccgggaggaaaagagagagatctggggctggggtatggatgatggggggaagggcggtcgcctctgccactgtcagggaccagccggccaacgcccacccgcaaaggtgtctaa

SEQ ID NO: 72802 - DNA, 290 bp, Homo sapiens; identical to SEQ ID NO: 43053
  chr11:35684922-35685212
  hypo

SEQ ID NO: 72803 - DNA, 30 bp, Homo sapiens
  chr11:3638442-3638472
  hypo
ttgcccggccccacccggtctcctgtgcct

SEQ ID NO: 72804 - DNA, 420 bp, Homo sapiens
  chr11:36398057-36398477
  hyper
gggaggagggagggacggagggagggagagctgggcagagcgcgacggggagaaccatccaggtcgctcatttctctccggtgagaaaacttcctcgggaagaccggaaactttttcctaggcgcgcggagtctggggcggaggcgagcggcgggtgtgcgcgactcggggtgattcacgccggggaccccaaggaggtgagtggtgggtggggggcgtctctgggaggggccggagtcataggctcagcaaccgcgcaggattgagcgaaaattaccgcgcgctaatctgacggggcgcggcgtggcgggggtaggagctagggaaaagtgtcacgtttgggggggcaaccaggtgggaactcctgcatggttaaggatcctccgatcggacgctgcaggcaggcgtaggggatcttac

SEQ ID NO: 72805 - DNA, 787 bp, Homo sapiens
  chr11:36398700-36399487
  hyper
gcagcagccttttcccggcggtccccctttttctggagggaggcgtgggagagaagggcagggcagggagccactttgtcccgtgcgctgctgcacgcgcgcgctctgcggactagggtgggccagggcccagccagtggggatcccgccgggacgggctgtgagcaagccctgggacggcccggctgcggaccccgcgctgggagtccgcagtatcccccttccgttttatttctcccgcctgccttcctttcggcgaggctttcctctgcgcgcttactgtgcgcgcatgccgggctcgctgcacgcagggggcgctctaggggccccgcccgggcagctgggaccctgcctgcccaaccctccggcccattttccttgaggccgccgcccggggtgggaccaggctgtgtgcttgctaactgtgcttcaggaatccgctctgggatgccttcctgtctggcaaaaggggttacccccagttctacccagtccctgtcctcggtcacatgctgccgccgcctcttcccccgcggtgccgggagcccgcgttttgtttgtcagcagttaggcggtgagtatttatagacgccacggcagtcctgcggtgcgcaaggtttcaattactgcgatgcgccccacaagacgaaaggttcacgcgctgcgtctgagctgcacgtctgccccggagacccgcgtggaaaaagctctgggctggaatctccgggcttccctgcttgggcagaattctggacctgttgcccagacgacacgtgcacattcagat

SEQ ID NO: 72806 - DNA, 110 bp, Homo sapiens
  chr11:3663415-3663525
  hyper
tgcggaagccgccagcgggagggagcgccgagggctctggcgggcgctgcgctgtccccggaggagtccggagtccggctgaaagcaaaggttctcgaggctaactgtag

SEQ ID NO: 72807 - DNA, 98 bp, Homo sapiens; identical to SEQ ID NO: 43054
  chr11:36687119-36687217
  hypo

SEQ ID NO: 72808 - DNA, 22 bp, Homo sapiens
  chr11:36935607-36935629
  hypo
ataaaggaaggtggccgggtgt

SEQ ID NO: 72809 - DNA, 858 bp, Homo sapiens
  chr11:369415-370273
  hyper
ccccgcacccctccccgcgcgccgccattggctccccgcggcctggctcggtccgattggttccgcgcgcgcggccggggcccgatccgcggtggcagccgtggatgctgttcggtcccgccgccgccccaggagcgcggagccgggagcggccgggcggggggcaccgcgaggagccgcccccgccgcccaccccgggcccgcggccgagggcggcctgggggggtcgcggccgcacccggtggccgcgcacggcggacaaaggaccatgcggggccgcgggcgctgagcgcggcggggcgggccggggatgcggcgcggggcgggcgggggccgggggctgcagcggcgccgctgagcgcggcctggggcgggcgcggcggccgcgatgccgcggctcccggtgaagaagatccgtaagcagatgaagctgctgctgctgctgctgctgctgagctgcgccgcgtggctcacctacgtgcacctgggcctggtgcgccagggacgcgcgctgcgccagcgcctgggctacgggcgaggtacggcgcggggggcgcggggggcgcggggggcgggggcggcgcggggggcgcggggggcgcgggcggcgcggggggcgcgggcggcgcgggcggcgggggccccggggcgcgggccgggcctcccaccgcacagaggtctcggctgggcccgaccctcccggagaccccgcccgctgttctccgctctgcgatttggggggagggggcgcggttcggctcggcccggacgctcgatgacgtcggcagtgacgcgcgcgaccctcccagagagggtccctgactctgggatctggcttggatccggtagtgaggggct

SEQ ID NO: 72810 - DNA, 93 bp, Homo sapiens; identical to SEQ ID NO: 42998
  chr11:3697398-3697491
  hypo

SEQ ID NO: 72811 - DNA, 30 bp, Homo sapiens; identical to SEQ ID NO: 42999
  chr11:3766731-3766761
  hypo

SEQ ID NO: 72812 - DNA, 159 bp, Homo sapiens; identical to SEQ ID NO: 43000
  chr11:3828803-3828962
  hypo

SEQ ID NO: 72813 - DNA, 33 bp, Homo sapiens
  chr11:38503116-38503149
  hypo
gctggacgtcaagagggacgcaccaacaggcac

SEQ ID NO: 72814 - DNA, 30 bp, Homo sapiens
  chr11:392634-392664
  hypo
cctggacacctcggccgtcagcagtggcct

SEQ ID NO: 72815 - DNA, 356 bp, Homo sapiens
  chr11:394701-395057
  hypo
tccaagcagggaccccggggtcctccaaagactgagcctggccaggccccacctgtgcctggagtcctggagccatccctgtgggggatgacagggaaggttggcacatggcaggcgggccaggccactcggtcggcaaacccggaacacgcacgcgcctggccccggtagcacagactcacatagggtctcagggacacccagacacccacgctcctcccatacctcacgggaatgagcagaacgggaaagcggggagaggtgtgggggtgctggaagtcctggaggaaagccaggcctgtctggaccaggggctccctgaggaattagaggggagggcccggctggagtgacct

SEQ ID NO: 72816 - DNA, 43 bp, Homo sapiens
  chr11:39673547-39673590
  hypo
cacagagacaggctccgtgcagtgcttgcggctggaccaggcg

SEQ ID NO: 72817 - DNA, 30 bp, Homo sapiens
  chr11:39808437-39808467
  hypo
catagtggtggctcccgggggtaggttcca

SEQ ID NO: 72818 - DNA, 231 bp, Homo sapiens
  chr11:40314692-40314923
  hyper
tctccttccctccaccgcctctgcaatttcataatctcacgttaaatggagtgcggggggcgggggcgggggcgggggcggaggtagtggaggaaaatttcaaggctccgtcagctgtcaagaagaaacccattcctccccccgctactttttttttttctttttaaggctcggggtgcctttccttcctctgtccccgcccccacccccagcacccggtccagatcctcc

SEQ ID NO: 72819 - DNA, 5 bp, Homo sapiens
  chr11:40315416-40315421
  hyper
gctca

SEQ ID NO: 72820 - DNA, 143 bp, Homo sapiens
  chr11:40315465-40315608
  hyper
cggtttgaactctcttcctccccctccctctgctctctcccctctttttctcccaaataaatgctctcccagcaccggcggcagctcttgccagcccaggctttctctcgaccaatgccacgtcctgacgcttagggtcctag

SEQ ID NO: 72821 - DNA, 448 bp, Homo sapiens
  chr11:406722-407170
  hyper
ggcccattcacaaagcgtggtgccgcagagctccccacggaggggtcccagcctggagcccgggcaccgcccatctctaacccgccgctagccccggaccctcccgcgcctgctccgcaccacggagccgggcctccagagcagcaaggtcaccaggtggcggtgctggcgcagcaggcggagcgccgggtgcgcggggtcgcgcctctggccctcgaaggtgatgaagatgggtctgcgggtgagctccagcagccggcacaggccctccctgcggggcgggaccgtcaggggggtgggtgctacgctggggcccacccaaccccgcgcgggacccaccggaagctgtggctgcaccaggcccggctcaggaaggcgtccgaaagcaccacgatgaggcgtcggcagcggctcaggttcaccaagaggtcggcggagggctctgcgg

SEQ ID NO: 72822 - DNA, 142 bp, Homo sapiens
  chr11:407389-407531
  hyper
cgggtgggcggggcacggggtggggcccgggataccagcgcgcggcaggaggtcgcggtcgtccaggaagagcttgtagccccgacgccgctccagctgcggctttaggatgaagttcacgaacttgcggtcctcggggcag

SEQ ID NO: 72823 - DNA, 32 bp, Homo sapiens
  chr11:416565-416597
  hyper
cgtcctcggtccgcggccgcccctgcccggtg

SEQ ID NO: 72824 - DNA, 37 bp, Homo sapiens
  chr11:41989424-41989461
  hypo
aatccttaatttggccgggcgctgtggctcacgcctg

SEQ ID NO: 72825 - DNA, 120 bp, Homo sapiens
  chr11:42366142-42366262
  hypo
tgcccgggctggtggaactggccggccgctccgagtgctgggcttgccgagcccttgcccgcccggaacacagaactcatgctggcctgtgagcaccaagagcagccctggttcctgctg

SEQ ID NO: 72826 - DNA, 293 bp, Homo sapiens
  chr11:429466-429759
  hypo
cacacacctcagacacggcaggcatatgtgggccgtgcagggcatcgggcgccaacagcccctgctcgggtcggcctcagctgcgctgccagctccacctcacctgttcctcgtcccacacgtacaggtcccagtgcaggaccacgcgggcgcgctgccgcttccagatctccaggaacaccgtggctgcggcgggggcaaggaggggcatcactgcactacgccaggtggacctcggagcttgggctggcacttcccctggccccgcagaggcgtcccgcagcaactcaccc

SEQ ID NO: 72827 - DNA, 44 bp, Homo sapiens
  chr11:4298908-4298952
  hypo
atttacccaatatttggtaaatcagtgagcgacagcaaacagag

SEQ ID NO: 72828 - DNA, 18 bp, Homo sapiens
  chr11:43402096-43402114
  hypo
gcccggccaaaagctggc

SEQ ID NO: 72829 - DNA, 126 bp, Homo sapiens
  chr11:43543226-43543352
  hypo
ggggcctcaagaccacgcggaacccctgggtgggtccccagctcgcttcagaggctcagagcagggtcagggacctggctccccggggccggagctgcctctaccccctggcgttacagactgcag

SEQ ID NO: 72830 - DNA, 46 bp, Homo sapiens
  chr11:43544024-43544070
  hypo
gccttgggagtggtccgcatccgtgggtagacgctgtgggtctcat

SEQ ID NO: 72831 - DNA, 133 bp, Homo sapiens
  chr11:43568942-43569075
  hyper
gcacagcgactgggccgggagcgacctggctctcggaagccgggcagggtgggggagggggcaggtaagtgggttgcctggcaacccggcagacccgcgggtggacaagctcaaggggcagccaggtgccacc

SEQ ID NO: 72832 - DNA, 187 bp, Homo sapiens; identical to SEQ ID NO: 33813
  chr11:43569128-43569315
  hyper

SEQ ID NO: 72833 - DNA, 51 bp, Homo sapiens
  chr11:43569569-43569620
  hyper
cggggagggagcgggcggggcggggccgcgctgctacgtaagcagccgcga

SEQ ID NO: 72834 - DNA, 107 bp, Homo sapiens; identical to SEQ ID NO: 33815
  chr11:43596489-43596596
  hyper

SEQ ID NO: 72835 - DNA, 462 bp, Homo sapiens
  chr11:43596850-43597312
  hyper
gcaggagggagagagcgggagccttagaatctgttatttgcgtcactcgaggagccggggctatctgcccgacaaacacacagaattaatccgagttacagccatagctgtctatgctacagtgaccagatgagaaagggcggggaaaggacgcgcgcgggagcgtgtgcacggccgagtttgcattgggcgtcttgggagagtttggggagggggctgtcctgctgggcacgcccctcggggccccgcttgcccggtgcagactaggctgcagcctgctctgcagctgcccagcccaagcctggggtggcgcccgcctcggccgcctcgcctgctcagtggctgcgtggaacacaaagcgctgtctccgagcagaagcgtcttctcagctgaaccagacccaccaaagaggagaatctgcacgtgacgtcagtagctgatgactgacgcaggctggcaaag

SEQ ID NO: 72836 - DNA, 66 bp, Homo sapiens
  chr11:43598418-43598484
  hyper
gctgcaactctctctcgcgttatgggtcggcgctgttgagctcggttttctcgatggccccctccc

SEQ ID NO: 72837 - DNA, 30 bp, Homo sapiens; identical to SEQ ID NO: 10840
  chr11:43599075-43599105
  hyper

SEQ ID NO: 72838 - DNA, 199 bp, Homo sapiens
  chr11:43600016-43600215
  hyper
aacaagggcttttaccgatgtgcagaataacacaaataacgctgcaacccacactttgtcttgacaattcagttcaaaccaaagctgctcacagcctctcggcccaccccgcggcctcctcgtcattcactgggacctactggttccctttcccaagcctcgcccctctcagccctgcaagttgcgtggttgtgtttac

SEQ ID NO: 72839 - DNA, 1105 bp, Homo sapiens
  chr11:43600492-43601597
  hyper
cacggattcccaagtcgtgactgcaaaaagtgagtaatgcgcgctggctgcgtcatggctctagtcacagttcattccgaactgagaaggaatcgtgacttcgcctggagacgtcccctacatgggagatggggggcgggggggcaccaaatcagtggggacgggggtgggggggaagacctatccaatgaaaaccgctgccaggggggcatttgaactccgtcgcttgctgtctcgctgtcccctctctgccccgcgcacctcgctccccctcccggccggcgctcgcagtggcgcgcctgctcgctctcccgctaagcgacgagtcttcaacaagttggaggaaggcaggaacgcaggggttaagctcggaaagccgcaattaccaagatcgtgaccctcccacacagtacagtaacttatatacttacctggaagaacccgctttgccgccgggcaaacacccgtggggggcggggaggggccggagggagcgggccggcaggagaggggctgcttccagctggctgcagtgcggacgggaccggcgcgctcccgtggcccccagaccgaggtaaggagcagggagtcggcgcccgggtcggctggtggtcggtcggctcactggtagtcggtcggctcacgggtagtctgagcagaacttttttttcccagttgccccgcgccgcggcggcggcgggcgcagaccgcggagcccctctggcgcggcgggcgcgcagacgctcggagggtgtgtgcttgcgtctgtcagtcccggagccgaggggatgccgtgggagggtgagtgggtcgcggagctgcaggagggtgatggatgggcgaagggggtgggtcgacagggacttgaagacagtgcctccaccgtcgagagacgttttctccgggcgtgctgggcgagggtgggagtgtgtgtgcgcgcgcgcgcgcccgcccgcacgtcgattccagggtgccaaagaacaaatatggcaactttccccccaagttcttgcaatgtttgcagtaacccatcctgggtgaggtttcccccactgggggactatactgctagggagggagatagtcaggacgtcccttagcccac

SEQ ID NO: 72840 - DNA, 30 bp, Homo sapiens
  chr11:43602138-43602168
  hyper
atctttgtcatttttcgtctggatcttctg

SEQ ID NO: 72841 - DNA, 454 bp, Homo sapiens; identical to SEQ ID NO: 973
  chr11:43602393-43602847
  hyper

SEQ ID NO: 72842 - DNA, 189 bp, Homo sapiens; identical to SEQ ID NO: 974
  chr11:43602848-43603037
  hyper

SEQ ID NO: 72843 - DNA, 1070 bp, Homo sapiens
  chr11:43603076-43604146
  hyper
cgcaccttcccgaagctgctccatccgagccttacccggccctttccccgttttccacggaagattcggccctttcccccgtcctttccgcggtgcccgaggctttggtcacctgtcttccctccgagcgagtcccccgcccccaactttttaacagactttgtatcacagggggaactggagcaggtggggtgtgtgtgttttcggagaagtgagaagaagctaaaatgcaataaaagtttacagaagttgtgtcttccccccaacccccgcccacaccacgaataaccccattcactcaatgcaaagaaaaggatctgagcttaaggccaagtcagaacctggaatatgaatcagtttaggacattttgtggtcatttttgaccgtaatgatccgattctgcaatatgggggtggggaagcccttgagggaggggctggaggcccttagtatcttatgtcctggtgcgggggacccggaggtgaggcgagccgcggtgaattgggtagatccgaaaaagagggaaaacacccaggcaccgcccgatccccggagtctcttcctcccgcgcctgcttccaacctaatttggggcgttttgcagcctcgggtctcccacatctcctctttttcaaaactaagtagcacggaagggggtaaaacaggcgagaactggggaagcccccgcagagaaggagctttggagagatgcggttgtgcccgactcagacgcttagcaggaacagaagcagcagcagcagcagcagccccatcccggcctctccaggcgccggtcctggggaggggggcaaagctgcaggagaggggagagtctgtgagtccccctcctccccctccactcattgcagtcctgaccacttcggtcacaagtggcacaaatcaggccttcaccacgctccccgcgcccttcgcctgctaggaacactgctagacgcccttgcccttagggactgggccagaaggacacacatacacacatgagtgcccacagggacagaaatgggtagaagatgggtctagagacaccggagttcaagacccgagggctg

SEQ ID NO: 72844 - DNA, 127 bp, Homo sapiens
  chr11:43604737-43604864
  hyper
aagaggttgagccaccgcagcgcaggcggctcagggttattgcgaccctagccccctcacttctccctccgaggctaagtgtgggactagggctccagggcccaaggagcaacggccgaacccggcg

SEQ ID NO: 72845 - DNA, 30 bp, Homo sapiens
  chr11:4361455-4361485
  hypo
cgctctgttttctgtcgctcactgatttac

SEQ ID NO: 72846 - DNA, 16 bp, Homo sapiens
  chr11:43694378-43694394
  hypo
ccgcaccctggccaat

SEQ ID NO: 72847 - DNA, 30 bp, Homo sapiens
  chr11:43701969-43701999
  hyper
atcccatttcctcttcgaacctgagctcaa

SEQ ID NO: 72848 - DNA, 93 bp, Homo sapiens
  chr11:43963470-43963563
  hyper
atgaatgggggtgcccgagggacttgggtgggggagtgaggagacaaacataaagaagacatctagggaagggaagaaccggaatggaataat

SEQ ID NO: 72849 - DNA, 392 bp, Homo sapiens
  chr11:43963623-43964015
  hyper
gtgcgcgcgcgcgcctgcggaggggggtggcaaggatccagaaggggagcccaccccttcttccgagctcagctctggggagccgggcgctcaggctcgccaggctgcaaagagagctgagagctgcctcgcgccccgcgcagaaccggcggtggaataaccagcgcctcaagtgtgtgcatctgggaccagggggcgggggagggggacctgcggccccgcggccaacccggttggtgcagacttggggatcccagaagggacagtgcccgcccagtcgcggcgattgagggtccctgtccgggcgcagctcgggccagccgcgtgctccggggccgcggcttctcccggaacccccgcgggcggggcctgccttccggagccggttggcg

SEQ ID NO: 72850 - DNA, 1054 bp, Homo sapiens
  chr11:43964245-43965299
  hyper
ccccgtgccccccgacgggtccgcccgcccgcccgccctcccgaggagcgccggcccgggcccgcgagggccgccgccaccccgcagcagatttggatcccccgcccggcgagcccccggctgctgcctcccggggggccccggcgcagcggccgccctcggagagccccggcgccccgccgcccggccccgcagacgccggaggcgccatggccgccaagcccggcgagctgatgggcatctgctccagttaccaggcggtgatgccgcacttcgtgtgcctggccgacgagttcccgcagcccgtgcggcccgccaagctgcccaagggccggggccggctgcggcggccgcgccagtctcgcttcaagacgcagccggtgaccttcgacgagatccaggaggtggaggaggagggggtgtcccccatggaggaggagaaggccaagaagtcgttcctgcagagcctggagtgcctgcgccgcagcacgcagagcctgtcgctgcagcgggagcagctcagcagctgcaaactgaggaacagcctggactccagcgactccgactcggccctgtaaggggcgccgcccgcgggggggacgcgcgcgtccgcggtccgcgcggggaccggcgtgtgaaccccgagagtgcccgcgccctgctcccgggggacccgcaaggacccgggaccgccgctcctcgcgcgctcggactcccgccccgctgcgaaccggtcggtgcgcccctcgccgcgctcgccctggcccgggagcgccgggagcggggccgctttcctcgtccttgtaaatgtttattttttaactcttcccagtgcgaactctgctgtgagtgtgtgcggggaggcgcgcccgcgctgagtcggcggcgggtagccactccatgcccttgtccgatggtttgcaactccgattttgcacaccgctccaccgtgccccccagcgcacacccattcacactcacgccaacactctcgctgaacacttttataattgttaggcgtggccgttgggactttgggcgcagcgcggctgct

SEQ ID NO: 72851 - DNA, 557 bp, Homo sapiens
  chr11:43965504-43966061
  hyper
gtggcagggggatgtcggaccagggagccgggagtggagctacctccacaagcttcggtcaccggaacgaggttgcgccaccggtgcgcgggtcggttgcctgcctccccaagtggatccacccccggtccagtgtgctcctgcgtccctggtctattccccatcgccggcatccgggctgaagtgaagccgcaggaggggcggaggcagagctgacgatggagagctctctcctccgtacagttcacttcccagagctggggtcagggtcctcgccccgcacccgccacagaagacgcatctccctctgcgctgattcctggcggcgggtggggagatgtcggagccagcaatgcgagatgtttgggcgttgggacccgagagtgggctggaggccagcctgggttggtcgagagtgtgggtgcgcgctcgctgtcgcgggcaggtgactccctgaccgcagttgacccagcgcagtgcctggcgctcctgcgctgcggggaaaaccgcggccgctatgtctccagccgttctctgcgctccgcagggttcctcca

SEQ ID NO: 72852 - DNA, 30 bp, Homo sapiens
  chr11:4399994-4400024
  hypo
gtgtttctggtaaagcggctgcctttctgc

SEQ ID NO: 72853 - DNA, 33 bp, Homo sapiens; identical to SEQ ID NO: 33832
  chr11:44324942-44324975
  hyper

SEQ ID NO: 72854 - DNA, 82 bp, Homo sapiens
  chr11:44325688-44325770
  hyper
gtatcatcacatagccgggtcctcgcagtgttggtttcccaatccgatgactgtcacctcggtgaggacctgtgctgatggc

SEQ ID NO: 72855 - DNA, 464 bp, Homo sapiens
  chr11:44325886-44326350
  hyper
cggcttcctgaacaggggtttggggggctaaggacgctgaggctccgggggcaggaagttctctctggttaagcgttctctcttctctccggcatacactcccctacccacccacctcgcctaccctcggggcgagaggctcaccaaggcagggcgcgccccccccatgaatcatcccaaggcctctgagccgcgggggctccgggcaactatccccctcctctcctggcctcaggcaccccagtccaggggtctgcagagaagcccgaagcccggacaaacgcgccggacgtcaacaacctctcatccctggcagcagcaaaggccaatatatttccatttcttatttcagtttgccaccaaaacaaagctgcgcgcggctgagggcaggaaggcgctgagaccgagaagaagggacgtcccggagaaagtgcgcccagctgatcttagaaaccagagtcctc

SEQ ID NO: 72856 - DNA, 7 bp, Homo sapiens
  chr11:44326515-44326522
  hyper
cgcaaat

SEQ ID NO: 72857 - DNA, 132 bp, Homo sapiens
  chr11:44330477-44330609
  hyper
cagggtcccaggactcgggtcttgccagaccacagtgtcccctgggaccctagggtctctggctccgcactgtgttgcgccagtgcgcctggatttcccgtgagctttcggccaaccacgctccgggcttcc

SEQ ID NO: 72858 - DNA, 81 bp, Homo sapiens; identical to SEQ ID NO: 976
  chr11:44330877-44330958
  hyper

SEQ ID NO: 72859 - DNA, 481 bp, Homo sapiens; identical to SEQ ID NO: 977
  chr11:44330959-44331440
  hyper

SEQ ID NO: 72860 - DNA, 425 bp, Homo sapiens
  chr11:44331482-44331907
  hyper
cgaacttgtcgcctccgggaaatgccctaaaaggcgacgagccctcccgactctgcgacaccgggctgtagtaggcgtccatggcagcggccggcgactcgcagtaagagacgcaagtctcagcattcatgcctggcttgcgcaggcggcgggcggggacgcgagcgagggcgcgaggacgccaccgcgcgccttggctgggagtttggggaggcgaggaggctgtggctgtgcactccttgcccggcctgctcgctctccctcctcccctccacgccggcctctctctctctccccctcttctttctctgtctctctcctctctctccctcctctctctctcttcccctccctcccccccccttcctctctctctccctctctctctttcctccctccccacagctagccgagggaaagaacgg

SEQ ID NO: 72861 - DNA, 814 bp, Homo sapiens
  chr11:44332324-44333138
  hyper
gggaccacgggcctgcggatgcaagcgagtcctacggactcctgcgcgcgagctcgcgggcgccgctgcgggccttcccgctggcaccttttcctaggtttccaaccttcctccccattcccgttcctacgggagattaacacacacacaagccttcgtcgtccagtgcatggtcacttgcacgtcttgttaactatttccctctgctgtaagggcgctgggctgggatgtagcggaatctgtgctccctcaagccctggagaagccctgggctgggcccggcttcagaagctttagagcgctgccctctgcgctcccgtctagaggccgcaccgttcacgccccacgtctgcgcccaggcgaggggatttcctgccaggcgaagtacagagagcggactctggagaccccctgaccttgcccgatagtcgcgctgtcacctgttcactccttggggtcaggggtcggggagaggggtgagaccgtctcttccctttctggcctcactgcccccgactgtaaaacgaactgcttggttttgataggttgtggtttcaccaccactgcgagcctcaaggcccctggcaccgccacagcaagggaaaaaactttgcgcgtgcagcccctcgatttcgcttcatgacaaccgtgctagagattggcgcccccaattttctgatgagctaacggaggctcagagaggggcggccacctggtccaggtcacacagctgggaaatagccgtcgcgccctggaacctctgctcaggctagtccctccaccgacctggaaggccgtgcggacagcgtagatg

SEQ ID NO: 72862 - DNA, 86 bp, Homo sapiens
  chr11:44333542-44333628
  hyper
accaagccaggagcgcgcaggctccagccgccccccactccatgcccaatgggaaccgcgcctcactggcccgcagacctaagcca

SEQ ID NO: 72863 - DNA, 136 bp, Homo sapiens; identical to SEQ ID NO: 10858
  chr11:44337726-44337862
  hyper

SEQ ID NO: 72864 - DNA, 176 bp, Homo sapiens; identical to SEQ ID NO: 10859
  chr11:44337882-44338058
  hyper

SEQ ID NO: 72865 - DNA, 466 bp, Homo sapiens
  chr11:44338086-44338552
  hyper
cgctgggacttgcaccccgagtttaggggcttagccatttccggaactcgggctagtggactctggggaatcaggcgctgggagaggccttcgcagctgcgtctctcctgcccagcatattgtgttgaatgaggcaagggagtgagggggtcgtaaaggaaacccgcactcaggggcacaccttcatttatctgggaacagcgcggatcccagaggtgcgggataaaccaggcgttccagctgctcacacgctgtttggtaccccgcgtctatgaagcacaaagcaggagcggattggaggttttacaaactgaccaaccccgccgcccgcgcccgctggagggagacgcacacctttgccctgcatattcgcttccaggctctgcatctctgctcttggggagccggccacccgcttttccgcgcgggggctggggttctcgcctgaaggcgaagtccgcgtgcg

SEQ ID NO: 72866 - DNA, 30 bp, Homo sapiens
  chr11:44340703-44340733
  hyper
ccagcccagggcggccggctcccaggcctg

SEQ ID NO: 72867 - DNA, 243 bp, Homo sapiens
  chr11:44341082-44341325
  hyper
gctactcattagctgcgtccagcctgtgcaactcccccgatccggccggtagtatctgaggactccagtggccagacctcgaccctctctcccacccctcctgaggtccttccttccccaggacccatgggcgcacagctggcctctccatactccccctacccgcccagagcaggcccagagcgcgcaactgcgggcgaactgacacctctcctggcgtcgacccctcggtccagaactgag

SEQ ID NO: 72868 - DNA, 68 bp, Homo sapiens; identical to SEQ ID NO: 3751
  chr11:44341966-44342034
  hyper

SEQ ID NO: 72869 - DNA, 30 bp, Homo sapiens
  chr11:44525426-44525456
  hypo
aacctgagggtctggcggctgagaacagcc

SEQ ID NO: 72870 - DNA, 362 bp, Homo sapiens
  chr11:445925-446287
  hypo
cacttcagaagaccccgtccaccagaccgcctccccctgaggcccaacatgcagcagaggcagctcctccgtccctgcagcctccttttaactgtgggatatggcagccacccgtggagcggtccgggtgacaaagccagcgagagctagggagcgcccaggtgaaatcccacaggcaggtgtgagcaccaattgtcattacctttgccctgggcccctcagagacctgtcctccccccccgcccccaacagcctcctgggcgcggccacagacacagacacagtgtctggacgagcagactcgtccaggcactgctcagaggcagcccctctgggtcagctggagtcggtgcctctgagaa

SEQ ID NO: 72871 - DNA, 66 bp, Homo sapiens
  chr11:44609349-44609415
  hypo
ccccaacctgccctgcgggcaaggacagaagaggcctgagaaccgtctcttcggactcaggggcag

SEQ ID NO: 72872 - DNA, 42 bp, Homo sapiens
  chr11:44620240-44620282
  hypo
ctgaggcaggtgcctcgtgccttgggccggtcctggctctgg

SEQ ID NO: 72873 - DNA, 30 bp, Homo sapiens
  chr11:44621968-44621998
  hypo
ttttctcttcttccccgaacaaagctgctg

SEQ ID NO: 72874 - DNA, 229 bp, Homo sapiens
  chr11:44748190-44748419
  hyper
ccctctccccactcccgcaacgatcttccgaattcagacgcagagagggcccgcgagcagagcgggaggtggtcggaggcggaggaaggggagatgggcagagggtgggcccagggacccccagacaaggcctggacgcggggttggaggaggaggcggaggctggcgggaggcgaggggcagcccgcagaggagacgcgcttctcggcagcaacggcgtctggagccg

SEQ ID NO: 72875 - DNA, 196 bp, Homo sapiens
  chr11:44748675-44748871
  hyper
gagcgagcgccgccgcctcgcgctgcgggtccccggacgcgccgccaccgccgggaaggcagccggcgccgggcaagttgcgagcgcgcccctccgaccaggaaagtttccccccggccgccggcgggatttggcgcggggtccggcagccgccgctggaaggtatggggctccgcacctccgtgccctccgcacg

SEQ ID NO: 72876 - DNA, 34 bp, Homo sapiens
  chr11:44749184-44749218
  hyper
tttcggccagggctgcgcccggaaaggggctgct

SEQ ID NO: 72877 - DNA, 120 bp, Homo sapiens
  chr11:447598-447718
  hypo
ggcttgagccaccgcgcccggccttctctgccacagtttttttgtctctaagcgacagtcaaaaatagaacctaagggggtgtgttaagatcacaatagttggcccggcgcggtggctca

SEQ ID NO: 72878 - DNA, 51 bp, Homo sapiens
  chr11:44919182-44919233
  hypo
gcaggacagttgccccgagtgtgtgtatctggagggcgggttttcataaac

SEQ ID NO: 72879 - DNA, 281 bp, Homo sapiens
  chr11:44922693-44922974
  hypo
tctgaaactggaacccgggcctccatattcttcaccggcccccaggctcacatcatctattttcctacctgactcacctttgaggttgtgggaggctcttcccaggagacatgtctcctttgattgcatttgtctgggagcccagcactccgcaagcccgggccatgagatgtaatctgcaatgaatgtggtacacaataaatacaggtagtccgtttatgagctgccatatttattacaccccttaattgctaaagagccagagccggctgaagctggat

SEQ ID NO: 72880 - DNA, 30 bp, Homo sapiens
  chr11:44925810-44925840
  hypo
gatgctgagtggccccgcctgtgcctcccc

SEQ ID NO: 72881 - DNA, 142 bp, Homo sapiens
  chr11:44929860-44930002
  hypo
ggcctcttgggcctccggtcctcccaccacacaaagggatttcaaatactttacagcccgcaaatcccatggtgccaaactttggttcttcccacaacagatctgcttctaatacttatctgtgcccaagaaaaatggaata

SEQ ID NO: 72882 - DNA, 33 bp, Homo sapiens
  chr11:44931098-44931131
  hypo
ggactcactggctctcgccgcaggtgaattcct

SEQ ID NO: 72883 - DNA, 41 bp, Homo sapiens
  chr11:449336-449377
  hypo
ggatgacaggcgtgcgccgccgcgcccggcctgcctagcat

SEQ ID NO: 72884 - DNA, 132 bp, Homo sapiens
  chr11:44941372-44941504
  hypo
ttgctgcggggtcaacgggcctgaagactttaagtttgcatctgtgtttcgactcctgaccctggatagtgaagaggtgccggaggcctgctgccggagggaaccccaaagtcgggacggggtcctgctgag

SEQ ID NO: 72885 - DNA, 85 bp, Homo sapiens
  chr11:449589-449674
  hypo
gtcaactaaaatcagcgtgtccgcaccattttcgcccgcccaatttcacgcgatcctgcgaaagaatgacccagaccggtccggg

SEQ ID NO: 72886 - DNA, 32 bp, Homo sapiens
  chr11:45167668-45167700
  hyper
ctcaccctcagccttcgcgggacgcctgcgtc

SEQ ID NO: 72887 - DNA, 23 bp, Homo sapiens
  chr11:45195161-45195184
  hypo
aaacaccgcgtcaaaaaaaaaaa

SEQ ID NO: 72888 - DNA, 37 bp, Homo sapiens
  chr11:45307820-45307857
  hyper
cctccaggcagctcccgggatccgggcgagccagcag

SEQ ID NO: 72889 - DNA, 16 bp, Homo sapiens
  chr11:45337961-45337977
  hypo
gcgcccagtctaaaaa

SEQ ID NO: 72890 - DNA, 56 bp, Homo sapiens
  chr11:45376235-45376291
  hypo
ccataggcagaacagcggcatgggctgttcaactgtgtatacgttatttattgatt

SEQ ID NO: 72891 - DNA, 220 bp, Homo sapiens; identical to SEQ ID NO: 33848
  chr11:45376858-45377078
  hyper

SEQ ID NO: 72892 - DNA, 75 bp, Homo sapiens; identical to SEQ ID NO: 33849
  chr11:45377121-45377196
  hyper

SEQ ID NO: 72893 - DNA, 65 bp, Homo sapiens
  chr11:45553228-45553293
  hypo
gaggtgatgcaggaacgccattaccccgttgcccatctggctcctccagacgcagtggtcctcca

SEQ ID NO: 72894 - DNA, 187 bp, Homo sapiens; identical to SEQ ID NO: 33850
  chr11:45686237-45686424
  hyper

SEQ ID NO: 72895 - DNA, 596 bp, Homo sapiens
  chr11:45686449-45687045
  hyper
cgcctcgggggccaccgcgcgtctcaagtttgctgccctcctcgaatgggggcagggagggctgaggtgatcgcggcgctcaccggccaccagccccggcagccccttcctgcgcccaacacgccgccgttcctcgccgccgccacccctccgctcaccgccggtagctgctgtccccgagcggaggggcgtctcccaccgcgcccgcgcccctcccggctgctgcggcggagtgtccgctcccgcccgccccggagcccgcggggcccggccaatacctggtcggggacgcgccgggagcagctgcagcgcccagcgccggctccatcctcgggtctggagtcagggtcgccggggacccgcgggtggcggcggcggcagcagccgcggcggcatcctccgcctcccgcgccctcctcctcggcctccctcctccctcctcttcctccgactccgcgcgcgcctcacgggcccctcttcatggcccgggggcgcgagcccggggcggctcgagcagctgagtgcgttctctccggccggacgcgggacccggggccggggctcagggacccgagagatgccgggacaggggccgg

SEQ ID NO: 72896 - DNA, 30 bp, Homo sapiens
  chr11:45825671-45825701
  hyper
gatacagccaagtcccgggacgtgccagct

SEQ ID NO: 72897 - DNA, 30 bp, Homo sapiens
  chr11:45902551-45902581
  hypo
cgggcagagatagagcgagcatgtgtgtgt

SEQ ID NO: 72898 - DNA, 63 bp, Homo sapiens
  chr11:45921994-45922057
  hyper
cggtctcaggtgaggcgccaacgtggggggcggcgccctgggccgccgcggagatgtgagggg

SEQ ID NO: 72899 - DNA, 23 bp, Homo sapiens
  chr11:46038808-46038831
  hypo
accacgcccggcctacatctatt

SEQ ID NO: 72900 - DNA, 30 bp, Homo sapiens
  chr11:46141017-46141047
  hyper
atttcaacatatgaccggaatatgatgaca

SEQ ID NO: 72901 - DNA, 169 bp, Homo sapiens
  chr11:46259315-46259484
  hyper
ataatcgggtcaacacgcggcgagtggcggtgcgcgcggggccaaccgcgtggagctgtcgggagggcgataggatgggcgcgcccgggctgcaggcggggagccggaggtgggaggtgcctcttgagagtggctctccaccgctgacagcaaacgagctggtccggac

SEQ ID NO: 72902 - DNA, 33 bp, Homo sapiens; identical to SEQ ID NO: 43057
  chr11:46298483-46298516
  hypo

SEQ ID NO: 72903 - DNA, 109 bp, Homo sapiens
  chr11:46299747-46299856
  hyper
acttcctcaacaatgcggtaagatgaagggtctccgttcccgttccacccctcggcacccgtcctcgcggcgcgcctgggcccctagaaggacccgactacacatcact

SEQ ID NO: 72904 - DNA, 15 bp, Homo sapiens
  chr11:46316818-46316833
  hyper
gtaccattactgccc

SEQ ID NO: 72905 - DNA, 461 bp, Homo sapiens; identical to SEQ ID NO: 980
  chr11:46316895-46317356
  hyper

SEQ ID NO: 72906 - DNA, 321 bp, Homo sapiens
  chr11:46317407-46317728
  hyper
cgcaggtctgcaagcaggagagctcgggaacctctcctccaagggagggaagccggcgccggctgcgcgtgacagccgagaaggagcttatattggcacgactataggaaaaagtctttaacgaggagggaaacaaatcataatatgtccttctccggcttcccacccccgttgcctggaaaggcacccctgtaggacgctcaccccctgcagaaccctgtcgccctcagagcgttgacacatggctcccctgaagttcgtgaactcctggccgccgaccccttgctcttgctccccaatttccatcggacaatctaaacc

SEQ ID NO: 72907 - DNA, 33 bp, Homo sapiens
  chr11:46332619-46332652
  hypo
ccatggcagtgacagcgacggctcccagagtcc

SEQ ID NO: 72908 - DNA, 222 bp, Homo sapiens
  chr11:46354344-46354566
  hyper
gccctgagctaggttcgtgcccgtggtgggctgggccgggctcgctcccttcgtgccctgagcgggcgggctgggcggagcggcgccctcccctccggaccccaccggctggagagtgtctctaaggtgacactcgggtgcgcggcagcagcggcggttgcaggagctcgctctccgcccgggctccggctccgctccagccgtccggggggcgccgcggcg

SEQ ID NO: 72909 - DNA, 332 bp, Homo sapiens
  chr11:46354603-46354935
  hyper
cgcccccccggagcgcaggaggaccccggcccgcctctcccaggcgcagcgcccagcatctcgctgctcctgtcgtctaagcgtcggcgtcgctagggacctgcggaacccggcgctcccctccctccccgcctcgcgtccccggcccgggcggactggagactcgaacttgagcgggtgcccgaaaggccgcaggagccgcgggcggaaggcggccgcacgatggccgaggggcagggcggcggagggcagcgctgggactgggctggcggcggccgggcagccgaggaggaggtggtgcggcggcgatgccggcgcggggaggaggccca

SEQ ID NO: 72910 - DNA, 123 bp, Homo sapiens
  chr11:46403934-46404057
  hyper
ccgcgagggcacctgcggggcccagacccagcgcatccggtgcagggtgccctgcaactggaagaaggagtttggaggtgaggcggggcgcagtcagagggcaggagacggggggcacagcct

SEQ ID NO: 72911 - DNA, 209 bp, Homo sapiens
  chr11:46405726-46405935
  hypo
cagatgcgagggctgcgtgcctacctcactgcccacctccccccttcccactgtcatggaaacccgagtgagccaccaggttgacccctttcctcttgcctgtgtgacccaggcctccaccctgcagaagccagggggtgagaggtttgaagagggcagatgggaatgccatccaccacagcctcaccctgactcgatgtgtgacctgg

SEQ ID NO: 72912 - DNA, 103 bp, Homo sapiens
  chr11:46413862-46413965
  hyper
ccgctgcgtgccggccgggccgcccgcgaggaggggcgccgtcggggcctggggaagcgcaggagcgggtggactggagaggttcggccggggagagaagagc

SEQ ID NO: 72913 - DNA, 221 bp, Homo sapiens
  chr11:46414479-46414700
  hyper
ctcaagaccctcccccgagggccggaggtggtgagggcgattgcgggggcggcggtggaggagaggcaggagcctcttggcagagaatgggagggaactcgagtagaagccagcgctgcggggctcttggtgtggggttctccgcgcggaacccggaagtggagttcgggtccccagagctcgcgagcgcgacggctggggttggtcggaattgggaactt

SEQ ID NO: 72914 - DNA, 22 bp, Homo sapiens
  chr11:46614016-46614038
  hypo
tacaacaaaactgggcgggcgc

SEQ ID NO: 72915 - DNA, 30 bp, Homo sapiens; identical to SEQ ID NO: 43060
  chr11:46774904-46774934
  hypo

SEQ ID NO: 72916 - DNA, 19 bp, Homo sapiens
  chr11:46777041-46777060
  hypo
ccaccgcacctggccccat

SEQ ID NO: 72917 - DNA, 85 bp, Homo sapiens
  chr11:46872609-46872694
  hypo
ggttgccaacaaccccgcccccaccccctgcggttgtgcacccggttgatcaaagattggtcttaagaccacatgagtaaacaag

SEQ ID NO: 72918 - DNA, 53 bp, Homo sapiens
  chr11:46916169-46916222
  hypo
cctccacgttgctgccgttgaggttggcacggaggatccggtccagggtgaca

SEQ ID NO: 72919 - DNA, 16 bp, Homo sapiens
  chr11:46920026-46920042
  hypo
gcgcccagccggtagt

SEQ ID NO: 72920 - DNA, 635 bp, Homo sapiens; identical to SEQ ID NO: 33862
  chr11:46938439-46939074
  hyper

SEQ ID NO: 72921 - DNA, 102 bp, Homo sapiens
  chr11:46939396-46939498
  hyper
agtaccagattctaccggggcctctctccgcaacccgcccgagcccccagccccaggaaggagggctatttacaatttatgggtttagcgaccctcctcacc

SEQ ID NO: 72922 - DNA, 37 bp, Homo sapiens
  chr11:46939526-46939563
  hyper
cgcaccaaggacacagagcccccgacctaacctgaaa

SEQ ID NO: 72923 - DNA, 83 bp, Homo sapiens
  chr11:46957761-46957844
  hypo
tgagtgagaattgagaagaaatggcaattagttcagaggacttaatgagtaccttttgtgtgtccagccgtcataggcagaaa

SEQ ID NO: 72924 - DNA, 41 bp, Homo sapiens
  chr11:46959060-46959101
  hypo
aaaaaggcacacacacgcatagatatgtacacacacacaca

SEQ ID NO: 72925 - DNA, 105 bp, Homo sapiens
  chr11:47178630-47178735
  hypo
acacagtgattgtgccgacgtcgtccagtgggcagcaccgccaacgacctgccttgggcggggccggcacgctggagggcgtggaggcgtcgctgttctaccagt

SEQ ID NO: 72926 - DNA, 699 bp, Homo sapiens
  chr11:47208581-47209280
  hyper
ggcctaagctcctcccgctccgagttcttatttccagattttgtaccacgattcattcttacccttcgcccctccaccccctttatcagtctggtacatttttccatatcgccacgatgccaccccacgctaaataaatcccttctccctcctctctccctacttccctctccccgctttcccccgggggtgagattttgcagagcggctccgtctgttatttatatccactggagcggtccaagaatgttccgaagctgacctaatcgccacctgctcggcctctccgcccctcccactctctcctgggcccggtgacccagcggcggtgccctgagccttgaagaccagggggagcgcggaccaacggggtcgaacgcccgggcgcagaaggtcccggacgcagaaggtcccgggcgcgcagaatcgcagcgggtcggagagccccggcgctctcagaggagtgcgcccccagggacgcggctctgagccctgggaagctgaggcgcctggctgcgccctctgaagctcgtacttttcctcccaccctcagctccctgaagagtgtgagtgcgtgcgcgcggagttttaaacggcagctttaaaaatagcaaaattatgttgtttctaaatccaggaggaatcactgacgcgttctttacgcagatgaatccgctcacaaaacgggaaagggacctg

SEQ ID NO: 72927 - DNA, 144 bp, Homo sapiens
  chr11:47215919-47216063
  hypo
tgccattgtgtactccgggtttcagctctgttggccgggaggctcctgctccagaagcctaccctggtgcacttgggcacccattgtgtgaccaacaccaggctgggtgctcagtccttaattcgaagaaagcaggccaggtgc

SEQ ID NO: 72928 - DNA, 266 bp, Homo sapiens; identical to SEQ ID NO: 43063
  chr11:47358971-47359237
  hypo

SEQ ID NO: 72929 - DNA, 141 bp, Homo sapiens
  chr11:47367760-47367901
  hypo
tgctcttcttctcatcgcgcctcatgcccttgagcctctttagcatgccgcgcaggtcagtgacgccgtactggaaggcgatgcgctcgtactcagatgggggtgcctgccgtaggatctcccacacgtcctcctctgctg

SEQ ID NO: 72930 - DNA, 30 bp, Homo sapiens
  chr11:47463077-47463107
  hypo
agtggctgaaagagccggctaacctactgg

SEQ ID NO: 72931 - DNA, 198 bp, Homo sapiens
  chr11:47599117-47599315
  hypo
cccacttgcactgtgcgggccaaaaaccgagagcattcctcaaagagagatgtcagctgatacatgtctgacacctcataaatttcctgcaactcctcagctcgaagtttcacagtcccatggtagatataatcaaccaggagctggaaaacagactcgctgacatcctgcagcacaatcacccggttgtgggcctcc

SEQ ID NO: 72932 - DNA, 213 bp, Homo sapiens
  chr11:47615713-47615926
  hyper
cggtcgagtcgggttcggtctgagcccgcgatctggctccgggctgcgggctgcgggctgcaggctgcaggctgcgggtgccgggctgcgcgctgaccgcccgcgctgcggcaggggcggcgggggctccggctgcttttcccggctctgaggcggcagcggacagggtgctggggccaggggccgggcgtggggaggcgtgagggaaaggga

SEQ ID NO: 72933 - DNA, 21 bp, Homo sapiens
  chr11:4785810-4785831
  hypo
gaatactgggcagggcgcagt

SEQ ID NO: 72934 - DNA, 23 bp, Homo sapiens
  chr11:47873752-47873775
  hypo
agtcaccgcgcctggccacactt

SEQ ID NO: 72935 - DNA, 30 bp, Homo sapiens
  chr11:4792115-4792145
  hypo
catgagcagctgtgtcgaattgcttgcgct

SEQ ID NO: 72936 - DNA, 82 bp, Homo sapiens
  chr11:486013-486095
  hypo
cgtgctcaccgtgtgcgcaggcgagtgtaaacagtgcacgggcgtgtgtgttcaccgtgtgcgcaggcgagtgtaaacacag

SEQ ID NO: 72937 - DNA, 245 bp, Homo sapiens; identical to SEQ ID NO: 42846
  chr11:487303-487548
  hypo

SEQ ID NO: 72938 - DNA, 30 bp, Homo sapiens
  chr11:487827-487857
  hypo
tttggtgtcaggccccgggcacggggatgc

SEQ ID NO: 72939 - DNA, 35 bp, Homo sapiens; identical to SEQ ID NO: 43066
  chr11:49212608-49212643
  hypo

SEQ ID NO: 72940 - DNA, 109 bp, Homo sapiens
  chr11:49229761-49229870
  hyper
actcggcagctgacccgcgagtcccagcaccgcggcaccacggggaagactccgaggtttgctccgcgaggcgcccccctaccgaagaggaagccgaggagaaagaagc

SEQ ID NO: 72941 - DNA, 54 bp, Homo sapiens; identical to SEQ ID NO: 42847
  chr11:493145-493199
  hypo

SEQ ID NO: 72942 - DNA, 30 bp, Homo sapiens
  chr11:49837177-49837207
  hypo
agtggatgccattaccgcaaatagtgcaga

SEQ ID NO: 72943 - DNA, 30 bp, Homo sapiens; identical to SEQ ID NO: 43067
  chr11:50205839-50205869
  hypo

SEQ ID NO: 72944 - DNA, 45 bp, Homo sapiens
  chr11:50206566-50206611
  hypo
tcaccaggtccttcacggtgtccaagtaatcgtcccactcgggcg

SEQ ID NO: 72945 - DNA, 163 bp, Homo sapiens
  chr11:50256715-50256878
  hypo
gtaacctcaacctcccgtgcttgatcgcttatataatctctgctcactgtaatctcaacctcccgggctggattccatatatataaatacatacatatatttgtttgtttagacgttatctcagtctgtccaacaggctggagtgcagtggcgcgatctcggc

SEQ ID NO: 72946 - DNA, 157 bp, Homo sapiens
  chr11:507665-507822
  hyper
gggacaggagggacccgggagaaacccccctggggcggctccgcatgtcggggtcgcgactctaggcgaccttggtagaggggctcgtttgcgccgagctcgcgacccccgagggagccacggccccgtgaaccacgctgcccgtcctggccactgg

SEQ ID NO: 72947 - DNA, 26 bp, Homo sapiens
  chr11:5169023-5169049
  hypo
tttttttttttttttcggagacagag

SEQ ID NO: 72948 - DNA, 39 bp, Homo sapiens
  chr11:518894-518933
  hyper
accggggcgggggggcgtgtctcccggtcacgtgacctg

SEQ ID NO: 72949 - DNA, 159 bp, Homo sapiens; identical to SEQ ID NO: 15524
  chr11:5192016-5192175
  hypo

SEQ ID NO: 72950 - DNA, 41 bp, Homo sapiens
  chr11:5192457-5192498
  hypo
ttctgcctccagtcccgggatgccaacgagagtgaatgttg

SEQ ID NO: 72951 - DNA, 44 bp, Homo sapiens
  chr11:520975-521019
  hypo
ccgctgcctgaacaccggcatttactcaccgatgctctcgtctt

SEQ ID NO: 72952 - DNA, 30 bp, Homo sapiens
  chr11:528361-528391
  hypo
cttcctccaccccctcggcagcccagcagg

SEQ ID NO: 72953 - DNA, 136 bp, Homo sapiens
  chr11:5330681-5330817
  hypo
catacagaaaacttgcgcctacacctatttttttaagcattccatagattggatctcatttctctccacatttttatgtcttcccaatataaaactttactcaggccgggcgcggtggctcacgcctgtaatccca

SEQ ID NO: 72954 - DNA, 6 bp, Homo sapiens
  chr11:536871-536877
  hyper
cggtcc

SEQ ID NO: 72955 - DNA, 148 bp, Homo sapiens
  chr11:537026-537174
  hyper
cggtgtgtgtttcctggtcctcgggggcgcttcccccggtgcttccttttgccgtcggcctcacttccaaccgaaggtcaggacggcaggcctcggccccaggggcgacccttccacctgggaaaggtgggcgcgagcctccagcaga

SEQ ID NO: 72956 - DNA, 95 bp, Homo sapiens
  chr11:5394464-5394559
  hypo
gcttgatatcagtctcggcaattttttagatattgtcttgatttgaagaaaattttcactggaagtctatattgatcgattttttctttcacaaa

SEQ ID NO: 72957 - DNA, 30 bp, Homo sapiens
  chr11:5411435-5411465
  hypo
ctgtccctggtgcaccgttttgggaagcat

SEQ ID NO: 72958 - DNA, 30 bp, Homo sapiens
  chr11:548977-549007
  hypo
ccagccaattcagagcggagtggaaaagcc

SEQ ID NO: 72959 - DNA, 21 bp, Homo sapiens
  chr11:55684103-55684124
  hypo
ttatttaaaagaaaacgtggc

SEQ ID NO: 72960 - DNA, 37 bp, Homo sapiens
  chr11:55743007-55743044
  hypo
tacaggcgtgagccaccgcgcccggcccaggattgtc

SEQ ID NO: 72961 - DNA, 16 bp, Homo sapiens
  chr11:5580873-5580889
  hypo
ccgtctcaaaaaaaaa

SEQ ID NO: 72962 - DNA, 160 bp, Homo sapiens
  chr11:55918225-55918385
  hypo
aaaaaaacaaaacaaacaagaaaaaacaggtagcaatataccagtaataagtcctctatcgtccacaatttctttaattttacatgaattaaactcagtaattataattaaaaagtacggatagtagaatgaatgtaaacaacaacgatgtgatccagct

SEQ ID NO: 72963 - DNA, 30 bp, Homo sapiens
  chr11:55919964-55919994
  hypo
attttcgcttattcccgccatttattcctg

SEQ ID NO: 72964 - DNA, 27 bp, Homo sapiens
  chr11:5609308-5609335
  hypo
catgagcctccgcgactgacctaaaat

SEQ ID NO: 72965 - DNA, 638 bp, Homo sapiens
  chr11:562246-562884
  hypo
acagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggtgagcccggggacctgatcccctgtcactcccccacccctgatatgggcagatacggggatcacagggtcccactcgggaggcaggtgagcccggggacctgatccc

SEQ ID NO: 72966 - DNA, 30 bp, Homo sapiens
  chr11:5624731-5624761
  hypo
cagccagggaacctgcggcctaatcggcat

SEQ ID NO: 72967 - DNA, 30 bp, Homo sapiens
  chr11:567232-567262
  hypo
cgctgggaccctcctcgcccagagttccta

SEQ ID NO: 72968 - DNA, 32 bp, Homo sapiens
  chr11:57056902-57056934
  hyper
gagggcaaaggctcccgcggggagcagccagc

SEQ ID NO: 72969 - DNA, 137 bp, Homo sapiens
  chr11:57071533-57071670
  hypo
ccacatctacaggcacggcacagagccacacctgacacaaacacacgcatccccgcatccccacacccccaccccacacacacacactcatactacgcacagaggtgtgggaaagcctggcacggcagtgcctggaa

SEQ ID NO: 72970 - DNA, 230 bp, Homo sapiens
  chr11:57117349-57117579
  hyper
attttgccaaactggcgcgcacggtgaggacctagccattcttccgcgaccccaaactccccaccttcagccctttcccagatttcagggccctttggccggcactggccaggagccgccgcgagacagcgccacctggtggaagcatcccaggccgccactggctttgtgcctgaatcctttctgctttccccgcgcagagcgatcttgccccccgcctccgccgagtc

SEQ ID NO: 72971 - DNA, 40 bp, Homo sapiens
  chr11:57150498-57150538
  hypo
gcagattggtaggaccgggcacggtggctcatgcctgtaa

SEQ ID NO: 72972 - DNA, 30 bp, Homo sapiens
  chr11:57168307-57168337
  hypo
gccgagcacttttcacgtagagccttactt

SEQ ID NO: 72973 - DNA, 30 bp, Homo sapiens
  chr11:57168787-57168817
  hypo
gtgaagtgtggtgcacgctctgaagggcac

SEQ ID NO: 72974 - DNA, 30 bp, Homo sapiens; identical to SEQ ID NO: 42849
  chr11:571791-571821
  hypo

SEQ ID NO: 72975 - DNA, 614 bp, Homo sapiens
  chr11:57194178-57194792
  hyper
gaagacacaaactcccgctgccaagttggtgttatcttcagtttactgacaatgaaacaaaagctcccatggatttcaggaacttgcccaaggtcacagggctagtttagtcacgacgcaggccattctactgccagaaatacccccaactcccatgaccctcgcctaggactcgcaaacctggtccccgccgcccttcctcgcatcaacttctaccaggaaagcctccgggggccgctccccgccagcctccgcaccccgctccagcctgcggcctgccctccccgcagaggagcccgaggggccaggccgcgctcggcgccccatggcgcccgaaaggggacccttcgccctacccgcctgctccgcgccggggctctccgcgccctttccgcacgggccaggttcgcattcgcgcctctcgcagcccctcccagtcccctgctcgcctccgccccctcctgcccgcccggaaggggctggggcagacctcccactctccatcacttccttcttcttttcccttgctcacagcctcccgcgccctttttacctctccctcttgaaacttctccctctagaaccccctagaaccccagcggtgtctttccctc

SEQ ID NO: 72976 - DNA, 1 bp, Homo sapiens
  chr11:57227221-57227222
  hyper
a

SEQ ID NO: 72977 - DNA, 21 bp, Homo sapiens
  chr11:57227249-57227270
  hyper
cgcacccgcttgtaaatgcac

SEQ ID NO: 72978 - DNA, 207 bp, Homo sapiens
  chr11:57235251-57235458
  hypo
cagaacaacctcatccgcacgctgcggccaggcacctttgggtccaacctgctcaccctgtggctcttctccaacaacctctccaccatctacccgggcactttccgccacttgcaagccctggaggagctggacctcggtgacaaccggcacctgcgctcgctggagcccgacaccttccagggcctggagcggctgcagtcgctg

SEQ ID NO: 72979 - DNA, 69 bp, Homo sapiens
  chr11:57243666-57243735
  hyper
ccacctcttcctccacgggaaccgcctgcggctgctcacagagcacgtgtttcgcggcctgggcagcct

SEQ ID NO: 72980 - DNA, 32 bp, Homo sapiens
  chr11:57281984-57282016
  hyper
ccatgtccggactctcgcgccaggaaagaccc

SEQ ID NO: 72981 - DNA, 30 bp, Homo sapiens
  chr11:57308593-57308623
  hypo
aaatagtgagggcatcgaattcaggaaccc

SEQ ID NO: 72982 - DNA, 163 bp, Homo sapiens
  chr11:57311354-57311517
  hypo
agactgtgtagcttccggacagaccagtccttcagccaggtaatgtcaaactctggggctccagctccaattccccctacctcctgcttccctcagcgtccaccatcaactcagtctgggttcccccagcacctgatttcaagatattcgaggattcctggca

SEQ ID NO: 72983 - DNA, 33 bp, Homo sapiens
  chr11:57373422-57373455
  hypo
tgctcatggaaagaacgacgtgttcaggactca

SEQ ID NO: 72984 - DNA, 30 bp, Homo sapiens
  chr11:57405988-57406018
  hyper
gatccaagcccggcccgggagaggggctgg

SEQ ID NO: 72985 - DNA, 30 bp, Homo sapiens
  chr11:57417507-57417537
  hyper
gtaggcatcaagggacggggctagaggagt

SEQ ID NO: 72986 - DNA, 30 bp, Homo sapiens
  chr11:57421913-57421943
  hypo
aagaacatatgatgacggtattgtttggag

SEQ ID NO: 72987 - DNA, 25 bp, Homo sapiens
  chr11:57423912-57423937
  hypo
ttattataaccggactcagaaactc

SEQ ID NO: 72988 - DNA, 20 bp, Homo sapiens
  chr11:57437214-57437234
  hypo
gcccccgtgcccagctggca

SEQ ID NO: 72989 - DNA, 37 bp, Homo sapiens
  chr11:57501031-57501068
  hypo
agtgaggaatttacagatgaaacgatatagctggaat

SEQ ID NO: 72990 - DNA, 91 bp, Homo sapiens
  chr11:57548730-57548821
  hypo
ggaatgtgagctcaaacagttgggtgacccctagtaaactctaaggttaagcttttccatgaatattttttttttccgagtctagggtatg

SEQ ID NO: 72991 - DNA, 18 bp, Homo sapiens
  chr11:57551113-57551131
  hypo
gagcgagactccatctca

SEQ ID NO: 72992 - DNA, 19 bp, Homo sapiens
  chr11:5784549-5784568
  hypo
aatttatttttgagacgga

SEQ ID NO: 72993 - DNA, 30 bp, Homo sapiens
  chr11:57994277-57994307
  hypo
aggcgcgagccactgcgccccaccaggtta

SEQ ID NO: 72994 - DNA, 148 bp, Homo sapiens
  chr11:58275194-58275342
  hypo
aagaggcctacataccgctgcatggcgatcataggccatggaggccaggaggtagcactcaacagtggcaaaccccacaaagaagaagaactgagctgcacatccatcgtaggagatggccttgtcccctgaccgcaatgcagccacc

SEQ ID NO: 72995 - DNA, 141 bp, Homo sapiens
  chr11:58406402-58406543
  hypo
tggttgctgagggtccgcacatgctgcgagaagcagggctgaatatcaggggtttctgggaccttcagagagtagatgctgtggtggacctgcactctggctgtgacctacaacctgatggaaccccgggttgtacgcctt

SEQ ID NO: 72996 - DNA, 229 bp, Homo sapiens
  chr11:58668329-58668558
  hyper
cattaagggaatcttcgagtccaagaacggaagctaccattggccttaatcttcacctcccgcttttcttccctgcttcttttctcctccctattccagtaggttagttctctggcgccatcagctggcagcacgcgggaatataccaaacgcggaaacgcgccttcgcctgccctgagtaactgcaaatccagggctgagtgaggtatttaagcgcttggcttgtgta

SEQ ID NO: 72997 - DNA, 481 bp, Homo sapiens
  chr11:58672686-58673167
  hyper
ggcattgtctgtgttcgccagcccctccacgaagttggatcatttgcggagcaggccaagtccctctagacctcacgcagacgcgggtgcagcctgctctgcgacttgcagtcagctggaagctgggcctctgcatcatcagggtggagctctctctgctgctgccgctggatcccgcctggatgcacgtcccgccaccgccgccgacccatcagcggcagaagggcagcaatggccacacaccgaagcaccttggcgggctattccccttgcagctctcctcagcgcgctgctcccactcgcaatcaaaaggcggaaaaagcgcgaaaccgccaggcatctcccatacccacccggctgccgcgcaacccctccttggcttccactgggagacaggggacgccgatgagcaggaagaagcagggcagtgactgcttagtttatcctggtacgcgggaactggctgtggaccgagtggttc

SEQ ID NO: 72998 - DNA, 121 bp, Homo sapiens
  chr11:58673168-58673289
  hyper
ggggaggggatcgctgggaccgggatgggtcatctggacaaatagggagggtgggcgggtgggcgcgcagtcccctcggcctggccgtctgacccgcccgcgagcgcgtgcgcccaggcgt

SEQ ID NO: 72999 - DNA, 16 bp, Homo sapiens
  chr11:58821650-58821666
  hypo
gcgtggcctcctattc

SEQ ID NO: 73000 - DNA, 152 bp, Homo sapiens
  chr11:58835165-58835317
  hypo
aggagacgcgtttgccgactttatctctgtatcgcttaggaggagttatttaattcactttagactttgttaagttaaatattaatgttaaaatgcccagggctattttgttcaagacagttgccactaatcacgtgatttttttttttttt

SEQ ID NO: 73001 - DNA, 30 bp, Homo sapiens
  chr11:58953988-58954018
  hypo
ccagaaagagctgggcgaggagaatcggcc

SEQ ID NO: 73002 - DNA, 179 bp, Homo sapiens
  chr11:59245284-59245463
  hypo
agcccctgcactatgcgactatcatgagtagagaccattgcattgggctcacagtggctgcctggttggggggctttgtccactccatcgtgcagatttccctgttgctcccactccctttctgcggacccaatgttcttgacactttctactgtgatgtccaccgggtcctcaaactg

SEQ ID NO: 73003 - DNA, 30 bp, Homo sapiens; identical to SEQ ID NO: 15547
  chr11:59312651-59312681
  hypo

SEQ ID NO: 73004 - DNA, 53 bp, Homo sapiens; identical to SEQ ID NO: 33871
  chr11:59318986-59319039
  hyper

SEQ ID NO: 73005 - DNA, 30 bp, Homo sapiens
  chr11:59323446-59323476
  hyper
gtacttgcttagttccgagagtgcggtttg

SEQ ID NO: 73006 - DNA, 28 bp, Homo sapiens
  chr11:59323871-59323899
  hyper
gatagactaagcaaacgcttttcttcag

SEQ ID NO: 73007 - DNA, 28 bp, Homo sapiens
  chr11:59323959-59323987
  hyper
gtccctgttcgggcggatgctgttttag

SEQ ID NO: 73008 - DNA, 19 bp, Homo sapiens
  chr11:59328895-59328914
  hypo
accttaaaggctgggcgcg

SEQ ID NO: 73009 - DNA, 138 bp, Homo sapiens; identical to SEQ ID NO: 43081
  chr11:59329214-59329352
  hypo

SEQ ID NO: 73010 - DNA, 330 bp, Homo sapiens
  chr11:59333343-59333673
  hyper
ccttgttacggtttaaaaagctggacaaagcccgtgcgccgaacgctttcgaggacttctttggccaagagggggcccgggctgtcaccattcccggcaagcccgcgaccaagcaggcagcggaggcggcgcaggccgagagctcccgcccctctgacagtgagagaagggtcgcagcgcccacggctgcctagaacccgaaagaagaggagcggggtgcggggacacagggttgctcaagaaagtgagctatgcgcagtgctccggaagagcttgtctcaaaccaggtcccaagtgagggcagaggcgtaacttcgtactgggcagttt

SEQ ID NO: 73011 - DNA, 196 bp, Homo sapiens
  chr11:5949707-5949903
  hypo
cccgccatttattcccgccatctcggcagccacctcggataccctgactcagcatttccgggtccacctttcttgttcccgccgcctcagtgaacacgcatgcccactaaagcacatcactaaggcacatcactcatctatataagcgcgctgcacctttggcacagcgcgacttccctgaccctccccctgcaga

SEQ ID NO: 73012 - DNA, 15 bp, Homo sapiens
  chr11:5949963-5949978
  hypo
cggccttattgatcc

SEQ ID NO: 73013 - DNA, 30 bp, Homo sapiens
  chr11:5951371-5951401
  hypo
ggcggttccatccaccgatccagagtggga

SEQ ID NO: 73014 - DNA, 30 bp, Homo sapiens
  chr11:59521144-59521174
  hypo
tctattttcttgaagcgcggggaactacgt

SEQ ID NO: 73015 - DNA, 34 bp, Homo sapiens
  chr11:5957970-5958004
  hypo
cctcctcaatccagtcggccgagaaggcttgcca

SEQ ID NO: 73016 - DNA, 61 bp, Homo sapiens
  chr11:59609779-59609840
  hypo
tcccatccacaggcacgttcacatccttagctcctcctccatgggacgctctcctttgtca

SEQ ID NO: 73017 - DNA, 188 bp, Homo sapiens
  chr11:59807943-59808131
  hypo
agtcttgatgctcctcgctgtcttgatttggaccggtgctgagaacctccatggtaaataacaagttttagagaatgcttcctcgaaggagttaatcataatgatcgctttccatgcaggtgttttactccctgaagaaatctgatcttattctaactggctagaagaagaagcgctttcaggccaag

SEQ ID NO: 73018 - DNA, 120 bp, Homo sapiens
  chr11:59841387-59841507
  hypo
ggagaccgtggaaagagagggagagagagaccgtggggagcggcagcgggagcaggagcgggagagggagagggagagggcagcactatgagttttaagaagcaattgaaaatgtatgca

SEQ ID NO: 73019 - DNA, 30 bp, Homo sapiens; identical to SEQ ID NO: 43085
  chr11:60282848-60282878
  hypo

SEQ ID NO: 73020 - DNA, 23 bp, Homo sapiens
  chr11:60409067-60409090
  hypo
ttatatactttcccccgttctat

SEQ ID NO: 73021 - DNA, 213 bp, Homo sapiens
  chr11:60524504-60524717
  hypo
aaactcatcaattttcggggaatcccggtaagggacagtcctgactcccgtcaggaggatgggacccacgcgtaaaatatcaggggttggattatcatgggtcaagaaatgaccaaagaacagaaagtgttttttaaaaacagtgcgacagctacttaaggctaaccagtgcactgcagagcctggagctctacacaacgctatgatcttaat

SEQ ID NO: 73022 - DNA, 26 bp, Homo sapiens
  chr11:60535370-60535396
  hypo
aaaggacgggaaaggcggggcacggt

SEQ ID NO: 73023 - DNA, 30 bp, Homo sapiens
  chr11:605782-605812
  hypo
gttctagggtggggccgtgatagcctggct

SEQ ID NO: 73024 - DNA, 67 bp, Homo sapiens
  chr11:60640875-60640942
  hypo
ggatgactatcccatcgtgaggctgctccgagaaccagtccatgtggaggtccggcttctgcagagg

SEQ ID NO: 73025 - DNA, 226 bp, Homo sapiens
  chr11:60718628-60718854
  hyper
ccgcagaaggagctgcggccgtcggggaaggcggtggcgggcagcaggcccgaggcggccaggtagagcagcaggctgagcgcgaccgcgcggtagcggcccaggtacacgtcggccagccagccgcccacgggcgccagcaggtaggaggcgcccaggaataccagcgcggcgcgcgtcgcctgctcgccggtccagttgaagttggtgctgttgaggtacagca

SEQ ID NO: 73026 - DNA, 261 bp, Homo sapiens
  chr11:60718976-60719237
  hyper
cgctccccgggcacgcggggctgctcccgggcgcgcggcgcgggcatcctggctccgggctgggccccccgcggctcttctctcctctcctctccccgcctcagagccctgcactcctgcccccgggcctcggccctctcccccacccaactggctggccctcctttctcaccgctttggcccacccttccctcctgtcccctctccctttcttgccctacccttcctgtccctccgctcactacccggactctaccacct

SEQ ID NO: 73027 - DNA, 30 bp, Homo sapiens
  chr11:607280-607310
  hypo
ggggcggttcaggctcggaacttgtcaaat

SEQ ID NO: 73028 - DNA, 30 bp, Homo sapiens; identical to SEQ ID NO: 43087
  chr11:60892552-60892582
  hypo

SEQ ID NO: 73029 - DNA, 170 bp, Homo sapiens
  chr11:60897862-60898032
  hypo
catttggtaaagaaccggcagcgctgacctagcgtcacgcggatggcacataggccggggaggggcaggcaccagaaggtcaaggtccctccttggccccagcagccccgggcccaccagatgctgcgtcctcaggtagtggacatttcaaggcacgtacaacttcctaa

SEQ ID NO: 73030 - DNA, 86 bp, Homo sapiens
  chr11:60927434-60927520
  hypo
agccaggttatctaacatctccgcaactcacttcatctgtaaaacgggatcatcacctatttggacatgttcgcaaaattcggtat

SEQ ID NO: 73031 - DNA, 171 bp, Homo sapiens; identical to SEQ ID NO: 5117
  chr11:60941596-60941767
  hypo

SEQ ID NO: 73032 - DNA, 30 bp, Homo sapiens
  chr11:61014723-61014753
  hypo
gaaatggccagttctcggatgattaatttc

SEQ ID NO: 73033 - DNA, 41 bp, Homo sapiens
  chr11:61027383-61027424
  hypo
atgctccttgacttacgatggggtcacgtcccaataaacct

SEQ ID NO: 73034 - DNA, 39 bp, Homo sapiens
  chr11:61036508-61036547
  hypo
tcaccaagaccccaccggtgacaccggcccctgcctccc

SEQ ID NO: 73035 - DNA, 377 bp, Homo sapiens
  chr11:61038898-61039275
  hypo
gagccaccgcacctggccaacaatacacacttcttaaggccaactgccaagcaccatcgtcctcacacatctactgagagcaggataaactcggtccaaccctttttgtgaaagtggaacttgacagcaccggagggagactgcggccagcctgaggccagcctctggaggggccaggacgcttgtctcctctgggtgaggcggggcagccaggtaaagcagctgaaggcgagcaggttgtcattcacctggcagatgcataactcacaggggtcaccaggcgaccagatctgtccaatcggaaactcaaccccgttgtcgtcaagagagcagcctggatgaggacaatggcagagaaaagacggcacaagacctag

SEQ ID NO: 73036 - DNA, 30 bp, Homo sapiens
  chr11:61041904-61041934
  hypo
taaagtgttgtgcctcgctcccctctccat

SEQ ID NO: 73037 - DNA, 158 bp, Homo sapiens
  chr11:61049497-61049655
  hypo
ggtccatgcctgccccgaggtgcgggatgtgactcagacagctgggagcggggctgaaatctagtgcttgtcttgttaataggttcacacatcgagcaggtatttaatgcgagtatcagagactcagccccagcactatgcagcggtaattaattgct

SEQ ID NO: 73038 - DNA, 175 bp, Homo sapiens
  chr11:61058212-61058387
  hypo
aggagatataattcccgctgtccccctccccctcccccaccactcccaggcgtctcacctgtacacctgatgccaacagctgtctccgtcatcgagaagcccacggggcacactcgggccacctcctgacagcctccatggttgcaggtaaggtcacagccgtactccccacatg

SEQ ID NO: 73039 - DNA, 124 bp, Homo sapiens
  chr11:61058771-61058895
  hypo
agcagacattgggagcgatgcagatgccactcccacagccgaaggagcagagggctgagaggagaagtgcaggtgagacacgaggaactggggcctcccgtctgcccctcggaccagggactga

SEQ ID NO: 73040 - DNA, 336 bp, Homo sapiens
  chr11:61062688-61063024
  hyper
aggggacgcggcggacgattgtggggagggtctctggcacctcgaagcgaaacacacaaaggcaacgccgcccgcctgctgatgcctctccgagaggcgcggagcccggggcgggggcaaagatcagggacccctgggggcggggtttcgccctcggcccacaccccctgccccggtttgggagtcggcttcctgcgaagcgctgactgaaggcgtcagaccgaggccccgggaggaaacagacttcgggaacaaggctagcaccagaggctgcgcgccccgggcatggcccctgtcggtgggacccgagacgccttgttgtgacgaggtgggaac

SEQ ID NO: 73041 - DNA, 97 bp, Homo sapiens; identical to SEQ ID NO: 10877
  chr11:61063061-61063158
  hyper

SEQ ID NO: 73042 - DNA, 30 bp, Homo sapiens
  chr11:61112512-61112542
  hypo
tcaagtggagggcttcggggcaggcctcac

SEQ ID NO: 73043 - DNA, 18 bp, Homo sapiens
  chr11:61198502-61198520
  hypo
tttttttttttgagacgg

SEQ ID NO: 73044 - DNA, 40 bp, Homo sapiens
  chr11:61276061-61276101
  hyper
tgggcaggtagggggcgggctccggcgctgggaccccact

SEQ ID NO: 73045 - DNA, 88 bp, Homo sapiens
  chr11:61276416-61276504
  hyper
cggggcgatgcctggcggtggcagtggcggcggccccggccggggcccgtgaccatgggcatcgccgagtccacgccggatgagctgc

SEQ ID NO: 73046 - DNA, 585 bp, Homo sapiens; identical to SEQ ID NO: 33878
  chr11:61276535-61277120
  hyper

SEQ ID NO: 73047 - DNA, 15 bp, Homo sapiens
  chr11:61277327-61277342
  hyper
cgctccaggactggg

SEQ ID NO: 73048 - DNA, 30 bp, Homo sapiens
  chr11:61305680-61305710
  hypo
aaagtcatcctgttccgaaagccctaagac

SEQ ID NO: 73049 - DNA, 518 bp, Homo sapiens
  chr11:61334835-61335353
  hyper
tgctgaaacagctgtcggccacgcggctccttgtccttggtgctgaaacagaactcagtcctggggctgcgccctcttccaggtcgccctttgcgcagctcccagcgagcaggatccgagagactgtgcatagtgattccgccttcctctgccaatgcctccctgatcaaccctcagctgaagctatggcagcacccagtgacctcaagagccccctttcctcgagttaggtcctcggatgctgaagaccccagtcctgactcaggacaaaaagggccgccccgcgaacgtggtaaataccacgccccattccctcccgggggcccgccgcactgcctcctggtggctggcgcgggcactgcaccccggcgggcgcacagacggtccccagcggcggcctgggccagcggcgaagcagcggcagacggttctccggcccccgccgccccctcaccgctcccggggcaatctggcgctcagagcttgcggcgttgcccgacacccgcacactccagcct

SEQ ID NO: 73050 - DNA, 95 bp, Homo sapiens
  chr11:61347879-61347974
  hyper
cagcgctggcacccccggggcaccggtgctggggagcctcgggtgcctctgagggcactgcccggctcccacaggggcagcggctcctcgctccg

SEQ ID NO: 73051 - DNA, 38 bp, Homo sapiens
  chr11:61355533-61355571
  hyper
gagctgtgactgtcccggttccgcgatccctggctctg

SEQ ID NO: 73052 - DNA, 43 bp, Homo sapiens
  chr11:61356081-61356124
  hyper
tgggaggtgagggggcgcagaggccgggcgccctggaaaggag

SEQ ID NO: 73053 - DNA, 93 bp, Homo sapiens
  chr11:61447983-61448076
  hyper
gggcctccggcgcggcgggccggtcctgggcgcgggcgcggtgcgagcggcgcggcgggctgggcagtgtccagggcgcgcggtggccggccc

SEQ ID NO: 73054 - DNA, 51 bp, Homo sapiens
  chr11:61526128-61526179
  hypo
atgcacaggcatgctcgtacctcagggcttttgcaccggctgtccccgcca

SEQ ID NO: 73055 - DNA, 192 bp, Homo sapiens
  chr11:615793-615985
  hyper
cgcccgaccctcatctctcaggctcccccagctcttggctctacccctccggggtcacggagcccccacggaggctctcgctcccggcctgcaccgcgtgggtctggggtccccagtacctgggtgccagagccgccgggacgggaagtttcgtctcgcggggaagcggagggccggcgcttttatggtggc

SEQ ID NO: 73056 - DNA, 30 bp, Homo sapiens
  chr11:61581920-61581950
  hypo
tggggctgtgtcgggcgttggttccttccg

SEQ ID NO: 73057 - DNA, 129 bp, Homo sapiens
  chr11:61582570-61582699
  hyper
tggcgataagattcacgttggcaggtccggcagccccgggccctgtaagtgatgcggcgtgtggggcgggggccggggcggagccggcggccggtggcaccacacatacggaccaatcgccgtccccgc

SEQ ID NO: 73058 - DNA, 53 bp, Homo sapiens
  chr11:61582756-61582809
  hyper
cgtctgcgcatgcgccgggacacgcctgcgcccttggccgcagtcagggctcc

SEQ ID NO: 73059 - DNA, 448 bp, Homo sapiens
  chr11:61583181-61583629
  hyper
ggcctggggctggggcgcgcgccgaccccgcagtgagaccaagggaagaagggacaggaccccgcgaagggcctaccgccccagagcgtaaacagcggtccgctccgcggaatagctgaagacctcgctggcctgcggctcagtggcctccccggcgattcgagaacagctctgggggtcctcgctaagtgtatgccattcccaatcccttatgtacgccagcggccgcttgccctccccggccagcgctgtcccttccgcgtcctccagtcttcacacgacgcaggggtccccaaggcagcggtctccccaagcttcccgtttcagccccatcctcgagaatgggctcctttcctgctccctctccgctcctgctggcgagtggagaccggcacctaggtccagacgcggctgcgctgcctctcctagccatcgagacaggatgtga

SEQ ID NO: 73060 - DNA, 232 bp, Homo sapiens
  chr11:61583894-61584126
  hyper
acaggtatgatcaggcgcctccgggctttcctccgaattagtcggtgtttggctcggagtgcgtaactctgtctcccctgcactcagcctccggtcccgccctctcctgtgcccccgcctggctgcgctcaccgtggcatcctgcccggcgtagtggctgatgacccgggagccccctggatgccggcgggtgaactcgctgatgttgtacaccttacggtcgatcactagc

SEQ ID NO: 73061 - DNA, 46 bp, Homo sapiens
  chr11:61584805-61584851
  hyper
cttgccacgtcgtgccgccaattgtgctgcccgaagtagcagcctg

SEQ ID NO: 73062 - DNA, 511 bp, Homo sapiens
  chr11:61594981-61595492
  hyper
gaggttgcagaaaggcgccagaatgtggatggcgcggacaatgtgggatactggagtctcgactgccgcgcgccaaggaagggcgtcacctagccaagccggccctggagttgagtgccccgcagcccgccggtccacccgcccggccgcttgctggcaccctggtggccgcgccggctttgtgtcggcatcaggtgcaaacccccagagcgccgggcgtgcgcgcacgcgccccggagcgcgcggagcccattcgttgcccccaccgggatctcctctaggatctcctccggcgcccggggccggagagtgggggagggaggaggtcggacacgtagcctgcctcgcagcagggctcgactccacgcgggagggcgggggagccggggacccgccgctccagcccgctggccttcgaaagatcctcctgggccaatggcaggcggggcgacgcgaccggattggtgcaggcgctctgctgatcgctgtggaaactcgggcggcggggaac

SEQ ID NO: 73063 - DNA, 944 bp, Homo sapiens
  chr11:61595751-61596695
  hyper
aaagcgaagagggcccgggctgcacacaccggctgggaggcagccgtctgtgcagcgagcagccggcgcggggaggccgcagtgcacggggcgtcacagtcggcaggcagcatggggaagggagggaaccagggcgagggggccgccgagcgcgaggtgtcggtgcccaccttcagctgggaggagattcagaagcataacctgcgcaccgacaggtggctggtcattgaccgcaaggtttacaacatcaccaaatggtccatccagcacccggggggccagcgggtcatcgggcactacgctggagaagatgcaacggtaagggtctgggggcgccccagccacccttctctgctgcaggcggagtcaggatccctggctccccgtgggccaaacagacctccggcgctgaatggagcttgggacgtcctgtagggaaggaaagtgcatctattgcactcgtaccccctccccaatcctcctcctcctctgggccgactggggtggagaccggatctgggacccggggaggcggcgctgcggtgaaagtcccagcggtggagaacagggcaagcatctaccgcgcgcgccgggacccacgcgtcctccccttcctcggggtttgtctggaggcagggactccccaagaggggcgctcgggccagacggctttggcgcccccagcggggaagatggccgcccctgcgcgccgctgaaaggagcgggagcgcaggcagccaggtgtgggactccgcgcttgtcccgcactctccatccagactgggtggcgagaaggaaagctcgtccccggccggagatcgctcctgctgggactcttgtctaagaagttcctcaatggccacctgggaaaaaccgcccagcagctcgggttcccacgctccagggattatctagactcaccccaagctcgagccggccttctt

SEQ ID NO: 73064 - DNA, 30 bp, Homo sapiens
  chr11:61625542-61625572
  hypo
ttctgggcctctcatcggctggttgatggc

SEQ ID NO: 73065 - DNA, 82 bp, Homo sapiens
  chr11:61633635-61633717
  hypo
cttcactctccctgacggctgccattggtccaccctttcatagagaggcctgctttgttacaaagctcgggtctccctcctg

SEQ ID NO: 73066 - DNA, 81 bp, Homo sapiens; identical to SEQ ID NO: 43095
  chr11:61641410-61641491
  hypo

SEQ ID NO: 73067 - DNA, 105 bp, Homo sapiens
  chr11:616542-616647
  hypo
tgttcagtcaagaatatcagatactctcacaattaaaacatttggaaaggaattaatggtgtatttccattagggaaagtgctgacaagccgcaagggatccctt

SEQ ID NO: 73068 - DNA, 488 bp, Homo sapiens
  chr11:61664512-61665000
  hypo
gcaggccaccagccacggggagagggaggcctggctcatcccccagtaacccacagccctctgaatactaagggaggactcaaatagtcctccccacagcaagtaagtggtgatggcggaggtggggtggcttcaggatttgggtttaatcccaagcacgagggcgggcagggaaaggatttggtttcattccttcagatgcccaagccttggccagagccccagggtgcaggagtgagggcgcgtggccacccagcctgtaccaacaaagcctgcctttattaaatagagatcgcgttacattccatccaaagaaggaaatccggacgtggtgagggatgcgtccaggtgggagctccgaacgctggtcctgagtgggctctgatgggtgggagggcccaggtcctgcctgcccacccaggccccacatgccagggcgcgtgtctgcatggccacccacagctgaaaacaggcgtgggtgatctgaa

SEQ ID NO: 73069 - DNA, 59 bp, Homo sapiens; identical to SEQ ID NO: 43097
  chr11:61665728-61665787
  hypo

SEQ ID NO: 73070 - DNA, 140 bp, Homo sapiens
  chr11:61666088-61666228
  hypo
agacaagcaggtacacgctgtcacatgccacagcggtggtccagacctgggaactacattagacaaggcacagatgcctccctggggtctcacaaggaccctgcgcagtgaggcggggaccacagcggccatccagggac

SEQ ID NO: 73071 - DNA, 174 bp, Homo sapiens
  chr11:61669877-61670051
  hypo
aaaggagtcaagtaacgcttgcaaaggctgactcaccctggcccgggaagatggcgagatgtagtaatggcttttggagtccccgagccggattcggtggcggcaggtgcgggtcagcccgctcagggcacatgtgctaggggaaagcaaaatgggtcacgggggctggctggg

SEQ ID NO: 73072 - DNA, 244 bp, Homo sapiens
  chr11:61674856-61675100
  hypo
ggcctcaccttgccccgagcctccttcagctgcttttctgatgccgcctgcttcatgttggcttctcgaaccatcttgtgagcttcctaggaagaaggcagtccctgcgtgagtggtgaggagccaacggacgcccagatgacccattccccaagttgttcccgcgcccagccggtgtacctcaaacaggctggccgtcagctcttccagctcctgttctagctgctcccgcaccttggacagc

SEQ ID NO: 73073 - DNA, 245 bp, Homo sapiens
  chr11:61684587-61684832
  hyper
ttgacgctgtcaccccgggacggtcggctgcccacccttcgcaccctgcaccccgagagacacccccgacccctcccccggagtctcctggctgcaagtcggctcgcctgcaggcagggcgggggcgcacagcacctccgggtggcggcgcagacccggcggggacccccgaaatcctcccgtcccgggaggcgaccgcggcccagacccagcgcgggaccgcgagcgcgcgcggacctacccgc

SEQ ID NO: 73074 - DNA, 305 bp, Homo sapiens
  chr11:61722682-61722987
  hyper
cccttctggctgttccgggtccctgtggccgcccaggctccagacaggccaggggaggatcacgaggagctgcggcaaggggctggggagggggcgggggaacgccagcggcaggtcggcgcctctctgtagggaaaggtgcggactgcagccagtgaaactgaagttagacgttaggtaagacgtcctgccgttagcaatgaaaaccccattttctgagggaagcgctgacatcatggtccctggagcccctgcgcgggaggggagggggtctggcggatttctgggaccagcagggggacccc

SEQ ID NO: 73075 - DNA, 32 bp, Homo sapiens
  chr11:61736195-61736227
  hypo
ggtccactgttctgtcgcgtcttttgacgcat

SEQ ID NO: 73076 - DNA, 23 bp, Homo sapiens
  chr11:61736670-61736693
  hypo
ttgcctggggctgggcgcggtgg

SEQ ID NO: 73077 - DNA, 82 bp, Homo sapiens; identical to SEQ ID NO: 43102
  chr11:61736993-61737075
  hypo

SEQ ID NO: 73078 - DNA, 42 bp, Homo sapiens
  chr11:61753272-61753314
  hypo
atcttttcatacgcttgaaaaaaaagacggtgagcatctttt

SEQ ID NO: 73079 - DNA, 30 bp, Homo sapiens; identical to SEQ ID NO: 43103
  chr11:61784772-61784802
  hypo

SEQ ID NO: 73080 - DNA, 137 bp, Homo sapiens
  chr11:61793162-61793299
  hyper
tgcagtcagcagacacgtacgggatgtgggaggtttgttttgaccacacccctgtcaatagttacaagataagccaaagcaagaagcacagacaccatgcctggcagaaaagcggccgtttgcggaactattttatg

SEQ ID NO: 73081 - DNA, 30 bp, Homo sapiens
  chr11:61899800-61899830
  hypo
ggctttgtgcaaggccgcagggcagggcct

SEQ ID NO: 73082 - DNA, 256 bp, Homo sapiens
  chr11:62105312-62105568
  hyper
agctgcgaacccagccgttcagaacagagactgggcattgtccccacagggtctcccgaggaccttgtacccgcgcggcttccttgggctggctttggacgacgctttcgccttcctgctgcctaggatccgccgacatgaatcccatcgtagtggtccacggcggcggagccggtcccatctccaaggatcggaaggagcgagtgcaccagggcatggtcagagccgccaccgtgggctacggcatcctccggga

SEQ ID NO: 73083 - DNA, 35 bp, Homo sapiens
  chr11:62184274-62184309
  hypo
ttcctgtttagcaagcgttgcgtaccttggcttac

SEQ ID NO: 73084 - DNA, 203 bp, Homo sapiens
  chr11:62191247-62191450
  hypo
aatcctaaatcctgacgatagatagtggcccctcaccagtctttcctgtgctcctccttcccacggctccttcattctgctcagtccccacacacacccccaccttccctgccctcagtttttaaaaagagccaagcccctttcaaccttaagacctttgtaccagccacacagccctggctgctcaaaaagtgtggctgatg

SEQ ID NO: 73085 - DNA, 228 bp, Homo sapiens; identical to SEQ ID NO: 43104
  chr11:62370522-62370750
  hypo

SEQ ID NO: 73086 - DNA, 95 bp, Homo sapiens; identical to SEQ ID NO: 43105
  chr11:62421710-62421805
  hypo

SEQ ID NO: 73087 - DNA, 30 bp, Homo sapiens; identical to SEQ ID NO: 43106
  chr11:62440622-62440652
  hypo

SEQ ID NO: 73088 - DNA, 117 bp, Homo sapiens
  chr11:62445413-62445530
  hypo
tcggccttttccctccgcctctcctcagcagcccggcgcatctcatcttcctgtagccgctgtcgtgctgctgacaactcttgcccttgtctcctgcgctgccgttcccgttccaat

SEQ ID NO: 73089 - DNA, 78 bp, Homo sapiens
  chr11:62450128-62450206
  hypo
attacaggcgtgagccaccatgcccagtgctggaattacaggcgtgagtgctgtaattacaggcgtgagtgctggaat

SEQ ID NO: 73090 - DNA, 27 bp, Homo sapiens
  chr11:62497829-62497856
  hypo
agccactgcacccggcccagtaatttt

SEQ ID NO: 73091 - DNA, 104 bp, Homo sapiens; identical to SEQ ID NO: 43007
  chr11:6257172-6257276
  hypo

SEQ ID NO: 73092 - DNA, 40 bp, Homo sapiens
  chr11:62609977-62610017
  hyper
cctgatcctcaaacccgggatcccgcggtgggagaaaggt

SEQ ID NO: 73093 - DNA, 43 bp, Homo sapiens
  chr11:62661211-62661254
  hypo
aaaagccttctcctgcgcaatggcttgggcctgtaatcccagc

SEQ ID NO: 73094 - DNA, 209 bp, Homo sapiens
  chr11:62666677-62666886
  hypo
acttgctttgtcctgcgaaagtaacctttaacttttaaaaagcttgtgattctgattgcttgtcttccttaatagtgtgttgccctggcaataatatttaaattcacatctgtgttttctagaaggtataaatacctgtgagttttctttgttaagccagagggggagcattgacacattcctcttctcccacgcgcatgaagtagaat

SEQ ID NO: 73095 - DNA, 15 bp, Homo sapiens
  chr11:626863-626878
  hyper
accccccaccccacc

SEQ ID NO: 73096 - DNA, 307 bp, Homo sapiens
  chr11:6280415-6280722
  hyper
aggagatggagggtgcggagacagatgcaggagctaccccaggcccgcagcgaggagctgcagggaactacggtagcaatagtgtcacggtcactgcggccactgcaacacagtacggtaaatgcggctctaggctcagactaaagcatccgcgcctcagcaggtgacgcacgcagacctggtctccaacgccacctccacgttccctgatacaccagagaaagatgctggatccgtggcagccgtctctacccaacccctcctaccctcccttccccgaaacctccccctacgctgccaatactct

SEQ ID NO: 73097 - DNA, 156 bp, Homo sapiens
  chr11:6281164-6281320
  hyper
ctgctaaagctgaaccggagcgtgcagggaaccggacccgggccgggggcttccctgtgccgcccgggggcgcctctcctcaacagcagcagtgtgggcaacctcagctgcgagccccctcgcattcgcggagccgggacacgaggtgggtgcctc

SEQ ID NO: 73098 - DNA, 102 bp, Homo sapiens
  chr11:63258610-63258712
  hyper
gcactgggggcggctcggggaggaaccgcggaggggaaagcgccgcgggctgcaaacggcagaggcgcgcggggtggcgacagtggcgcgggcgcagtgagc

SEQ ID NO: 73099 - DNA, 57 bp, Homo sapiens
  chr11:63258713-63258770
  hyper
cgtccgagaacagaatgggacgaaacggggcgcttagaggcccgggaatctgtgggt

SEQ ID NO: 73100 - DNA, 101 bp, Homo sapiens
  chr11:63374106-63374207
  hypo
gcctcgcctggaggccggagatgagccttgcagatggctaacacctccggcagggggagcagccgagcaaaggccccagcggggcgcgtgtctgagcaaca

SEQ ID NO: 73101 - DNA, 90 bp, Homo sapiens
  chr11:6341394-6341484
  hyper
ggctgcgcggcgcaccgcgcgctcttgggcggcgttggcgtgcgagctcacgcgctccgccttggccagcagctgcgccaaggtgttgct

SEQ ID NO: 73102 - DNA, 101 bp, Homo sapiens
  chr11:63537119-63537220
  hyper
cgcgttaccacggctcggaagcgctgggcggaccctggctgcgggtcccggggcgcccccggtcccccagctccggagaagcggagcgcagggacccggag

SEQ ID NO: 73103 - DNA, 154 bp, Homo sapiens
  chr11:63572071-63572225
  hypo
tgggggtgaaaagaacgtcctggtagcatttatgtcctgggtccggttattcctaaagtcggcctgtatccctgcccttcccacaattgggcattcagcccttccttcagttccatgagccaataaatcccccattttgttcaagctagtatat

SEQ ID NO: 73104 - DNA, 96 bp, Homo sapiens
  chr11:63609980-63610076
  hypo
ttcctgtattctttaaaacgggaaaaaagacaagcagcagctcctcaggtcacaaggccaggtatatcaaacactggcctccgagaatagatcatg

SEQ ID NO: 73105 - DNA, 18 bp, Homo sapiens
  chr11:63641124-63641142
  hypo
tatttttttctgagacgg

SEQ ID NO: 73106 - DNA, 56 bp, Homo sapiens
  chr11:63652242-63652298
  hypo
cttggcagttgatagcgatagttgctcatggcagttgatagcgatagttgctcaga

SEQ ID NO: 73107 - DNA, 12 bp, Homo sapiens
  chr11:636895-636907
  hyper
actagggtgagc

SEQ ID NO: 73108 - DNA, 88 bp, Homo sapiens
  chr11:637176-637264
  hyper
ggggcccccctgagccggggcgggtcgggggcgggaccagggtccggccggggcgtgcccgaggggagggactccccggcttgcgacc

SEQ ID NO: 73109 - DNA, 152 bp, Homo sapiens
  chr11:637349-637501
  hyper
cgcgggccggccgcgggggcatctgcgggggcatctgcggggctggctgggcagggcgcggcggcgctggtggggggcgtgctgctcatcggcgcggtgctcgcggggaactcgctcgtgtgcgtgagcgtggccaccgagcgcgccctgca

SEQ ID NO: 73110 - DNA, 30 bp, Homo sapiens
  chr11:63735580-63735610
  hypo
actcctggtttcaagcgatcctcctggctc

SEQ ID NO: 73111 - DNA, 30 bp, Homo sapiens
  chr11:63743650-63743680
  hypo
ggggaatactgactccgaggtgccttcttt

SEQ ID NO: 73112 - DNA, 18 bp, Homo sapiens
  chr11:63767704-63767722
  hyper
ccgggagccgatagccgc

SEQ ID NO: 73113 - DNA, 182 bp, Homo sapiens
  chr11:63768254-63768436
  hyper
gggcctcagcgtcggtgcgatcccaaggcccacctccccaggcggcgccccatcacggggcggcggcaaaccctaggacccattttgcggatgaggaaaccgaggccaccttgttacagggtgatcagatctgtagctggagtctgggtcttccagccgcgcggggaggtgagcccgacgcc

SEQ ID NO: 73114 - DNA, 145 bp, Homo sapiens
  chr11:63779111-63779256
  hypo
agggaatcagggctgcgggacgaagacatggagcagggcagtgcatcagggttctgggcagagtggccagggcaggcaggatggcccttgtgcgtgttcgaacaatgggtggctggtcatgggaggggcgcgggtagaggcctga

SEQ ID NO: 73115 - DNA, 30 bp, Homo sapiens; identical to SEQ ID NO: 43111
  chr11:63780950-63780980
  hypo

SEQ ID NO: 73116 - DNA, 32 bp, Homo sapiens
  chr11:63783251-63783283
  hypo
ctggaggactgagaacgcggagcagtgctgag

SEQ ID NO: 73117 - DNA, 82 bp, Homo sapiens; identical to SEQ ID NO: 43112
  chr11:63783734-63783816
  hypo

SEQ ID NO: 73118 - DNA, 30 bp, Homo sapiens
  chr11:63785738-63785768
  hypo
gtgcctgacgtcccacgggtgggggggctc

SEQ ID NO: 73119 - DNA, 295 bp, Homo sapiens
  chr11:63803412-63803707
  hyper
cgcggctccgccgggcgcccgagccgggcagatgcgccgccgcgcgccccccgctccgggcccgccaccgtgctctgccgcgcgccgggggctcctctcccgggcccccctgggcgccctccggctctggttcccgcccgctccttggaataacccctgaggctccagccgtcaccgcaaagtttcccgaggagacccgcctccccggccgctgcgcaggtagggctggctgcaccgggcgggggtcggggtccgcgcgtctgggacagggcgccagagccgacggggcgggggc

SEQ ID NO: 73120 - DNA, 30 bp, Homo sapiens
  chr11:63804018-63804048
  hyper
cccgcactcgggaaccggaggagggcgcgc

SEQ ID NO: 73121 - DNA, 94 bp, Homo sapiens
  chr11:63804348-63804442
  hyper
gggcactggagaccccggggaggaaggctggggagtgttgtcgcccagctgcagggaaccgtggttgatcagagctccccgaggaggagaaagt

SEQ ID NO: 73122 - DNA, 254 bp, Homo sapiens
  chr11:63849380-63849634
  hypo
agccctctggactcccggctctcgagtgccgcgttctacctgctgtgttctaaatggacatgccatccccacagctgtgtcaataaagcagccatttacagagcgggcgccggatcccgtgacaggttgaaaagtgtgtgagctgcagcgtcctgggctggggcagaggggccgtggcgagaacagatggggctgtgcccatctccccaggccctcctgtggctgcgcctggagcctcccgggagggaggccag

SEQ ID NO: 73123 - DNA, 30 bp, Homo sapiens
  chr11:63906088-63906118
  hypo
ctctctccccaactgcgatgccgctcggct

SEQ ID NO: 73124 - DNA, 59 bp, Homo sapiens
  chr11:63916700-63916759
  hypo
caggtgctgagtgaccgtcatttgcacgtcacgtgcatcagctccgagtgcccccagta

SEQ ID NO: 73125 - DNA, 30 bp, Homo sapiens
  chr11:63920212-63920242
  hypo
cctgcagaacagctccgagcttcctcccac

SEQ ID NO: 73126 - DNA, 20 bp, Homo sapiens
  chr11:63934599-63934619
  hypo
aaacacgaggatggattttt

SEQ ID NO: 73127 - DNA, 30 bp, Homo sapiens
  chr11:63938071-63938101
  hypo
cctcctgggctcaatcgatcctccagcctc

SEQ ID NO: 73128 - DNA, 37 bp, Homo sapiens
  chr11:63955145-63955182
  hypo
atttctggaataagacgttgctcttttacctttaaga

SEQ ID NO: 73129 - DNA, 129 bp, Homo sapiens
  chr11:63978732-63978861
  hypo
aacctgcactccaggcgtggcacctgcactgttccgggggatgccagctcacttctcggacagcgcccagactgaggcctgctaccacatgctgagccggccccagccgccacccgaccccctcctgct

SEQ ID NO: 73130 - DNA, 40 bp, Homo sapiens
  chr11:64010257-64010297
  hypo
ctatgaccagctgggcgcagtggctcacccctgtaatccc

SEQ ID NO: 73131 - DNA, 80 bp, Homo sapiens
  chr11:64039207-64039287
  hyper
cccttcgtcgtcctccgtccccgcggggtaggagctgtggcgactccggatctccacagccccagcgcctgcagagggtc

SEQ ID NO: 73132 - DNA, 67 bp, Homo sapiens
  chr11:64042943-64043010
  hypo
cccatctgccaggatcgccatgacaacaaatgagagcaggaaagccccctaccggcccctcatagcc

SEQ ID NO: 73133 - DNA, 99 bp, Homo sapiens
  chr11:64054286-64054385
  hypo
tctctactgctgccccgtctgcctgcagttcttcaccttgacgcttatgaacctctactttgcccaggtaaccaactgtggtcccgggtggggggcggg

SEQ ID NO: 73134 - DNA, 1297 bp, Homo sapiens
  chr11:64058814-64060111
  hyper
gttgcggacccttcccgatccggtaatgggcctgggagatgccagattagcgtggtgcctgtccggagagacgggccagctgatgcccaggtcggggccctgccgctggccacactgggctccggtccaaggctagaaggctggcccctgctgcaacccctctccggctcctctgccacccacctcccggggctggccggctgtggggagccaggcggccgcaggtaaacggcttggggcggcgccggcggcgagggcgctgcacggagggaagcgcggcgccggaggggttaaccgcgggaggaggggggcttctgccggcgggaggggggtcccagccccggcggccgcccgctccgcccctgccgcctccgcggcccagtcggcaccggcgaggccgtgctggaacccgggcctcagccgcagccgcagcggggccgacagtaagtgcggtgcgggctccggtgcgcgggcaggactcaggggcagggacgccccaggggcgactggccgggcggggtgcccacctctcgcgcgtgggcgcctccgggagtggtgtggccgccggtcccgccgcccgccacgctccgaggcgtcgctgtgcggacgcgggggaggcggtgggagcgagctgcgggcgctgcgcggtggccctgctgtctggcgtgtgcacgctagtgtccacacacgtgtgcgtgggctctgggtgccctggcgcggccggcacgcccatgggggccggggatgccggggcgtctgcggagagtgcaggtggggtgcgtgcgtgcagcggggcggcgcggcgctgcagcctcgggatggagcgtgggcgcgcgggtctttgtgcccgcgcttggcggcgcgtgccggggcgtgtgtgcgcgtgggcgccgccgcccgctgtctcggactgacagctgtctcgggggctgtcgccccggtgtggcctttgcggacccccgccccgctttttccgggaactgggcgtccccagcacccctcctcgcctgggtgcggcggccgggacccgcccctgggttcctcgaaagcccggcggggcgcgggggcaccctggagggccagccaggaagcagggcgaggcgagaggggacggagaagccgcggagatgctgtcacagccgcagcgggcgagcagggacccaccattcccctgtccccgccttgcgctgtccggcctctcctccgggtttcccttcggacgcctccgagccccctcagcctcctcctcgagggccagctccccgcacccccaccaagctccacacatttcctcgct

SEQ ID NO: 73135 - DNA, 33 bp, Homo sapiens; identical to SEQ ID NO: 33894
  chr11:64060160-64060193
  hyper

SEQ ID NO: 73136 - DNA, 420 bp, Homo sapiens
  chr11:64066842-64067262
  hyper
ccagctggactggcacggtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccggtgtaggggcaggatccctggccgggcctctcaagggcttcgtttctgctctccccggcatgcctggctt

SEQ ID NO: 73137 - DNA, 215 bp, Homo sapiens
  chr11:64105859-64106074
  hypo
ttttggtctgagagtcgtgatgtctgtgtctgcctgccacctccttctctgagtccttgagagttctacggagagcagtactgctccaaacattccataaaacagccaggcgctcttaagccagctttacaattgtgcagatgaagtggagccgagttttcactctgctctaggagtgtcactgacaggccgggcgtggtggctcacacctgtaa

SEQ ID NO: 73138 - DNA, 85 bp, Homo sapiens
  chr11:64108286-64108371
  hyper
cggagcctgatgctcagtgggcggggcctgagggacggtgggcgaggcctgttgacgggaggcgggtcctcgagcccacctccgg

SEQ ID NO: 73139 - DNA, 95 bp, Homo sapiens
  chr11:64117072-64117167
  hypo
ccagcaaggaggaggcgctgatggagctcaagaccagggccctgcagctggaagaggagctgttccaggtgatgcctgcccgcctgggagctggg

SEQ ID NO: 73140 - DNA, 105 bp, Homo sapiens
  chr11:64120222-64120327
  hypo
cagctgcaggcccagcgggccagcgtggaggcacaggaggtggccctgctggcagagcgtgaacgcctgatgcaagatgggcatcggcagcggggcctggaggag

SEQ ID NO: 73141 - DNA, 126 bp, Homo sapiens
  chr11:64120822-64120948
  hypo
ctattgacacagctgcgaagtgcccaggaagaggagaaccggcagctgctggctgaagttcaggccctgagccgggagaacagggagctcctggagcgcagcctggagagtcgggaccacctgcac

SEQ ID NO: 73142 - DNA, 30 bp, Homo sapiens
  chr11:64124074-64124104
  hypo
taggtctttgaagcacgtcacaggccaacc

SEQ ID NO: 73143 - DNA, 88 bp, Homo sapiens
  chr11:64124704-64124792
  hypo
ctccacggtcagcgccggggcccggagatggagctgggacgagtgtgtggacaggggggatggctggcccccacgagcagctccaggc

SEQ ID NO: 73144 - DNA, 66 bp, Homo sapiens
  chr11:64129402-64129468
  hypo
aaggatcctaagaagcgattgggcgcggggccccagggggcacaagaagtccggaaccatcccttc

SEQ ID NO: 73145 - DNA, 41 bp, Homo sapiens
  chr11:64140397-64140438
  hypo
cttatggacccaagacgggtgccaggcgctccagggactcc

SEQ ID NO: 73146 - DNA, 30 bp, Homo sapiens
  chr11:64147610-64147640
  hypo
gtgtgagcgtgtggacgtgtgtgggtgtga

SEQ ID NO: 73147 - DNA, 104 bp, Homo sapiens
  chr11:64168551-64168655
  hypo
tgtgggtaggaaatacgtggagcgctgagaatgggcacagaatgcaaagatgtttgtttccaatgcggatgccccgcagagggcacccccggcagaggagctct

SEQ ID NO: 73148 - DNA, 21 bp, Homo sapiens
  chr11:64184141-64184162
  hypo
aagaatgaggctgggcgcggt

SEQ ID NO: 73149 - DNA, 76 bp, Homo sapiens
  chr11:64187500-64187576
  hypo
ggttgtgagatgggtcgtgcctgacaccatttggcgctcagccaactcttgtttgtttcgtcgattctgctgggtt

SEQ ID NO: 73150 - DNA, 209 bp, Homo sapiens
  chr11:64292291-64292500
  hypo
gtgtcccgagaatggcgcccagggagggtgtggaatctccgcggcccccctcacagccctgccccatgtgccccctccatctcgcagttcatctgtgtcctttctaatcttcacaataaactataactgtaagtaagtgtctccccgaattctgtgagcagtcctagccaatgaattgaacccgaggaagaggtcgtggggacctctta

SEQ ID NO: 73151 - DNA, 44 bp, Homo sapiens
  chr11:64313087-64313131
  hypo
ctgaagtctacctgccgccagggcaagggcgcatatgtcaggaa

SEQ ID NO: 73152 - DNA, 62 bp, Homo sapiens
  chr11:64323679-64323741
  hypo
tgaccatctccatcccgccaggccccaaccaggggccccaccagtgccgccgcttccgccag

SEQ ID NO: 73153 - DNA, 126 bp, Homo sapiens
  chr11:64361015-64361141
  hypo
aacacgggcactctccgtaggtctctgacctggcgccatgcaggggggctccatgcaggctccagggctgaaccactcggtctccttgcagtgatggagtggacggcggcacgggcccgacccttg

SEQ ID NO: 73154 - DNA, 271 bp, Homo sapiens
  chr11:64409914-64410185
  hyper
agctggggtggggcccgcgggggcccagctgcgcacacgggaagcgccccccgcccccgggccaaccgggtggccggcatctacagtgccacttaccgtggccgccgcgggtgaggaagggcatgcggttgatggcgatgggcacggtgccgtgcttgctgtggaagtggtggacgtggtgggtggtgctgaggctggaggagacccgggccccctcggccgcccccagcagcaacagcagcaacagcggcaacagcggcagcagaggtgg

SEQ ID NO: 73155 - DNA, 233 bp, Homo sapiens; identical to SEQ ID NO: 33897
  chr11:64410203-64410436
  hyper

SEQ ID NO: 73156 - DNA, 359 bp, Homo sapiens
  chr11:64410638-64410997
  hyper
gcagggaggggagagcgagggaaatcctgcggaaaaaccgagctggggagcggggcggtgcgggctggaggagagaagagggacggagacctggttcccccgaaggcgggagaccgacggcgactggggccggccgcgccgctgctgccgctgccgcccgacggaggccgggggaaaggagggagcggccgggggaggggggggcgggagaagggggaagggaagcaaatccgggtgaggggggaatgaagggataggagaggaggggataggagaggaggggagcggggctgagccgaggaaaggcgcgagcctgcgagattccggcggagagatggaggcagcgaagtgttgctgca

SEQ ID NO: 73157 - DNA, 30 bp, Homo sapiens
  chr11:64411442-64411472
  hyper
cactgagatgtgtatcggcttgggtatgga

SEQ ID NO: 73158 - DNA, 257 bp, Homo sapiens
  chr11:64478747-64479004
  hyper
acacacacacacaaccgctgagtggcccacagcttctagagggaccaggggagagaacgtcaggcctgaggcacacacgagctggaagaacagggacgaggggcggggagagacgcgcatgcgccgcccccagaccgatgggggagcccctccccacgcccagccagaccctaatggaagaggctcctcccagtgcttcctctcctcagcgccccctgccccccgacaccacagccccgccccgggccgctcagccc

SEQ ID NO: 73159 - DNA, 78 bp, Homo sapiens; identical to SEQ ID NO: 33900
  chr11:64480253-64480331
  hyper

SEQ ID NO: 73160 - DNA, 877 bp, Homo sapiens
  chr11:64480379-64481256
  hyper
cgaagcgccccaggccctcacccccgcgcccaggcaccgggcggccgctccccggggctcaccttcgctgcagaacttgccgccgaagcccgtgtggctgcagtcgcagcccacctcgccgggggccagcacggtgcagaggccgccgttggcgcaggggttgcgcgcgggcgcgcacagcgggtcggcggtggcgccgcgcaggccctggctgcccagcagcgcggggggccgctcgcccagcttcaggttggccaagaggccgcggaagggcggctcgtacttgacggtgctcagcgtaagcgccgagaggcgcacgtcgggcgggatgccgcccacgaacaggtcgctggccacctgcatctcgcgccgcttggagcgcacctcggcggcgcgggcctcgccgtccaccgccagcgccgtgcggcgcgcgtcgcgggtcagcagcaccatgtgccagcggtcgtcggccaccggcgtgtccagctgcagcgtggccggctcggcgcacgaaagcgtgaagcgcagccgcaggcggccgtccaccagcagcagctccaggaagtcgcagtcgccgccgtcgtccaggtagagcagcagcgcgcgcgtggcgttggtgcgcaggctgaagctgagctcgccgctgctcgccgcgcccgcccagcgcgcgtagcgagcccactgcccggggccgccgccgaactccaggccgtccgcgcgcgccgccagcgccagcagcagcagcaacagcagcggcggcggtgtcggccgccaccggctcccggacgccatgcctacggcggccccggccccgcccggcccccggcccccgctcaggcttcagagccgcgggcgcatggggcgggagggggccggg

SEQ ID NO: 73161 - DNA, 214 bp, Homo sapiens
  chr11:64488458-64488672
  hypo
ggggctctgggggcacgtagtggccgtgtgtgtgttgtgtacatggcagcaaggcacctgggggaggtctcaaggaggcaggcatgaggtggcagcctctctgggtggggagtgtgggctgtatgctgccaggaggtgtattgtgtacgcaggtgtgtgtgcctgtgtaggtgtgtgtctgggtgggtgccaccgagcgcgtgtatcattgtca

SEQ ID NO: 73162 - DNA, 33 bp, Homo sapiens
  chr11:64496441-64496474
  hypo
acactctgggccctgcgccgacactcaactgac

SEQ ID NO: 73163 - DNA, 30 bp, Homo sapiens; identical to SEQ ID NO: 43124
  chr11:64507459-64507489
  hypo

SEQ ID NO: 73164 - DNA, 30 bp, Homo sapiens
  chr11:64508029-64508059
  hypo
cgacaaattctaccccggaagagccccgaa

SEQ ID NO: 73165 - DNA, 202 bp, Homo sapiens
  chr11:64511882-64512084
  hyper
cccgcctggctctaccgcttcctcgtgtgaccttgagaatcacttggcctctgggagcctcaattttctcatctgccaaatgggggtacgcgggggagggccccgctggaaggtggctgggaaaagctgggtgcaccgtggaggtcctccgccctccggggatccagcgcgccttagctctcgtggccgctgccccctctcc

SEQ ID NO: 73166 - DNA, 850 bp, Homo sapiens
  chr11:64512898-64513748
  hyper
gggacctgtggggagcgaggaatgaaatcgtggctatctggagacgcggccttgatgtctgggaatgggggcggggggcccagttcacacaggaggaacggggccccggaagcctggctccccacagggtcgaatggaaaggggcagccgcatgtggcggtgggttctccgcagctcggagactggagacctggatgcctggccaacagggaggaacttgggaggggcagccgcaggcggttggggtccccactagccgggcctaggagagcgggtaacggtttccgaccatttggcttcagacacactcactgtgaaaccaccgaccccaaacctcccttccgaggcgtgcccctcccagccttggggcgggggatccaggaccgcccccgcacctcagtcttggtaatgtaagacttagaaacaggacctttctgttcctcagtttccccataatgagggcctagactaggcggtctgcgagtgttccctgccgtaacactcccccgactttggatccagtgtagccacctgctaagagacccttaaacgccgcagtagggcggggctaagggcggagccaagaaggcgccgagcatcctctgcttcctccccctcctgggtcctgccctcgacagcgcggatcctccgtggtccgggaagcctcagcccaagtcccggctcccagccccggtgggccccacccaggcagacgccccgcccccggccagcgaggctggccgctgacctagtatggacacggcactgggaagagaggcgtggagggtgacgccaggaaaggggctggagaggcctaggccccgcccccacgggtcgccccctccacctc

SEQ ID NO: 73167 - DNA, 43 bp, Homo sapiens
  chr11:64572043-64572086
  hypo
ccaccttcagggcctcgggctgtgccagcgacagtcccaggag

SEQ ID NO: 73168 - DNA, 80 bp, Homo sapiens
  chr11:64578524-64578604
  hypo
tcccacttccgcccgcgagatactctaacacgtgctaagagtagcttttgtttgtttgttttgagacacggtctttctct

SEQ ID NO: 73169 - DNA, 58 bp, Homo sapiens
  chr11:64609349-64609407
  hypo
ctttcacctttgatacgaaggggctggctgaggggacacagggcgggactcagagtgc

SEQ ID NO: 73170 - DNA, 53 bp, Homo sapiens
  chr11:64610107-64610160
  hypo
gcctccctgtctggacgaagcttttgtctggtcaagaacgtcctctttcctca

SEQ ID NO: 73171 - DNA, 87 bp, Homo sapiens; identical to SEQ ID NO: 43128
  chr11:64667987-64668074
  hypo

SEQ ID NO: 73172 - DNA, 96 bp, Homo sapiens; identical to SEQ ID NO: 43129
  chr11:64669480-64669576
  hypo

SEQ ID NO: 73173 - DNA, 30 bp, Homo sapiens
  chr11:64733479-64733509
  hypo
aaatatcctaccaaccgcaggaacccaaaa

SEQ ID NO: 73174 - DNA, 602 bp, Homo sapiens
  chr11:64739234-64739836
  hyper
ggggggactgcacttcggcggcggagggtggagcccggcccggaaacttccctcagaaataaacagaaacgcaaagacaacttcccgagggcccgggccgtcgtgtgccgttacctcagccccaggtggttcccaggctcggccaggctatgtctcacacactgactaggggtccttcggcctcagaaaagtggccccggacggaatacccactaagaagtgctctctgaaaaaggcgggcgccaacctcgaacgaagtcgttttgagggactggctcgccagctcctaagcaacttcggggctcgtgccgcgcacccaccaggccttctgcgcacgcgcaagtgcgcttcccaccgccccttcgggcgcagctccaaggcctggccgcggtctgcgcgtgcgcatttcattgtcgacaccgagaggacgccttggcgccttcaggtccctcctggatttaccagcccattgtttatttcgcgcctgctttagcgtggtgtcgtcgggaactagcgactgcagagtccttactgtgtgctaggcgttatgcagggtaccttcctttattcctcggcgatatgctctgcggcaggcattaatg

SEQ ID NO: 73175 - DNA, 30 bp, Homo sapiens
  chr11:64766930-64766960
  hypo
tgccgtattctcacacggtctctctgcctt

SEQ ID NO: 73176 - DNA, 19 bp, Homo sapiens
  chr11:64774608-64774627
  hypo
gagcacagcagctcacgcc

SEQ ID NO: 73177 - DNA, 30 bp, Homo sapiens
  chr11:64794372-64794402
  hypo
tggcagcaaacccatcgcaaaaaagctcca

SEQ ID NO: 73178 - DNA, 152 bp, Homo sapiens
  chr11:64809453-64809605
  hypo
cagcacaagatccaccgagccccgacgtgggacctcgggcccatctctgggtcttagttgtctcaggaataaaagtggagggggcaagggtggaaagggagaattggtctaaatagtgattttcaaacttttttttttttgagtctcgctct

SEQ ID NO: 73179 - DNA, 31 bp, Homo sapiens
  chr11:64809845-64809876
  hypo
cgtgagccaccgcgcccggctgattttcaaa

SEQ ID NO: 73180 - DNA, 30 bp, Homo sapiens
  chr11:64825805-64825835
  hypo
cacctgaggttctcccggatcctgtgggca

SEQ ID NO: 73181 - DNA, 337 bp, Homo sapiens
  chr11:64875821-64876158
  hypo
ctcacctccggctcccgacgtgttagagttcaccgaccatggaggcagtggcttcgtgggcggcctctgccaggtggcggcggcctaccaggagctgtttgcggcccagggcccagcaggtgccgagaagctggcggccttcgcccggcagctgggcagccgctattttgcgctggtggagcggcggctggcgcaggagcagggtggtggtgacaactcactgctggtgcgggcgctggaccgcttccaccggcgcttgcgggctcccggggccctgctggccgctgccgggctcgcagacgctgccacggagatcgtggaacgagtggcccgcgag

SEQ ID NO: 73182 - DNA, 96 bp, Homo sapiens
  chr11:64878797-64878893
  hypo
ggtgtcggtgctgaccggcatcatcaagatcagcctgaagacgctgctggagtgtgtgcggctgcgcacctttgggcgcttcgggctgcagcaggt

SEQ ID NO: 73183 - DNA, 30 bp, Homo sapiens
  chr11:64879104-64879134
  hyper
cccaggatctggtctcggtggtccttcccc

SEQ ID NO: 73184 - DNA, 200 bp, Homo sapiens
  chr11:64883895-64884095
  hypo
atgaccagggtaacccgttcagctagggagctcctcaatgagagttcttggggcaggtggcacggggcctccccaaagccgctccagctccccagtgagggcggccacctcctcggctaccacagcatgggcttggtgagccctggcgcagtctagggccaggggtgtgagggccgcctcattttcgttggtccaggcca

SEQ ID NO: 73185 - DNA, 79 bp, Homo sapiens
  chr11:64903249-64903328
  hypo
cagagttggcttccccgtaaggccacgtataactttttttcccccttttctttttatttatttatttattaatttttgc

SEQ ID NO: 73186 - DNA, 19 bp, Homo sapiens
  chr11:64903448-64903467
  hypo
caggcgtgagccacaacac

SEQ ID NO: 73187 - DNA, 30 bp, Homo sapiens
  chr11:64937648-64937678
  hypo
tgctttgggcagggccgccctcaggctata

SEQ ID NO: 73188 - DNA, 135 bp, Homo sapiens
  chr11:64950220-64950355
  hypo
caagtgcagaagcagcgggccagggagctgggcctgggccgccatgagaatgccatcaagtacctgggccaggattatgagcagctgcgggtgcgatgcctgcagagtgggaccctcttccgtgatgaggccttc

SEQ ID NO: 73189 - DNA, 159 bp, Homo sapiens
  chr11:64951735-64951894
  hypo
ggtggaggtggccctcggaacccagggtgcggaacccacagtgcggatccactttggcccagcgccacacccacctgctccagtctgcaggggcgcagtctcgcccccttccctcgctcctccaatccgctcctccctggcctccgattggccagttca

SEQ ID NO: 73190 - DNA, 96 bp, Homo sapiens
  chr11:6497213-6497309
  hypo
tggccaggtctcagctttcaaactgacatccccatttccaccccagtccatgccagatgcccctcctttgtgctcccacagcgccctctgtacttc

SEQ ID NO: 73191 - DNA, 72 bp, Homo sapiens
  chr11:64975460-64975532
  hypo
ccagctgcctccacacgggcagggccggggcctctcttacctgctttctccccttctcggtccagcaagtgc

SEQ ID NO: 73192 - DNA, 72 bp, Homo sapiens
  chr11:64977462-64977534
  hypo
gccctcaccctctgccgccacctcagtccatcttccggaagtttgacctggacaagtcgggcagcatgagtg

SEQ ID NO: 73193 - DNA, 144 bp, Homo sapiens
  chr11:65028520-65028664
  hypo
atgctgggattacaggcgtgagtgaccgcacctggcctgggatggacattttaaaggttcctgatacatattgctaaattgttttctcgaaacgctctataccatcccaccagcattgtatgacgcctacggttgagatttttg

SEQ ID NO: 73194 - DNA, 151 bp, Homo sapiens
  chr11:65091310-65091461
  hypo
ggttgcagtgtgtgatgaaggaaagaactggggctcgggaagggcgggactgtgaagctggaacacaggctggcggcagcagggaagagtttcgctggccaggctgacgctgaggcgatggggtgctgctgaaggacgtgaaagcagaaga

SEQ ID NO: 73195 - DNA, 205 bp, Homo sapiens
  chr11:65127486-65127691
  hypo
tctgaaactccttgacgatgagactgttcctgtctgacccttgtcccgtgctgctctgtaaaatggaacgctggggagctggggcctgtttttgccccttgcttgtaggttttagtgaatgaaaagaagcttttgtgttactttcagcttgcttcgttgtcctaattgaccaactccacacctggcagctcgaactaacaactcc

SEQ ID NO: 73196 - DNA, 30 bp, Homo sapiens
  chr11:65168665-65168695
  hypo
attcacagtcacctgcggtgggcgtggaaa

SEQ ID NO: 73197 - DNA, 30 bp, Homo sapiens
  chr11:65182751-65182781
  hypo
cctgccagcctggcacgcacagcctggctc

SEQ ID NO: 73198 - DNA, 585 bp, Homo sapiens
  chr11:65185143-65185728
  hyper
taggaaagctgggctcgcttatttggccaaggagggtggggagggttggaggaggtctaggggccgctggaggtgcagggcagcccggggaggcagggctatggggcccagccacgcattccacaggccttctctctgcgggaacaggagtgaggacacaggcgctcagcgtggcagggtgggaacaggaaggtctcgtgagctctgtgacaggatggggctacaggagacagaggtagcagtgagctggtgaagaggcaggaggaggcaaggaggacagggtgttctagggtgccagctcaggcaaggctccaaggagtgggtgagtgctcaggaggacgggggaccaaggcctggggtaaggggcaggtgcccaggcactctagcatggcacggaacaggggacagtcccaggacatccggatgcagggggctgacaccgcaaagttctttcctgtaaagcacagcccgaggcctggggcttggccctgggcagaggaagccccccttagatctgccttggcagtagtgaggaaagggcgtgcacagaccccacgcagcccgaggtgacgggtcaaatgcaag

SEQ ID NO: 73199 - DNA, 30 bp, Homo sapiens
  chr11:65192943-65192973
  hyper
cagatcagcatccttcgctgccccttagca

SEQ ID NO: 73200 - DNA, 209 bp, Homo sapiens
  chr11:65197681-65197890
  hyper
tctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaa

SEQ ID NO: 73201 - DNA, 30 bp, Homo sapiens
  chr11:65259108-65259138
  hypo
ggccctgtcattctgcgggcttctgtttta

SEQ ID NO: 73202 - DNA, 28 bp, Homo sapiens
  chr11:65276916-65276944
  hypo
gagccaccgatcccggcccacagttttg

SEQ ID NO: 73203 - DNA, 44 bp, Homo sapiens
  chr11:65306381-65306425
  hypo
accggggaggggggccggtaggggcgcctcgggtctcaaggcgc

SEQ ID NO: 73204 - DNA, 30 bp, Homo sapiens
  chr11:65306775-65306805
  hypo
cccacccccgaagcccggctcacccacgca

SEQ ID NO: 73205 - DNA, 203 bp, Homo sapiens
  chr11:65309028-65309231
  hypo
gggagttgtccagtccgagggaggagctgggaggacactcaccctcacaaccgtgctggtcctgggtgggagtgaagccctcatcgcagacacacacataggagccctgaaggttcttgcaggccccatggggaaggcacaggctcgggtcctggctgcactcatctatgtctgcggggcaagagtagcgcagctggaaaccc

SEQ ID NO: 73206 - DNA, 30 bp, Homo sapiens
  chr11:65360776-65360806
  hypo
tcacccccttctcaacgctgccaccagagc

SEQ ID NO: 73207 - DNA, 79 bp, Homo sapiens
  chr11:65405437-65405516
  hyper
agaatgagcactgctcggtgctgacctccgccaggcctggaatccccgctgctgcgcttcccgccgcagacagctcccg

SEQ ID NO: 73208 - DNA, 251 bp, Homo sapiens
  chr11:65413862-65414113
  hypo
tggtcccaggtctcccgtgggcatggagtcctgccgcccctcactaacgcctccctccccgcagggtggccgtgagccgcacccaggacacccctgccttcgggccagctctgcctgctggcggaggccccttcgcagccaacgccgacttccgggccttcctgctggccaaagcgctgaatggtgagcaggcggccggccacgcgcgccagttccacgccatggccacgcgcacccgccagcagtacctg

SEQ ID NO: 73209 - DNA, 30 bp, Homo sapiens; identical to SEQ ID NO: 43146
  chr11:65463016-65463046
  hypo

SEQ ID NO: 73210 - DNA, 83 bp, Homo sapiens; identical to SEQ ID NO: 43147
  chr11:65478528-65478611
  hypo

SEQ ID NO: 73211 - DNA, 104 bp, Homo sapiens
  chr11:65511076-65511180
  hypo
aataagggcactgatctcattcatgacagttccaccctcatgactaatcatctcaccccaagccctatctcctagttccatcgcctttacggttgggatttcaa

SEQ ID NO: 73212 - DNA, 66 bp, Homo sapiens
  chr11:65511418-65511484
  hypo
ggcccaaggggccagcgggagctgggaacaggtgaaagcctcaccccctgccgagttggcagggca

SEQ ID NO: 73213 - DNA, 154 bp, Homo sapiens; identical to SEQ ID NO: 43150
  chr11:65551581-65551735
  hypo

SEQ ID NO: 73214 - DNA, 75 bp, Homo sapiens
  chr11:65554042-65554117
  hyper
ggcggcttcgcgcctccccaggagcctcgggcgcgccgggttgggccggccccagtggggcgagtttcgtgtcat

SEQ ID NO: 73215 - DNA, 86 bp, Homo sapiens
  chr11:65554637-65554723
  hyper
cgttctcagggaagacggcgacattccgcggaggtggaaccgccgcgcgccgtccgggctcggaccttccccggaacgtgggggcg

SEQ ID NO: 73216 - DNA, 170 bp, Homo sapiens
  chr11:65577359-65577529
  hypo
gtcctactgtggcctcggggtctggtcattctccgaatggggctgaaggacagcaatagggccagaacggcaatctgggtctgtgcatcatgttctagccaacaaaacatcccaccttggattttattttttaaatctattcaaagcttcggttccgcatccaattccca

SEQ ID NO: 73217 - DNA, 97 bp, Homo sapiens; identical to SEQ ID NO: 33909
  chr11:65600749-65600846
  hyper

SEQ ID NO: 73218 - DNA, 810 bp, Homo sapiens; identical to SEQ ID NO: 33910
  chr11:65600847-65601657
  hyper

SEQ ID NO: 73219 - DNA, 137 bp, Homo sapiens
  chr11:65629450-65629587
  hypo
agctactggccagctcggcactcaggagcccgagtgatactgctggtgctctaccgggagcacctggtgagcactgggctacaccgggaggcggaaccatggcagtggggtgggaggttccccgaggggcctggccc

SEQ ID NO: 73220 - DNA, 99 bp, Homo sapiens
  chr11:65640238-65640337
  hyper
gcacagctccctggacgcgcggccccaggaagcgccccccgcccgcccgcctgccgcggcgcggcccaccccggcgcctccgcccgcccttcggcggat

SEQ ID NO: 73221 - DNA, 21 bp, Homo sapiens
  chr11:65665095-65665116
  hypo
ccacagcgcccagcctagtat

SEQ ID NO: 73222 - DNA, 68 bp, Homo sapiens
  chr11:65666703-65666771
  hyper
agcccaggcaagtcccgacagcggtagcccgagcccaagcgctgcgggcccggcgtcccagtgacccc

SEQ ID NO: 73223 - DNA, 243 bp, Homo sapiens
  chr11:65667149-65667392
  hyper
ctggactccccaggccgagaaacgatagggacttggcgacggaggggcgaaggacagacagacggacggacacgcggagggtcgcagaccgggccgggactcccaccctggcccagctgctctcccgacggatcccgcctccctcccgtgtggggaccctcaccccagcccagactccagatcccaggaattcagcccgaagcggagagaccctcctagccttcgaggcgaccaccctaggcg

SEQ ID NO: 73224 - DNA, 30 bp, Homo sapiens
  chr11:65677170-65677200
  hypo
ccaggcgcgtggtggcgggtgcctgtagtt

SEQ ID NO: 73225 - DNA, 212 bp, Homo sapiens
  chr11:65684960-65685172
  hypo
agcactcgggagccacgggcactacccccaagctggaaacggctctcatagagagtggggcagaggtgccagcgattggcccggtagatgcccaggtaggtgtagacatcaggcttgtaggtgagcaggcacttaatgcccgctgcacggatggctgaatccgcctccagtacacccaagcggtccgtgaagtcgtccgtgtaaacacagat

SEQ ID NO: 73226 - DNA, 30 bp, Homo sapiens
  chr11:65721988-65722018
  hypo
gactcctaacaggtccgtgaagcagggagt

SEQ ID NO: 73227 - DNA, 36 bp, Homo sapiens
  chr11:65722778-65722814
  hypo
aaagagttaggtactcggctgtacgccgtggctcac

SEQ ID NO: 73228 - DNA, 30 bp, Homo sapiens; identical to SEQ ID NO: 43154
  chr11:65741409-65741439
  hypo

SEQ ID NO: 73229 - DNA, 398 bp, Homo sapiens
  chr11:65779206-65779604
  hyper
tctggacagccctcccgtgaaccgtccctgtactggcacttgttgctggggactgtcgctgtcctctccctccccgggccaggtgtgtcctggagggcagggaagcgtcttggcacgcgggtgcgcgccgccccctcggcctcctgggctccctgaacctcgcaggaccccggcaacttcgagccccgccccagctccaggccgcgggggcgcatcgcgggcgtcgggcggggcggcccagcgggtaaaagctgcgcggccgcaagctcggcactcacggctctgagggctccgacggcactgacggccatggcgcgttcgaacctcccgctggcgctgggcctggccctggtcgcattctgcctcctggcgctgccacgcgacgcccgggcccggcc

SEQ ID NO: 73230 - DNA, 73 bp, Homo sapiens; identical to SEQ ID NO: 985
  chr11:65816447-65816520
  hyper

SEQ ID NO: 73231 - DNA, 159 bp, Homo sapiens
  chr11:65816560-65816719
  hyper
cggggtccgagggtgcccggggccctgcgcgccgagtgccggtggcttgcctctcagcgcctggatgggatcaggtggcagcgtccgctaggctcgctcctcccggctctgcccgccccccgccccccgccccccatcgcacaccggaggaaggcgagg

SEQ ID NO: 73232 - DNA, 30 bp, Homo sapiens
  chr11:65901677-65901707
  hypo
tcagtaacagggactcggtgattaaatttc

SEQ ID NO: 73233 - DNA, 166 bp, Homo sapiens
  chr11:66048056-66048222
  hypo
ggggattgtttgttccggggggctgagtcagcgccaggcagcctggggggtgggaggggtgacgcccgccgcctgctggtggtgccagctctggggtacagacggcacccttctgctccctgtggaccctgttgctgtgcgtgccaagtggcgctgcccagagtca

SEQ ID NO: 73234 - DNA, 217 bp, Homo sapiens
  chr11:66059146-66059363
  hyper
gctcaaggtcgcgagcgcgagcgcggccggaggagaacccaggggtccagccgcccagcgggggcttctcggggacgggcggagcgcccgcggtgccaggcgctgccggcggcgccgccggtgccgcgggggcggggtcagcggagggcggggcgcctggcacccgggccgccaacgccgccgccgccgctgccgccgcgctcgggctcgagctccg

SEQ ID NO: 73235 - DNA, 33 bp, Homo sapiens
  chr11:66059580-66059613
  hyper
gagccgggcctggggcggcgtgagagggaccag

SEQ ID NO: 73236 - DNA, 60 bp, Homo sapiens
  chr11:66101601-66101661
  hypo
ccgtctgcggcaagccggcgccgcaggcgggctgccaggatgggccggagaggcttgagc

SEQ ID NO: 73237 - DNA, 30 bp, Homo sapiens
  chr11:66114013-66114043
  hypo
ccttgcctcctgccacgtagaatggctccc

SEQ ID NO: 73238 - DNA, 86 bp, Homo sapiens
  chr11:66147017-66147103
  hypo
agtacattcttaatgcggtaaaaaaattataatgtgctttaaattttgctcattcattgctatatataagaatatggggcggggcg

SEQ ID NO: 73239 - DNA, 68 bp, Homo sapiens
  chr11:66186333-66186401
  hyper
actctttcagcaccacggacagcggtcggcgcagtattccttcactgcagattcgctcagattgctgg

SEQ ID NO: 73240 - DNA, 107 bp, Homo sapiens
  chr11:66187360-66187467
  hyper
gggtcatggagggtccggcgctgccccttcgcttctcagctgctcccccatcttgcccgcctaggcagggcggggagccctccggagcggtgcggaggcagccaggc

SEQ ID NO: 73241 - DNA, 30 bp, Homo sapiens
  chr11:66187796-66187826
  hyper
tggtccctttcccaccggactccctttcca

SEQ ID NO: 73242 - DNA, 390 bp, Homo sapiens; identical to SEQ ID NO: 33916
  chr11:66188095-66188485
  hyper

SEQ ID NO: 73243 - DNA, 214 bp, Homo sapiens; identical to SEQ ID NO: 33917
  chr11:66188570-66188784
  hyper

SEQ ID NO: 73244 - DNA, 297 bp, Homo sapiens
  chr11:66188852-66189149
  hyper
cgagctgccaggcgccggagaccctggagctgagggaacccgctggggctgtcgcatgtctagggcagcgtgctggcgagctggggagattcgggactcgggagattcgggactttctacttttcctcctgagctccctccagacctcaccttagttctgaatgagagttagagagcctggacggtgtccctaacaccagattatgagaggataagagccaggacagagcggcctcggtgcccgccagtgcagaagcgctccgggagccggggagggaagcccgggaagttgcaggg

SEQ ID NO: 73245 - DNA, 33 bp, Homo sapiens; identical to SEQ ID NO: 43156
  chr11:66324511-66324544
  hypo

SEQ ID NO: 73246 - DNA, 167 bp, Homo sapiens
  chr11:66325229-66325396
  hypo
atgagtgccatgcagcgcaaactagaggactttcgggactaccggcgtctgcacaagccgccccgcattcaggaaaagtgccagctggagatcaacttcaacacactgcagaccaagttgcggctcagccaccggcctgccttcatgccctccgagggcaagctggt

SEQ ID NO: 73247 - DNA, 39 bp, Homo sapiens
  chr11:66327260-66327299
  hypo
ctgcccagagggatgcgctggtaccgcccctcttggaaa

SEQ ID NO: 73248 - DNA, 35 bp, Homo sapiens
  chr11:66332091-66332126
  hypo
gagggcgggagatcccgtggcggtaaaactggagg

SEQ ID NO: 73249 - DNA, 30 bp, Homo sapiens
  chr11:66346865-66346895
  hyper
cagatctgggtcctgcgcttcacaccacct

SEQ ID NO: 73250 - DNA, 33 bp, Homo sapiens
  chr11:66347133-66347166
  hypo
ccccattcccgtagccgccgcttatgaccaagc

SEQ ID NO: 73251 - DNA, 30 bp, Homo sapiens
  chr11:66410982-66411012
  hypo
cagagcggctgctatcggtgcgggaaagag

SEQ ID NO: 73252 - DNA, 189 bp, Homo sapiens; identical to SEQ ID NO: 43158
  chr11:66411368-66411557
  hypo

SEQ ID NO: 73253 - DNA, 30 bp, Homo sapiens
  chr11:66454424-66454454
  hypo
actctcctcccatcccgagagcactgttcc

SEQ ID NO: 73254 - DNA, 51 bp, Homo sapiens
  chr11:66494819-66494870
  hyper
gagggggagggcagacgacatgtagcaggttaagaccggggcaaacctgca

SEQ ID NO: 73255 - DNA, 156 bp, Homo sapiens; identical to SEQ ID NO: 43159
  chr11:66511194-66511350
  hypo

SEQ ID NO: 73256 - DNA, 94 bp, Homo sapiens; identical to SEQ ID NO: 43160
  chr11:66513159-66513253
  hypo

SEQ ID NO: 73257 - DNA, 93 bp, Homo sapiens; identical to SEQ ID NO: 43161
  chr11:66513553-66513646
  hypo

SEQ ID NO: 73258 - DNA, 16 bp, Homo sapiens
  chr11:66515380-66515396
  hypo
gcgcagggcagcatta

SEQ ID NO: 73259 - DNA, 82 bp, Homo sapiens; identical to SEQ ID NO: 43163
  chr11:66557367-66557449
  hypo

SEQ ID NO: 73260 - DNA, 1097 bp, Homo sapiens
  chr11:66625090-66626187
  hypo
gacccagcccctccccgggccaggctcacagaagctggcttctgggactgtcctgggcccaagtgggcacctgcgccagccccacctgtgcctgggctgtggccccttcctacagggcgctcaccatggccccgccgctcctgctgctgctgctggccagtggagcggccgcctgcccgctgccctgcgtctgccagaacctgtccgagtcgctcagcaccctctgtgcccaccgaggcctgctgtttgtgccgcccaacgtggaccggcgcacagtggagctgcggctggctgacaacttcatccaggccctggggccccctgacttccgcaacatgacgggactggtggacctgacactgtctcgcaatgccatcacccgcattggggcccgcgcctttggggacctcgagagcctgcgttccctccaccttgacggcaacaggctggtggagctgggcaccgggagcctccggggccccgtcaatctgcagcacctcatcctcagcggcaaccagctgggccgcatcgcgccgggagccttcgacgacttcctagagagcctggaggacctggacctgtcctacaacaacctccggcaggtgccctgggccggcatcggcgccatgcctgccctgcacaccctcaacctggaccataaccttattgacgcactgcccccaggcgccttcgcccagctcggtcagctctcccgcctggacctcacctccaaccgcctggccacgctggctccggacccgcttttctctcgtgggcgtgatgcagaggcctctcccgcccccctggtgctgagctttagcgggaaccccctgcactgcaactgtgagctgctgtggctgcggcggctggcgcggccggacgacctggaaacgtgcgcctccccgcccggcctggccggccgctacttctgggcagtgcccgagggcgagttctcctgtgagccgcccctcattgcccgccacacgcagcgcctctgggtgctggaaggccagcgggccacgctgcggtgccgggccctgggtgaccccgcgcctaccatgcactgggtcggtcctgacgaccggttggttggcaac

SEQ ID NO: 73261 - DNA, 410 bp, Homo sapiens
  chr11:66626525-66626935
  hypo
ccagtacaacagcagcgaagatgagaccctcatctaccggtgaggatgcgtgccccacacccggctgcactcccggcgcccttcctccgccctctgctccccacaaggctttgcttccacccctcctctctctggggctgacaccccctccccgaccatggctgctggactcttggaggagcagtggcctggcctggcctggctgcctgagggggctggagctcaaggggcggcagaaggaccccaccccgagatgtcccaggtgtcactgagctgtgcaggcctccccggcagcaggtggcggttgggtctgtctgaagcacatggcccgcgcccgcgtgttatttctgcctctgctggtgccatccccccaccccattcccctcgcttgcctgcgtcctgtgccagtg

SEQ ID NO: 73262 - DNA, 79 bp, Homo sapiens
  chr11:66627238-66627317
  hypo
gtgcccatttctccacgctgccggcctcgcccctgtgccacgccctgcaggcccacgtgctgggcgggaccctgaccgt

SEQ ID NO: 73263 - DNA, 573 bp, Homo sapiens
  chr11:66631279-66631852
  hypo
tgctcatcttggtggcggccgtggggtggtctttgccgtgggcaatgactttgaccagcagggagtcgtagtggggcgagatgacggctccttggaaggcggaagcattatccaggcggatgcccatgccctctccgctccggaacacctgtgggaagggtgaggcgtgaggacctgcgccagaaactgcggtcaaaagtgccccacccaccccgaggctggccaggtgtgcacccagcagctgctgagagcagagcgtggggtgtctgcaggtgaatcccagctctggctggtcaggttttgctgtttctgccaccaaacccaggagtgcgtcccttctctacgtgccacgcagtcactgctactggctccctgtgaggagctgggagggggcagaggaggaagggaatgcctgccgcagagcgggagaggggcccgggcaggcaggggccagccctgcctctattcccacggacctgctgcacctgcctgagcaaccctctagcctttcagactcatccacgttcgttccacagcacggattgaggtctgctgacccggccgctaaagggc

SEQ ID NO: 73264 - DNA, 94 bp, Homo sapiens
  chr11:66633739-66633833
  hypo
cggatgttctcctgccgcaggcccaggtcgggtaggctcctgccctcagccacgtggatctgagcatggaccaggtctacgctgtagggcattg

SEQ ID NO: 73265 - DNA, 143 bp, Homo sapiens
  chr11:66637063-66637206
  hypo
ccctggtcgatgcctcgcattagctgtggctgaggccttgctgcagagtgcacaccccggccttcggcatggggaggtgacgcatcctctgctgcctataggccagggaagaagagggggcaggaccccgctgcacacctggc

SEQ ID NO: 73266 - DNA, 144 bp, Homo sapiens
  chr11:66648961-66649105
  hypo
tcaggaaggcacctacgacgacctgcaggctgaggcagggcgagggcctggccgtcacctgccccgctcctgacagagctgccgcttccatagcacacaacacatactcactgagctccacctggtgcccggccagtgccagtg

SEQ ID NO: 73267 - DNA, 30 bp, Homo sapiens
  chr11:66658260-66658290
  hypo
ccacctcccccgccgcggttgtttccaatt

SEQ ID NO: 73268 - DNA, 78 bp, Homo sapiens
  chr11:66683635-66683713
  hypo
tggtctttcccttagcgtaggtcaggccaggcccacagctgtagacagcaagcctgtcctgctcgttgccaagcagtt

SEQ ID NO: 73269 - DNA, 17 bp, Homo sapiens
  chr11:66683833-66683850
  hypo
ggcgtgagccactgtga

SEQ ID NO: 73270 - DNA, 408 bp, Homo sapiens
  chr11:66725945-66726353
  hyper
ttgggcagtgttctccgtcactcctcgcccctaggctctggactcctccctgtgcccgcctgtccgtcacgtttaagccttggcgccccacgtcagccccgcccctcccgtccccggcgagcgcctggataagtggcgaggctgggagagcccgcccctggcgcaccaccgcctactcccttgtctccggagcctcacgtgggccgccggaccctagccgacgcccgcaataggcggaagtggccgggctgtggctcgcagttattggctgtcggcgggggtggggacgttcgattcattcacccgagtagcacgtgtctcccgaagctgcaagcacaacagttcgcactggggctcaggcatcccggctagacgcagatacgcgctggctagcggagaagaggtcgc

SEQ ID NO: 73271 - DNA, 102 bp, Homo sapiens
  chr11:6676451-6676553
  hyper
acacagccagagagacgcccagggacacacaacctcccagtgacacgcactgacacactccgacgatgcactggaacacaacgctgtcgcaccccacacccc

SEQ ID NO: 73272 - DNA, 341 bp, Homo sapiens
  chr11:6676627-6676968
  hyper
cgctcacgttcacgcccgcccgggtcccgcaggcccaggccccccctcccccattgtctccggctcagaacaaagcccccggctccgccgccgctgccgcagcccaggggaggccggcgggcagggcgggcgcggccagacgggccgggcgggcgcgggcactgacctccgcgcgacgcgggctccctcgcccggtgctggggcgccgtccggccgcggtcagccccccgggcagcgcccgctcgcgcggggcctgaggccgcgcatcgtccgcagtcgctgtctccgaggcccgcgatcccctccgggcagccgccgtcggtccgcgcgcccttggccgt

SEQ ID NO: 73273 - DNA, 133 bp, Homo sapiens
  chr11:6677213-6677346
  hyper
cccaggccccggctccggatccggccccagcgccgcgccgcgcccccgtcccggttcccttcccttctccccgtcacttctcccgtcctctcctcccattcggttctctacgccctctcgtctcttccccttc

SEQ ID NO: 73274 - DNA, 590 bp, Homo sapiens
  chr11:66790528-66791118
  hyper
acccctgtccccaggcgtgggagcgaggggttgggcttggcctcagggcgtccctggatcccggacgcgcttggggatctccggctcggaccccaggagcagagacagcgctcgagcttgtcactttaaattcaagagggagcgggcgggcaagcgggcgagcgcgagggagcgcgcggcgggctcctgggagcgtgcccggactgcggcgcagctccggtccgccgccccggcccggccgagcccccggcccgcgccgcgctcctcggaggcgggagcccggcgacactgcaggggtggcgttgccgccggcggccgggctaggcgcaggtgcgtgcgcgctgcgggaggcgggccggcagctggagcccagccggagcggcggcccctccgcggagcccgggtgagtacgcaccccgccgacccccgtgcgcggccgggatcgcaccctgatcgcggacgcacgcagccccctcctcgggccctgggcccgggaccccagagccccgcgcactccgcgctcctgcacctccgcgccgcgcttgcacacgaacgaatgccgggcaccgcgcacgctgggcgcccttacc

SEQ ID NO: 73275 - DNA, 260 bp, Homo sapiens
  chr11:66791246-66791506
  hyper
cgccctgactgtcctcactgtccctgctctggcttcgcaccccctcccgacactccggtccccatacaccctggaggttcccgaggcaggagcgctgggtctgcaggaaccgtcccaatctggaggggaacgttgcaccccagcccgaggaggccctggccgtgtgaagagccagatatgaccctcagccgccggtggcaccagcctgagtggggggctttccagagcttaggagaggggtatggcggggcaggggagga

SEQ ID NO: 73276 - DNA, 241 bp, Homo sapiens
  chr11:66824362-66824603
  hyper
ccggccccgggatgacggcggcccaggccgcgggtgaggaggcgccaccaggcgtgcggtccgtcaaggtggtcctggtgggcgacggcggctgcgggaagacgtcgctgctgatggtcttcgccgatggggccttccccgaggtgagtgccccgcgcctccgcctcgcccggttccgctcgcgcgcccgggtgtacaggtccgtgccggagcggcccaggctgtgcgcctaacccggcct

SEQ ID NO: 73277 - DNA, 180 bp, Homo sapiens
  chr11:66897583-66897763
  hypo
ccaccccacctggctaatttttttttttttcttgcaccaaagctttctaaagttagtgatttatttctgacaagtttgcaaaacccaagagagagcagttttctgggttgaactcatacttcgtgtttactcgagtctgagtcacggcacctgacttcctcacaggtgcacctgactgct

SEQ ID NO: 73278 - DNA, 42 bp, Homo sapiens
  chr11:66897883-66897925
  hypo
gggattacaggcgtgagccaccatgcccggccttaagctctc

SEQ ID NO: 73279 - DNA, 295 bp, Homo sapiens; identical to SEQ ID NO: 43169
  chr11:67072101-67072396
  hypo

SEQ ID NO: 73280 - DNA, 183 bp, Homo sapiens
  chr11:67179695-67179878
  hypo
gtgcctgccatggatcggcggggaggacccacggtctccatcttgccctgccacccacttgaggttccctgaattcccacactgttccaggctcccagaggggtcagacttggactcacctgcatgggaaaggccctttcttctcctctgagcctcagtattctcctgcggataatgggatta

SEQ ID NO: 73281 - DNA, 264 bp, Homo sapiens
  chr11:67209957-67210221
  hypo
ggaacttggggttgacggcgcagaaggtgctgtcccaggtaacacgggacacgcgaatgtcctcatagcactggtcgttcttgaccggctgcccgaacacatgccggaatttgctctgccggaccactttgcggaaggacatgtctgcgggacagagaggcctgggtcagtccggcccatcccaacaactccagccctccccaggctgctgaaggtgagccgggaggatgcaaccgggggccaggccaccgtaaccctcctggg

SEQ ID NO: 73282 - DNA, 217 bp, Homo sapiens
  chr11:67230800-67231017
  hypo
agcctcttggttggccggtaggggagaccagctcagtgccggtttccttctccctccccgacagtgtcatgggaagagccctgggctacgttcctaattctacctaccacctgctggctgtccttgggtgagtcagtccttatctgtaaaatgggacggaggtagtgaagattacaagatataacccgtgttcagtgcttagcgcagggcctagtat

SEQ ID NO: 73283 - DNA, 206 bp, Homo sapiens
  chr11:67232077-67232283
  hyper
gccgcgatcacttctcgaagtagggcaggtagaagaactggaagccccggtggcccttgaccgcgcagtagatgaagatcacgtgatagactgcggggcggggcctgtcagcgcagaagccccgcccctccccgcaacaccgcccccagtgccgccccacagcccccgccccttccgccccggtgcccgctcgcacctccaggcac

SEQ ID NO: 73284 - DNA, 36 bp, Homo sapiens
  chr11:67258422-67258458
  hypo
gaagaggacaaagcccggttccgggggatcttctcc

SEQ ID NO: 73285 - DNA, 30 bp, Homo sapiens
  chr11:67291596-67291626
  hypo
cctgggtctgtcctccggggcccccagttg

SEQ ID NO: 73286 - DNA, 199 bp, Homo sapiens
  chr11:6731043-6731242
  hypo
actcctgaggtctctcgccccagtgccacccaacccactgacactaatcctctccaatcctaaccccaccttgatggcagcgctactctctccacttctatcacagaaatccccatctctacacaggcatctttgctttatcccaatttacctttttcccatcttttgtgtgatttcttgagaacggcctctgaatctc

SEQ ID NO: 73287 - DNA, 30 bp, Homo sapiens
  chr11:67378945-67378975
  hypo
agtctgtgtgtgagacggtgctgatggact

SEQ ID NO: 73288 - DNA, 155 bp, Homo sapiens
  chr11:67402314-67402469
  hypo
agtccatgagcagggcgtagtcggccagggagtccatgcccaggatcttcacctggaagggggggaacatcctcctgcgggagggaggtgctcagcagccggatgcggctccaaccctggcccctgcctcaccccgcccccgctgctcacacctg

SEQ ID NO: 73289 - DNA, 32 bp, Homo sapiens
  chr11:67408869-67408901
  hypo
acttaccacacagcacgcgcacagacacaggc

SEQ ID NO: 73290 - DNA, 128 bp, Homo sapiens
  chr11:67442012-67442140
  hypo
ctgctctgctgactgcgatcctcccaggagactggcagctcccaaaccaactcccgtgcccacgcctggcaatggggtaatcaatggggtgatgctcagtgttacccaacaggcgtggggcagggctg

SEQ ID NO: 73291 - DNA, 215 bp, Homo sapiens
  chr11:67462618-67462833
  hypo
ccccaaggcaagatccgccttaagccgtatgaggtagccacggaaccgcaggcaagactcactcgctcggtccagcagtaggacttatcatgatttacacaagcaacaccagctgcagtgaggcttgtgactattcacacacacttttaacctccagaatatcccgaccaccaagcaagtactttgtcgcacccttgcgacgtttctttactttg

SEQ ID NO: 73292 - DNA, 491 bp, Homo sapiens
  chr11:67478792-67479283
  hyper
ataggaggtgcaaagcgcggtcacacgcggcccgggtccgcggccgacagctgggaggatctggagcggggccgggtcgcaagaagaccctgaccctgctcccgcgctggggcgcgtgctaagggcccgcagggtttcagctgtattttcgaacccctgtgcttggccgaggggttcccaaggctccactccgccttggagggggctgcggaagcccggaggtgacccgggctctgggaggggcgtccccaatgtgggggaggggagacaggggcctttgaatacagcgcgggactcagagggggtccccccgacctaagacgtggtaaactgaggccggcgaggagggaggctgagtccggggaccaggcggcccctcactgctcctccggtccgtctcccctctgcgcctgttcgtacgggcagggccggcggccgagtccagcgggctcggggccaggcctgggccccgcgggcggcgcctcctcctc

SEQ ID NO: 73293 - DNA, 24 bp, Homo sapiens
  chr11:67479341-67479365
  hyper
cggtaaccgcgcaccttgtgctgg

SEQ ID NO: 73294 - DNA, 232 bp, Homo sapiens
  chr11:67764062-67764294
  hypo
ctgtacttaccaaggcgataccagtgcaggcaaagagcacctcgaagccgctgtagataaagaaaggcacgaggtggcgcaggcggtagtcacgcacgtgcttgaagggcagctggaagatgttgccccagcccacgctgcgcagatcgatctcctccgtgggccggtaagcggctccgcacaaacccagcacctgcgaacccattacttgaaggggcggccagccaggccc

SEQ ID NO: 73295 - DNA, 147 bp, Homo sapiens; identical to SEQ ID NO: 15585
  chr11:67781462-67781609
  hypo

SEQ ID NO: 73296 - DNA, 146 bp, Homo sapiens
  chr11:67797137-67797283
  hypo
tgtcctccctctgcacgggcatgggacatgccctctgcctccttcctgtcctggcctgcccaactcctacctaccctcagcgcagatcctcccaacacacacatgcaggcagcctcggggcctctgcgggtccctctaccacagca

SEQ ID NO: 73297 - DNA, 154 bp, Homo sapiens
  chr11:67811705-67811859
  hypo
cctgaaccagtgcagcgtgagcaccacgcacaagtgcctcattgccgaggcctggtgctctgtgcgagacctgcccgccctgcaggaggccctgcgggacagctcggtgagcagcctgaggcctcgccccctctccgcccgcccctcctaccag

SEQ ID NO: 73298 - DNA, 23 bp, Homo sapiens
  chr11:67865088-67865111
  hypo
caagactccgtctcaaaaaaaaa

SEQ ID NO: 73299 - DNA, 405 bp, Homo sapiens
  chr11:67895795-67896200
  hyper
accctcctcccccagcgctactgcccgggccgaattccaaggccagcggctgcccgctgagaaggaatccggaccaacgggattctggcttccctctggcccctcctggcgagagcggcgccgggaggagggggcctcagaaggggcgggcaggggcggggcccgcggggtaggcggagctcccaggaaaacagcgggcggggcctcgcgcgaggggcggggttggcggcgaggcgtcccaggacccccattcctccctccgccccggggcttctggggagcggcgcagcttgactgccaccgactgcgggcctccctgccctacaagcccccacccccgcccccccttgggacctggcgaggagttgccccgcaaagttggggctggtgcggggttaaggggat

SEQ ID NO: 73300 - DNA, 187 bp, Homo sapiens
  chr11:67915941-67916128
  hypo
ttttgagtgaccagccgttattcggcactcaaatagggaaggctgtcaggggagcagctgactgcagagagactgccttggaaggaggagaggcccgggggtggagcggaggtttcgggtaaacagaggcggcctgactgacagaggggcatcagccaggggaaaatagaaccgggatccaggatcg

SEQ ID NO: 73301 - DNA, 68 bp, Homo sapiens
  chr11:67984320-67984388
  hypo
ggagggagagtggggcgtacccggctttcccagtggcccctctgggcggctggcgggtttcctggtca

SEQ ID NO: 73302 - DNA, 45 bp, Homo sapiens
  chr11:68096122-68096167
  hyper
atggctcaggggcaccgcagtctgcacctccgtccctggatccgt

SEQ ID NO: 73303 - DNA, 154 bp, Homo sapiens; identical to SEQ ID NO: 15587
  chr11:68111091-68111245
  hypo

SEQ ID NO: 73304 - DNA, 236 bp, Homo sapiens
  chr11:68132977-68133213
  hypo
ttcagaaacaagtgacggtcctcttctggaaccttctctcactctgtcctggttttctcagtccacactcgctgtgaggaggacaatggcggctgctcccacctgtgcctgctgtccccaagcgagcctttctacacatgcgcctgccccacgggtgtgcagctgcaggacaacggcaggacgtgtaaggcaggtgaggcggtgggacgggacggggcgggcgggcggggcggggc

SEQ ID NO: 73305 - DNA, 30 bp, Homo sapiens
  chr11:68133516-68133546
  hypo
ttccaggtgtcggttcggggcgggcccttc

SEQ ID NO: 73306 - DNA, 81 bp, Homo sapiens
  chr11:68210051-68210132
  hypo
gtgttttcgtaagcccgaaagatagcatctgaagagtcaacattgagccttgccttttgctgctaacgatgtataaaagct

SEQ ID NO: 73307 - DNA, 76 bp, Homo sapiens
  chr11:68225302-68225378
  hypo
ggtgctccctgctctcgcttccagccatcttctctagagtatggccagcccttcttctgcccggaagctttccttg

SEQ ID NO: 73308 - DNA, 42 bp, Homo sapiens
  chr11:68226707-68226749
  hypo
gtgctgggattacaggcgtgaccgcgccgtgacctcctgtgg

SEQ ID NO: 73309 - DNA, 82 bp, Homo sapiens; identical to SEQ ID NO: 43183
  chr11:68385159-68385241
  hypo

SEQ ID NO: 73310 - DNA, 201 bp, Homo sapiens
  chr11:68385532-68385733
  hypo
ctgcctttcctaccccgccaaggaggagagaccgaggagcagggcatgctctgggctccagcctggatttgcccgcccatggagaggacacgttccggatcgtcctcttccacacagtagactctgtcctgccgaagggagaagtctgcatccctgggttagacacgtctcatggagtcctctgcccgtgaccaggggggg

SEQ ID NO: 73311 - DNA, 30 bp, Homo sapiens
  chr11:68400244-68400274
  hypo
cttcacacggatgcacgtgaaatttaccac

SEQ ID NO: 73312 - DNA, 30 bp, Homo sapiens
  chr11:68409085-68409115
  hypo
caggagacagctgagcgccagggcaattta

SEQ ID NO: 73313 - DNA, 38 bp, Homo sapiens
  chr11:68409607-68409645
  hypo
gacccttctccccaacgaagcttcgcactgccaacgcc

SEQ ID NO: 73314 - DNA, 30 bp, Homo sapiens; identical to SEQ ID NO: 43185
  chr11:68412854-68412884
  hypo

SEQ ID NO: 73315 - DNA, 197 bp, Homo sapiens
  chr11:68417837-68418034
  hypo
aggccctggggacatcgtggccctggggacatcatggtccctgcctccatggagctgacgctctagaggagccggacacaaaaggcaaaatgaaagcacgcgagcttcatcatcagccagactacaggcttaaaagagcgttggcgccacaactaaaattcaactggcggtgggcgcggtggctcacacctgtaatc

SEQ ID NO: 73316 - DNA, 41 bp, Homo sapiens
  chr11:68418419-68418460
  hypo
tccctgtccccctcccgaaggcagcccggccgagggcaagg

SEQ ID NO: 73317 - DNA, 242 bp, Homo sapiens; identical to SEQ ID NO: 43187
  chr11:68432989-68433231
  hypo

SEQ ID NO: 73318 - DNA, 456 bp, Homo sapiens
  chr11:68437415-68437871
  hypo
ttctagaacaaggttcgaactctgttcctgcaggtggcctgaccgcccccaaaaggccttcccacctgggggctgtggacagtggaaggcgagcgtcctcctggaaggttttcaggcacaagggggaccaaattgtggacacgcgtgaacaggtcctgggagtgagcaagaacccctgaggcccctcccaggaagaggttcagcaggggacagcatagccagaccgtccacagtctcggcggaccaaggccacgccacagacgctccaccccaggtggagaagaggcggctggcaggagtcctttctccgggggcccccccgggcacttcacagctcccccgcacgctagagctgcacgttagagctgggccaccggcctcgagtttcctttcatccccacagaaccagctctcgaggggccctgggcgtggggaccaccccgccctgcctcttgc

SEQ ID NO: 73319 - DNA, 878 bp, Homo sapiens
  chr11:68451662-68452540
  hyper
ctggggctgggaccccggggggagcagtggggttgacgccacagcgatgacttgggccacgggtctgggggctctcccgcggggcgattgggctctgtctttcgggattagggtctctcccacagggtttggggttctctctgcagatttgggggagtctctcccgcgggatgagggggggctctccgccgcacccgcctatgatggcccagaggacccgagctcgggtcactcccgtcgccctcggggctcggcgagggtgcaggaggcgggcgctgagccggtgacgcgactccgggcggctcccgggtgcgccgcatatatagcagcggcggcggtggcggcggccacaccgggcggcggacacgtggagggacccggcccgcgccttctgcccctgctgccggccgcgccatgcggtgagcgccccaggccgccagagcccacccgacccggcccgacgcccggacctgccgcccagacccgccaccgcacccggaccccgacgctccgaacccgggcgcagccgcagctcaaggtactactggcgccgggccgaccctgcgcccccgggaggcctccccttcggctttcctctgcccagggacggttctgccagggccctggcccggccgccgcctctgctcctccccgcagccccggcactccttgcctcggggcgcagcccactccgggttccgacccgcccgccctgtccttcccttccagatggcccgaggcagcgccctcctgctcgcctccctcctcctcgccgcggccctttctgcctctgcggggctctggtcgccggtaagtgcggggcgcgtctcctccgagcgaaggggacatcagagccggccgggcgtggagggcttcct

SEQ ID NO: 73320 - DNA, 319 bp, Homo sapiens
  chr11:68460889-68461208
  hypo
gcactgcacatggctcgcacgagcctcctgagcagtgttcaaaaagggccaaggagcccagcctccatgcaggtgtgcggcctctgtgcaggggtgcggcctccatgcaggtgtgcagcctccgtgcaggtgtgggacttctgtgcaggggtgcgggccccagggtcagcagcacaaaggtgtcggactctccccctgtggcatcatctacctccttgtctaaaccttgccttccttttaggtataaacggagtgtggcaggtggcagccagaaggtgagggaaaggaagtgaggggccaggagcggctgtggtgccat

SEQ ID NO: 73321 - DNA, 36 bp, Homo sapiens
  chr11:68564345-68564381
  hypo
accatgagcggccctcgtcctcggaggtagatgtac

SEQ ID NO: 73322 - DNA, 153 bp, Homo sapiens
  chr11:68607258-68607411
  hyper
gaggcccaacttgaccgctcggtgaccactggtccggggccggggccaaacgcagcagccgcagcagtatcggaagggacccagtttaattctcttcccctccagggtaggcggcttgtttttagtaccaactcgaaacgttattttggcctg

SEQ ID NO: 73323 - DNA, 30 bp, Homo sapiens; identical to SEQ ID NO: 43189
  chr11:68672906-68672936
  hypo

SEQ ID NO: 73324 - DNA, 30 bp, Homo sapiens; identical to SEQ ID NO: 43190
  chr11:68692056-68692086
  hypo

SEQ ID NO: 73325 - DNA, 38 bp, Homo sapiens; identical to SEQ ID NO: 43191
  chr11:68771669-68771707
  hypo

SEQ ID NO: 73326 - DNA, 76 bp, Homo sapiens; identical to SEQ ID NO: 43192
  chr11:68804728-68804804
  hypo

SEQ ID NO: 73327 - DNA, 30 bp, Homo sapiens
  chr11:68902975-68903005
  hypo
agactctccatgccccgatgaagttgtgag

SEQ ID NO: 73328 - DNA, 172 bp, Homo sapiens
  chr11:68965052-68965224
  hypo
ccccagtggtggatccgtttttggtcctcatagctctgccttttctagaatcgcatcaatagacccatgcagttggcagtctcttcagtgtggcttctttcactttgtattatgcctttaacatccagccatagttacagggacatcgctggcacctcgcaggctgggtggc

SEQ ID NO: 73329 - DNA, 30 bp, Homo sapiens
  chr11:68975015-68975045
  hypo
caagctgagaggtgacgtcaggactgaact

SEQ ID NO: 73330 - DNA, 376 bp, Homo sapiens
  chr11:69192450-69192826
  hypo
taccaagggcggcgtcgcacaaactgtgggattaggtggcagaggctgttccgaggctgctccgatgtgtgggaactgagggggttcccaggatgtgagactttcagtgctgaaactgggaaagtcctgggcgagccgggacaagtcgctcaccctactagagacagttgggcgaaggagacacattgggatcagtctcccatggccttcaagtgtcagggcaggggctggggacctcccatataacgagcagcctcaggagactccaggcaggcaggagcgtcgggggctgcgactccagaatggccaaggcttctaccgtccagcccctttgtaacacagagcacccaacgggcgcagccgcccccatgcctca

SEQ ID NO: 73331 - DNA, 30 bp, Homo sapiens
  chr11:69193336-69193366
  hypo
gagccctgggccaggcggttctggaggctg

SEQ ID NO: 73332 - DNA, 30 bp, Homo sapiens; identical to SEQ ID NO: 43195
  chr11:69206384-69206414
  hypo

SEQ ID NO: 73333 - DNA, 148 bp, Homo sapiens
  chr11:69227108-69227256
  hypo
gaaccaaatatcatacgagatagacagatagattaataggttacctctgtgtggagtaacaggccatttcaatttttaaatgatcctctggctggcagcagagctggggagcgcaaggcggtgctcattaatagcagttggggccggg

SEQ ID NO: 73334 - DNA, 30 bp, Homo sapiens
  chr11:69253125-69253155
  hypo
actagggtgagggcacgggattgcagtggg

SEQ ID NO: 73335 - DNA, 94 bp, Homo sapiens
  chr11:69269195-69269289
  hypo
agcctacacagacctcgtgagctgatgagtctcaccatcttattatttattctttattattaacaaagccagacatgcacgcaggactccccgt

SEQ ID NO: 73336 - DNA, 111 bp, Homo sapiens
  chr11:69279556-69279667
  hypo
gagcccacagaccaccgggaggcccagccaggggctgtgggagatggagctgtgctggagccactgctgagtgggtgatgggtggggccggagcagcgccgtatgcaaaga

SEQ ID NO: 73337 - DNA, 190 bp, Homo sapiens
  chr11:69280486-69280676
  hypo
aatctgtccggggtgcggtctgggcatgaaaagtttttcaggctctccaggtgattctcgtgtgcagccaagttagagaacactgactcccggggaggtggattacctgtcctcccggcaaagcgcaggactcgcagtttggcaagcttccagcagcagcgagttcgggtggctccgtggggagccttac

SEQ ID NO: 73338 - DNA, 67 bp, Homo sapiens; identical to SEQ ID NO: 43197
  chr11:69339948-69340015
  hypo

SEQ ID NO: 73339 - DNA, 167 bp, Homo sapiens; identical to SEQ ID NO: 43198
  chr11:69360946-69361113
  hypo

SEQ ID NO: 73340 - DNA, 30 bp, Homo sapiens
  chr11:69431611-69431641
  hypo
gcctcacagggtgcacggtctactgcaagg

SEQ ID NO: 73341 - DNA, 91 bp, Homo sapiens
  chr11:69452198-69452289
  hyper
ggccaggcctgactgcgggggagagggccgaacgtgacctccgaggtcacccccagccagctttctctcctgtggtcggaagtggttttct

SEQ ID NO: 73342 - DNA, 711 bp, Homo sapiens
  chr11:69452657-69453368
  hyper
ctaattgatctggagcggaaacgcacgtctgcggttggggcgatggggggggcggtgcggctgtccatgtgccgagcgtgtggctgtctcgggtgggcactggggccggagttcgccccggcccacctcgcagttttggggcgcctgggatcggcgctacgtaagcgaagcagagctgccatagcacgtgggccgccacgcgcaccccaaaagcaagcagtgtggggggaaggggagctcgagcgccttcggagcccaggggccggctttcggaagcgttttcccgggcgacttaagggcttaacaatggaaaactcgcggagcctgagccaagtcctttcaagtcgccgccaggtatgcggctgcaggtgaccccacctgggtgcgcccgcccgccagccgccctggtggaaaagcgggtgcgggaggtcgctggcgaaaggtcgggactggtccctgcaccacccgcccccaacccaagccccgagccccgcggcgcgcagccgcgctgagtcccggggtctgcgtcgcggcgcgccggttcctgaatgaacgcgctcccttcccccgcctgaatgaaggttcccacagccagggacggtggcgaacacgcgcctgcagcggaattcgctttctcctgaccgaccatccgcccaggccgcggtcaccggggcgggggccagggggcgaggaaagcgtgaaggtgatttc

SEQ ID NO: 73343 - DNA, 48 bp, Homo sapiens
  chr11:69458766-69458814
  hypo
aggcccggcagcccccggcctccccttgagagccggctccttaggtga

SEQ ID NO: 73344 - DNA, 64 bp, Homo sapiens
  chr11:69466049-69466113
  hypo
agggcgccaggcaggcgggcgccaccgccacccgcagcgagggcggagccggccccaggtgctc

SEQ ID NO: 73345 - DNA, 59 bp, Homo sapiens
  chr11:69468423-69468482
  hypo
ctcttctcttccctgcgcctgtgatgctgggcacttcatctgatcgggggcgtagcatc

SEQ ID NO: 73346 - DNA, 714 bp, Homo sapiens
  chr11:6947603-6948317
  hyper
agagttccaagtgtgcggcgtgggcggggcctgcagaaagggacggggcctgcagaaagggacggggctggcaaaggcctggtctacctcaccgatccgggtcgcgggggctcctagggggttccttccacagctggtgcgcgtgcgcaagagtgcgtcgaggttgttccgcggcaatttatgaaactcggagccggcagtgagttgagggttcggcgaggtcagggattcctagttgcagcgtgattaccaacgccagctcccttcactgtccaagacagcgattccgcggctcctctgagaactggcgcttgtgagtgactgaacgggccactggagaggagcggtgctcacgggtatcgttctcgtcagcgggcggtggggacgcggggtcttggaattgggaatcacgcttgagggcgtccatgcggaacgtgcagcttacctcagcttgcttgcagttacccagtttccacgctgccctccaaggtctgtgccggaaaacctggaggagggcgcgagctgacgggagggatggaaacgtgggctgcggaagtaagacaagcgttgagagcagcgacagagggcgagggggtgggcggcgggacggctggggtcaggatccagctccgctaaagcaaggatttaaccacactcctgtcgcctcttccactctgcaataggggcagtctccagacgcgcagagtggttagt

SEQ ID NO: 73347 - DNA, 32 bp, Homo sapiens
  chr11:69481718-69481750
  hypo
accaggcaatcccttcgcgtctcccctccctc

SEQ ID NO: 73348 - DNA, 154 bp, Homo sapiens
  chr11:69498956-69499110
  hypo
tgaggcagccgaggacgcatagtggctaccggggacccagccctgccatggcctgaggcattgtccctctaggtgggagcgtgtaggactcatgcacccccccgggaggctccaagagagtcccccatttgacctacaccccttatttcttaga

SEQ ID NO: 73349 - DNA, 472 bp, Homo sapiens
  chr11:69516989-69517461
  hyper
aaaacctgaaacaggcgctccgagtacacggagcacggcagaggcaccgagcaattttgagactctaaaatgctttgtcccgctgttcacaaaggagctggttgggccggaggcggccccgcctctgcatcctttctggggtgggggccccgggcaggcgcggccacccccgccctggcccctgctccgccagggagtccggggctgcgtgtgaggcctgcgcgggccgagacctcacacagcctcctctgcgcgcggggccgcgggaggggcgcgggttcgttcctttgaactcccagcctttgttcccggccaccagagccccagcgctcgtacacttccggccccgggacctctgcggttacctgggccttccctgccagcccccaccccctgcccccaccagaaagcgtttacaggacaggtgaggcccgcaggaggaaaagcactcccctggcgcaacatgactcca

SEQ ID NO: 73350 - DNA, 478 bp, Homo sapiens
  chr11:69517719-69518197
  hyper
aatatcaaaggaggccgaataatgggtttcctcggtccggctaggccggcctttgactcaattggaaatgcaaaggcagcttttgcctattctctggctgctggctgagaccctaaatttccgtaggaaatcgtcggacatgcacttaatcggtctttgcaatctttccctcgaagttgcacgcgggtctgggcggaggaggcgaggaaaccctggattcgaaccagcgcctttctctccttcaggcctccgcccggggacaggcgccggtcccccgccccggcgcatccgccccgtggggacacttaccagcccctgcatcttgccgtcggcgcccatgcagaggtaccgcacgctgtgcacgcccttgatggccacggtccgcagagcgactgccttgatctccagcaaacctaggcgcaggggaagcgagaagctgcagcaaggaccgctgggcccgcaccacgtgggtgcggtc

SEQ ID NO: 73351 - DNA, 418 bp, Homo sapiens
  chr11:69518198-69518616
  hyper
gtccacaagcctgtgcttctccctagcgtcccgcgctgtttggggactaacggagggatcctaacgtccaggtgccaaaacctggggttcccaggagttgaggggtccgcaggagcctaagggtggcaaaggaaggaagggcgctggggtggggcgcgcgcagcggggtggggtgcgcgcggcggggcgggcgggggtgctggcgggcactcactgtgcgcgctctggccccgcgcgcagtccacgacgccgtcggcacggatgcgcaggaagcagctggagagcccgtgggggccggaggtgtacaggtgccgcaggcggatggggtcgccccagccgtagtgcacgtggggccccgcgtccgagaaggcgagggggcgcccggccacggccagccagaggccggccaggatccata

SEQ ID NO: 73352 - DNA, 870 bp, Homo sapiens
  chr11:69519059-69519929
  hyper
ggaactcctccccaccgcgcagcggccccgaggttcttggctgggagagtttgactttgtaaagcaatcgacaactggggcccttcccccaggcctcaggctcccagtggatgcactcggcgtggggcactagcgggggcggggtcaggaaccccggggccagaggttggggggcaccgagttttgcccccttcaccctctgtcgggaaaagcctcacctcggccttagtgcccttccccttaaaagcccactcgcactccctcccccgactttcgcagccccgcacatctgacgtcaaagccgtcccgtagaattttccccggcagttccgacagtctcaggttctttcagcttcatcttcttgcaattcctgccccgccccttttatccgggtaaattgccccccgacggggggccgggcgcgctctcggccggcggggaaacaatggaagccgcgcggactgtaggtggcgccgcagcctcggcgtccgcctgggctttgcgctcctggccccgcgcccctgcctgctccgcgctcgccccggccccgcggctgtgcgcgagatgcaacctgaaagggggcactgggaaggaggctctcgggcagggtgggcgggccagctgcgggattggtgaaccccagcttctcggctggagggtggtggaggcaggggcgcagggagggaggcctgggcctccgtttcccgttttttgagctgtcttgtgtcgggggtctggtttttgagtccccgagtccctgcgcacggggtcaggaggaacagcacggtcggggaggtcgagagcgccttacctggtggggaggggtcgggaaggggcccaggaacggtgatgggcgcccctggcgtccg

SEQ ID NO: 73353 - DNA, 101 bp, Homo sapiens
  chr11:69533072-69533173
  hyper
tctcacaccagcccacgagggggcaggttttcctgcctgaggccacacagctcttcagctgcagggtggggactcacagccgaccgcgggactctgatgag

SEQ ID NO: 73354 - DNA, 670 bp, Homo sapiens
  chr11:69588847-69589517
  hyper
cgaagatgctcaccacgccccgctccacgggcgagagctccagcaggcctgggggcggggcgcaggtcattgcggggcaggtgatccctggcccactccgcccctcggcttgttcgcctccggggaccctatttctggggtggggttggggataaagggccagggttcccggcgcagccgcccccaagggcctccagagcccaagctgccctctagggcctccggagcccaagcctgcgctagctcagattagcttgcctgtgtaggggacccccggcggccgcacccagtcccggaccttcagacgcgagcccgaccccagcggttccccagcctgggccaggccggggcgcgtgtctcgggccccctgtggctgcaccgcgcgccctgtgcccacgggcgaaggcgctggaattcggcgctcggagcccgagtttctgaaggcgggaggcggcgcccgacctcaggggttgcgctgggctgccggagccaagagtgtctgcgtccccagccccgcgtcagaagggaccggagcccgagtccgccccggttcccggggcccccgagcaggtgcccgccgagggtctcagagtgtgactgagcgggttggcccggcggccgttgccccccgcccccgccccttcgcgcctggccgcgccactcactgtcg

SEQ ID NO: 73355 - DNA, 367 bp, Homo sapiens
  chr11:69589746-69590113
  hyper
tgggtgcagtgggtgcggcggcgccccctcggcccgcccagggcgccagcaaggccagcaggaccgccgggagcagcgctaccgcggccgtcccgggccccgacatcccggcccgagggccgtgcgtcggtcaggcggtcagtgcgcccgggaagctggggggcagagctgcgcctgtggcgtcccgcgggagcgcacggccgacctcgggcaggagtgcgcaaccgaggaggtgcgggaggcaagcgacggggcccccgggcgccgggctctaccccggctgcatggagcggcgagccgggcggaaagcgcgcggctggagctgggactctgaggagcagtgcgcgcctccctgagcgccaggccc

SEQ ID NO: 73356 - DNA, 521 bp, Homo sapiens; identical to SEQ ID NO: 33939
  chr11:69590114-69590635
  hyper

SEQ ID NO: 73357 - DNA, 99 bp, Homo sapiens
  chr11:69611957-69612056
  hypo
gcgccaggctggctctttgttgcttacattgtgtgagtgcctcactggtgtcagccgcacagacccaagggccggcccatcccacgtcctctccctgca

SEQ ID NO: 73358 - DNA, 30 bp, Homo sapiens
  chr11:698834-698864
  hypo
gtcaggccttgctcacggcccctttctctt

SEQ ID NO: 73359 - DNA, 184 bp, Homo sapiens
  chr11:69970448-69970632
  hypo
ccctcagctcctgtacgaagagtgggcacgctatggagttttctataagtaccagcccatcgacctggtcaggtaagaacgcgccacagcctgcgggaatcaagtccctactccgatggcagtcggataacatccctgtgggtttcaaccgctctgaatgttcagtacccgggaacgtgtttga

SEQ ID NO: 73360 - DNA, 50 bp, Homo sapiens
  chr11:70005678-70005728
  hypo
aggatgtgccccacacgcccctggtcctggggatgcgggggagatggacc

SEQ ID NO: 73361 - DNA, 36 bp, Homo sapiens
  chr11:70017163-70017199
  hypo
cggcagaaccggttccgagtgcgtgctgggtttggg

SEQ ID NO: 73362 - DNA, 30 bp, Homo sapiens; identical to SEQ ID NO: 43204
  chr11:70022959-70022989
  hypo

SEQ ID NO: 73363 - DNA, 30 bp, Homo sapiens
  chr11:70023256-70023286
  hypo
ctgagtcctgcacttcgacggccctgaact

SEQ ID NO: 73364 - DNA, 265 bp, Homo sapiens
  chr11:70050901-70051166
  hypo
attgcattttaaaggcggtctacgaaacatagctgacatttgagatgtatgtgtgcttggttttatttatatcgtcatgtagttactgtgtgctgggaaaagtacaccagaaggtgagcggtgggtatggacaggttggtagcgggcgactctgccttcctccccagaagttcagcatagcggttaagggtcgactctggcaccacactcttagggtttcagaacatggctctgccatcgtctagctacacgatctcaggaatgt

SEQ ID NO: 73365 - DNA, 42 bp, Homo sapiens
  chr11:70098175-70098217
  hypo
tcctttctgcagctccgcctctcccagcggctcctaaacccc

SEQ ID NO: 73366 - DNA, 38 bp, Homo sapiens
  chr11:7041865-7041903
  hyper
ccaccgcgacgaccccgaggaaacgctgtcaggtcgcc

SEQ ID NO: 73367 - DNA, 66 bp, Homo sapiens
  chr11:707906-707972
  hypo
gcaaacactcaggctcgccactgagcccgtgaacattccagacattctccacggatagatggatgg

SEQ ID NO: 73368 - DNA, 98 bp, Homo sapiens
  chr11:71098921-71099019
  hypo
acatcccaagagtcccgacgtcctgatagtcccaacatcccaacagtcccaacattccgacagtcccaacatcctgacagtcccgacattctgacagt

SEQ ID NO: 73369 - DNA, 30 bp, Homo sapiens
  chr11:71108366-71108396
  hypo
agtaggagcctgctgcgccccaaccaggca

SEQ ID NO: 73370 - DNA, 57 bp, Homo sapiens; identical to SEQ ID NO: 43207
  chr11:71117658-71117715
  hypo

SEQ ID NO: 73371 - DNA, 185 bp, Homo sapiens
  chr11:71192648-71192833
  hypo
cctttggaggctcagcggaacccagcccatcagcattcagggtcacgctcaccatcttgccagcattgtaatcatgcgtatctgcagttcgtcggtggagtcagcctctgacacgccccgcagtgaagtgtcttttttccctctgaaaaatccattcatcctgccacgtgcgggtatttgtcctg

SEQ ID NO: 73372 - DNA, 54 bp, Homo sapiens; identical to SEQ ID NO: 33940
  chr11:71274712-71274766
  hyper

SEQ ID NO: 73373 - DNA, 536 bp, Homo sapiens; identical to SEQ ID NO: 33941
  chr11:71318274-71318810
  hyper

SEQ ID NO: 73374 - DNA, 105 bp, Homo sapiens
  chr11:71318952-71319057
  hyper
cgctccagatccccccagctctcggcggcggacccgggccgcgtgtgagcgcgctttgcacctcctatccccagggtccgccgagagccacgattttttacagaa

SEQ ID NO: 73375 - DNA, 19 bp, Homo sapiens
  chr11:713388-713407
  hypo
tttgtgtgtttgagacgga

SEQ ID NO: 73376 - DNA, 98 bp, Homo sapiens
  chr11:71507939-71508037
  hypo
ctgcacacagagacacggacaagccagtgcctgtccacgtggggcagcccgttaactacagagccaacaaacaagccaggacacgaagacatactggg

SEQ ID NO: 73377 - DNA, 29 bp, Homo sapiens
  chr11:71781578-71781607
  hypo
cccagtggctcacagcggtaatcccagca

SEQ ID NO: 73378 - DNA, 30 bp, Homo sapiens
  chr11:71792634-71792664
  hypo
ctcttccaagacatgcggttagcattagat

SEQ ID NO: 73379 - DNA, 30 bp, Homo sapiens
  chr11:71850743-71850773
  hypo
agtcgagggagcggccgctgcatccagatg

SEQ ID NO: 73380 - DNA, 30 bp, Homo sapiens
  chr11:71939243-71939273
  hypo
catgtgcacacgtatcgcattctgcctgat

SEQ ID NO: 73381 - DNA, 203 bp, Homo sapiens
  chr11:71951172-71951375
  hyper
ccgccgcgcccttggcgctggccgcgcgctcctgtttgcggaacttggcccggcggttctggaaccagacctgcgggcacaggggccagtcagcctggacgagggtcggagaacgcacggggtcagcccgcggccgcaaggctcgagtgagatcctggttcggaaagaaccgggcccgggttcttactagttggaggggcctt

SEQ ID NO: 73382 - DNA, 332 bp, Homo sapiens
  chr11:71951406-71951738
  hyper
cgctccactggcccctgcctccagatccctgggttcttgcccttgggatccactcacccgctgactctgctgcctcccagcactcttggtctcccggaggggaccctgccttcgttctcctcactctaagttcttcccccaattccttcttttaggaagctctgggacttccctcctggagtgttccagggccgtggagagcagtttagggcgccagtaaaccttttgtctagggcatccagtcaaggcgggccaactgaacatctgtacacggagttgtacaaatagacaacagtctgctctagcccggctctcttcggccctgtgcctgc

SEQ ID NO: 73383 - DNA, 282 bp, Homo sapiens; identical to SEQ ID NO: 33945
  chr11:71952135-71952417
  hyper

SEQ ID NO: 73384 - DNA, 83 bp, Homo sapiens
  chr11:71952458-71952541
  hyper
cgtcttggtcccggcagcctggggccgagcgtcctccctattactcaatggagccggcgggataaaggcggagggagatcagg

SEQ ID NO: 73385 - DNA, 231 bp, Homo sapiens; identical to SEQ ID NO: 33947
  chr11:71954593-71954824
  hyper

SEQ ID NO: 73386 - DNA, 119 bp, Homo sapiens
  chr11:71955006-71955125
  hyper
cgccacgcacgagtcgtacgaattgaggtaggagtagtccatcggcccggggggcgggggcgggggccgggccaggccgggtcggggtcggggtccgggtggaggtcggaagggaggtt

SEQ ID NO: 73387 - DNA, 330 bp, Homo sapiens
  chr11:71955189-71955519
  hyper
cggccgcactcagcccgggtgcaacgcaagtgcagccagcccggcccgcgcgccttttaacgcgcaggaccccgcggaggggggcggggcggggcgagctccgaaggggcggggcctaggaggcccagacaccgcccaaagccgccccgacccccaccccgaagggtccccgccgccgtcttagggctcagaggtgtggagctgggatgcgcgggaccctatccccggagtccctatcctgccccaatccggaccagaccttcggtctctacacagcgtccgaggccagagggtcccgacccttttcccgggcctccccacctgcggccc

SEQ ID NO: 73388 - DNA, 50 bp, Homo sapiens
  chr11:71955549-71955599
  hyper
cgctcgtgtgaagaagttaattcaattcgctctgataaccgagttattcc

SEQ ID NO: 73389 - DNA, 777 bp, Homo sapiens
  chr11:71955600-71956377
  hyper
atctggcccctcagccccgcccccagcgaggtcccatcccggcggagactgcggaggcggcccaggaagggggatggagaccgggaagagacggagcctgggatggggacagggaagggacgtggatagacagaggaaacagagaccgggagagaaaggggcagaaacagtgatggagacagggacaagagatacaggtacacagagggagacaaggacggaacatacacagcgaaagacaggatggagcggggacagggcagagacaggagatgagggtaagagagagacaggatggagcggggacagggcagagacaggagatgaggttaagagagagacaagaggagacagggagacagggggacgagaaagagagtgagggaggcatggagacagaaggggtcgggatgagacatggacggcaaccaggactgcggtggagagcaagggagggatgagacaaaacagaggcaggaatcgtgagacagacacatatgcccagggacagtctgagagagacagggccagggacagccacaagcgcgggagcagaggctgagagcggagagaaaacgcctccggggagcttagacacgagggctggagcgcagaggggcccagggatgatgctggaggctctggggtgcggcctccacggggctgcggagagggagggtcgtgggagccaggtccctctaccctgacttgtcccgaggcccacacgaccttgcaccttcagggcccgcctgcctctccccccgttccctcagctcc

SEQ ID NO: 73390 - DNA, 269 bp, Homo sapiens
  chr11:72109412-72109681
  hypo
gggttcgaatcaagtcgcccgagagcggatactcagccattgtgtccagttttaatcctgtgttttcccaagtaattaagccttcttgcttatgaacttgtgactaagtaaagcatcaccgagaggttgtaacatcaaagtgccttccaccgtctgtccgtgtttggtaaaattggatttcttttccttcttaaagaaaaactaattgaatttagctgaaggctgtgtatatttgcacaagccggtgaaggctacgctaagtcacagtg

SEQ ID NO: 73391 - DNA, 174 bp, Homo sapiens
  chr11:72125662-72125836
  hypo
ggcattgacagacaccgaagtcaatcagacatgaatcttgcctacaaggagctcttattctgagctggaggagggaaaatgaaacaagcgcacaaataagtgcactaagtatcacaggtgctcagagatgtttacacaggctcagggagcacaactcaccgccttgcaaagctc

SEQ ID NO: 73392 - DNA, 24 bp, Homo sapiens
  chr11:72146622-72146646
  hypo
gagccactgcgcctggccctgatt

SEQ ID NO: 73393 - DNA, 169 bp, Homo sapiens
  chr11:72388041-72388210
  hyper
aagacctgcccgccccgccgccctgccgggagtcaagaaacaccgttttttgttagctggggaactggaggtgggatggcaggaaggatgctcctgggaggtagggtggctgcccaaagcgatgggaagattcagttctggaatccggcctccgcgctgcccccatagc

SEQ ID NO: 73394 - DNA, 322 bp, Homo sapiens; identical to SEQ ID NO: 33953
  chr11:72432837-72433159
  hyper

SEQ ID NO: 73395 - DNA, 253 bp, Homo sapiens
  chr11:72433380-72433633
  hyper
aaaacactgagaaagcgaaaagtcacccagaatcccccggggcagacacttcctccccgcccccaggctgcacccccacccaagctgggaagagacaaccaacagtgtccactgatcttgcaggccctcacagggtggatgcccaggaagtcctgactgacaagccctggcggtggcctctccaccactccacccgcataaggagacagagaggctaggaaagaggctctctgaagggcgcaagttctgccct

SEQ ID NO: 73396 - DNA, 431 bp, Homo sapiens
  chr11:72465657-72466088
  hypo
tgctggaaggatcaacggccggatgatcaacaaccttaacaaaattaagggcagacgcaggggaccgcggcagcggccatgaggcaggtgggaagcaggcacagtgatgagccggctgaggctgtgggatcgtttattggggctctgtccagccaggctgcagcacccgcctgggcctggcccggtgccaccaggtgccgggtgggggaggggagaaagtgcaggagcggccgccgccccagggctcgcccggtcctgtctccgtccctgaagcggtgcggcgctcaggtgagcgaggtgtcgtcgtcgctgccctcgccgcccgcgccgcccatccgctcctctctgctctcggccaccgcgctctcgtcgatgttctccagtgagtccgcatgctgcaccgacagctccgacagcgccaggctcggcaa

SEQ ID NO: 73397 - DNA, 46 bp, Homo sapiens; identical to SEQ ID NO: 43212
  chr11:72475677-72475723
  hypo

SEQ ID NO: 73398 - DNA, 30 bp, Homo sapiens
  chr11:72492307-72492337
  hyper
ggctgcagatgctgacgccaccttcctggg

SEQ ID NO: 73399 - DNA, 204 bp, Homo sapiens
  chr11:72532174-72532378
  hypo
caaatctcttagctacgtgactttgggcaagacacttaaacctctctgtcggtgtccttgtctgtgaagtgagagtggcagtaccagcctcctggtgtggtgaggatggaaggagcgtgtagcctgctgggaacatcatggcgcccgagggccggatgggcatttggcagcctctgcgcgaggagtcctcgcagtggttatgca

SEQ ID NO: 73400 - DNA, 42 bp, Homo sapiens
  chr11:72532613-72532655
  hypo
gggcaggtgagcagccgactcccttagcgccttcggccccgg

SEQ ID NO: 73401 - DNA, 203 bp, Homo sapiens; identical to SEQ ID NO: 33582
  chr11:726307-726510
  hyper

SEQ ID NO: 73402 - DNA, 69 bp, Homo sapiens
  chr11:7272860-7272929
  hyper
actcggcggtgggagcgggtgcttggtttgcatcagggatgaggggtggagtagcgaaagcgcccggag

SEQ ID NO: 73403 - DNA, 82 bp, Homo sapiens
  chr11:7273066-7273148
  hyper
cgcgcactcctgacctggccccgccccccggcggccgcgagtagcgggcggagcgcaagcagagaggcgctctgggctgtgc

SEQ ID NO: 73404 - DNA, 111 bp, Homo sapiens; identical to SEQ ID NO: 33609
  chr11:7273149-7273260
  hyper

SEQ ID NO: 73405 - DNA, 220 bp, Homo sapiens; identical to SEQ ID NO: 33610
  chr11:7273679-7273899
  hyper

SEQ ID NO: 73406 - DNA, 173 bp, Homo sapiens; identical to SEQ ID NO: 33611
  chr11:7274075-7274248
  hyper

SEQ ID NO: 73407 - DNA, 228 bp, Homo sapiens
  chr11:72905832-72906060
  hypo
cttccttcagcctgccgccctgtcctgagtcatgcagttccctagcactcctgggacagctgagccctgtgcatgcatgcacgcagcattcccctgcagcctgcgctcacaccaccccccacgcaccaccctccacctggtcctggacatacttcgctacctcaaggtatccaatggccaaaatccaaggctaccactggggaagattcttcacgggtttgcagtgtg

SEQ ID NO: 73408 - DNA, 388 bp, Homo sapiens
  chr11:72929267-72929655
  hyper
cgggcgggttgagggcggtgccagggtcagtcaaaagtccgccccgccccctgcctggcccggcttcggggttggggaacagcgcagggaggtgggtagccgggctcccaggcacgtgggtctctgcggctgcggcgggacccgggcactggcacccgggagcggcggcgacggcaccctgagaggagaagcgcagcgcagtggcgagaggtggggtggggcgtctggagggaacaaggcgctgggagaggcccggggaagcggcgggccagactggcgcaggtgcggactgggcgcggggcaggggagggcgctgtggagcggctgtcgccccggggcacagttgcgagccggcgtgtagcgcataactggacggcttgaacgcgcc

SEQ ID NO: 73409 - DNA, 266 bp, Homo sapiens
  chr11:73019833-73020099
  hyper
cggggccagccctctcggcgcgtgtccaagctggcgtctgggcccctggccgcccccgcgcagccgcgcccgctccgcagcctctcgccgtcggttcgccagctctcccggcgcttcgacgcgccgcgtctggacgacggctccgctgggacccgagacggaggcgtcttacccgcggccgcggaagaagcggccgagggcccagcgcgaggagcctggcccagcgtcaccgagatgcgcaagctcttcggcggtcctggctccag

SEQ ID NO: 73410 - DNA, 762 bp, Homo sapiens
  chr11:73072907-73073669
  hypo
aaaagggtcctgtgccgcgtgtatgtgtacgcgtgtgtagaagggtgtatagggcatccacacacacacacccatgcaggcctgcctccctccattctgccggggtttcccaggagtggggaatgctggcagcagttcctccattcaccttctcctgtccattggcgcctcctgcagttctcctgtgcggctcccaccctgaacagctgcccggagccctcgcctgaggtatgggtctgcaacagcgacggctacgtgggccaggtgtgcctgctgagcctgcgcgccgagccggacgtggaggcctgcatcgccgtctgttccgcccgcatcctctgcatcggggcggtgcccgggctgcagcctcgctgccaccggtgaggcctgggcggcggggtgggcggcaccgcgggcctgggagaaccaacccctgtcccagcacactctcaggccgccccggcgtggttgtgggcggggcccggcgagtgtgggcggggtcggtgggcgtgtccaccaccggggccccgtctggctcgtagctgctgtcatcctcactccgtcttctcgcagggagcctcctccgtcgctgaggagtcctccagagacggcaccggagcccgccgggccggagctggacgtcgaggccgctgcagacgaggaagccgcgacgctcgcggagccggggccgcagccctgccttcacatctccattgcaggctcgggcttggagatgacgccgggcctcggcgagggtgacccccg

SEQ ID NO: 73411 - DNA, 153 bp, Homo sapiens
  chr11:73310292-73310445
  hypo
ttcaggaaagaggttcgccaaaatattagcaatgattatcttgggggaaagggtgtcagattgcacgtaggttttttttgttttttgagacggagtctggatctatagccaggctggagtaaagtgggggcgatcgcaggtcactgcaacctc

SEQ ID NO: 73412 - DNA, 26 bp, Homo sapiens
  chr11:73507247-73507273
  hypo
ttccgagtgcagttacggccgcccaa

SEQ ID NO: 73413 - DNA, 266 bp, Homo sapiens
  chr11:736495-736761
  hypo
aggggaaagcagggccggggtgggcgtgtggaaggttttggggtgtggcttcaggtgagtcttcaggaggcttcgttaggattgggcatgtttgggacggaagtggttcgggactgatggacataagaagggtttggagtgagtctggagactgagcccagctgtgctgtccgctcacaggtcctaggcaacgactgtcaggaagttcccaaaataagtcactcacaacctcatcgtcctgggtaagtttcctgatatgttccaca

SEQ ID NO: 73414 - DNA, 135 bp, Homo sapiens
  chr11:73662980-73663115
  hypo
gcacctggccaaaaacatgtttttttttttaacaaatatttattgagcgtctaccacaagggttgagagggtacttcactcctgctgcagtggtagcagctggagataaatgtcggaatccgacatcgacactcc

SEQ ID NO: 73415 - DNA, 84 bp, Homo sapiens
  chr11:73679409-73679493
  hypo
agacatcattttcatcgtaaaggagaagctacaccctcgcttccgcagggagaatgacaacctcttcttcgtgaaccccatccc

SEQ ID NO: 73416 - DNA, 30 bp, Homo sapiens
  chr11:73679852-73679882
  hypo
ctcccgccccttcgccgcatagcaccctgc

SEQ ID NO: 73417 - DNA, 30 bp, Homo sapiens
  chr11:73764263-73764293
  hypo
taattttatttttaccgtcaagaattagag

SEQ ID NO: 73418 - DNA, 30 bp, Homo sapiens; identical to SEQ ID NO: 43218
  chr11:73805524-73805554
  hypo

SEQ ID NO: 73419 - DNA, 33 bp, Homo sapiens
  chr11:73883502-73883535
  hypo
tagatctgagggaagcgacgtactggcctaaga

SEQ ID NO: 73420 - DNA, 28 bp, Homo sapiens
  chr11:7388589-7388617
  hypo
gcgtgagccaccgcgcccggccttccag

SEQ ID NO: 73421 - DNA, 37 bp, Homo sapiens
  chr11:74022679-74022716
  hyper
tcagacagtcctggccgcgcggcggcagccgctcccg

SEQ ID NO: 73422 - DNA, 141 bp, Homo sapiens
  chr11:74064904-74065045
  hypo
agatggggtggctgccgggcgggggctgaaaacccagaatgtttaaaacaaacaaaactgttctggagggatgctcccacatttcaagccacaaaaaagattctctccataagtcctgaaagctcacgtgaaaatttataa

SEQ ID NO: 73423 - DNA, 23 bp, Homo sapiens
  chr11:74100854-74100877
  hypo
cttgaaggaactggccgggtgcg

SEQ ID NO: 73424 - DNA, 39 bp, Homo sapiens
  chr11:74107733-74107772
  hypo
caggcctgagccacggcgcccggccggaaattcattctt

SEQ ID NO: 73425 - DNA, 36 bp, Homo sapiens; identical to SEQ ID NO: 33956
  chr11:74178590-74178626
  hyper

SEQ ID NO: 73426 - DNA, 36 bp, Homo sapiens
  chr11:74246640-74246676
  hypo
acggcacccagcccaagatgacgtttatatcttctc

SEQ ID NO: 73427 - DNA, 119 bp, Homo sapiens
  chr11:74302524-74302643
  hypo
caccgcgcccggtctgctaccctattttaaaccaccactatctttcacttaaaaatctcagaatgtaagttacatgtgaacaggctcggtttattattgctcatagctgcagccccagc

SEQ ID NO: 73428 - DNA, 30 bp, Homo sapiens; identical to SEQ ID NO: 43010
  chr11:7439190-7439220
  hypo

SEQ ID NO: 73429 - DNA, 242 bp, Homo sapiens
  chr11:74394395-74394637
  hyper
ggtggccctgggtagcgagcgcggccgggcgggcgccgtggcctcaggggccctccccgggctgggcacccccacgccgcccgggcactgctcgcggccgcgctttacaagcgaaaacaaacacggccacaagcagcccctgtgcgacgcggccccgcgcccgccagcgccgccgccgcccggtcaaagccggctttgtgcccgtcccgccgcccccgcggcccaggcgattttaattagcg

SEQ ID NO: 73430 - DNA, 37 bp, Homo sapiens
  chr11:74394860-74394897
  hyper
ccccattattaatagcgctagccggagccagccctta

SEQ ID NO: 73431 - DNA, 808 bp, Homo sapiens
  chr11:74441835-74442643
  hyper
ctcccggtctacttacgggctcgagcgtgggagtccagggggaaccagagcagcgcgagtcccagcaaggaggagaggaccctcacctcgggaaccatcctttccccagggtcaggccgctggtccgggagcggagtcgggaggaagggagacgaaaaggacacggaggcacaggggccacagatcaacccacagaccccaggaggtctgctgctagagcggggtcggagaagggccaggaagcagcggtgggcaggaaaggagggcaggaagggaggtctaaggtgggaagaagagaaaggtggaaagagaacgcggggaaaggagggagagatggagagacgaaggaaggtccagcagaagggagaggcgatcaaagaaagggggaaggtgagagggagaggaggagaaagcagggagaggaccggcgtctgccgagcgcgcagcgccgggcgaggcgcgcgggaccagcgggtgttgcgggcgcgcgggctagaggcggccggcgccccctgctcggtgggctcggggtcgggccgcgggggcctggggcccggcggggcggcggtcccagcagcggcggcggcgcggcggccgcggagggaggctgagcgcgggccggctgtgctcgccaagggcttcaggcgccgcgctcgggcgcatttgtactttgccgcgggaagcaggcagcccggcctggcgctggcctagcgctggcgcctcctctggggcaccgcgggctcggtggattggccacccgagaaacaggcccactttttcccctcctctcttgtgcgggtctccggga

SEQ ID NO: 73432 - DNA, 168 bp, Homo sapiens
  chr11:74442705-74442873
  hyper
cgggccacggggtttaacccctgactccccgcgacgccaagaatgcaggagggcagagttgagggagacctcaggtggaactttcaggtggggaaggctgagctgtcggggctgcgggtaccgggaaggctcagggtaaggcgctcggcggtgcgtgcccggaactcc

SEQ ID NO: 73433 - DNA, 167 bp, Homo sapiens
  chr11:74951632-74951799
  hyper
aggagccaaacttctcggcagcccggaggggcgggggcggagaggatgaagagaaagcgcagcagccgacagccctgattctcgggagcctcccaccccgcctcccacggcgaggagggcgcggagactccgctgggggcggaggacgagaccgggaggcggggagg

SEQ ID NO: 73434 - DNA, 606 bp, Homo sapiens
  chr11:74952123-74952729
  hyper
ccaggggctgctgctcgtggcggcggcgctgagccagcccgcggcaccctgccccttccagtgctactgcttcggcggccccaagctgctgctgcgctgcgcgtcgggagccgagctccgccagcctccgcgggacgtgccgcccgacgcgcgcaacctcaccatcgtaggcgccaacctgacggtgctgcgcgcggccgccttcgccggcggggacggggacggcgaccaggcggcgggcgtgcgcctgccgctcctgagcgcgctgcgcctcacgcacaaccacatcgaggtggtggaggacggcgccttcgacgggctgcccagcctggcggcgctcgacctcagccacaacccgctgcgcgccctgggcggcggcgccttccgcgggctgcccgcgctgcgctcgctgcagctcaaccacgcgctggtgcgcggcggccccgcgctgctggccgcgctggacgctgcgctggcaccgctggccgagcttcgcctgctgggcctagcgggcaacgcgctgagccgtctgccgccagccgccctgcgcctggcgcgcctggagcagctggacgtgcgcctcaacgcgctggccggcctggaccc

SEQ ID NO: 73435 - DNA, 389 bp, Homo sapiens
  chr11:74952948-74953337
  hyper
cgcggacagcggcgccgacgctcgcggagaggaggcggaggccgccggcccggagctggaagcctcctacgtgttcttcgggctggtgctggcactcatcggcctcatcttcctcatggtgctctacctaaaccgccgcggcatccagcgctggatgcgcaacctgcgcgaggcgtgccgggaccagatggagggctaccactaccgctacgagcaggacgccgacccgcgccgcgcgcccgcgcccgccgcgcccgcgggctcccgcgccacctccccgggctcggggctctgagcggcgcccccgggctcggggcttcccttgcctggcccgaagccgtggagatgagacacccgcgagccccgagctctgagaccttcccctgact

SEQ ID NO: 73436 - DNA, 35 bp, Homo sapiens; identical to SEQ ID NO: 43221
  chr11:75100584-75100619
  hypo

SEQ ID NO: 73437 - DNA, 33 bp, Homo sapiens
  chr11:75140949-75140982
  hyper
acgtgctccagcaggcgtcgcagctggccgcgg

SEQ ID NO: 73438 - DNA, 660 bp, Homo sapiens
  chr11:75141202-75141862
  hyper
gcgctaggctgttggcggcgcgcaggcggccctcgagaaagcgcacgcaggcctcgcgcaggcccgccacgcccagccgctccgccagcgccagcacggccgccgcctcgtcctccgcgcgcagccgcacgcccgctccgtacacgtagtcgagcaccacggccagcgccgccgccgccccggccgggctcgtgcctggcgcctcgggagctactggcaccactggcaccacggccgggccgcgctcgggccgcccggccgcgaacaagctgcggaagtaggcgctgcccgcgctgagcgccgcgcggtggcacggaaagtcgcgcccgccggcgcgcagcaccacgtcggtgagggtgccgctccgccggtaggcgttcagggcctgcagcacgcgctgcgcgtggcacggacccgcgcacggcgcttcgcagcccggctccgactcctccggcgcatggccttgccgcatcctgccggggagagaacacaaacagcgtcggggaagccacctggctgcgcccgggagaggcgacagccctcatccgtttatttcctctcttgaccatttgttcagcgactctcccctccgttcagcatccaggttccttacggctacagtgccccagccccgcctcaccagcgcgacattctgccctg

SEQ ID NO: 73439 - DNA, 30 bp, Homo sapiens
  chr11:75146658-75146688
  hypo
atacggagagcacatcggagacctctacac

SEQ ID NO: 73440 - DNA, 56 bp, Homo sapiens; identical to SEQ ID NO: 43222
  chr11:75152480-75152536
  hypo

SEQ ID NO: 73441 - DNA, 30 bp, Homo sapiens
  chr11:75160673-75160703
  hypo
aagggagaccagtaacgcccagctctgccc

SEQ ID NO: 73442 - DNA, 30 bp, Homo sapiens
  chr11:75163174-75163204
  hypo
gaggaggtggaaccccgccttgcagaggtg

SEQ ID NO: 73443 - DNA, 49 bp, Homo sapiens
  chr11:75221046-75221095
  hypo
gcagagctccctccccgtgctaagctgcagcatgcgctcaatgccactg

SEQ ID NO: 73444 - DNA, 30 bp, Homo sapiens
  chr11:75229378-75229408
  hypo
gggaggaagcagcctcggaaggaatgagct

SEQ ID NO: 73445 - DNA, 247 bp, Homo sapiens; identical to SEQ ID NO: 33966
  chr11:75294375-75294622
  hyper

SEQ ID NO: 73446 - DNA, 94 bp, Homo sapiens
  chr11:75294662-75294756
  hyper
cgggtggggagcctcccattccagagaccccccgactccctgcccctcgcggcgtaggggcgccctttctgcggcgccgcggggccgtcctctc

SEQ ID NO: 73447 - DNA, 848 bp, Homo sapiens; identical to SEQ ID NO: 33968
  chr11:75378401-75379249
  hyper

SEQ ID NO: 73448 - DNA, 828 bp, Homo sapiens
  chr11:75379282-75380110
  hyper
cggcggggcgcccgggtgctcggtggcctccgagtacttggtgaaaaccagcggcacagcgatgtccgctttgtccaactggttccagaagcgggcgatgcagcaggccctcgtgatgcacggccacgccatgatgctagctgaaaagccggcctcctctttcttcttgtggttctaaagcaagtctctataatcttccttcagcctccgatcctgaccggccaatgtggttcccaccgttttctacccccgatcagccggagctagttcgccctcctccctcagcgagcacccggggagagctgtcctaggagagtctgtagagtccctcgattaccggtcgcaaacgcctttgggagcgcagtctgctgcgagcgccgaagggtgagacgcacggcgttcccgagtccccggcgagggtgtctgggacgcgcccctccctgcggctgcggcggcgcacagacctcggtcgagcgaggcgacgtgaggagaggtggctacaggcttaagccatggcgcagaggaggggccgggcggtgtggccgcagggtccgcggaccgggctcgagtctccttcctgccggcgtcctagtgcagccggccacctagcagggctgggaggccatcacctccagcggagaccgagcattgctgcctccgccgctgcccgcgaggatgccgcagccgccgccgccaccgcctcttctcctgggaagcgaccccacccttttctgcagctctcggtctccgccgctgcccgcgaatgatgctgcagccgctgccgccgccgcctctgcctctgctgcagggaagcggccccaccctttt

SEQ ID NO: 73449 - DNA, 55 bp, Homo sapiens
  chr11:75428929-75428984
  hypo
cagcatggtagagttcgcgcccttgtttatgccgtgggagcgcaggctgcagaca

SEQ ID NO: 73450 - DNA, 91 bp, Homo sapiens; identical to SEQ ID NO: 15601
  chr11:75459473-75459564
  hypo

SEQ ID NO: 73451 - DNA, 718 bp, Homo sapiens
  chr11:75863175-75863893
  hyper
aaaactggatagattcgtcttggtgtgttgagtgtccattttacagaggaagcagttgggacccggagaagttagtcttggctaagttcacagagctaaaaagtgacagagctaggacttgaaatcaggacctttgagtcacgtctctgcctgacctcagccctgcgggccccgttcccgccattccttcctgcctctcacgttgactgggctccccctgtcggtcggcactggctgaacagccatggagtggcgctttggggaaaccacgggcgaccaggaaagatctcaggcaagcctcgggtaagtgagctgtaaactgagacctgaacccagacacagcccatgccaggccgagcgaagagcctgtgcaggggcttggagtagagaagagcacggctcctgtgaaggattcagaggctggagctgggcgatgggccaccgcgcggaggaggcgcgggcggtggtccgagttcctcaagggatctacagacggcgcccctcctacccagggtgtttcctgatgattgtattttgtatttcagcgttgatgattttttttttcactacttcaccccctcccaaacgcccaaaactgcctggtgattttttttttttttttcaaagtgcatcctgacccctctggctgcctccatagactcagctttagtcccggcccatcctgctggcacaaggaagccaccgcatgtgatggggt

SEQ ID NO: 73452 - DNA, 30 bp, Homo sapiens; identical to SEQ ID NO: 43224
  chr11:75879446-75879476
  hypo

SEQ ID NO: 73453 - DNA, 30 bp, Homo sapiens
  chr11:75921359-75921389
  hyper
aaaggtatggaggagcgcttggtttgctta

SEQ ID NO: 73454 - DNA, 320 bp, Homo sapiens
  chr11:76032896-76033216
  hyper
tgccctgcccatgcccgccccacaaggcccacgcttgcgccctcgggctgcgcagggcgagggtttgggggcgcggtactgacgggtgtccaggcctctcctcgaagggttccgcgcgcagaaaggtgggccggggccagaagacgcgctggaaaggcgttttctgccccctccgggcctcgggaatatttgtgggctgccggcggggcaggcggggtgggggaggctgcccggcgggcgggaagccccgcgcactcgggtcccctgcggtccccggcgggggtcggcgcgtgcggaaagcggcccgagcccccaacctc

SEQ ID NO: 73455 - DNA, 38 bp, Homo sapiens
  chr11:762939-762977
  hypo
tctgggatgaggtgacggcctggcgcaagagcacgggc

SEQ ID NO: 73456 - DNA, 716 bp, Homo sapiens
  chr11:763302-764018
  hypo
cgccctcacctgccccgccctcacctgtccccgccccgcagggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggtgagggtccctctgtggtaatggggtaaggggagcagcctcagcagcacctcaggcaggaagagcccgagacggagctgccgcatcaacaagcagtgaggtgcacaggtcggcgcggggcaggcaggggtggcggctcaaggtagtgcagccggcaggcactgggagggcaggtggggtggtacctctgccgaagccttcctggtcacagcttggtctctttccaggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcgggtgaggccccactgcccagctgtggctcctgctcgggcaaggccagcactgccgtgccacgctgccctgtgggt

SEQ ID NO: 73457 - DNA, 609 bp, Homo sapiens; identical to SEQ ID NO: 43225
  chr11:76371627-76372236
  hypo

SEQ ID NO: 73458 - DNA, 243 bp, Homo sapiens
  chr11:76382021-76382264
  hyper
gggttgcagaggaagcgccgtgggagcgaggcccatcccagcggccgccgcacgtgcagttcgcggccccgcggggtccggaggggggcgcggtggctctaggagccgcaggtccacagaggaaatccggcctggccccgatttcccagctgctggcgccgccgcacttaacgcgggggcaaacaggcgaggtgacggcggggctgaatgcggaaggaaatgacccttcgctggccctggggc

SEQ ID NO: 73459 - DNA, 77 bp, Homo sapiens
  chr11:76510624-76510701
  hyper
ccctggcgcccagggcgagggcttcgaatcttacacaatcaggaaaattcgtgcaaagaatccgttttggaattcac

SEQ ID NO: 73460 - DNA, 21 bp, Homo sapiens
  chr11:76571168-76571189
  hypo
cccagacgggggctgggagta

SEQ ID NO: 73461 - DNA, 282 bp, Homo sapiens
  chr11:76902405-76902687
  hypo
acctgagggaaaacccagcagtaggatgtcctcagtcctgtgtcctcaggcccagtgaatcctctcctggtgctgaaggaagagcatggcacaggctgatgggagggctgcgcagcccttgtgtgcagatgggaatggaattccctctcaggttgccacggcatctgatggagaaactcctcagcaaacaggagttccttcacacttgccctgaagcagctggagtgtgggcgtcccgcagactcacctcggaggctggagcctcctcggctgagcgggacc

SEQ ID NO: 73462 - DNA, 18 bp, Homo sapiens
  chr11:77025115-77025133
  hypo
aaaaatatttaaggccgg

SEQ ID NO: 73463 - DNA, 154 bp, Homo sapiens
  chr11:77116020-77116174
  hypo
aatatgagggggaggcgcatgcatggggcatggtacataaaagaagataatcaagacaggcttctctgagaaacagttacttaagacctcatttaaatgagacagcaaatcatagtaatatctggaaaagcattttaagcgaaggagtaataag

SEQ ID NO: 73464 - DNA, 40 bp, Homo sapiens
  chr11:77186167-77186207
  hypo
caaaattgcttcttacgttcctttccgttctcaatgaatg

SEQ ID NO: 73465 - DNA, 41 bp, Homo sapiens
  chr11:77301363-77301404
  hyper
ggggggcatgtcccccgagacgggtgcggtgaggctattgg

SEQ ID NO: 73466 - DNA, 94 bp, Homo sapiens
  chr11:77309684-77309778
  hypo
ctactcttccttccacggtaatccttgtctctgatgtttgtgttacaaccttccaaactggttgtttttgttgttgttttttgggtttttcttg

SEQ ID NO: 73467 - DNA, 101 bp, Homo sapiens
  chr11:77534272-77534373
  hypo
aaaaaaaagaaattaaaatcctacttcaggaaaatatctttatggttatgaattatcactgccaaagaagttttaatttaataagtcggaaaatattgttt

SEQ ID NO: 73468 - DNA, 443 bp, Homo sapiens
  chr11:782133-782576
  hypo
tgaactggccagagacgtcagacgtggtacatgccggcctctgtggcctggaggggcttgcaacaaggaggcaggccctgtcccaagctggcctagcctagtgtccaggacatggaggacagggtgcagcagccccggggaggggtggggccgttccctcccaagcacacttctggagctgctgcagtcgggggtgaccctaacctaccttgtgccttccttcccatgtgccggggcgggtcccacacacctctctcctgccccgactggctcccacctggggcacgcagttgggcaacccaggccctgctctgcccgtcgagcctccagggcaagtgcaagctcagcctgggcctggagacggcggatcggagcgtgtccaggtgctcagggactggtcaccgaaaggcaaggagccctccctgggacgagggagacaccca

SEQ ID NO: 73469 - DNA, 30 bp, Homo sapiens
  chr11:78262164-78262194
  hypo
gtcctcaaattagaccgtggtgattggctg

SEQ ID NO: 73470 - DNA, 30 bp, Homo sapiens
  chr11:78369244-78369274
  hypo
ccctctgtccaggcccgcaggccttcctcc

SEQ ID NO: 73471 - DNA, 30 bp, Homo sapiens
  chr11:78381201-78381231
  hypo
aggggcccaatctgacggtagcggatggtg

SEQ ID NO: 73472 - DNA, 162 bp, Homo sapiens
  chr11:78387174-78387336
  hypo
cacctccagaggcctcgctcacccgcagccggcgcccaaagacagtgacctggccccgagcctgctctttgcgctggcgccactccaccaggttgaggccgttgtcgatgggcagcgtgacattcctcttgcccacggtggggttgacggtgccagccagca

SEQ ID NO: 73473 - DNA, 427 bp, Homo sapiens; identical to SEQ ID NO: 33973
  chr11:78672891-78673318
  hyper

SEQ ID NO: 73474 - DNA, 181 bp, Homo sapiens
  chr11:787323-787504
  hypo
acagtgtgtgacggtcgccgccaaaagcagttctactctacctgttattgcattatacgctggttagactcaggtggtgctgggtgcaagctggaggggcagtctagcggggcagggcgggcacagctgtgaggggccctcgacatccctgcctccccgccggcgtcggggctcccctgga

SEQ ID NO: 73475 - DNA, 30 bp, Homo sapiens
  chr11:78775970-78776000
  hypo
aggccaatgtctgtccggtacagggtcccg

SEQ ID NO: 73476 - DNA, 188 bp, Homo sapiens
  chr11:7905970-7906158
  hypo
acgaagtgggaggcccggatctgtagccactgatccggttgttgcagctgcacctgggagggtggggctcctgcctgttccatgaagcaggaggcccaggtctacagctgcagtgtgggtagctgcagggcaccctgggagctccaaccccaactcggaacaggcagggctcccgcttgtccaaggat

SEQ ID NO: 73477 - DNA, 33 bp, Homo sapiens
  chr11:7909927-7909960
  hypo
aagtgttgggattacaggcgtgagccaccaggc

SEQ ID NO: 73478 - DNA, 135 bp, Homo sapiens
  chr11:79148413-79148548
  hyper
agcgcgctgtgagtccgcaggaacgcggccgggccggggacgggagaaaggcgcggccgggaccctgcactgtgccgcgcggcgcttgcggctggaacttggcctggaacgcggtcttctcggctccagtttccc

SEQ ID NO: 73479 - DNA, 204 bp, Homo sapiens
  chr11:79148811-79149015
  hyper
ccgcgacctgattcccgccctgcccggggagctaacccagccgcctccggggcgccctccttcttcctggattcccacggctggaccagagcccctctggcagccgggttaaaggctccttcagcaaggtcaaggcgcggccggctggcacctggggatttttttccagccgagcactggcttttcaatcgcattgttaaggat

SEQ ID NO: 73480 - DNA, 621 bp, Homo sapiens
  chr11:79149239-79149860
  hyper
cttcagcgttccccacggctgtgtcagggctggggtggcttatccccctacagacgaaaatcaagatttaaaagcatactcttactgtggtttctctatcaaagcccatcaacgtgatacacaggctgcggcgctggagggaagcggcgaaacggggagaataaacgcaacagaagcaaactgctgtctgcagaggcgagaggcgaaggaacggaagccatacccgaccccagccccatcccgtccccatcagcgccgggctagcgcaggaaaccaggaataggtgtaggtaagggtggcagcccggcagagccagcgttctactccctctaacccctcgccagcgtgggcctggatggctgggctgcctgggcatctccaagggggaccaggcaccgcgggcaggtttctaaacacgtgaagggcacagggcttgaaagacaaggaggggcgcccaggaagggcggaaaagaggggctttggggctccccaggacaccaagtcagtttctgaaaacggcgttccctggaaggccttccaacacctccgagggaagacttggagctctgaagacccaatgaaacctcagttctgactgactcctcctctgcgatcaattcc

SEQ ID NO: 73481 - DNA, 475 bp, Homo sapiens
  chr11:79149861-79150336
  hyper
gatgcccccacttagtccctgcctcggtaaccggttctttggggacagcagcatcagcacccgacgcccatcgcacaagtgggcgccgtggtgcgaggcgtatcctagctacccaggccggggtgggggcgccccggtacttacactccccaagcaggcaaactttcaggcttgtctttcgagaaccgggagctcgcatcacagttccgggtaatcaccgaggcagcttatgtaattgcccgcgatgccgctcagcagatctctctccttactcggcctcagagctcagtacatgggcaccctcttccccccaccccccaccccggcgattggaatcccgagcttgccccaccaccgccttctacaaagcagcggggtgatctcgtgtgctacaaacaccaagccagtatgcaggttcaggcaaaactctggctgcctccctgcgcccctttcactgcgtcgatggtttacagat

SEQ ID NO: 73482 - DNA, 1801 bp, Homo sapiens
  chr11:79150674-79152475
  hyper
tggttgtgtattcctcggttgcgtgtgtgtgtccacacacacacacacacacacacacacacgccgccccactaccttccagtctgctcctccaatgtaacgaccgcatttaaaaatggcaattaaaatgactgaggagctcggtgatcacatttcaacccagagcacatttcccgaagctgggggtgagagtagtcatacagtcacactcacacccgggagccctccaagcgtccatctggcggctgcagcctcagttggctcctagacgaacatcaataccgcggccgggcgcccggtgaggagaggcgggcgccccgcgggttgcagagggcgaggagctggggtcgcatctccaggatctgagctccaaccaccgcccgtgcggggctgctgcagccggcacttgccccgcagggcaggctgcagccgctgaagcccggcgccgcctcgcgggctcctccagcgcccgacgggggcctggggcgagctagtctgcagaggggctgcaggcgaccgggccggggcggggaacgggatccgggagaggcagacgaacctggggcgcgccgcctccctcccacccgcttcccacctccctgccctcccccaacccttgctcccaggctccagtccgcggcgggctccgggggctgcggcggctccaggctccagaacagcttgcctcttcggccacccgcgccctagcctccctcctcctgggccaggggagcaagcaaacatctcccggagccctcggcagccgcgtgagctacccgaaccctgcccgggccagcagtgcagagggcgatggagctggcgaggcgtcgccgcggtccccaaggcgcttttccgtagagcggatcacgccgccttaccgtggctgcaggctgctaccgccggggaagcggcgaggacggcggcagggaggcaaggcgccgcgccggtggctcctctctctctcggcggcgcggctcctctgctccgcgagccgtagcggggcgcccaggaaggagcaggtccgggctctgcgctcagctccagcgagaccaacaatagctcccgcggggagcggagccccagcgagcctccagccgcgcgcgcacgaccggctcccgctcccggccgctcccggccggcgtccctgccagcactgctgccccacatgaaacagctgcaatcccgaggcttctggggggttggggcgggtgtgtgcgcgcgcgtgtgtgagtgtgtgtgtgtgtgtgtgtgtttaatagcttcccttctcttcttcccctccctgcctgctcgcctgcctgcctccgtcccccaccctcgctctcttacacacagaaagagagggcgagcgagagagagacacacacacacacgcacacgcacacgcaggttacatgaatgggaggcggtagccaatcctacgaggccggcgagccgcgcggcgcactggcgctgggagcagggccgcactccggcgcgggggggcgccacgcaggtgatgggcgcctctccgggggccacgcgcggccgctccctcaccccagtctcggttcctctgtctccttcccccttcctctccgccgccttctccatcttctctccttttacctcctttgctttctcgagttctccgagctctctcagttcggtatctttctggtctctttcttcttttaccctccttgcttgctttctcttcccctttctgaaactttctcttttcctttctggactttcttgtacttcctctcctcttgccttttgttctttcctcctcctttggctttctctccaggctccc

SEQ ID NO: 73483 - DNA, 15 bp, Homo sapiens
  chr11:79152508-79152523
  hyper
cgcctttccctgggt

SEQ ID NO: 73484 - DNA, 151 bp, Homo sapiens
  chr11:79152734-79152885
  hyper
taacagctactgagtcgtgataacaatcacttaaaaaatagcagtgattgcggtccaagagatttctgtccctcgaatgtttggatcgtgatggcaagcacatttccaagagaagggcatttttatgtgatgagagcggtagtttgactga

SEQ ID NO: 73485 - DNA, 41 bp, Homo sapiens
  chr11:796141-796182
  hyper
caccgacccccgctccgccacctgcccgctggtcctgctct

SEQ ID NO: 73486 - DNA, 290 bp, Homo sapiens
  chr11:8040261-8040551
  hyper
gaagagaggaggggacggtggtttcaagacttccaccctggggaagaagggacggggagacggcgggaatctaggaaattgggggatggctatttccattcctgagaaggggggaacttgattgtgggaggttggctgaagactcccacgccggaaaggagggcgcctctgcggaagggccccgagtggcgacagcggatccgggactcccaagcaagcaggagccggagcagcctcttagcaacccctgtcccgggaaggtttgaaagcagcggtgccctagtgacgcc

SEQ ID NO: 73487 - DNA, 30 bp, Homo sapiens
  chr11:804039-804069
  hypo
agaggcagggcagagcgagagatggagaca

SEQ ID NO: 73488 - DNA, 12 bp, Homo sapiens
  chr11:8040552-8040564
  hyper
gaaaagatggag

SEQ ID NO: 73489 - DNA, 195 bp, Homo sapiens
  chr11:8040581-8040776
  hyper
cggagcacacctcggaaataaataaataagcgcccaggctgccgcagccgcgcccccgcgggacccgagcgagggggagggggcctcacgggcccgggtccccgcagtcgcgcgtccccgccattggcagagccggagggggtcaccccccggggggcgaatggtacagtcctccgcccgcgcctcggccgggcc

SEQ ID NO: 73490 - DNA, 189 bp, Homo sapiens
  chr11:8040960-8041149
  hyper
cgggagaagcgggcctccgggggctaggactggcgcgagcgcccgacccccagggtgggcttgggcacccggaccctcgggcatccgggacccagagcctcgggtacggcgcagcggagctccagcgagggtagtgtccccacacccacggggcagagctgtcggaggagggcacgcggccactgggac

SEQ ID NO: 73491 - DNA, 108 bp, Homo sapiens
  chr11:8041493-8041601
  hyper
gccccgcggggatggcgagcggctgccggcgtgggcggtttggagctgcgctccccacgcactcgtcctggaggaaggagtcatcctcccaggcgaaatgaaaaaaat

SEQ ID NO: 73492 - DNA, 594 bp, Homo sapiens
  chr11:8102561-8103155
  hyper
ctggcccggctgcagcgccgccgttagccgaaggtgggagccggcgcggtcacgcgcatggagcgtggatcgcgacgatttcgggggagggggcaagggcgctccgcaggccctgagccggccggggggtggggtctctgcggggcggggcggggcggggcgagggagaaggggcaggccgccgctgccacgcagtactcccgccttggcgccagaggggcgcgggacggtgcggtcggcctccccgcctccacgcgcgcgcacgacccgcgcactcccggagcttcgcccatctcgcctcgccgcgccgcgcaggcagccgctcgcagagccagcagccggggccctggcgtgcagcgcgggcctcggcggggcccagcgccccggcccgggaggatgcggcccggggcggcccgggagctgagcagggcccccgcgccggcccctccgggccccggcctccagagccgcagccaccgccccgcccccgagagacatgacttccaagccgcattccgactggattccctacaggtacgcgggcgccgggccggggcgcccaccactcccgactcgggacgtgagctggctggg

SEQ ID NO: 73493 - DNA, 24 bp, Homo sapiens
  chr11:81697887-81697911
  hypo
agaattcaagcatggcgtgggtgg

SEQ ID NO: 73494 - DNA, 820 bp, Homo sapiens
  chr11:8189946-8190766
  hyper
gttgaaaaaacataacgacttaaggtttgctgtaccaattccatttgccttgatttcgtaccaagcggcgcgtcagaaagtacacggaaaacctaaagagggaaacccaactgggaacccttgactcaaagcacgtgaacaaatggtgacgagatgagttaagccagcggggtaagagagaagggactgcgcctaaacgggagtacgcaaggccacctagaggatgcacagacctgcatgcatacgttcctgacccttccagcagcagaaccatctgggccgccacccgctgataacaacggaaccgtgggcattggcccttcaacgccgtctcgcccgccctctccagtcagtttggtggatatttcggtgaaggctgcagactctcagagtcacccctccctcaagcagcgttctccgtactcttcggcgccgggaagctcagagggagctggcctgctcttaccttcaggtgtcggcggcggctcctgccgcttcccgcgggacaggaaggccttgggcagcagcagcgacagagccaggacaagcccagaagccagagcgactctctgcactgtggagtacgccatgactgctcacggtggtcgcaggtgcagacgccagccggaaccggaaccggaaccggagcacgggctgccgctcccgaccgaaccgcgggcggcgcggacggcgtcgcgcgagggacaaggtgcgcgaggcgcacgcatcttcacctccactgtcgggagttgacctgctcctcccgcgtggttacccgtcgctgtaaatggtaccctcgccttcccgttcatactaacta

SEQ ID NO: 73495 - DNA, 30 bp, Homo sapiens
  chr11:8213825-8213855
  hypo
ccttaggcagattggcggcagcacttccat

SEQ ID NO: 73496 - DNA, 44 bp, Homo sapiens
  chr11:82214275-82214319
  hypo
ctatcttttaccagtcatatgaccttggtcggttattcaaattc

SEQ ID NO: 73497 - DNA, 30 bp, Homo sapiens
  chr11:823464-823494
  hypo
attccaggggcagaacgggcatccctggct

SEQ ID NO: 73498 - DNA, 104 bp, Homo sapiens; identical to SEQ ID NO: 42855
  chr11:823903-824007
  hypo

SEQ ID NO: 73499 - DNA, 190 bp, Homo sapiens
  chr11:82443379-82443569
  hyper
ctggtttcatctccacgtgcattttcccatcgttcttcagatttaggagaaacccacggaggcgcggcgctctccacagccgtctctaatgaagggaagcgtgcctcgaagtcagtcccggtgcgccccctcctcccccggcgccccttcccaaaccccgtcggatctccaaaggctggaataggcggtg

SEQ ID NO: 73500 - DNA, 1541 bp, Homo sapiens
  chr11:82443651-82445192
  hyper
cgaaagaggccaaatggccccgcccgtcctccccgccgggagaatccgcagcggcggggtacagggggctcaagggctcgttcaaggtcaagccgccgcggggggcagtcagggggctctttttggtcggggagcagcccgggacgctccagggctcggggtacagtaggtttcccaccactgccggcggcggctcaaagaggccgggctccagctccgggggtccccgcagtacggaggctccggcggggaacacgtcgagaggctcggcggcaagcaagactgccgcctccgtgccggcgccgtagtcgggccccagcagctcaaagaactccacggcctccgcgcccttctccaggtcgcccaagctcacgtccggccccgacgggccacacccgccgccgcctgcccgggacggctccgtgaagaaggacggaggcagattgcgtgcccgcagcgggaccttcctggcccctgggatcgccgtggcccccgcggggcctgccacgtcccctcccgcgcccccagtgcccgcacctcctagcccggccgccggcgcagccacctcaccccccgccggctcggcacccccggggacgtggcgcagcgagtcgaagagcgcggccagacttcggctttgcaagctggcggccgcggcggcctgcgacgcctcccgccggggggcagccttgccgtgggccggggccgcgactgtcggggcgctaggggcggccagcggccgtttggctggcgtgtcggcggcgctcggggagggcgggccggggggcgcggcgcccatgaggccgctgcagcgcttgatctgcttctgcaggtacttgcggtggttcaccttccgcttcgacttgcccggcttgtccagcgccagcttgatgttgctggacgccgagtcaatgaagctgagtagatcgcgggtggcctcgcgcacgtcccctccttcggctcccgacagcagcgcacccgccggagccccggtctcatcgtcctcgaaacagcagcccttgtccagggctccgaaggcgccccctagcccgtccggggagcccccgaagccgaagggcacgaaagggtgcgtgctgaggagcgccgcctgcaccgccatcgccgcggctcccgggctgtccgcagcgctgcccgtgcgcccccgccagctcctgcccgccgcccagacccagctcccgccccggcgcggcgcgcgcggcgcagcctactagttccgggcctggctcgctgcgctgcctcccgggggagctcattaggtcttgtaagcaaggggcggagggagggagcgcgcggcgaccgtcccggtggtagaggggaggggcttacttagcctggcttggaggagtggggggtcgctttagttttctgagctttctgaagctcaacgccttaactccttcgtttccctttgccccgtggtgtttctcttgactcctctaaccgcaaggggtgaggaagagatggctggtctcaaactccagttcaggcccatgaggccgctgcagcgcttgataggcttc

SEQ ID NO: 73501 - DNA, 156 bp, Homo sapiens
  chr11:824828-824984
  hypo
ggcccggcccgtgatcggggccctggggctgtgagaccccgaccctctcgaggaaccctgcctgagacgcctccattaccactgcgcagtgagatgaggggactcacagttgccaagaggggtctttgccgtgggccccctcgccagccactcacc

SEQ ID NO: 73502 - DNA, 87 bp, Homo sapiens
  chr11:8284225-8284312
  hyper
tctgggccaaactcccgcctccgcgctcagagagacagggagctagcgggccggcacaagaggcggctctctttctcaccgagtcac

SEQ ID NO: 73503 - DNA, 32 bp, Homo sapiens
  chr11:8284313-8284345
  hyper
ctcatgcagatgtcccccggagggtccaaccc

SEQ ID NO: 73504 - DNA, 393 bp, Homo sapiens
  chr11:8284568-8284961
  hyper
gggagccccagcctccgcgcggccccgcggcgcagcacacggccagtgcacagctcctcggctcgcggccgggacccggggggcgtgcggccccgggcgcgtgcagcccggggctcgacctcctccccccgcaagttccgcccggctgtcccccggtacttccccccgccccagccccggcccccagcgcgccgcccgccccgcaatccccgcacagcccagcaggtgtgcgcccgtgtccccgcgtgtgtgtgcctgcgcgccgcggcagggggcgagggggtgaggggcgtcgagaccccggcccgccacctaccgtcctccttgtccagcaccatcatctcgggcgctccgtgtccagccgcagctaggctcggccgggagaagggcgcc

SEQ ID NO: 73505 - DNA, 84 bp, Homo sapiens
  chr11:82851824-82851908
  hypo
gtgagccaccacgcccggccaggaggggtgctttctaattgctacccttagcactcagggatgttttctcggacctcacccaga

SEQ ID NO: 73506 - DNA, 447 bp, Homo sapiens
  chr11:8289527-8289974
  hyper
caccccgctgggatccgttccgcagtagggtgcggaaggggaacgtgcagacacccagagaggctgggagactggctggcagtgggcactgccgggaagcccgcggtgcgggtcgcagaggcgctccggatgcccgcaaggcggcaagagtccgtgagaaagttcccagccggagcgcgcagggctggcggcctcgttgggaccgggagacttcctaatcccgccgccgccgaagcccgggcgctgagcctggcaccgccgaccccggcaccggcgcacacatcagccgccgcgcttccgggaagccacccatcagccggaggaggcccgcgggtgctgagggctctgccgccgctagcggggtggactccgcagggccagcgccgcagtctccgccccacgtcccgcgtgcccccgggcaccggcaccgggcgccgggcacctacc

SEQ ID NO: 73507 - DNA, 46 bp, Homo sapiens
  chr11:8289975-8290021
  hyper
tcctcctggtccaacaccatggtcccgacggctccagccggactag

SEQ ID NO: 73508 - DNA, 366 bp, Homo sapiens; identical to SEQ ID NO: 33622
  chr11:8290057-8290423
  hyper

SEQ ID NO: 73509 - DNA, 2 bp, Homo sapiens
  chr11:829531-829533
  hyper
cc

SEQ ID NO: 73510 - DNA, 30 bp, Homo sapiens; identical to SEQ ID NO: 43229
  chr11:83561479-83561509
  hypo

SEQ ID NO: 73511 - DNA, 104 bp, Homo sapiens
  chr11:84431431-84431535
  hyper
aggggacattccttccgggctgcggcagtggcagctcgctgggggacccaaacgctgtgctcgccgggcacatggagcgacagcctagaccgagctgccgcttc

SEQ ID NO: 73512 - DNA, 164 bp, Homo sapiens; identical to SEQ ID NO: 33989
  chr11:84431536-84431700
  hyper

SEQ ID NO: 73513 - DNA, 316 bp, Homo sapiens; identical to SEQ ID NO: 33990
  chr11:84431954-84432270
  hyper

SEQ ID NO: 73514 - DNA, 45 bp, Homo sapiens
  chr11:84578824-84578869
  hypo
taataattatggggccggacgtggtggctcacgcctgtaatccca

SEQ ID NO: 73515 - DNA, 30 bp, Homo sapiens
  chr11:847531-847561
  hypo
ccgggcccctgactgcgtctgggcaaccca

SEQ ID NO: 73516 - DNA, 561 bp, Homo sapiens
  chr11:850546-851107
  hypo
gaaggtttgcaccatcgcggggtccgccccctgcactcagagcggctgccccacgccctggtcccctctcctctcctctcctctcctcacttgatgagacgggacacgttgcacacgtgcgcgccggacagggccacccgggcactgcgcctctcctagggtcggggttcgagtccgggtcgtggccagttttgcgcggggccccggtgcctcctctgcgcccgctccctcctcggtgcagccgttatccttgcctcggccccgcccctccaggcaggcgacctgtcgggcccagggactcacttccgagggtttgagccggctgccgccaaggtcccccagtcgccgggaggcgctgcggaagggaatcctggacactgagcagggccgtgggccatcagtgttcgcgggagacactggctttcccgcgcctccggcagcagaggcttccctaacttttgcggaggtggggtcaggtgtgctcagacctgcagtggtgtccgggggggccctgtgtgctggatggagcagagctgaggtagagggcggacagggttccac

SEQ ID NO: 73517 - DNA, 198 bp, Homo sapiens
  chr11:85071077-85071275
  hypo
tgtgctgaagcagagcgaaagattacccacaggcattatacagatgatccctgtgctgtgtgaaggattcagttggacggaaaagtcctctacaattcaaaactcctgtggtatgatttttaacacacttgtcagcggtttctagttgtcagtttagaaaacaagggttttaaaataaaagtacgcaatacactgtaa

SEQ ID NO: 73518 - DNA, 150 bp, Homo sapiens
  chr11:85359853-85360003
  hypo
caaatgacctcttatcgatataaaacaggtagcaataaatatttaaacgagtgcctgtaatgttgtaggaaatgagaaaatctggtttcataaaagcatgttttcctttgttgttatccctgaactgtttttttttttttttttgtagac

SEQ ID NO: 73519 - DNA, 40 bp, Homo sapiens
  chr11:85379748-85379788
  hypo
agattaagaaacatgcggccgggcgcggtggctcacgcct

SEQ ID NO: 73520 - DNA, 30 bp, Homo sapiens
  chr11:854103-854133
  hypo
ggggcctgctcttcccgcctgtcagggatg

SEQ ID NO: 73521 - DNA, 30 bp, Homo sapiens
  chr11:85521596-85521626
  hyper
gtaaacaggtgctgacgctcctacctttct

SEQ ID NO: 73522 - DNA, 213 bp, Homo sapiens
  chr11:85564766-85564979
  hypo
aaaccccatagtaaacgaacaagatagaccttaactactgactaattctccaaagcaaaaagtcaggaaaataaaaaaatctcgttaagctgtaaaaaataaaaataaaaataaaaatacatatccaggtacatactctttctttctttgagacagaggctcgctctgtcacccgtgcagtggcagtctcggctcactgagatctcagccttc

SEQ ID NO: 73523 - DNA, 199 bp, Homo sapiens
  chr11:858423-858622
  hypo
ctggcacttctgccacggagctggcctctggtcctgcacactccagacacatccaccctggctcacacacaccctggctcacatgcaccccggatcccacccccgctgacactcaccccggttcccatgcaccccaggctcacatgcactcccggctcacacgcacccctgctcacacgcacttcggctcacacgcact

SEQ ID NO: 73524 - DNA, 399 bp, Homo sapiens
  chr11:858987-859386
  hypo
cacccctgggtcacacgcatccccgctcacatgcaccccagctctcacgcacccccgggctcacaccaacagcttgcacccccggcacacatgcaccccggctcacacgcacccccgggctcacacgtgccctggctcacacgcacccctgggctcacatgcaccccggctcacacgcaccccaggtcacacgcatcccctcacatgcacccaggctcacacacccacccccagcccacactcatccccgctcacacacacccccactcacacacaccctggcccacacgcaccttggctcacgtgcaccccggctcacacgcaccccccctttcacacgcaccccgggctcacacgcaccccgggctcacacgcaccccccctttcacacgcaccccg

SEQ ID NO: 73525 - DNA, 39 bp, Homo sapiens
  chr11:85906236-85906275
  hypo
agcccccgccccagccgcacccaccgctgccccaggagc

SEQ ID NO: 73526 - DNA, 121 bp, Homo sapiens
  chr11:86085741-86085862
  hyper
ctaagggggtgaggtcgaatcccagccttgacgccttagcaaccgagcgagcctttctcgcgtcccagcaacgcgcccttccctctgccgggcctattctccctggtgcccctcccttcct

SEQ ID NO: 73527 - DNA, 60 bp, Homo sapiens; identical to SEQ ID NO: 3775
  chr11:86085931-86085991
  hyper

SEQ ID NO: 73528 - DNA, 33 bp, Homo sapiens; identical to SEQ ID NO: 42861
  chr11:860888-860921
  hypo

SEQ ID NO: 73529 - DNA, 599 bp, Homo sapiens
  chr11:8615288-8615887
  hyper
accccacagtaagttcgcttctaaactttcaaaaagtttcacgtcccaagatggggtgaaggtgagacggtggagatgaaccggggcagacagagaccaccccaaataccggacccgggggaaatggggtaccaacggctgggccccaggagacactcggaggggtccgcgggctcggcccggtccctccgctggggggttaccagccggccggcagcgagatacccagaggcccgtttttccaccgcgttgccatagcaacggcctggccggctgcgccccgggccgcccgccccatcccgcgggcccgccctgagccagtgactccagggaccactcaccgcggccggcggactggcgggtctccgacaggtgcgcacactcggcgcaggctgtcgctgagcccggaattctgcaccgggagaaacttttcagcccgcagagcaaccgcagggcagtggacgggggccgcgcgaggacaaacagcggcggcgggtgcaaagccccttctccaagccgcggggttggccgggaggtgccggctgcacaacggcgcccacgtgacccaggtgcagccccaggcgcgcccaagggcagct

SEQ ID NO: 73530 - DNA, 140 bp, Homo sapiens
  chr11:861908-862048
  hypo
tgagactccatctccaaaaaaagaaaaaaagaaagaaatcataaccaggagcagagtgtgagggaatcagcgtttctcctgccacgagtgacaggggacagctggggacatcacagagatcttgtcgggagctgggaatc

SEQ ID NO: 73531 - DNA, 476 bp, Homo sapiens; identical to SEQ ID NO: 42862
  chr11:862616-863092
  hypo

SEQ ID NO: 73532 - DNA, 259 bp, Homo sapiens
  chr11:86382846-86383105
  hyper
ttcaggggcacagggcgcgccgggccaggcttggagtggcagccttgggcgggcgcggtgggtgtccagcgcgggagggcgccgcaggcccggcccggccagggagccagccgcgtgcctgtccccagcgcggcacccatggtccttggcagacctggcacgggagagaaagcaaggtcagggcctccttccagccagccaggacccacgcgcgctgcggggcaccgggcctgatccggggacgcgccctctgggagag

SEQ ID NO: 73533 - DNA, 69 bp, Homo sapiens
  chr11:86385660-86385729
  hypo
tctgtagctgttgcccgcctctacacagcgctaacaccatgttagcatcccagccgtggaaagcgggaa

SEQ ID NO: 73534 - DNA, 101 bp, Homo sapiens
  chr11:864732-864833
  hypo
cccacccggagggtgcgccccaggttgtcccccgccctctgacgcagcgtcctgagccgtctgctcccagcgccccatccgggccgcgcaccgtggggttc

SEQ ID NO: 73535 - DNA, 470 bp, Homo sapiens; identical to SEQ ID NO: 42864
  chr11:865657-866127
  hypo

SEQ ID NO: 73536 - DNA, 33 bp, Homo sapiens
  chr11:86641548-86641581
  hypo
cagggccgggcgcggcggctcacgtctgtaatc

SEQ ID NO: 73537 - DNA, 42 bp, Homo sapiens
  chr11:866956-866998
  hypo
tggaaaacaggttggcgctggaggagccgggtcttggcatcc

SEQ ID NO: 73538 - DNA, 30 bp, Homo sapiens
  chr11:868485-868515
  hypo
attacaggcatgaaccgccgcacacaccac

SEQ ID NO: 73539 - DNA, 265 bp, Homo sapiens
  chr11:869823-870088
  hypo
agaacacgtccaccgcggaggccgcaatgcccacctagagcaggtcgtagaagtagtccaggccctggcccagctcccagatagagaccccaacgcccagctcccgggccagctccagccgcacctgcagggactgggcacagatggaggtgtgagcacctgctggggcctgtccccccaacacccagggatgtcctccaggccgaggggcagcaccgcctggaccccaggccagtgcctgctgtgctgtcgcatggcccacccc

SEQ ID NO: 73540 - DNA, 141 bp, Homo sapiens
  chr11:875376-875517
  hypo
gggcgtggctgggcccgcaggtaatgccagccagtccctgcacctggccccattggggatgtgctcaggagctgctgctagtcagccaaggctcccagaggcacaagctgtagacactgagggccccgggtgtggagaaga

SEQ ID NO: 73541 - DNA, 217 bp, Homo sapiens
  chr11:87908267-87908484
  hyper
cgcttggccgcaagccgctgcctcgagactggaaaccggccgcgaggcgctctatccccctgaccccctccccccgcgctcacctgcgatatcccagagctgcaggcgcaccacagtctccgggtcccagtggagcaccttgagcgcgaagtccacgccgattgtggcccggtagtgcgaagagaagttctggtgcacgtagcgcttgatgatactg

SEQ ID NO: 73542 - DNA, 271 bp, Homo sapiens
  chr11:88241705-88241976
  hyper
gaacacggggggctccgctccgcacgcgcaggccggcgtgctttccagggacattcacaacgacgaggagctctgagtgtaatctcttatgataagagtgtcatatttgggagacgacgggatacagagggccgactcggacactggcgagttgggggttgtgctccccgagtccaccgagtctctgaagggggacggcggggtgagagccaccagctcctccaggtctggcttggcggccgcagcctcgggaccggccgcggggctctcc

SEQ ID NO: 73543 - DNA, 145 bp, Homo sapiens; identical to SEQ ID NO: 989
  chr11:88242130-88242275
  hyper

SEQ ID NO: 73544 - DNA, 266 bp, Homo sapiens; identical to SEQ ID NO: 33997
  chr11:88242358-88242624
  hyper

SEQ ID NO: 73545 - DNA, 73 bp, Homo sapiens
  chr11:8832710-8832783
  hypo
cacttgggatttttccgggcagcagttggggcggaaatgcactcacatcccaggagctcgcctggactggcct

SEQ ID NO: 73546 - DNA, 30 bp, Homo sapiens
  chr11:88796652-88796682
  hyper
ctgttggctgcgctgcgagcagtgagactc

SEQ ID NO: 73547 - DNA, 185 bp, Homo sapiens; identical to SEQ ID NO: 33998
  chr11:88798746-88798931
  hyper

SEQ ID NO: 73548 - DNA, 262 bp, Homo sapiens
  chr11:88798965-88799227
  hyper
cgcccccaggcagccgctcctcgagggcttcctgcgctctcgtagcggccttggctgcagctggagcgctagtgtcggcgatggaggcagcggtgacagcaggcagaacggctgcggggcccgcggcggtggcgctcgctctctcgcgccagcgccgggagcacgtgccgcgctcgggcagacgcagctggaagcgcagcgcagggctggcttatactcccgcagcgcgcggcgggggttggcagaacggccagggcataga

SEQ ID NO: 73549 - DNA, 39 bp, Homo sapiens
  chr11:891173-891212
  hypo
cctcagcaccttcaccggccccgccgactgggagggcac

SEQ ID NO: 73550 - DNA, 350 bp, Homo sapiens
  chr11:89224313-89224663
  hyper
gcaggacagagagaacgcaaggagagcctagcccgccatcctaccaggcagaggtgtttaaccccttcgttggcgagccagctcctccaggacacagccatgccgccggccccgccgcgctgcgctctgtgcccgccggaccgagaaggagcgggcggcggccggggcagcggttacagttgtgcggcctgccgggccgctgagcgaggaccgagggtcaaagactgagtggaagcccgaaggcccggcgccgagccagcccgggcggggtctgctacccagagccgggttttccgggcgccctgactcccacccgcaccgggtcagctctgcccactcagctgcccaga

SEQ ID NO: 73551 - DNA, 53 bp, Homo sapiens
  chr11:89224735-89224788
  hyper
cgagcctgttgttgtggctgctgctgttcaggatgtcccgggtgggaacttgg

SEQ ID NO: 73552 - DNA, 70 bp, Homo sapiens
  chr11:89785710-89785780
  hyper
cgccctctcgtggagcggaggcagctcaagctggtacttttcccccaaccgctcccggcaggggcgctcc

SEQ ID NO: 73553 - DNA, 21 bp, Homo sapiens
  chr11:89899713-89899734
  hypo
tacagattggctgggcgcggt

SEQ ID NO: 73554 - DNA, 30 bp, Homo sapiens
  chr11:89957319-89957349
  hypo
cattgttacaaatgacggagtattctgttg

SEQ ID NO: 73555 - DNA, 1338 bp, Homo sapiens
  chr11:9025010-9026348
  hyper
aaaagaaagaagacccgagggcaagagggcagggcaggacctcttctttctactggagaagagacatccagggaggaggcacagccgaggggagcgcaagctagaaaagctacgacggaatccccaccgaaaccgcagcaggggtactggaaggggaggaatccgcgacgcagcgaccgcgagccaagggcagcggcgggccgggccgtgactcagtgaaagccgcaacggccgggcctcggaaaacggcgggcgcgaagccgccggggccggggcgagaacggcggcgggggctcaccatgtccttggacgagcccagcttcttgaggccgtccaggggcagcaggtcggcggagtccttgtggatgaactgcaccgcctgcttcatccggcgctgctgtcgcagtgacgccgcctcccgcatgtcggtctccttgcggccgccctcagtgaggagccctgagtaaaacatcgctgaggcgccggcggcccggtagcccacagccccccggcagcctcagcctcgagctcctccagcgccgcaagggccccgagccgcgccttttatagccgagcgtgacgtcgcggggagcagccagtgcgcgcgcggggggcggggccggcacagagtccacgccccgcgcggctccctcgcgtcccgcgtcccgcgtcccgcgtcccctgctcacccggtggcaaagccggcgaggaggcggcggcgctggtggggactgacccggcagtccgagaatccaccgcggccttttcacccaaccgccccctcctgcgtgggggccccgcatcccctggactggcgtgggctctggggcccgatgccctggcagccccggccatctctgccgctggccgcgggtacctgctcacctgtccacgccgtggccgacccggggatcaccgacagccgggccatgcctcgagtcccgccgcccgcgccgctgctcggcttctcagaaacgcacctccacgccgccagccggggctccagggtccaccgcccgggcccggaggactggcgactccctccgaggttgggagcgctccggatttctccaacttcaggtcggtccccacccaccgggccacgtgactggggagggggcagccggtgcaggcgtgtggaggaggctttcgggacctcctcccccgggcaccctctgcctgcagcccggcacccggcccgcgtttccgagccgggggagcaggtgcagtcggaagcccgcgggtgggcgtggggcgggggagtggcgagggtcccccgcctccgcgggagcgcacgcggctgcgagccctacacctgctctccgaccaaagaagcac

SEQ ID NO: 73556 - DNA, 30 bp, Homo sapiens
  chr11:90705557-90705587
  hypo
tttgctctgcggtcccggggacgcctgcgc

SEQ ID NO: 73557 - DNA, 140 bp, Homo sapiens; identical to SEQ ID NO: 3690
  chr11:9112446-9112586
  hyper

SEQ ID NO: 73558 - DNA, 332 bp, Homo sapiens
  chr11:9112639-9112971
  hyper
cgcaccctcctgcctgctcgccggcgacggtctgactagcaggcgctctggaggcatccggaccggggcgggaaccgtcagcagctccgggtccgaggccgggccgaaggactcagggccccagcggtcgtggcgccttggcccggccggcgggtgaggtcccggggggagcagaggcccccgcggagctgcagccgccagccccgagccccgcgcgcccggctctggactccgccggggacctaaacactcttcctggccctgcctgctgtgccaggtgcgcccccgcggccggacactcaccctcctgcggccccgcggcacggccccga

SEQ ID NO: 73559 - DNA, 465 bp, Homo sapiens
  chr11:9113031-9113496
  hyper
accgcccaggccgccccgggacggttgcggcccgcgacccccatggatggctcagcggttgcgggcagaggcggcggagtgcgggcggtggcggcggcggcgcggggaggtgtgcgcggacgccctgcccgctgccgctgccacccccggcccggccccgcccgccccccgagccccggcctcattttcacacggtccctcccgggccggggcgggaagcgcaggcgggagcagtgccgccccgcccggcctcctcccgtcccctccccggcctcgggtggagggggcgcggccgcggtggcccgagcgcggctgtcagcctggcggggcggcagcaccgtgcctcgcgccccgcgcagccctggcacccagcccgctgccccccgcatccccgctccgctccaacgctcggagccctcggtgccgcgcctgttccagtgtgttacaactcgacccaggccctca

SEQ ID NO: 73560 - DNA, 674 bp, Homo sapiens
  chr11:91957315-91957989
  hyper
gaagagattggaccacgttagctgcttagtctagttccctcctccacaaggcaatcggatgaccccaggatctcaatgtttaggaaagtcgtaggagccctcactgggaggcacatttttagtccagaggcacgacatttgatggtttaatcttcacactacaaactagccttgggacgttatataaaccatgttaacctcgatgtgcctcagtttcctctttgtcccaggagagtaacgcgttctctgtcttcacagggatgtggtgcgggtgagactcaatgcactgtgcgaaagctctcccaagccagcaagcaccacgctctccccgcggcaggaaagtacgttggtgtcatcctagagccccagagggctgagggaagactcgagctctaaaattagccgcttccaggcccggcgccgggaatgccctccagttcgccgcgcctcctccgccgccccctcccgcgcgccccctctcccctgcgccacgctcctagatcgctagtcatccccgccgccgaggctcctctccccctcgcccttttcgctcgcggtttgggaggaggagactgcgagagacaagcgcgagggggagactggagaggggcttggccgtgcgtcggcgtcggctgtgatggggagcccggagcagccaggcggcgagcagtagc

SEQ ID NO: 73561 - DNA, 1337 bp, Homo sapiens
  chr11:91957990-91959327
  hyper
gcggcggctgcagctcggagcagacaggagagccggcgctcctccccgcaggctgcgctgtgaactggcctgcggattgggatctcgcgcctcccgtccctctcctcccgctgctgttctcttcatctcggctcccctcctccgcttgcgaacccccggcggcggcggcggcggcgtcccgagcgcagagcgcttctgctcgcggcctcagtcccggctagcgcgcggtgggcgctgcggcggcagcagccgggggaccggctcgcccggagcaagagcgccgagcaccgggtgaagaagaccacgggggaggcgcctcgtagagccgtggatcgccagcggaggcaagggtgcgtggggatttgtagcgtgatgatttggctgcctggtgcaccgactggagcgcgcctgccggagcacagcctcagctgctgggtgcaaatgggctgcgaggtgggctggggaggcgagagccgacgaagcgcgtgggggaaacttttcaccttgtaaagttccaacctccgcgcagccccgagccgccgttgctaccgctgcaaacaggagaagagggtggcttggccccgcggcgggagccgggaggtttacacggagagttggccaagtttggggctgaggatctggggaggggttgcgaggggggttgcggatcagtgcacccatccccggctcccagccgcccctgcaggtggatgagaaggttcaggtggcgagcctgcttggcagccggtgcctctcgggcgcagtgggggatgttcagatgccgatggatgatgcacttaggggaccccgaggtgcaagttgggtcatcgctaggcgaggcgcggcgcagagagggagcccagcctccactttcgctaggaaagggaaagggttaccagtctgcgggtccgttccccacgcctgactcgggcttgcggggcttgtggtcagggtgagatgtagtgaacggcggcggcggctcttcgactggggacgacatcctttacggagtggttggggacagagactgtccctgctatcttgacaaggagagggaaccggaatgctttgcgagagtgcatgatttttggcgggcgtgtgggaaggctgcttgtctttgaaaagaaagcagcgcgggtctgaccatccccaggagtgcggaggagctgtctccggattgggggcgagaacgccaggggcaccagctccgagctcaggccccactcccgggcggttcgggacgaatcccctctacaggccagtgtgtgtgcagggcaagtgtagggggctgaggggcgctggcggggaggcagtagaggtggcctggaccatcttgg

SEQ ID NO: 73562 - DNA, 275 bp, Homo sapiens
  chr11:91959354-91959629
  hyper
cgccagtgggagtcgctgagctaaagtgcatctggccccccggcttgcatgatggcgagcccggatatttttagctgtgctgtgatctgaattccctcctctcctctctcgttgacttttgtcacatgtgctttccgagatggtttaacattgaacatgattgggctttgcggaaagcaacttttattcactttccaccgttctcctcttgtgggcggggggtggcgggggcgtgcttggggcaaggatgcaggggtggccggagtttggctgcg

SEQ ID NO: 73563 - DNA, 128 bp, Homo sapiens
  chr11:91959986-91960114
  hyper
cgaacctgcagcagccgcggcgggagggagggacgctgggaccgcggtaatgattgaagtctttttcccccctctcccctcctcccgctcctctccgcccccagactctggcgcgtttgttttccaag

SEQ ID NO: 73564 - DNA, 101 bp, Homo sapiens; identical to SEQ ID NO: 34006
  chr11:91960369-91960470
  hyper

SEQ ID NO: 73565 - DNA, 73 bp, Homo sapiens; identical to SEQ ID NO: 34007
  chr11:92675236-92675309
  hyper

SEQ ID NO: 73566 - DNA, 30 bp, Homo sapiens
  chr11:9285492-9285522
  hyper
caggataatcactttcgaaagagaaacttt

SEQ ID NO: 73567 - DNA, 85 bp, Homo sapiens
  chr11:92929479-92929564
  hypo
cattacttatttcctcgggaaatattctgaaggagaattgctgggtcaaacgataagcactttttttttttgagacagagtctcg

SEQ ID NO: 73568 - DNA, 30 bp, Homo sapiens
  chr11:92931349-92931379
  hyper
aacttaaatttggggcgcctgtccgtatgc

SEQ ID NO: 73569 - DNA, 610 bp, Homo sapiens
  chr11:93063447-93064057
  hyper
tgatgaactccccagcggtttacagttccttcgtgatctatttggttcattcattcaacaagtatttccgggctgcagcttgggtgcccagccttggggtaggcagtgggactacaaagaggaaaggacccagaatagagggggcactggacgtataactgcgggacagcgaggtcgcgctcgcgcggggtgaggttggaggcagccgaggagccgcacagggcagcgcctgccgccgccgccgcgcccatcccccactccgacggccacgagttcgggccgcgacgtccccatggcaacacgcggcggcgccgcgcgcggggagggagaggcccaactgcctcgttggtcgcgcggcgggagggcccaggcggcgggagcgcggcggcgggtggcggggccccttggggcgggcctggcggggcgggaggtgacatacgcggtcctgcgccctcgcctcagacctctcgggcgagcgcggcgcagcgcaggtaatggctcctggccttcccggccccgcctcgcccctgaccctcacccaaaggccaggctgcgcgggtcctcgagcgggacaggggaaccccaaaagggcggccgctctgcgggaggc

SEQ ID NO: 73570 - DNA, 88 bp, Homo sapiens
  chr11:93476681-93476769
  hypo
cacccaggcctgctgcgctccaccctttatgggagggtgcgtgggggtgagcagatgctggagccggagcgagcgcttttggtcgccg

SEQ ID NO: 73571 - DNA, 157 bp, Homo sapiens; identical to SEQ ID NO: 43011
  chr11:9405392-9405549
  hypo

SEQ ID NO: 73572 - DNA, 37 bp, Homo sapiens; identical to SEQ ID NO: 43012
  chr11:9405789-9405826
  hypo

SEQ ID NO: 73573 - DNA, 21 bp, Homo sapiens
  chr11:94064788-94064809
  hypo
ccaccgcgcctggcccaagaa

SEQ ID NO: 73574 - DNA, 415 bp, Homo sapiens; identical to SEQ ID NO: 34009
  chr11:94134049-94134464
  hyper

SEQ ID NO: 73575 - DNA, 179 bp, Homo sapiens
  chr11:94134682-94134861
  hyper
cgacggtgacgcgctctggctctgacaagcctggctccccccaccctaccgggtggcgccgttgctgaccccacgcccagccgttcccactcccgcctgaaactcctccgacagggcttcgcttcgggggctcagtccccagcgcgtacacactcgcgtggtgtcggcttagcctcttg

SEQ ID NO: 73576 - DNA, 169 bp, Homo sapiens
  chr11:94156922-94157091
  hypo
ccctgagggtccagacgatggagccacaggctggtcccagtgctacagggctacagcacacagctggggctgtcgagctaagagctggggctggcactcaagtaggggagaaatcccactttcagaacactgaaaggagtgagacacgtgggttcgtgggccagtgcag

SEQ ID NO: 73577 - DNA, 30 bp, Homo sapiens
  chr11:94275224-94275254
  hypo
atatgcatgagacctcgggcattcttcagg

SEQ ID NO: 73578 - DNA, 26 bp, Homo sapiens
  chr11:94275794-94275820
  hypo
ttttttttttttttccgagacggagt

SEQ ID NO: 73579 - DNA, 26 bp, Homo sapiens
  chr11:94276060-94276086
  hypo
gggagtataggcgtgagccaccgcgc

SEQ ID NO: 73580 - DNA, 190 bp, Homo sapiens
  chr11:94277933-94278123
  hyper
ggctgcgcttcaacatcagcggctgccgcctgctcaccgaccgcgcgtcctacggagaggctcaggccgtgcttttccaccaccgcgacctcgtgaaggggccccccgactggcccccgccctggggcatccaggcgcacactgccgaggaggtggatctgcgcgtgttggactacgaggaggcagcggc

SEQ ID NO: 73581 - DNA, 248 bp, Homo sapiens; identical to SEQ ID NO: 34012
  chr11:94473423-94473671
  hyper

SEQ ID NO: 73582 - DNA, 97 bp, Homo sapiens; identical to SEQ ID NO: 3783
  chr11:94473672-94473769
  hyper

SEQ ID NO: 73583 - DNA, 108 bp, Homo sapiens
  chr11:94473802-94473910
  hyper
cggcccagcgcccggccgggggagccgcggggtggcacgcggggaaagttggcgcgcgcctgaccgcgcctggaagccgcgcggtgccagggccgagttgtcccccaa

SEQ ID NO: 73584 - DNA, 58 bp, Homo sapiens; identical to SEQ ID NO: 34015
  chr11:94474489-94474547
  hyper

SEQ ID NO: 73585 - DNA, 613 bp, Homo sapiens
  chr11:94501445-94502058
  hyper
gtagggttctagtgacgagcccgggcgaccctccccggcccgcgcgcggggagcggggagcgcggacggcggcgggagcgcgcgagaagctctaggacccagcagcggttgtcgggtttggggctggaggtgaagccctgtgtgaatggggttgattgtccggcgccacttccccgcgctgcccggcagccgtcttccccagccgagggactgaactagccatgatcgcctcatgtggagggcaaagttgcgccggggaacttgtgagcctgcggtgaaaggtaaccagcccccactcgaggtgccgggagggcgtctccgagtctcccacgcgaagaacccagtcgccccgggctccccgggcccctgctgctcacggaagggggcagcttctgggggcccggggctgagatcccagattgttgtttttaagcgggttcccttgccccgctccaggtccagttgcctgcgggccgggcctcagcgtcttgccgccccgcgacccacgttgactgaagttgtggccccggggtttgggccccggggtgctgcgcgcccgacgcggggctggcctttcctgaggggcgcagccatatggccagacactccgagg

SEQ ID NO: 73586 - DNA, 180 bp, Homo sapiens
  chr11:94502372-94502552
  hyper
acaataatctgctttcgcggggagaaaatttaaactttccaaatggaactgttttttcttggaatgtgacatttgtggcaggagggagagtggtacgttggccgatgacagccgagcggaacggtggcctagtgccgggacagggaccgagcgtgccccataggcggccgggctggagga

SEQ ID NO: 73587 - DNA, 15 bp, Homo sapiens
  chr11:94502757-94502772
  hyper
cgaagatttttgcct

SEQ ID NO: 73588 - DNA, 247 bp, Homo sapiens
  chr11:94884155-94884402
  hyper
ctctttccctttctccggatgcgggcctttgagagtcagcgacgccttagactcctcccagaaaaatgcaccctcatctacccaattctgccctaccctttggagctcctggaccctctaaccgctcggtggggtcagagcccacccccggaagggccgctggtcggggactggttcgccctctcctggcctcctcggaccagtgcgcggggaggatcccgctaacgccgggcgcctgcagaccttg

SEQ ID NO: 73589 - DNA, 18 bp, Homo sapiens
  chr11:94885458-94885476
  hypo
agtaggataaaaggccgg

SEQ ID NO: 73590 - DNA, 26 bp, Homo sapiens
  chr11:94892054-94892080
  hypo
tcctccctgggcgacaaagcaagact

SEQ ID NO: 73591 - DNA, 24 bp, Homo sapiens
  chr11:94895717-94895741
  hypo
gcgagactccgtctcaaaaaaaaa

SEQ ID NO: 73592 - DNA, 30 bp, Homo sapiens; identical to SEQ ID NO: 43237
  chr11:94924721-94924751
  hypo

SEQ ID NO: 73593 - DNA, 30 bp, Homo sapiens
  chr11:94965054-94965084
  hyper
atttacgcaagtaatcgagtttgaggggag

SEQ ID NO: 73594 - DNA, 146 bp, Homo sapiens
  chr11:95007432-95007578
  hypo
cacttcatccaaatccgttaatttaatgattaaaaaaaatctccatccatttggtcctcactgggcccgttatggaatcagactgttaaagctagaagatgcaagagaccattgatatggttaggatttctgtccccacccaaatg

SEQ ID NO: 73595 - DNA, 30 bp, Homo sapiens
  chr11:95462538-95462568
  hypo
caccacagttctaaacgaataaacgaatga

SEQ ID NO: 73596 - DNA, 94 bp, Homo sapiens
  chr11:95488635-95488729
  hypo
gaggatagaagtgaccgggcaaagaagagaatctgctatgtgaagagcaccaacaggattctatgacatgaaggaagcccgttagatatctctg

SEQ ID NO: 73597 - DNA, 43 bp, Homo sapiens
  chr11:95658708-95658751
  hypo
ttctctgtgcagagtcggttgcacagtacggtctcactaagta

SEQ ID NO: 73598 - DNA, 26 bp, Homo sapiens
  chr11:9567879-9567905
  hypo
ctgttcctattcggccatcttggctc

SEQ ID NO: 73599 - DNA, 30 bp, Homo sapiens
  chr11:9593400-9593430
  hypo
acaaaaccacatcaacgaacatccactgat

SEQ ID NO: 73600 - DNA, 35 bp, Homo sapiens
  chr11:971825-971860
  hypo
tgtgccccacaggaacgctgcgccatgagagcatc

SEQ ID NO: 73601 - DNA, 46 bp, Homo sapiens
  chr11:9830623-9830669
  hypo
ccctggataatcaaacgacttagggataaagcgcttgcacaaaaga

SEQ ID NO: 73602 - DNA, 172 bp, Homo sapiens
  chr11:98437969-98438141
  hypo
cccattgcagagtaccggacaggagcggctataatggctgtggaaatcactcttggccacctcagtgcctttctctctttgttgccagggacactcaacagcgctgggctaaccatgtaagctttaagggtcgggtgcccagctaaggccaacacagcgcagtggcattcta

SEQ ID NO: 73603 - DNA, 120 bp, Homo sapiens
  chr11:98480681-98480801
  hypo
gactccgtccccccaaaaaaacatacctttgattaccatataattttagaatatttaatataatctcacacaagtccatttttatagtagttgaaaaagttttttttgttgttgttgttt

SEQ ID NO: 73604 - DNA, 199 bp, Homo sapiens
  chr11:985267-985466
  hypo
ccaccgtgcccggcctgtctcagttttgtaaatgcttccagctgggtacacaaatgtgaatgaactatattaaaaatgctctcatgatgtatgggtgcagccgggaggggcagggtgggctgcgggccactggagactggtgagcaccgttctgtcttgcccagaagaccctgcagtgcgaggccgcctgactgagtgc

SEQ ID NO: 73605 - DNA, 30 bp, Homo sapiens
  chr11:98627345-98627375
  hypo
tccgttttgacagggcgtggaagtaagcgt

SEQ ID NO: 73606 - DNA, 146 bp, Homo sapiens
  chr11:986867-987013
  hypo
tggagagcatgtgcacgctggccagctctgagttctcccatgaggctgtcaagacgcacatcgagacggtcatcaacgccctgaaggcgagtgccctgtccttgggttctgctcactccctgagcaggtgccgtgggtcttcctgt

SEQ ID NO: 73607 - DNA, 818 bp, Homo sapiens
  chr11:98891098-98891916
  hyper
agtccttagatgaaacgcgtaagtgcagaaacaaaagagaagtgcttcccattcaggacttaagaaaattctgcaaagtgaaaaagtccactctcaaaccgacctaagtgaacgcgtcagtctgtgctgctgctgtcagaggtgtgagccggggactacaggaatcagagtgaagacaggagcggaggaagggactctcgcctggatctcccgtgccgactccagccagcacgtttgctttgtaatctatgaatgttaaatacggaggggttgcagagcagaaacgctcggggaaggggggcaggtcctctgtacttagcagggaaggaaaatgccggttgactagtgagacgagtggagaaacacagagcaccctccgggaggcgcacagttcgttaagcccagggacatgctcaatgaacctttgcagcaagaggcagtgaggcgctggacgcgggcgccggtgacagcgcgggcggccggggaggggcgaggggccgccccgggaggacacagccagtcagaggcgcggggcgcagggcgcgcggacgcattggaggaaaacacgcgagccccaaacacaccagccgcaggaggcgccgcacctacttcccaatataaccaactacggcgtgggggagcggaactgcgagaaggcggcagccaaagtgccattaaagctcggggcggagaggatgcgttacctgggtcccgtctgctgcgagaggcagggcaagctggaggattccctctgaatgattaagaactccgcaattcgcctctgccacaggctgcaaaggacccgaggaaccgctctc

SEQ ID NO: 73608 - DNA, 258 bp, Homo sapiens
  chr12:10029304-10029562
  hypo
agccatgtaacttaccgcactgtgtaataccagaggtatcaacggtgagaaaaaattttgtggaatttatggccaagtcctaacgggtgaaacataatttctactgatcctttgagtcctagagcaataccaggtcaattatagctaagcatttatagagcttttgtgaaatagctcctggcatgctactggaccttgcagaaatagattacttggatgtgagtcagcaggcatccgtatgttctgaactgccattaa

SEQ ID NO: 73609 - DNA, 33 bp, Homo sapiens
  chr12:100595448-100595481
  hypo
ccgaggctggagtgccgtggtgcgatctcagct

SEQ ID NO: 73610 - DNA, 29 bp, Homo sapiens
  chr12:10085916-10085945
  hypo
gtaaaactggctgggcgcggtgtctgtca

SEQ ID NO: 73611 - DNA, 28 bp, Homo sapiens
  chr12:10086245-10086273
  hypo
gcttttggtgcttcggtgcagagacaga

SEQ ID NO: 73612 - DNA, 26 bp, Homo sapiens
  chr12:100969543-100969569
  hypo
ccgcgcctggccgttatctctatttt

SEQ ID NO: 73613 - DNA, 151 bp, Homo sapiens
  chr12:101025396-101025547
  hypo
ggatttcttttgttgcgttaacatctagagattgtagtatttttacagaagaaagatgctggaaacgtcccaatttattgtctaggtttttttttttgttttaaaatatttattttcagggttgtgagaggctactcggagcgtaacactg

SEQ ID NO: 73614 - DNA, 30 bp, Homo sapiens
  chr12:101109113-101109143
  hypo
aattaaagtgcaattcgtaactcattgtga

SEQ ID NO: 73615 - DNA, 858 bp, Homo sapiens
  chr12:101110839-101111697
  hyper
cccgagaggctgtggcgcgcctgggactccccgacccttgccacgacatccctgccaccccttttggcgtgaacccaccggggatcccgcccgacgccggctgcgctgggccaaatccgcggcgcgcctctgccgggcacctcccacctccagcttcgcccctcccctctcccggccgcgcgtcctccgcggctggttcaatccccgcggggacccggagcgcggctgccggtctacgccctctctcctgccgctctcgcggcgcagcccggccgggggcccccgcgcgccggcagctctaggggcgagcgcggcgcgctgactgggcgtgctcagccgcggagcgcccgggcgccgctagagccaagcgcatgcactcgccgggccgggccgtccaggggcgcagcgcgcagggggccgctctagccgacgccctggccagtctgggcaggacgcgggccaggatggcctccctcaccgcatacggtaactggggccgtcgcgggttcctggggcggcggggcggaagggaggggcccagggagccgtcgaaacacccggggaaacttcggggttcgcctctgcggaggggtctggaagggagggagacggcggccgtgcgcgccgctcctgaggggccgatgttccgcggggtttcgggccgcgggtaacccgggaaccgggtgtctgcgggaaaaacgcttcaaaatttgggaggatctgggagcttcgggactctagaaacattcccctcgcttccgaccactcaggggaagggacgcgggtgttaagtcctcctctagcggggtgaggcttggagttgggagatgtgcgttcagccagcgcttatcttgtccc

SEQ ID NO: 73616 - DNA, 21 bp, Homo sapiens
  chr12:101254680-101254701
  hypo
cttcaagaatggggccgcgga

SEQ ID NO: 73617 - DNA, 100 bp, Homo sapiens
  chr12:10187643-10187743
  hypo
cctggagtctggccactcagtggcccaggctctcctctgattgtcccggccaaactctgccttgtttcaccagttggtggcctgccgatatgctcttgac

SEQ ID NO: 73618 - DNA, 30 bp, Homo sapiens; identical to SEQ ID NO: 43532
  chr12:102158693-102158723
  hypo

SEQ ID NO: 73619 - DNA, 137 bp, Homo sapiens
  chr12:10243173-10243310
  hypo
gagatttatatgaaacgttatttccaaatggggaatgataactagtaaagaatatagaaatagacagtataattactatcctctggaacttacaatctagtaggcaaaataagttaaagtctcggagaagacatact

SEQ ID NO: 73620 - DNA, 48 bp, Homo sapiens
  chr12:10264235-10264283
  hypo
gtggggacaagtgggcgagtagccgccgcgactcggcctatcatgtcc

SEQ ID NO: 73621 - DNA, 30 bp, Homo sapiens
  chr12:10264869-10264899
  hypo
atcagtggaagtaagcgtgagatcacggtg

SEQ ID NO: 73622 - DNA, 30 bp, Homo sapiens
  chr12:10268125-10268155
  hypo
ccggcgtcctgagtgcggtgagtaaagatg

SEQ ID NO: 73623 - DNA, 179 bp, Homo sapiens
  chr12:10306356-10306535
  hyper
cccagccagcacatccgccatcctgcaccccaggttccggcacgggctgcgacggggcctcggaactgctcccaagcggctgggaaagaactcagtcaggcatgtcggcctgcaaagcacccaggatgggcagtggagtctgcaccgttgacaggctcctagagcggccaggcagagga

SEQ ID NO: 73624 - DNA, 91 bp, Homo sapiens
  chr12:103100245-103100336
  hypo
gccaatcacctagacttattataattagagttactagtcccttcaggttaccagtgaatttttttctataaagcaccgaggcttcaaagac

SEQ ID NO: 73625 - DNA, 361 bp, Homo sapiens
  chr12:103218204-103218565
  hyper
tagatcttcatcgggcgcccctttctcatctctcgggctctgactcctcttggggtgcttagttcaaggctggacagcctagaagacacccaccaagtgtgggtggggaagaagcagagcaagggcaggccgacccgatctgcagccacactccttgtcctccgggtgaaactgcagaccgcacagcgctgggaggacacatgggccacagggcgggagctgtccgtggttctggccggcgtcgacccgtgggtatttaagggttggggcagcccgcctaccttctgctaaaccgcagggaggagtcgggggctgcagaacctggattggttttaattaacccacgcgcaggcaaggtctg

SEQ ID NO: 73626 - DNA, 130 bp, Homo sapiens
  chr12:103311160-103311290
  hyper
ggagggtgtgggggacgcaggaggcaccacttcgctgcccgccctgggtaaagggaagaagccagggagcgacgggccacccaagccccgtcgattagacaggtttaggcacttccgggactctcagaag

SEQ ID NO: 73627 - DNA, 115 bp, Homo sapiens
  chr12:103344593-103344708
  hyper
ttgggggctgagactcgccaggacgcactcagaatgaactttccgcgcaggtcagatataggcacccaggggttttgtgacgtcacaatgccgtctgacccggtgaaaggcaaag

SEQ ID NO: 73628 - DNA, 106 bp, Homo sapiens
  chr12:103350198-103350304
  hyper
agcgacggctgcaagcgcctccccctccctctcggcgccagcacgcggccccgccgggctccgctcccagtcgcctgccaccgggccgccgggcacacgcctgggg

SEQ ID NO: 73629 - DNA, 239 bp, Homo sapiens; identical to SEQ ID NO: 34577
  chr12:103350383-103350622
  hyper

SEQ ID NO: 73630 - DNA, 570 bp, Homo sapiens
  chr12:103351416-103351986
  hyper
gtcccattgaaaaggcggacgcactccggcagcccagcactctctcacttctggccagggaacgtggaaggcgcaccgacagggatccggccagggagggcgagtgaaagaaggaaatcagaaaggaagggagttaacaaaataataaaaacagcctgagccacggctggagagaccgagacccggcgcaagagagcgcagccttagtaggagaggaacgcgagacgcggcagagcgcgttcagcactgacttttgctgctgcttctgcttttttttttcttagaaacaagaaggcgccagcggcagcctcacacgcgagcgccacgcgaggctcccgaagccaacccgcgaagggaggaggggagggaggaggaggcggcgtgcagggaggagaaaaagcattttcactttttttgctcccactctaagaagtctcccggggattttgtatatattttttaacttccgtcagggctcccgcttcatatttccttttctttccctctctgttcctgcacccaagttctctctgtgtccccctcgcgggccccgcacctcgcgtcccggat

SEQ ID NO: 73631 - DNA, 104 bp, Homo sapiens; identical to SEQ ID NO: 1058
  chr12:103352051-103352155
  hyper

SEQ ID NO: 73632 - DNA, 97 bp, Homo sapiens; identical to SEQ ID NO: 1059
  chr12:103352170-103352267
  hyper

SEQ ID NO: 73633 - DNA, 15 bp, Homo sapiens
  chr12:103352268-103352283
  hyper
cccaagcaagtcaag

SEQ ID NO: 73634 - DNA, 524 bp, Homo sapiens
  chr12:103352313-103352837
  hyper
cgctgcaaacgccggctcaacttcagcggctttggctacagcctgccgcagcagcagccggccgccgtggcgcgccgcaacgagcgcgagcgcaaccgcgtcaagttggtcaacctgggctttgccacccttcgggagcacgtccccaacggcgcggccaacaagaagatgagtaaggtggagacactgcgctcggcggtcgagtacatccgcgcgctgcagcagctgctggacgagcatgacgcggtgagcgccgccttccaggcaggcgtcctgtcgcccaccatctcccccaactactccaacgacttgaactccatggccggctcgccggtctcatcctactcgtcggacgagggctcttacgacccgctcagccccgaggagcaggagcttctcgacttcaccaactggttctgaggggctcggcctggtcaggccctggtgcgaatggactttggaagcaggtaggttgcattttggggtgggcaggggggtattcttgccttcgtcctccctctgag

SEQ ID NO: 73635 - DNA, 312 bp, Homo sapiens
  chr12:103358661-103358973
  hyper
gttctttacccactgcgaaagcgaatggcttggatctagcgcaggtcgaagttatattccttcttcctttgtatgcaagattaggttgttacaaaagagggtgtgtaggttaatggcaggaagcaagttgcagcgcggagcgcgggccctgagcgcgtgtcaggcttaatgatttattcaagctgcagcgcatccgggcgttgattggctgcaggcatgcgtccgctgtcagctgcgcgcgccgggaactctccaggctacctgaagctggggggaggaagaggaggcgtggggacccgaggggagaggtgt

SEQ ID NO: 73636 - DNA, 339 bp, Homo sapiens
  chr12:103359233-103359572
  hyper
gagacaggagtgggacgcgctcccagaacgtcccgcgtgcgcccccctctaggcagccagcgggcggccgcttacaaagccgcctttgatgctctggctaccagggctattttggggacgagatgggggaaagccgccaacccacactccttggagggagtcactttctgcaaagtgcgttggagaggactgggccctgggtccgggctgtcgaagcaggaagtggatgtaggggacaaaagctccgcacctgccaaatgcgagaccttagagagagcctccccctcgccgctccctgctcccccgcgggcccgggaagcttgcactaccgggctcagc

SEQ ID NO: 73637 - DNA, 145 bp, Homo sapiens; identical to SEQ ID NO: 34585
  chr12:103359573-103359718
  hyper

SEQ ID NO: 73638 - DNA, 41 bp, Homo sapiens; identical to SEQ ID NO: 43385
  chr12:10363278-10363319
  hypo

SEQ ID NO: 73639 - DNA, 222 bp, Homo sapiens
  chr12:10364324-10364546
  hypo
tggggaaatccagaacgaggcttcgcctcacctgccctaatgcccaatcttctactagcattccaggcagcgctttctagtcacgtgagggatacctaaccactggaactaaataagatgtgggggaacaactgaggtcatcacctaaattgcttgatactctcttttccagaagacgagccccctttctgagtttatggcagaaagtgaatccctccctcc

SEQ ID NO: 73640 - DNA, 30 bp, Homo sapiens
  chr12:10366550-10366580
  hyper
agtagttaaaactaccgcaggcagtgagta

SEQ ID NO: 73641 - DNA, 351 bp, Homo sapiens
  chr12:103889165-103889516
  hyper
cgcccccaaccgctccgcccggcccctcccccgctccctcccccacccctcccccttcctgtattagcatgcgggcggcggcgagccggccgggtggggagggcggcggtggcatcgctgcgcggggcgcattgtgggccgcgctcgcctccgcgggggaccatctgctcgctgtcaatgcatcacctgctcgtctgggccgtcgccggggcaacggggggcgggggattaaggagcgtgtgcgtctcggtccgggccgaggcggcgaggtgggggttggggcgggggaggagagctccttggccccccacccccctgccccgagacgggtcgacccgctcgggggccggc

SEQ ID NO: 73642 - DNA, 197 bp, Homo sapiens; identical to SEQ ID NO: 1063
  chr12:103889517-103889714
  hyper

SEQ ID NO: 73643 - DNA, 237 bp, Homo sapiens; identical to SEQ ID NO: 34588
  chr12:103889788-103890025
  hyper

SEQ ID NO: 73644 - DNA, 30 bp, Homo sapiens
  chr12:103897121-103897151
  hypo
tcacagtcctcgttccgccccctcgcccac

SEQ ID NO: 73645 - DNA, 207 bp, Homo sapiens
  chr12:103922840-103923047
  hypo
aacaacgaaaaaaaacgccattgcaaactataccatgaaaaccaataaatgcccatcctccaggtgcctgagcatgacttaaaaataggggtgaatcctatccacgtatcggcatctggtgtcaaatcatcacaatgaacagtagcacaagatctcaacctttgtgttcacttattttactcctctctttaccgttattaatagctg

SEQ ID NO: 73646 - DNA, 175 bp, Homo sapiens
  chr12:104322966-104323141
  hyper
gcatcctcctgcactcgttaaactaagggttttccttttctgtgctagacccgcttttacgaccacgctctccacctgattcacagaaagggttctacgaccgtcaggtcaccgccgcctttgtactttattggggagtcgaaggcctcagcgctgctcgcgatttccctaaggt

SEQ ID NO: 73647 - DNA, 18 bp, Homo sapiens
  chr12:104354143-104354161
  hypo
acccggccaatctgtacc

SEQ ID NO: 73648 - DNA, 30 bp, Homo sapiens
  chr12:104539506-104539536
  hypo
taaggcatttatattcgtctgttctcacgc

SEQ ID NO: 73649 - DNA, 190 bp, Homo sapiens; identical to SEQ ID NO: 34590
  chr12:104609336-104609526
  hyper

SEQ ID NO: 73650 - DNA, 270 bp, Homo sapiens; identical to SEQ ID NO: 1066
  chr12:104609527-104609797
  hyper

SEQ ID NO: 73651 - DNA, 158 bp, Homo sapiens
  chr12:104671514-104671672
  hypo
acttgttgtttttaccggtttttagcctgttcctcactctatattatttaattgtaagacaaacaatggatttggaggtaggcacagttggatttatataccagctccaacacttacctggtttgtgacctttggcaagattcttttttttttttttt

SEQ ID NO: 73652 - DNA, 30 bp, Homo sapiens; identical to SEQ ID NO: 15682
  chr12:104690709-104690739
  hypo

SEQ ID NO: 73653 - DNA, 84 bp, Homo sapiens
  chr12:104695390-104695474
  hypo
aggcgtgagccaccgtgcccggctgcttttgttgaatttaaagtggatgtgagaagctcctaagaatatcgttcactgtaaaag

SEQ ID NO: 73654 - DNA, 102 bp, Homo sapiens; identical to SEQ ID NO: 43535
  chr12:104696536-104696638
  hypo

SEQ ID NO: 73655 - DNA, 30 bp, Homo sapiens; identical to SEQ ID NO: 43536
  chr12:104698273-104698303
  hypo

SEQ ID NO: 73656 - DNA, 293 bp, Homo sapiens; identical to SEQ ID NO: 34592
  chr12:104850244-104850537
  hyper

SEQ ID NO: 73657 - DNA, 968 bp, Homo sapiens
  chr12:104850577-104851545
  hyper
cgcacaccgcactccccgggcaacagctggacgcgaccatatcccgggtaggggcggggggagcgcgacgctccgccccggcgctagggtccctccctcctcccggctctccgcaggcgccctcccctcgccgggggccgcgagttgcatttggtaaaacccagccccggaatatatagatcgttggagcgcaatgaagtagcctttggagagaagggagagggcccgtcggacagccacagcggccagcgcagcggcagcggcggcggcaccaccatcaccgctcgcaccccagccgcccggcccgcgaccaggcagcggcggccgccggcgggatcggaggaggcggcggagcggcgaggaggaggagcaggagcgcgcagccagcgggtccacgcatctcagcacttccagaccaactccggcaccttccacacccctgcccgggctgggggctccgagagcggccgcgaagcgactccgatcctccctctgagccttgctcagctctgccccgcgcctcccgggctccggtccgcgcggcggggtccctgctcctgcgccccgggcgcgcttcccggacaccccggtccccgcagccaggacaaagccatgaagccagcgctgctggaagtgatgaggatgaacagaatctgccggatggtgctggccacttgcttgggatcctttatcctggtcatcttctatttccaaagtatgttgcacccaggtagggggcgcgttagcgtggttttgttggatattttcttctctctcgcgctctagctcgctccgcctgatttctgcctcttccaaccctacctctccgccttcggcctcttcggggctcctggctgcccagagctcctggctgcccagatctacccgggtcaccgcgtcgggatggggaggagaagggaaggtgtgcttcgccctcttcttcctaccggctccgggctggaggatgg

SEQ ID NO: 73658 - DNA, 258 bp, Homo sapiens
  chr12:104851893-104852151
  hyper
ggtgtggagagtggtcgggtgcccagcgttgcccctccaccacgcgccggccgtttgcccccggggtccgggtccgcagtgaccttgcggctggtgccccggggcctgctccagcccccagccctgagctggaaactccgagctcctgggtcacgccttgaccactgcagttttggaggaaactttggccaggtcctgggctgaccgtccgtttgcatcccccacttctgggatccgagcaacgggaatcccccgggc

SEQ ID NO: 73659 - DNA, 287 bp, Homo sapiens; identical to SEQ ID NO: 11387
  chr12:104852152-104852439
  hyper

SEQ ID NO: 73660 - DNA, 6 bp, Homo sapiens
  chr12:104852440-104852446
  hyper
ggccac

SEQ ID NO: 73661 - DNA, 385 bp, Homo sapiens
  chr12:104852447-104852832
  hyper
ttggctcagaaatccattttctacgcctccgagttgcctttctcagcgtagtcacagcaataatttgcttttctaattgcaaggaggagggaggtggaaacgcatttccttccagggaagtggggttggtgtttttcatttttgcctcccgccttctcctttcactgtgtatctaacactttaaacagacgcagtcccgaattcatcaagcctgcgtttgggtcgatggcagaggaataaagctgttctttccatcaaacaggcagggctgcaggctgcagattccttgacagcgcagggacagacggcccctttgccccactcggtctggagcagttgttaaggcagccacactgccaaggatatggtccgactctaccacatg

SEQ ID NO: 73662 - DNA, 30 bp, Homo sapiens
  chr12:104858624-104858654
  hypo
gatgaaatggatcagcgctctgggagtgga

SEQ ID NO: 73663 - DNA, 39 bp, Homo sapiens
  chr12:104975776-104975815
  hypo
gtaagggatgcactacgtcattatcgtcagcatcatcat

SEQ ID NO: 73664 - DNA, 76 bp, Homo sapiens
  chr12:104983800-104983876
  hypo
aaataaataaataaatgaagatgcctcaccctagctggcccgtcccttggctattaggtgccgcatgacccttgta

SEQ ID NO: 73665 - DNA, 78 bp, Homo sapiens; identical to SEQ ID NO: 43538
  chr12:105018625-105018703
  hypo

SEQ ID NO: 73666 - DNA, 39 bp, Homo sapiens
  chr12:105025106-105025145
  hypo
aagtcattttattgacggtggtagcggaccctgttggtg

SEQ ID NO: 73667 - DNA, 96 bp, Homo sapiens
  chr12:105029202-105029298
  hypo
agaagatgtaattgccggttgtcttacaagcagtcatctcatcacaggggggttggaaggagaattcaggagccaaacagccgcaagagcacctgg

SEQ ID NO: 73668 - DNA, 96 bp, Homo sapiens
  chr12:105056873-105056969
  hypo
agactagggagcacccgggaggatccagcaggctggcctgtgttgggtcagtgcaacaaggcttccttccagaggcctgggcgagccctgtctaac

SEQ ID NO: 73669 - DNA, 153 bp, Homo sapiens
  chr12:105069312-105069465
  hypo
aatgaatgaatgaaccgaactaacaaccgctgttatgagccgagtgcttactcagtgccaagtgctttgtttggactttattcaatccaggggttgaagaaccactcactctggagtcagattcctggtcctaaaccacgtacttaagcaaat

SEQ ID NO: 73670 - DNA, 88 bp, Homo sapiens
  chr12:105100669-105100757
  hypo
gaggagagaaggggtcgggaggaggatgggatcacagcgaggctctgaattgaggtccatttccaccctttggcggcatagactggaa

SEQ ID NO: 73671 - DNA, 30 bp, Homo sapiens
  chr12:105103480-105103510
  hypo
cagaataggcaaatccgtggagacagagag

SEQ ID NO: 73672 - DNA, 42 bp, Homo sapiens
  chr12:105104150-105104192
  hypo
gcaggctcttttcttcggtggcacttccgtgggctctctggg

SEQ ID NO: 73673 - DNA, 119 bp, Homo sapiens
  chr12:105140973-105141092
  hypo
cggctgcccgggagccgataactcccgggtgggtctccagaccccaggaggctgcaccatgcagggtctcagaccacagtctgcctggactcgaaccccagacccggttcctagctccc

SEQ ID NO: 73674 - DNA, 30 bp, Homo sapiens
  chr12:105147152-105147182
  hypo
ttacctggctcacaacgagcactcacccag

SEQ ID NO: 73675 - DNA, 30 bp, Homo sapiens
  chr12:105150821-105150851
  hypo
ggtgctgacccccaacgacctgaagcactt

SEQ ID NO: 73676 - DNA, 30 bp, Homo sapiens
  chr12:105392811-105392841
  hypo
tggcagtgttggtgtcggagtggggtactg

SEQ ID NO: 73677 - DNA, 30 bp, Homo sapiens
  chr12:105393128-105393158
  hypo
tctgccattcaggcacgatctgccaactca

SEQ ID NO: 73678 - DNA, 333 bp, Homo sapiens
  chr12:105478020-105478353
  hyper
tttgtttgttttaaacgctgtcttggtgtttagcaaagtctaagcatcgctgctcatccccagccccaccgccccggccctcccgccccggagtctggaaaccaggacagggtgacagccgggacgctcgcccgggccggactcacccggccagtggagaagcgccggagcgcctggctgccccgccgcagcatgctggagaggagcgctagcactggcgacgcggcagcgcgggaggcaggcgggcggcgcagcctgggcgcggcctgggcgcggcctgcagtctggatgccccggactgcctggctcgcggctcgccgctctcggcctctg

SEQ ID NO: 73679 - DNA, 30 bp, Homo sapiens
  chr12:105673102-105673132
  hypo
cactgcaattactttcgcaccaacctaata

SEQ ID NO: 73680 - DNA, 31 bp, Homo sapiens
  chr12:1057793-1057824
  hypo
agcctgggcaacagagcgagactatgtctcc

SEQ ID NO: 73681 - DNA, 82 bp, Homo sapiens
  chr12:1059279-1059361
  hyper
gaccttcccagattccgcccgggccgaggcagcggtggacctggtggttctcgcggcctctcaccaccgccgcgcacatcca

SEQ ID NO: 73682 - DNA, 189 bp, Homo sapiens
  chr12:106532217-106532406
  hyper
cccgcttgactttgccgtaggtgcctttgcccagggtctcctgcagctcgtagcggtgcttcaagttgtgcttgtggtgatgccgcttcaccccgtgcggcttcctgggctccagggctgcagtcgcccccgccaccgcctctcggggagagcccggcgcccccagccccaagtcggggcggtcccccg

SEQ ID NO: 73683 - DNA, 30 bp, Homo sapiens
  chr12:106533379-106533409
  hyper
gaggctggcaccccgcggggcagagctgcg

SEQ ID NO: 73684 - DNA, 35 bp, Homo sapiens
  chr12:10658417-10658452
  hypo
cggcctccgcatccccgccccgcactaggacccct

SEQ ID NO: 73685 - DNA, 696 bp, Homo sapiens
  chr12:106974297-106974993
  hyper
ggctccgggttcttccgcctcactcctggcctgtgagcccggctcacctcaccctacccacctccactctgcgtgcaaaaattataataataatagcaacaataatagtctcatccgccctggagaccacccgtgcccccgtggcatccctcaaggactctccgggcggtggcagccgcccaccctggggacgcgctccttgctgccaccggaacgcccctggccaggctccatctacgcgctgtcagaccctcccgccgtctgaagaaggcttttactcttcagcctattccagtggcagagaagctaaggctacaaaggcgaacgcgaacagtcagatctgacttcgaattccgctgtcattgctgccaggcgcaccacgaggacgcgcggtgaccgccaccatggcattcggctgccaaaggtttccatcgacctctttcccatcaccagcatcgcagcgggaaagaatgtgcctggcgcccttctgggcactgggcatggggtggtgaacaaagtcctccagaaataaaccgggtaatgagcccggcagcggccggggcaggaagggaccttcgcagagagtggtcaggcacagcccctccgaggaggcgacgctcagctgagaccagggtgacgcaaaggtgtcggccggttaggcacctgtgaggaaggaggagccggcagagtgccaag

SEQ ID NO: 73686 - DNA, 481 bp, Homo sapiens
  chr12:106975246-106975727
  hyper
gggctccccagtctccgtacattgtcccactcagctctgattgtggggagggggcggaccgagggggcggggggcgtctttccgaaggatcgcggaaagccgcgcgctgccaggggcccggggttagagacccccactcccgcacggcgttagggactccgcgcttccccgcccccgccgcggcccgccggctctgcctctgtccatggtcaaagcacccggggtaatccgcctttctcttccgcccgccgggccccattcatattctaatcacagcgcggccgacccgcgaacggccactttatcggggcccgcaggagacgcagcttgctccccctcacttccacttccagcaccccccggccctcgcccccctctttctgcactttcaactccgccgaggagggggtccctgggaaaaccgcgtccccacttggatgccggggcttctcacaaacttcgaggccgactgggggacggc

SEQ ID NO: 73687 - DNA, 377 bp, Homo sapiens
  chr12:106976403-106976780
  hyper
cccggcctgccagcacggcgcggggcccgatggtggggaagggccgggagggggagggggccacatctaagccaattttgatttcgcctataatgagtgccgggcgaaggctggagaaggcctctggaactttaaataagaaaaacgttgctaatgctataatagaagggggaagtcggagggctgggattgcgtcgctctgagccccccttttcggaggcggcttttcttattcaaaacaggcccacaatgggcttcacagtgcgcctcgccacggccccatctgacgagcggccattcatcaggccggctggcctatcaatgacattgctcccatcggggctcctataaaatgatgctttttcccatgaaacatc

SEQ ID NO: 73688 - DNA, 45 bp, Homo sapiens
  chr12:106976842-106976887
  hyper
cgctttttctctctcccccttctccgagctcgctcccttctctcc

SEQ ID NO: 73689 - DNA, 459 bp, Homo sapiens
  chr12:106977393-106977852
  hyper
tttcgcttgccctggacacaaagttacgtaaagatgcgctggctcgcggcgagctcgaggtgccacttgcagaaactttgccagccgaccgccccctcccggacccaggtcctcctagggtatgggggcctcggaatagcggtgcgctcggggtctggcggccagggccgggaagccgagcggaacgccccgaggcgggggagggtgacggcttcgcactgcgcctgggaggtggggaccgaggctccggctggtagagacgcgcagctggagggagtggcggcggcgaacccggtggtccgggggaatccgcagaaacgggaggtgggagtcctgggctgtggggtcgggcttttagcttttctgccaggaaggggcacccaacgccgggctccactagggagctgtgaccttgctggagggagggcaggacgcagactggcccgctaaactcggcgt

SEQ ID NO: 73690 - DNA, 72 bp, Homo sapiens
  chr12:106978702-106978774
  hyper
ccctgcgtgcctctccggacacggcaggccccgctgaggtctctactggcggtaaagcgggagcccagagag

SEQ ID NO: 73691 - DNA, 557 bp, Homo sapiens
  chr12:106979033-106979590
  hyper
gctgtggattcgtggcgttttctgttctcgatgcaactggtgctcgtgggggcaccgggtcctcttcacctcaactgcaaacactccagagacgttctgaaatgaaatcctttccccatccacttctctcccttttgtatatccgagacatccctaggtcaccaccctgaacgcaaaatcaaaagttttggtacacgacagtgtgaagaaatgacactagacgcaccaggtgacatttcactccgacttgcaaaaccgacgacaagggaagtgcggctcggcgtggtccagtccagaagccttccctcacctcccttccagagaatttaatccaattagcctttcttctgagtttcccttgttatgtaaagggtcttttctcctggcttgcagagacgcgcgctccatggagcagttcgattctgctccttttgtataagatcgcgcgcgatcagaaccaggaatattgctgttattatatcattccgaaaggactggaacaaccgactcacagcaagtgctggggcgaagtaggaaacgtccaggataagagaggc

SEQ ID NO: 73692 - DNA, 238 bp, Homo sapiens; identical to SEQ ID NO: 34610
  chr12:106979636-106979874
  hyper

SEQ ID NO: 73693 - DNA, 872 bp, Homo sapiens
  chr12:106979875-106980747
  hyper
agcccgacaaagcaaagcccctctcggaggcaaagccccagcttgccgcgcgccgcggtgctccggcaggaggcaaaggcgacaggcgcgcgcaggggcagtcgacgcaccttctggccggtgcgcggtttgcagtaagcgcaggcgcgcgtcccgctcggcccgcgctacagccccacgccgcgcaaaagtgggtgctgagccccgcgtggcctgcgctccccacgcgggccaccggcagctacgtgtttgtggccgccgggtccaatcagggctgctctgcccgggtgatcgttgctcagttactcaagttatccggaaattcgagaacgatgggggaaagtgggtagaattttaggccaccgagaacttgtgcaaagtgggccgggccgggtcggtcgcctacgcaacagaaggatcatttcttttaaaacgggatggcgcgttagagagggccactgccaagctggagctggaaacttctgcctccatccactttccgctcccatctccagaacccagagctgaggcggccaaagtacttcctggagccggatttgagttccccgggccgcatcggtgggagggcacgctagtttacaggcccccagctcagcacaaattctttctaaaattctaccaccaaattaattatatgcctttgtgggcccggggtagggatgtccagtggccttggcgccgtgcccacaaggcaaagtgcgtcctggagggaacagggcccgagcctcctccattcttgcccaggcacagccctggggaaggagccactgtctgcgggcttgggagagcaaggagccggaggtccgagccttgctccagcgcccaaaccagacagtctcgccctccccggg

SEQ ID NO: 73694 - DNA, 741 bp, Homo sapiens
  chr12:106980911-106981652
  hyper
cgcaggctgggtcctcggagtcccggattcagcacgcgactctgtgcggcagcctgggacagcgcgctttcctacccggcctgcaggtcccagagactcggaaaagtttgcaggggccgcccggcgcctcgggcctgggatttccaaagccgctcccgcccccgtccccagcgcgtcaccatggagactgctggaagttggtggtggaaaacagacctggcgcaaagcaaaatattatgagtgcagttggggtgacttcagggggcggggggaccggagggcaggagcgggagccagaggcagaggccgacaacaaagggcccagtgcgaggaagagagaggagtttgcacggggcctccccgccgctgtgtgagtgctggaccatcctgcttcccagaggctccgaggtctctaatttctctccagcagctataccttttctcagcccgccttggagcccttgctccctccctcctctccgggttctcttccagcctcccccctcacccgtccggaggttaggcgccagctgggcagtgcgcccgcctccccaggagccacaggctcaccaacgtgaaaggttctggcttttcttccccacgacccgtgggtcgcccagggtgagtttctcaccccctatctcaaacccgatctgaaagggtgatgggttagaataaggtgggaacggaacgggaagagaagggagcgtctggccagaaatcttgcgagtggggatgggt

SEQ ID NO: 73695 - DNA, 200 bp, Homo sapiens; identical to SEQ ID NO: 43542
  chr12:107138858-107139058
  hypo

SEQ ID NO: 73696 - DNA, 47 bp, Homo sapiens
  chr12:107297268-107297315
  hyper
tgactgggaagcttccgcagggaattccgccccggacccctggagac

SEQ ID NO: 73697 - DNA, 50 bp, Homo sapiens
  chr12:1073029-1073079
  hypo
gagtgacgagggcagcggtactctttcaaatggagcgattgcttagggaa

SEQ ID NO: 73698 - DNA, 30 bp, Homo sapiens
  chr12:107432746-107432776
  hypo
acacagagtgctgggcgtggtggtgcatgc

SEQ ID NO: 73699 - DNA, 146 bp, Homo sapiens; identical to SEQ ID NO: 34616
  chr12:107486450-107486596
  hyper

SEQ ID NO: 73700 - DNA, 645 bp, Homo sapiens
  chr12:107487210-107487855
  hyper
ggcgacgctgtctctcggcccgggagaaaggaccgggaacggaggctagaggcggtggtcgaggccgctggacggttgccggccggtgaccggtcccgaggctgcccgggtgactctgccgccgccgccgcgtcagcggcctcggccccgcccccggctcctcattggagggcgcgctcccctcgtgaccaccggcacctcacgtttctgaagtgtgtttactacactggctcggaggggtaatctgctcgcgcttcggtcgcttttggaggagcggcagccgcttgatcccaaacttgttgaccctcgtccacacgctgaactcactgcctctgcccctttcctgtgccgactggtggccgtcccttggaagcaaatcgcgttgaccacaggccccttgtgagggaaggcttagccccgcccccaagggccatgagcggccaccattggccgaggctcgctgagacccggatgagcacggggatgcggggagcttgcgggcgcgcgcgctgctccgttaggcgcgcgtgcgctctcgctgcgttccagagggtaagggggcggggccggcgggcaggagcgcgctcggcgattcctcccgtgggatttggggagggcctggaaattgtccggtttccttcagga

SEQ ID NO: 73701 - DNA, 387 bp, Homo sapiens
  chr12:107711950-107712337
  hyper
agggggcagcatccacgtctctacgcttgcaagggttccccaagtccctggccactgctccccacttcctgcagcctcggtgtccgccgggggcgtgtgtgaggggcggggccgcatggggaggagggatttaaaaaaaaaaaaaaaaagcgaggtaattagcattctccgattccactggctctccgccgcccctgctttgcatacgcccgtcccactggctgcccggggtttgctggggttcggcaaggtttgcagccgccacggccgctgctgcgctccggtgcagggcaggctggcgccgagcgaaccagggccgggaactgggagccgggagccgggagccagctgcccgcggagctgcggcggcggcggcatctggggtgg

SEQ ID NO: 73702 - DNA, 222 bp, Homo sapiens
  chr12:107713205-107713427
  hyper
gagcgccatggagatcgtgctgtcctggggcctggccgcgcactgtacggcggctgcgctggccgcactgtccctctacaacatgagcagcgccggcggcgaccgcctgggccgcggcaagtcggcccgctgcggcctcaccttctccgtgggccgcgtgtatcgctggatggtggacagccgcgtggcgctgcgcatccacgagcacgccgccatctacct

SEQ ID NO: 73703 - DNA, 40 bp, Homo sapiens
  chr12:107714075-107714115
  hyper
gcgaggttccgcccccggtgcggggcggggcgacagctgc

SEQ ID NO: 73704 - DNA, 657 bp, Homo sapiens
  chr12:107714660-107715317
  hyper
gttagtttagggcgtcgtttccagcaggttctatcatcgtctcttcatgccccactgttttgaaggcctgacttgggtaggtttgaacccgcagttctgtccttgaagggggtggggccggggcgcttgttttcgagagctcgcgctggcggtgctgcccgtctgcgaaagccggagctagacacttcaaagcttcaattttccacaggaaatggtagaaacgtaactggagactctaaaggcgaaataaaactttgttacatattcggcggtttggccagaggttgcgcggttggagctgaaatgcagtctttctgggcagatttcattcatgttgctgcctgtctgtttcccgggggctggaggagcactgcggtgggcggtgccaagggtgtgcatgtgcgtgtgagagtctgtgtgcgcgcgcgtctgtgcgtgtgtaagtgtgcttgtgagtgtgcgcaggaacaagcgggcgcgcagggcgcccggctccagccgaagcctttggaaaccgaccctgccgccctcggtcccttcacctggatttgatcgtcagtgggggaggggaaggaaggagcaaagcgggtgtgtgtttgtgtgtgttggggaggggaatccgcactgatctcggagactcttcgggatctctttgcc

SEQ ID NO: 73705 - DNA, 86 bp, Homo sapiens
  chr12:1079112-1079198
  hypo
tgttgacagactttgcgtcagtgtgaagtgagacacattgtcttcatatatcccactccatttctggtgatataatttagggctgg

SEQ ID NO: 73706 - DNA, 218 bp, Homo sapiens
  chr12:10813764-10813982
  hypo
aacatcatgagtttacgatcaaaattccagaggaaaatcctgaaaagtttttgcctaatttttatttacattaaacaacaaatatatattaagtgctgttaaccattccttgctactcctccatatgtcccctctaacataattttgggccttttcccaggacccaagtaagatggcaaaatttagatgttatattcttgatccgtgtcatctcttcc

SEQ ID NO: 73707 - DNA, 492 bp, Homo sapiens; identical to SEQ ID NO: 1068
  chr12:108168922-108169414
  hyper

SEQ ID NO: 73708 - DNA, 55 bp, Homo sapiens; identical to SEQ ID NO: 34622
  chr12:108169549-108169604
  hyper

SEQ ID NO: 73709 - DNA, 30 bp, Homo sapiens
  chr12:108199937-108199967
  hypo
tgtgctggcctgtcccggggatccctcccc

SEQ ID NO: 73710 - DNA, 178 bp, Homo sapiens
  chr12:108237347-108237525
  hyper
gtgctaccaggaatccgagtagaagtggtcagggatggagcccagggccacctcatccttcttcctcctggagccaaacagcttcttcatcgcggcagcttcggagaagcctcagctaccctgcagctccccttcgccttttcgcggaatccggagtccagtcacaattagctaagcc

SEQ ID NO: 73711 - DNA, 134 bp, Homo sapiens
  chr12:108237660-108237794
  hyper
cggctggcgctgggcttccagtgccggactgccagaacaggctgggagcgctggggtcttggcgctctgcagccaccagagatctggccgagtgggtctggttacccccacccctgtgccgccacagcccggca

SEQ ID NO: 73712 - DNA, 389 bp, Homo sapiens
  chr12:108238125-108238514
  hyper
gcccccagctctgtgcgcccgctgaggaggagacagccagcagcgtggtcaggcaggctctcgcgctgaggaggcagtgcactcaggatactgaggccgcccagagcacgccccgccaacccacctaggcgcctgagctgcagcctctgcgccgtctctgccgcggtccggcaggccgcctggattggccgccgccgctgctgccaccacggtgtccacccaacgactctaatgtgggaagtctggcggtggagggtgtcgcgggctctccggcagacccgtagctggtggtggagctgagggccctggggcatggcgggcagggacttgaggcccgcaggaggagggggccgtgccgatgctggctgtgccggggctgcctgagaacc

SEQ ID NO: 73713 - DNA, 32 bp, Homo sapiens; identical to SEQ ID NO: 43387
  chr12:10823904-10823936
  hypo

SEQ ID NO: 73714 - DNA, 433 bp, Homo sapiens; identical to SEQ ID NO: 34625
  chr12:108297323-108297756
  hyper

SEQ ID NO: 73715 - DNA, 231 bp, Homo sapiens
  chr12:108523208-108523439
  hyper
gcagccggtgccctgcgcgcaccgggcccgggcatctccatccccggggcgggtgcccgcgcggggcctcgccgcggctcggggcacccgcagtgccgcccgcccgagcgccaggctcacaggagcccggctttcacttcctctcgcttccgcccgcctccctggctcgccggctggcgtcgccaccgcctcctcgtccccggccaccgctgtcgccgctgctgcaattca

SEQ ID NO: 73716 - DNA, 36 bp, Homo sapiens
  chr12:108523736-108523772
  hyper
gctccaggagggagccgggcgcggagctggtgcgaa

SEQ ID NO: 73717 - DNA, 22 bp, Homo sapiens
  chr12:108569903-108569925
  hypo
ccacgcccggcctattgttata

SEQ ID NO: 73718 - DNA, 17 bp, Homo sapiens
  chr12:10857716-10857733
  hypo
ggagtctcactctgtcg

SEQ ID NO: 73719 - DNA, 76 bp, Homo sapiens
  chr12:108603987-108604063
  hypo
catggagtgcaagggcgagcgaggcagcgtgtgcggcggcgccaaccgcctctctgtctaccggctgcagctggcc

SEQ ID NO: 73720 - DNA, 174 bp, Homo sapiens
  chr12:10875104-10875278
  hyper
cctttcttctccaaacgcaggcattttccaccacgcgaatccgcaacagtgcccgtctgggagacagaagttaagacctaaactttctggcccggaaccagaagggagatgcacacggccgccaggagcgcagggcgcagcgcgctcacctgggagcgccggcaagggaggcgg

SEQ ID NO: 73721 - DNA, 55 bp, Homo sapiens
  chr12:108871619-108871674
  hypo
caaatgctatgtaaacgtcacacctgatccagccaatctgcggtccctacctaaa

SEQ ID NO: 73722 - DNA, 97 bp, Homo sapiens
  chr12:108891814-108891911
  hypo
tcaaaaaaaaaaaaagtgttccattcatactgaaaatatctgggaggtttgcactgtgtgcaagatctgcactgggggctgccgacaagggctgccc

SEQ ID NO: 73723 - DNA, 161 bp, Homo sapiens
  chr12:108898965-108899126
  hypo
gtcagacatagatgccggcagttgagccaatcatgttaaagacagcggctccatctccccttgtctttgtcagccacgtgtacagcaaacaccagacatgatgaccccagtcaactggaaagcctattcacataacaagattagggtggggtggccagcct

SEQ ID NO: 73724 - DNA, 30 bp, Homo sapiens
  chr12:108926148-108926178
  hypo
aaagtggaaggcactcgaagggagaggccg

SEQ ID NO: 73725 - DNA, 193 bp, Homo sapiens
  chr12:108982619-108982812
  hypo
tcctctggagggtcccgctgagcattagtggaagactgcagactggagccgctgatcagggagctcacccccgtctgcacccccagggtctctaatgattgcttctgttttactagatttttatgtattcaagggaagcttcatgcacttcccagtcacgtcacaacaactaacaccccgcaggagcttggga

SEQ ID NO: 73726 - DNA, 26 bp, Homo sapiens
  chr12:109162468-109162494
  hyper
ggccggcagacactccgggcctgcag

SEQ ID NO: 73727 - DNA, 30 bp, Homo sapiens
  chr12:109162732-109162762
  hyper
ccatctggcacagagcgtccctgccctgcc

SEQ ID NO: 73728 - DNA, 58 bp, Homo sapiens; identical to SEQ ID NO: 43544
  chr12:109208616-109208674
  hypo

SEQ ID NO: 73729 - DNA, 30 bp, Homo sapiens
  chr12:109305521-109305551
  hypo
cggaaccgtggccttcgctgcttcagaagg

SEQ ID NO: 73730 - DNA, 191 bp, Homo sapiens
  chr12:109343498-109343689
  hypo
acagcacactgtcagcgttccacccaaacatccccattcttagcatgtccacgcatgccagtccaccttctaactgccagtacctgtgaccctttccagagaactttctctggtcagtaaagcttggctggccagcctttgtggcaggccagaagtgccgaagaatttaaacttcccgggagtagccctca

SEQ ID NO: 73731 - DNA, 30 bp, Homo sapiens; identical to SEQ ID NO: 43546
  chr12:109719635-109719665
  hypo

SEQ ID NO: 73732 - DNA, 30 bp, Homo sapiens; identical to SEQ ID NO: 34627
  chr12:109746889-109746919
  hyper

SEQ ID NO: 73733 - DNA, 36 bp, Homo sapiens
  chr12:109873504-109873540
  hypo
tgacataggtgctatcgtctccgctttctatgcagg

SEQ ID NO: 73734 - DNA, 36 bp, Homo sapiens
  chr12:109886472-109886508
  hypo
ttttattttacatgtcgccaacgtttgtacaacata

SEQ ID NO: 73735 - DNA, 30 bp, Homo sapiens
  chr12:109970653-109970683
  hypo
ttgcacagggtcccccggggccccagcaca

SEQ ID NO: 73736 - DNA, 78 bp, Homo sapiens
  chr12:110030802-110030880
  hypo
tttggctgtggcagccgctgaaatgtgcagctcagctcctggacagctttgcactcaaaccagcgaactgttctcctg

SEQ ID NO: 73737 - DNA, 30 bp, Homo sapiens
  chr12:110039080-110039110
  hypo
gccctgctcttagcccgtgtctagactctc

SEQ ID NO: 73738 - DNA, 156 bp, Homo sapiens
  chr12:110240870-110241026
  hypo
gcacagggatggtgtcgttgcggccattgctcaggttcagcaaggccttgggcaggcaggtcttccccgtagatggctctagcaagagagacacacaagatgacgcagtgctccagcccatgaccttgaacttccaggcatcggggtacagaacac

SEQ ID NO: 73739 - DNA, 228 bp, Homo sapiens
  chr12:110258634-110258862
  hypo
gccctattaagggatcgtaatagggtcgttgtgagaggtatataccttgagtcaagtgcctggcataaagaaagcctcaataaacagcagattgcacaacagatggcttctctctgagaatcccggattcaaaggcggtggaggtctctggctccgtccccatgccccaacttgcggagggtggaaaaaggggcccatcctcggggttacccgcggctttgcctgatc

SEQ ID NO: 73740 - DNA, 136 bp, Homo sapiens
  chr12:110271059-110271195
  hyper
gggaccccccggagccggacgggccacggagatgtccccaggggcgcgaggggacctcggctgagccgcccctcccgggcccgggccccacttacctccgggacggctgggcgccggcggccgggagatccgcgct

SEQ ID NO: 73741 - DNA, 30 bp, Homo sapiens
  chr12:110271432-110271462
  hyper
gggtgtcgcgatccccggatagagcggcag

SEQ ID NO: 73742 - DNA, 30 bp, Homo sapiens
  chr12:110299819-110299849
  hypo
ctccgggcatgctgtcgtcatgctaggcca

SEQ ID NO: 73743 - DNA, 40 bp, Homo sapiens
  chr12:110353414-110353454
  hypo
cctgggcctgctcatcgccccgcgccggggtctgctctcc

SEQ ID NO: 73744 - DNA, 153 bp, Homo sapiens
  chr12:110367786-110367939
  hypo
tcttttctaggaacacgttaccttcaaccaggacaaggaaagaaagaaaactatactattggaaagctcatgggtgccattgaggacaaaaacaggcgagttttgctcttggttctgcaactgaatcacttgagaagccgtgcacagctcccg

SEQ ID NO: 73745 - DNA, 17 bp, Homo sapiens
  chr12:110506948-110506965
  hypo
aaaatcatggctcatcg

SEQ ID NO: 73746 - DNA, 98 bp, Homo sapiens
  chr12:110563148-110563246
  hypo
taataattatttgtgcgtaatttttcatcattgtggagaaattatcttttttattttattttttctgttgagacggagtctctctctgtcccccaggc

SEQ ID NO: 73747 - DNA, 34 bp, Homo sapiens
  chr12:110563785-110563819
  hypo
gaactagcacaagatcggccaggcgcggtggctc

SEQ ID NO: 73748 - DNA, 468 bp, Homo sapiens
  chr12:110717498-110717966
  hypo
ctgcagtgcttctatcggtcctgaaagagacagaggaggtaagggagaagaattggtacgaaatggtgcagagctggtctcagagggcaacaacagccagccctccatgaccacactcccaccgtgcactcacgtgcccctcttgaagcggctctgatcctgtgacctaaccagtttccacctggcttctctcagtgcgttgccatatagtataattttttgtttgtttgtttcgtgtagggttttgttggttcttttccaagtatcaatcaaaactacatgccaacgtccactccttggaaataattaaatgacatgacgtgcctgattttttcagctggtgatgcactgtaatttgcatctgctgaaggaatttatcttaagtcctgaagcccagccacttgagacaactgaggtgatttttctgctctgcttttgctcatgcggatggtgcgttattgttaaaca

SEQ ID NO: 73749 - DNA, 181 bp, Homo sapiens
  chr12:110782679-110782860
  hypo
tttgttcccaggttacgtcggcgctgctaccgtgggtgctgctgcatggtggttcattgctgctgacggtggtccaagagtgtccttctaccagctggtactcagtcacctttctttctgtaccttacatgagaagtgttgtgaggccttgacctttctgtggtttcggtatctatcaaat

SEQ ID NO: 73750 - DNA, 179 bp, Homo sapiens
  chr12:110784092-110784271
  hypo
ctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtc

SEQ ID NO: 73751 - DNA, 29 bp, Homo sapiens
  chr12:110840419-110840448
  hypo
tgagccactacgcccggccaataaaggat

SEQ ID NO: 73752 - DNA, 153 bp, Homo sapiens
  chr12:110886947-110887100
  hypo
acacttttattgtctcgactcccgatttgaatgtacattctttaagattagggatttgttgaacttatttgctgctgtaaatacagcctggcaggcagcaggtgctcgttaacgtttgttaaaaataatgtgtgagcaggctgggcgcgatgg

SEQ ID NO: 73753 - DNA, 39 bp, Homo sapiens; identical to SEQ ID NO: 43552
  chr12:110908132-110908171
  hypo

SEQ ID NO: 73754 - DNA, 205 bp, Homo sapiens
  chr12:111127155-111127360
  hyper
ctgtcctgggcctcccgcagttacaaaggtcccgcccgtgggagcgaatcgcggatcacaaaaatcctgccccgggccagcctaagggaagggtgggcgggggaaccacttccttcctccgccggctggagcggggcgaatccaccccgccaacccctttcggggagcttctgctccatcccaccgtctccgggccacccctgcc

SEQ ID NO: 73755 - DNA, 23 bp, Homo sapiens
  chr12:111153712-111153735
  hypo
accgtgcccggccagtatgctac

SEQ ID NO: 73756 - DNA, 430 bp, Homo sapiens
  chr12:111284604-111285034
  hyper
cgctggagagtgtgtcgcccctctcccccaaccaaaagcttccctccaaccagctgctcttgtcctctcctcccgagggccctgtgccctcccagcggacttgcaggggagaacgtccatgtttgtgcgagtcacaaaggcgcccgttccaggggtcccagaacgcccgggcgtggggctgggggtgtggcgcagcgaggccgcgcagcaagcagtcctcccggcaccgtcggaagcgcagttgcagcagccgtcggacaagcggccggagcagccacggacaagcagtccgggccccgccactggtaagtttcgccgcccgcccggccgcgcctgctgcgccacagctccccctgccagggaaaaggaaagagcggtcgcggtccccagtccattcatatctcgctgccctaagcgttgaaagtatcag

SEQ ID NO: 73757 - DNA, 30 bp, Homo sapiens; identical to SEQ ID NO: 15686
  chr12:111296630-111296660
  hypo

SEQ ID NO: 73758 - DNA, 30 bp, Homo sapiens; identical to SEQ ID NO: 43555
  chr12:111355976-111356006
  hypo

SEQ ID NO: 73759 - DNA, 30 bp, Homo sapiens
  chr12:111358838-111358868
  hypo
tgagtgaagcctccccgaccaccatcttta

SEQ ID NO: 73760 - DNA, 352 bp, Homo sapiens
  chr12:111369069-111369421
  hypo
caggatcccagagctcggatccagcctcaacgacccagatagccctgcagtggctttcttgtccctggtatttttagccctcggtcatctatcttgcctgcactggggacagcggcactcagacaagcccatttttactggtgcccttcagatgcccgcgggctcagctgtctcggtgcctggcattccgggggtattgttcctctctacgagtcccagattccagcaacagctgctgccccaggctcccccgccagcttccccctgcgctccccctgcccgcctgccagagcccccttgctgaagaacgtggcacagtgacagccgaacctggtcccgcatgcctgggccc

SEQ ID NO: 73761 - DNA, 127 bp, Homo sapiens
  chr12:111375004-111375131
  hyper
tgtatctggcccaatcgctgagcgtccgcgctgcatttctccaaactgcccagcagggggcggtgctacctcggctccgcgcagccacggcttcccgctggcgaaccaagggcgcggaatctggaga

SEQ ID NO: 73762 - DNA, 144 bp, Homo sapiens; identical to SEQ ID NO: 34631
  chr12:111471165-111471309
  hyper

SEQ ID NO: 73763 - DNA, 650 bp, Homo sapiens; identical to SEQ ID NO: 34632
  chr12:111471310-111471960
  hyper

SEQ ID NO: 73764 - DNA, 138 bp, Homo sapiens; identical to SEQ ID NO: 3943
  chr12:111472058-111472196
  hyper

SEQ ID NO: 73765 - DNA, 155 bp, Homo sapiens; identical to SEQ ID NO: 34634
  chr12:111472356-111472511
  hyper

SEQ ID NO: 73766 - DNA, 101 bp, Homo sapiens; identical to SEQ ID NO: 34635
  chr12:111472571-111472672
  hyper

SEQ ID NO: 73767 - DNA, 166 bp, Homo sapiens; identical to SEQ ID NO: 3946
  chr12:111472851-111473017
  hyper

SEQ ID NO: 73768 - DNA, 90 bp, Homo sapiens
  chr12:111535426-111535516
  hypo
caggggggtcactggcgtgagcagaccacccgtgactgcacaagacagcgttttctcacagcagcaggtcctgctcggcaagcgaggcgc

SEQ ID NO: 73769 - DNA, 30 bp, Homo sapiens
  chr12:111590629-111590659
  hypo
ggactggggacaagccgctctagatggggc

SEQ ID NO: 73770 - DNA, 30 bp, Homo sapiens
  chr12:111692613-111692643
  hypo
acaggtggccaaatgcgttaattctgttcc

SEQ ID NO: 73771 - DNA, 30 bp, Homo sapiens
  chr12:111706217-111706247
  hypo
ttcacaggttccaggcgttaggacacagag

SEQ ID NO: 73772 - DNA, 54 bp, Homo sapiens
  chr12:111725510-111725564
  hypo
accgccgccttcccgcgcacctgcttacctcggcatggacgcccattgtccaag

SEQ ID NO: 73773 - DNA, 30 bp, Homo sapiens
  chr12:111760419-111760449
  hypo
caaacttcccacctgcgcagtggcatgtcc

SEQ ID NO: 73774 - DNA, 17 bp, Homo sapiens
  chr12:111763135-111763152
  hypo
accgctgccacttacca

SEQ ID NO: 73775 - DNA, 30 bp, Homo sapiens
  chr12:111783547-111783577
  hypo
aaaaaaaaagtttcacgaaaaagaaaaaaa

SEQ ID NO: 73776 - DNA, 80 bp, Homo sapiens
  chr12:111844610-111844690
  hyper
actgccgaggtcgaccgggccaggcccccgcatgctgctgaattgggcggttcaccagggctaggcgtcccagagacagg

SEQ ID NO: 73777 - DNA, 133 bp, Homo sapiens
  chr12:111872804-111872937
  hyper
cttcttctgaatcatcgttcttcgaaggcaggcagtagctaccgttgtctggggctttggggatcttggtggtgatgagtcccctctcctctggtgcactctccccacccgagacgggcgacagaggtttttt

SEQ ID NO: 73778 - DNA, 30 bp, Homo sapiens
  chr12:112083284-112083314
  hypo
ttaaataggtgccttcgagatgatagctgt

SEQ ID NO: 73779 - DNA, 37 bp, Homo sapiens
  chr12:112149584-112149621
  hypo
ggattacaggcgtgagccaccgcgcccagctatgcta

SEQ ID NO: 73780 - DNA, 91 bp, Homo sapiens
  chr12:112196381-112196472
  hypo
agctgggagtgacaccgaaagaacaggctccagtgatctctgctgcttgtacccattgtcagtcccccagggttgtcggtcaccacccagg

SEQ ID NO: 73781 - DNA, 34 bp, Homo sapiens
  chr12:112204378-112204412
  hyper
tcgcttttgggtttacggccggtctcttcacctg

SEQ ID NO: 73782 - DNA, 73 bp, Homo sapiens
  chr12:112204919-112204992
  hyper
tcgcgctttgttttccggcccgagtcccccgcaggcccctaggaaggccccgcgccgccgtgggccttagtgt

SEQ ID NO: 73783 - DNA, 19 bp, Homo sapiens
  chr12:112281623-112281642
  hypo
tgtttgtttttgagacgga

SEQ ID NO: 73784 - DNA, 30 bp, Homo sapiens
  chr12:112591860-112591890
  hypo
atggaacactagacacgggaaccatgcggc

SEQ ID NO: 73785 - DNA, 351 bp, Homo sapiens
  chr12:112605505-112605856
  hypo
ggagggtttctgaaacggtttggctttgatgagacacacactgcccgccaccccagccactgcgcaggacatgagctcgggggcgtggagcctcctcccggcctctgcctaccttgttcttattgacagctgagctggggcacagcagcagcagcgacagcgaggaactctgcagctccttacacacctgccacaggaagtggcggaaagagccgcctgtaggacagacgagacacatgggcacctggggtgtcccggcgggaggcgacaccgttccctccctctcacctgctggctggagcggctactccttccacggcctacctgccgctgtggcggggtagaaagaag

SEQ ID NO: 73786 - DNA, 91 bp, Homo sapiens; identical to SEQ ID NO: 43561
  chr12:112610355-112610446
  hypo

SEQ ID NO: 73787 - DNA, 160 bp, Homo sapiens
  chr12:112628549-112628709
  hypo
ccccaccctagattccgatccccagggaaggcagcctcacctagcagctccaccacctgcaggaggacggatgtcggaatggtgtcaggctcatcttcggacttcccttcactgtcctctgatttccaggacagcagctgctctgcgaaggccatagcca

SEQ ID NO: 73788 - DNA, 91 bp, Homo sapiens
  chr12:112630855-112630946
  hypo
gcaacttactctttgcggaatccagattgactttctttacaagacacaacaacaaaagctgccccggggaaattcacgtccatgttgactt

SEQ ID NO: 73789 - DNA, 30 bp, Homo sapiens; identical to SEQ ID NO: 43564
  chr12:112820695-112820725
  hypo

SEQ ID NO: 73790 - DNA, 157 bp, Homo sapiens
  chr12:112825977-112826134
  hypo
ctgcactccagcctgggcaacctaacgagtccatctcaaaaaataaaaataaaaataaaaataaaaaagttgttagcacaaaggaaaagtggacaaaagatattattgaagagttttcactcaaggaaaagcaaacactgtacgtttttgttccttc

SEQ ID NO: 73791 - DNA, 146 bp, Homo sapiens
  chr12:112919565-112919711
  hypo
gattacaggcatgagccactgcgccccagctgattctttacagataaacaaacattgactctgctttgacatgtgcttggatcaggtaactgcaccagctgcctttctcctcccacttctgcctggtcctccgaatgcctgctttt

SEQ ID NO: 73792 - DNA, 325 bp, Homo sapiens; identical to SEQ ID NO: 1070
  chr12:113012954-113013279
  hyper

SEQ ID NO: 73793 - DNA, 147 bp, Homo sapiens
  chr12:113013320-113013467
  hyper
cgcaggacccgtgctatcctttgggattttgaggggcgggtccggcaaggccccccaaagtggctgctcctgcgagtctccgagaggggaacaggtggtcgcggggtggctgcggcgaaggtagctcctctccggtagccacggggt

SEQ ID NO: 73794 - DNA, 30 bp, Homo sapiens
  chr12:113229160-113229190
  hyper
tgctctgagagtgagcgacagtattagaaa

SEQ ID NO: 73795 - DNA, 74 bp, Homo sapiens
  chr12:113229420-113229494
  hyper
cccaacctcccctcccggcctcccacctttctttctccaggcaccgcacacataaatcacgggtgggaggcagg

SEQ ID NO: 73796 - DNA, 110 bp, Homo sapiens
  chr12:113494306-113494416
  hyper
gacaaagattcaagccggtgactcctaaacatcccactccctgcctcacgctctgcttggggtcagaaggccccttggggtctcgggagggcctggccgaggatttgggg

SEQ ID NO: 73797 - DNA, 607 bp, Homo sapiens; identical to SEQ ID NO: 34641
  chr12:113494430-113495037
  hyper

SEQ ID NO: 73798 - DNA, 89 bp, Homo sapiens
  chr12:113495038-113495127
  hyper
ccccccaggcggagagtctcggaaaaccgcgcccccggcccctgccttccctccaggcctgccccaagggaaagcgggcggggcgaccc

SEQ ID NO: 73799 - DNA, 632 bp, Homo sapiens
  chr12:113541503-113542135
  hyper
actttagaaataacacgtcgcatacgccaagcagcgtcctatgctctttgtgtaaatcaagtcatttaattatcacaactccacgagataggcactgttatcaacctcatttcacagttgaggagactgaggcatagagaggttgagtaacttgcccaaggttgcacagccagcccaggcggaagtgggacacccgctgattgacgggtggggagggcggagcctgcagtccgccctgccccctcacctgagcgctcagcctggaggcagcaggtccagcgcgcgctgcggaaggcaccggggtggcaggcggccagcttgttcgggttgggggcgctggccttgcgcaaggccgagagccactggttgagctcattcacattctgcagcgggtgggaggcgatcagggggcgggtgggaacagagggacgccccccgctccccatcgcggtggggtctcaccttgcactggaggtaggtggtgtgcagcgcccccgtgccgtcctgcgtcaccacctgcatcacgtggggcagttggaaggcgccctcgtctacgcgctccacggcgcggatgtgagacacggggatggagtgacacatctggggaagaggattgtcgctgcaggatgggc

SEQ ID NO: 73800 - DNA, 385 bp, Homo sapiens
  chr12:113592078-113592463
  hyper
tctctaacaaatggaggttgacatttaagtcactttccagaaagattattccaataataaggaacgctggcggccaggtgggatggagagggtaaggcactgcaggcccatgtgagtcccttccccgcccccgactctagttccaagaggttccggagctggtggcgcgcttcgacggcctggccgagacgcaggcggcgctgaggctcagggagcgcgagcagctcgcggagctggaggcggcgcgagcgcggctgcagcagctgcgggacgcctggccggacgaggtgctcgcacagggccagcggcgggcacagctgcaggagcgcctggaggctgccagggagcgtacgctgcagtgggtacgacccgccctaggtggggg

SEQ ID NO: 73801 - DNA, 36 bp, Homo sapiens; identical to SEQ ID NO: 43567
  chr12:113677751-113677787
  hypo

SEQ ID NO: 73802 - DNA, 30 bp, Homo sapiens
  chr12:113690294-113690324
  hypo
ggtcttcacggcagccgctcacatagacac

SEQ ID NO: 73803 - DNA, 155 bp, Homo sapiens
  chr12:113725857-113726012
  hypo
ctcacctgtcttcaccgcatggcgtgtggaaggcggggccggcatgttctgagggcgggggctgaggcgtgcacctgtgtgtggaggtgacgggtgtcctcctcgctcaggttgtttaagttgaaggagcgctaccgcaacgtgctggacaccat

SEQ ID NO: 73804 - DNA, 36 bp, Homo sapiens; identical to SEQ ID NO: 43569
  chr12:113795723-113795759
  hypo

SEQ ID NO: 73805 - DNA, 30 bp, Homo sapiens
  chr12:113835162-113835192
  hypo
ccttcagctctttcacgatggaagcgtggc

SEQ ID NO: 73806 - DNA, 149 bp, Homo sapiens
  chr12:113849535-113849684
  hypo
acaggcgtgagccaccgtgcccagctgccctgttcttgtgtcatttggtgtaatggaatcacacaatgtgtgggcttttgtgtccagctgctttcactggtggcacgttttcacgattcatccacatcgcagcacgtaccagtcctcca

SEQ ID NO: 73807 - DNA, 513 bp, Homo sapiens
  chr12:113900165-113900678
  hyper
gcccagcaatcctggcgccccacccagggggagagcaggatgtgtgcgtgttcgagtccggcctgctccctcgggctcaacataaacgtcaaagtaaggaagagcgggagctggacccggctggccacttcctgacccacagccctattcctagagaagctgaccttgagcctcaagattggccaccagggagcgccagcgtgcaggtggctcggtctccctctcggtggctcccggttcacgcgagttcctcgctcgctctccgtcttctccctctggctgacgctgtctctccatctcctcctcatcttgccccctttcctctccctctctttcaatctctctccttttcttatcatctttttttttaaagacggggaaagcacagcgagaaataagattacaaaatgccactcggattgcagagagagggaaaaacaccgtctccgccccttggcctcaccctctctcagtccaaagaggtggcggtggctgggtgggtgggtgggggcc

SEQ ID NO: 73808 - DNA, 407 bp, Homo sapiens; identical to SEQ ID NO: 34646
  chr12:113900752-113901159
  hyper

SEQ ID NO: 73809 - DNA, 611 bp, Homo sapiens; identical to SEQ ID NO: 34647
  chr12:113901407-113902018
  hyper

SEQ ID NO: 73810 - DNA, 312 bp, Homo sapiens; identical to SEQ ID NO: 34648
  chr12:113902041-113902353
  hyper

SEQ ID NO: 73811 - DNA, 963 bp, Homo sapiens
  chr12:113902608-113903571
  hyper
gaggtgtagggactccggattgcaaacccattctgcctcaacaaatctgtatcaactctctgaccgccccacatagccccttttccagaaccttcgggatatcctgccttcccccaccaggtggggccctgaaggactgacgtgggggacgtcacgaaaggaccaccttgtaccaggcacccgctttgtacggcgggaaaaccagcgagtccagaagcctgagtctcttctgcaaatccactccccctgctgagtcctgggatctcagtcaaggggcgaattcctgatgccccctgccaccctcttccctctccaaaccctgaaatctgtccaaatggggggtgtctggaggcgtggcttggaggcagtttaagcaacagctaaaacggttgccaattactttttaaaaccattaatttaattctccccgaaagtgaaggggaagatggggagcggcaaatttggagccccaaagggacagggatgggagacggccgcggcccgcggcgagccggaaaaccagcgaaggccgctgcccccgcgccgtgcgcgccgcctccgcccatatggcggccgggccggaggtaattggaacaaacgccgtctgaaaagggcacaaaagccgcagctggggctttgtccgcgctcccacggggagccgccggccccgccgcccggcccctttctcgcccgctgccggtcgccaccgccgggatctcccagcgcggattaggcggggctgcctcgctgggggctggggagtcttccccaccattacggggaacgaggggcccccagtatccagctccccacctcatccagcgcgcagggagaggaggcggtgggataggtcggggcgggggcgaagtggtcctcggggaaaccttggttaattatccaggcggggaaaaattccgggccggtaccgcccccactacctcgctgctccgggcccagattttg

SEQ ID NO: 73812 - DNA, 30 bp, Homo sapiens
  chr12:113903957-113903987
  hyper
cctcttcctaacctgcgttacaactcagaa

SEQ ID NO: 73813 - DNA, 346 bp, Homo sapiens
  chr12:113904732-113905078
  hyper
tggaatttacctatacgtgatcgtgcgatcgtgtctagacgtgtgtccctggagtctctgaacgcaagtgtgagtgcaccttgtgccctgcgtgggtgaatgtgtcactgtatctcgtgtgtgcttctgtgtgcatcactgtatgggtgagaccatgtatctgattttgtgtccaggacatgtgggtgagtgtacatgtgtctgtgatcgtgtgtccagcgagtgggcgatgttctggagcggcggaaagcgtgctggccgggacccttcgccctcagctcccggaataggacaggtgcggaacagcgaatcccggggcgccccttacctccgtagtaggtgtacg

SEQ ID NO: 73814 - DNA, 1054 bp, Homo sapiens
  chr12:113905380-113906434
  hyper
ggtggagagaggcttcggcgaaccagccaagggtgaaggatttcgcggacccgtggggcgactcataaagacttgggcttcctggtccccggctcgcccgcggcctgacggctctataaaggcctccctcccggcacggctctcgcctcggcccctcggctccggagccagcctctggccgtttgtctgcccgcgcttcggcgcagggagggagggggcatcgcctgtttctctgctcgaaaggtggaggtaaagagggatcccggaccccagagaggcttacaaccttccataagcaaggcggggggcggaattcagagaggtaaagtgacccgcccccaaatcgcaataccaggaggacagcagggctagatggaatctttcggttcacagtccccgacctcgggcaagtgccccactcgggcgcacggtctgctcccagaccagaaccaggcgcgctcgtagccaaggaagcttggcgggagactcctccgaggctcccggctcccaggccagcggggctaaggagctgtgcccgccccgggccgcacctggatgacgcgcatgttgaggccggtctcctgcgccagctgctcgcggatgtggcgcgtgggcttgggcgtggcggcgaaggcagccttgagcgtctccagctgcttggccttgatggtggtgcgggggccgcgccgcttggtgcccgagttctgctcctcgttctcgttgttggccgtctccttgtccgacgaggtcgagttgtccgtctctttggggtcgtcctgcagtgcgtcctggaggtccggggacaaactgcggtccgtacaggatgacactgcgggcggacggatcgggaaggggacagcggcgtcagcgacggccagacgcctcttcagtccagtggcgggttcccgccggcccaagctacggcctgcccaggctacggccagccccgctggattccctcccaaacctgcgacagcccctcccccagggacccggtgcccgcccactctctccaggcggggctgggcctttggaggggcgctcttaagccctc

SEQ ID NO: 73815 - DNA, 47 bp, Homo sapiens
  chr12:113906828-113906875
  hyper
gcacagacagcacaccgggggccaagtagggagtgccaggctgggca

SEQ ID NO: 73816 - DNA, 58 bp, Homo sapiens
  chr12:113907104-113907162
  hyper
gggcgagatgccttgcgcgcagccggcgcatttcgtgccaaagcgcctgtggacacaa

SEQ ID NO: 73817 - DNA, 42 bp, Homo sapiens
  chr12:113908232-113908274
  hyper
tccagggagttaacacgtgtaaaggagcggctgacattttct

SEQ ID NO: 73818 - DNA, 576 bp, Homo sapiens
  chr12:113908739-113909315
  hyper
cgagaagccttcaggcgtctctaactcatgcaaaaatccttcctctctctcgggacggggcttgaagcttctgtcttggggttgcagctgcttggaaggggcggagaggagtggatagcaagtttgtcagggcttcctccctctgccccgccagcgctctgagccggcctcgagccaacgtgaggcagcgaagcagcgtccttcttcctccgcctgggctcgggacctttcctggaccaaggacaggaggagagcaaagtgctgcccgctccccatctaagcttgtgatccggggaggctgggatggggatgggggtatccccttccccagcgccccagtggagcgcgcgcagggtgggcgcgcaggcagcagagcggcgcggcctcttacctgaaaaagtcatttttgcagtagagcttgccctcgcgcgagaagcacttctccgagaggttggttttgcactcgcagcactgaacacatttgatgtgccacgcgcggtccagcacgttcagcagaaagcggtcgaggatgggccgctcgcaaccggcgcagtgcaccatcatagccccgcgccc

SEQ ID NO: 73819 - DNA, 175 bp, Homo sapiens
  chr12:113909328-113909503
  hyper
cgccttgccctccctttgggcccctggccctcgggcctgccgggccctccgctgcccttcgcctcttgtctcagcagctgcagggcgagtctggtccggaccaagactcagccggtccagtccttgggcaatctctggcctggcgctgggctgcccggagtggggtggtgggggg

SEQ ID NO: 73820 - DNA, 123 bp, Homo sapiens; identical to SEQ ID NO: 34657
  chr12:113909534-113909657
  hyper

SEQ ID NO: 73821 - DNA, 977 bp, Homo sapiens
  chr12:113909717-113910694
  hyper
cgtggcgctgcacgtagggggcccagcggccaatgggcgcaccgtggccatggcaacctcttaaatttatagcatatctaaattggctacagcgttgctgtccggacagagcaaaaaaaacaaggcatcagtattgttgagtattagcttgtacctggttcggaggctaagtaagtatttaccttccagtttggggctgacggggcgggggcagcgcgaaacgaaaattgcgtctctcttcctctctctttctcctcacaaatatttgggggtcacgggttccaaggcctagtccgggaggtacccctgcccccttcgccatccctggaacttgcagaagttgccccacgccccacacttcgctccccttctccagcccagccagcccagattggattcccccacccccgcgccccctctgcgccctgaagctgcgtcagcgcggttctcccggctcctggagccggccccggcttctttttgtcatacacggggctggggcccagccgggcctttctcatggagagagctagtggagaccgcgcggcctgggtagttttccccgcccggccgccgagcccaggcccaggcccagggtggggaggcgggggagcaggaggggtgccatttggcctggtcccgaactccagagtttcaggcctgagtgcgctgctcacggggctctgagggagatgtggacagggggagattcagggtggacgggtcttcccgcagacagctcggaggtggcactcaccacgtctctcctttcctcgctgcaccttccagattccaggtcagcctatggggcactgtggtgagtgggtcgtacggctgaggcgggggacaccagcgactatgagagcgctgtttgtattcacgccgtgcgggctgggtgtgcaagttcgtcccctcattgggcgcaggagaagcggcgcacgtatgttccgtgctcggcagggcgcccagagtgtgag

SEQ ID NO: 73822 - DNA, 853 bp, Homo sapiens
  chr12:113912829-113913682
  hyper
agtcccctagagttgcgttgggggcctcatcctcagtacagctcagccccagttcgagaactccctggacctgggctcagccaagctgcccagaacccgcccggccttctctagcccaccaccttccccggtgcacagcatcggaaaatgccagcagaccagctattagactcatcccgacctaacagcgctaacagatggcgaccaggcagcgaaatcccctcctatatgtaactaataaaccgcttgtgtcttaacagggtaatgcatggagacgcaatgtcacttatacaagatgttgatggaatttactatataaaaatcttcctcctagagtaaagagtatcaacattacaactcgacagacggcggcgggataagtaaaacagacaaaagacaaacaagataataatctgtttccaatcacttaagccctgtagagttagtaatatgcggtttgcatattcccccttgagttcggtaattaattactggcgaggaggcgcacactagcctggggtgggagttttggggagcgctgagctggggcgtggggcatacctctcttgagttctccagcccgggacaccgggcagcggccggaatgagggcgcttccagaggtttggagctgacccacccgcgggttgaagaggtcgtttcagttgcacctccctattcctcaccggaaagcctccggcctgggagattctgcagccaagcaggaaagggggtcttctctggcagccagtgtctctcctggctcctcttaaagcatcctctccttcgaacggccgggagtggcagctttattgggaaacgcgcgctctgggggcccaggtggctggggggac

SEQ ID NO: 73823 - DNA, 4 bp, Homo sapiens
  chr12:113913883-113913887
  hyper
cggc

SEQ ID NO: 73824 - DNA, 336 bp, Homo sapiens
  chr12:113913888-113914224
  hyper
gcgttacaaattgtaaatttaaattgctcgccggattcattacctcccctctttgatttcagccagccgtgaaaaattatactggtgtaccactgagaaactgttttgccgcaaagagcctacgcctaatcactggctttctccctccgacaaaagtgtaattattttgtttggggtgtaaatataggccgcgcctcgcacacacactcagcgtcccgcagcgccgcagagcaccgcccgccgccggaaggaatcgggcccccgagtaggagcgggcgtgaaggctgagccccgctgtctggaggccggaggagagcggctggtgtggcgctccgg

SEQ ID NO: 73825 - DNA, 228 bp, Homo sapiens; identical to SEQ ID NO: 34662
  chr12:113914300-113914528
  hyper

SEQ ID NO: 73826 - DNA, 44 bp, Homo sapiens; identical to SEQ ID NO: 34663
  chr12:113916222-113916266
  hyper

SEQ ID NO: 73827 - DNA, 404 bp, Homo sapiens; identical to SEQ ID NO: 34664
  chr12:113916326-113916730
  hyper

SEQ ID NO: 73828 - DNA, 40 bp, Homo sapiens
  chr12:113916972-113917012
  hyper
acaggaagagccttccgtgcgtgggcgggggttggagagg

SEQ ID NO: 73829 - DNA, 291 bp, Homo sapiens
  chr12:113917226-113917517
  hyper
ttggcgagtgagcttcgtgcacggcatttttcaccctctggaagaagccagatttcgggcaaggtagaacgtgagaagaatcccttttatactggctcctacgaaaggaaccagaaaaaaaaataatacacattttgagcagcctctgtgggtgcagcttgttgaactcggagccagacgctttttctggcgaaacggagaaaaaacgccgcggaaacggtgcgcagggttggggagtataggttctgattgcaacataattccgcaagcttttttattttttatttttcc

SEQ ID NO: 73830 - DNA, 121 bp, Homo sapiens; identical to SEQ ID NO: 34666
  chr12:113917580-113917701
  hyper

SEQ ID NO: 73831 - DNA, 575 bp, Homo sapiens
  chr12:113917730-113918305
  hyper
cgcggccggctggggcctcgggcagtgacagtgaaacgaattccaaacccattctgaactcgccatggcgctctcctgccctccaacacccaccccaaacaccgtgtaggcagaagcgaggttccccgtgaagccgggttaaaatcggcagctgagatgcggtgggatgggatcatagccgagttcggaggatgcggggagagaatagaaaaatctccatcgttctgctctgctctctttctttctcctctaagcaggtttgccggagaaggcaggggtgagccacggtggctgcccggctgtgcaccggcgccggagtttggaccaagacaaagacaggagctgtccgcggtgctgaatcggcggcgccgtcgccggagcaagggggcttctgtaaccagccctctgctcatttactccccatccttctagctccccttcgctctgtgactcttgccttcccctgaatttatttcccttttgggggactcaccttagaacctgcgccctgtacacaggtgtatatacatatatcaaagaacaaaacgattgattgaaaacggtgtcttctcctt

SEQ ID NO: 73832 - DNA, 254 bp, Homo sapiens
  chr12:113952930-113953184
  hyper
gaagtaactctaaaacgcgtgatggaggccaaggggccgccgcccgggctgcagctgaaacggcgctttcacaaacaagacgtaaattggatgcaaacatctaattaaccttctccctcagttccctccgcagagggggaggtgggcctcctagggctcccagcgcctgtcttccctcgggggatggatttgggggaagggaggaggaggggaggcaggcgcgaggggaggaagccaggcgttttctttctttt

SEQ ID NO: 73833 - DNA, 42 bp, Homo sapiens; identical to SEQ ID NO: 34670
  chr12:113953467-113953509
  hyper

SEQ ID NO: 73834 - DNA, 425 bp, Homo sapiens
  chr12:113957582-113958007
  hyper
gatgtgtgattgattcggccccccttccctctgcccttctggtagaaaattaaaagaccatttgttaaggggcgaaagtcctcaggtgcatcccgaggctggacaatttgtctctgtgaaaaggacgctattatcagagaggctggatgcaggcggagggcgggcccgaggggcggcttgggagggggaggctcggaggagcgaaggggctcaggcaggggtgggggggcggaggccgagacaatggggggaaaaataataaatacatcggagcgtgccagccgcggggatcctggctggagaggcgcgaggggcaggggggctgcttggggctggaggagctcatgtgctcgggcctcggaagccaattcctttttcatgacccttgtccaggaccagaagggtgtcgccggggagctctgccg

SEQ ID NO: 73835 - DNA, 30 bp, Homo sapiens
  chr12:113972789-113972819
  hypo
ctgagtgcagagctgcgggttggagacgta

SEQ ID NO: 73836 - DNA, 61 bp, Homo sapiens
  chr12:114029358-114029419
  hyper
ctagagtgtccctagcgtcacgccctgtcgccctcccctgagctcccggaagcccatgggg

SEQ ID NO: 73837 - DNA, 249 bp, Homo sapiens
  chr12:114029630-114029879
  hyper
acctgcagctcaacccgcctaggagaggcgctcgccgagctcgattctccgggtgccataaattaggacgccagtcgccggcgaacgctgggggcttccagtataccttccagcgcagcccgcaggctatttttatctccctcagcacctcggcacctcggaggagcttctgctaattcactaccccgacaccgtctcatctcccctgcaaccaaacccaagtctattcccaggcgtaggggagttggg

SEQ ID NO: 73838 - DNA, 96 bp, Homo sapiens; identical to SEQ ID NO: 34673
  chr12:114075780-114075876
  hyper

SEQ ID NO: 73839 - DNA, 184 bp, Homo sapiens; identical to SEQ ID NO: 34674
  chr12:114075909-114076093
  hyper

SEQ ID NO: 73840 - DNA, 84 bp, Homo sapiens
  chr12:114107345-114107429
  hypo
agcctgcgtcctaaacgtgcaaagcacttcactcccatgcaaaagcaggttctggggaagagcattgcacggtgttttaagacc

SEQ ID NO: 73841 - DNA, 153 bp, Homo sapiens
  chr12:114130067-114130220
  hypo
actcaccccagcatgcgcacccatgcgccgcacacactccgacacatgcaccctccagctcaaataggtggacgtgcttgggaaaaccatggagtaagtgagccccacagagagggaccgtgaaatccctgttgccgccggggccaccagaat

SEQ ID NO: 73842 - DNA, 109 bp, Homo sapiens
  chr12:114236423-114236532
  hypo
tgtgttgaggggccccggacaagcttcctcccggtcatcctcagggcagctgtagcatgactgtcacctcatcagcgaggccgtgcctgggtcccgagtgagggcgctc

SEQ ID NO: 73843 - DNA, 242 bp, Homo sapiens
  chr12:114240196-114240438
  hypo
ctcatccaatgcccacggtgtgcaggggcctttctacctcccatttcagtctcctggcctcaccctacagatggggacgtggctcagggaggtacagtgcttgcctgagtcacacagccgggaggcgacacgcccgggtgcgctcagttaatcctcggagatgagtgttcctctcatgcccgttttacagaggaggaaactgaggcacagaacaaccctgaggtaaccgccctgaggtcaca

SEQ ID NO: 73844 - DNA, 84 bp, Homo sapiens
  chr12:114273766-114273850
  hypo
accattatattctctcggctgcgctcgcaggtactgtggcctgccgcggccctgaaagcttctcgatgccgtgaccctgctggt

SEQ ID NO: 73845 - DNA, 44 bp, Homo sapiens
  chr12:114282443-114282487
  hypo
gtcagcccaaaagaccgtcccgctcctaccgtgaaagtgagcgg

SEQ ID NO: 73846 - DNA, 249 bp, Homo sapiens
  chr12:114290668-114290917
  hypo
ctcagtttaaacaaacgtgttgaacgcacgccactgacaatctaatagcgatggtttactgtgcacacaacacggctcagcactgtgctgggtgcgctgggcacccggcgaggaggaaggctgtcccggccttaatgagctttgtccggctcgctcatcattggtcccttccactacaggtcctgtttggctagaatctgccaggtgaagacagtaggctcacagaacactcctcgagaggcccagtgc

SEQ ID NO: 73847 - DNA, 44 bp, Homo sapiens
  chr12:114295503-114295547
  hypo
gctggcgaggctctccgagggtccccatgcgccttctctgcctg

SEQ ID NO: 73848 - DNA, 152 bp, Homo sapiens; identical to SEQ ID NO: 43574
  chr12:114329563-114329715
  hypo

SEQ ID NO: 73849 - DNA, 30 bp, Homo sapiens
  chr12:114337104-114337134
  hypo
tgtattactgaagtccgaggcaggagccac

SEQ ID NO: 73850 - DNA, 58 bp, Homo sapiens
  chr12:114337939-114337997
  hypo
ggaagcccgagcctgcgaaatctcaaaggaaggacgaaaacaacggcaagaaaaccct

SEQ ID NO: 73851 - DNA, 32 bp, Homo sapiens
  chr12:114402798-114402830
  hypo
aggtgcagtggctcacgcctgtaatcccagca

SEQ ID NO: 73852 - DNA, 390 bp, Homo sapiens
  chr12:114833759-114834149
  hyper
ctgacacatccccaccgaacttgcgaatcgccgcgtttaacagcctgaaaatctggcctgctttttcccgggaactgcggaggttgtctctgtgactttgattatttgcattgatgaccctggggcaagattcttggaccaaccctggagtccggccccgatcgagtggaggtagttgggggaggcgagccgcggccgggggcgggggagggacgaggaactcgcgggccccgcggctgcccgaccccgggccgcgcgtctctaatctccggccgccgtggcccggccgcctccccggccgatagcgacgccgaccggggcggcgtggcgacagagagacgcagcggggccccgctggccgccacagtccccggccggcggggccatcgg

SEQ ID NO: 73853 - DNA, 30 bp, Homo sapiens; identical to SEQ ID NO: 34676
  chr12:114834466-114834496
  hyper

SEQ ID NO: 73854 - DNA, 534 bp, Homo sapiens
  chr12:114838368-114838902
  hyper
cgaatggaggcctctccctccgagccccggagccaaagcctcgcagtgtttatcagcctgagcgagcgcgcccggaggcggaggcgcagaagacttcgcaggccttttatagttaaatcctcacggctcaggctcggggggaaagagggactcggacgtgtctttccttcctgggggaataggaagaggactgcagttcgttgatataaacagaacgcgcctcctagttcactcaggccttgggccgagcggggagcagactttgtttaattttaaataataataaatgtcactgttgtcagtttattgagggaggcttcggctggagaacgggggcggggggcgtctggaaaggcggctccaccctcccccttcacacactcggtggcttgggcctaccgttcgcctgctccacacgcctgctcggggcatcctctggctttttgctttgcgggacgcggaagacccgtccagcacgggtagggatgtggccaggacgtccccaggcctgggcgcgcgcgtgcacatgctcac

SEQ ID NO: 73855 - DNA, 154 bp, Homo sapiens
  chr12:114841029-114841183
  hyper
gcaagacaaatggtgcggcgcgcgggtctagtcggcggcgcggaggaggcaggaggaggcaggaggaggcgggaggaggcgaaggctacggaagatcagaagaggggtcaagccatcgctcatgccggcctgaatcggccgctgacctggccct

SEQ ID NO: 73856 - DNA, 324 bp, Homo sapiens
  chr12:114841672-114841996
  hyper
ccaggccaaagccctcgtctgcgtcggccatggtgcgcccagggccctgtgcccgcgcaaggttctgctctgaggacaagaagcagggggagatgggggtggggaggacagagagagaacgagagaaaggttggagagcacaattctagtgacaggagggagcagtttggcccccagtttccagctaccagcacctccgttcccagccgaaggtgactgcagaaggccctagaattattactgttactagtattcctagtagtattactattactttataagcaggcacaacttcttgcaaaagacccgcgtcagacccggaga

SEQ ID NO: 73857 - DNA, 227 bp, Homo sapiens
  chr12:114842960-114843187
  hyper
atctagaaatggggccgaggagaaggacagcttctgaggcctgacttgcaagcagctttcttcgcctcgttctcggggcttcagggaggcggcgactggagccccgctgcctactcacaacaaaagaaagcagggctggcgcccctacacgcgctcccattcactgccggccgcggggagaatcctaccccgcgccctcgccagggtcccggggagctctgggctgg

SEQ ID NO: 73858 - DNA, 545 bp, Homo sapiens
  chr12:114843260-114843805
  hyper
cggcggcctcccagactccatttgccggggagctccgagccgcgcaaaatctctgcaagctgtgctctgcagaatgcaaagccgggctggaatccgccattcccgccgccccagccgactcggccgacgagctccctcctgagcctcccgggccatctgccgggacggttacctcgttcggtgaagccggtgcattcaccacatcctctgctgctcctagcagggaagccggcggtgaggcgggggagcaggcatggtggctccggggtttatgcggggtttactgcttacccagaatagcggctactgctgcctactagggcgcacctaccgctggagcctccgcggcgactgcccacctccaacacacacctcctctgctgtgcgcttgctctccctaaatacttcccagttggcaagcgccaaagaacacaaaatagcctccaagagcaccggcaaccatataatctcagtgccccgctcctcctttacacccccagggagggaaagttggaagcccagtgaatggtcgaagtcctttctga

SEQ ID NO: 73859 - DNA, 193 bp, Homo sapiens
  chr12:114844184-114844377
  hyper
acaaatcatttcaaacgcggtcggcttctaatcgggaagtaatctcagtgacgctggcggtgcagagaaccgagtctggacgcacacacacaaacacaccgcgggcctccgcagccttgcagacattctctccaacgctgacctcgagaaggagagctgcctgaccccgcctggccggcgctcgccttcctga

SEQ ID NO: 73860 - DNA, 1101 bp, Homo sapiens
  chr12:114845846-114846947
  hyper
aaagaggcaaccaggcgatagcgactatctcaccagccgctgcacctataggacttggagacgtcacgagtcacgcaaccggcccgcgcgctgtcacgtttggctggggggcagcggcgggaggtaaatttctctccgtcttcgcctatcagtgccgggtctgcgcagccacaggttccggacgtcttggccccgggaataaataaagacataaaccaacccggctttctccggaggaatgagggtgatgaacataagacacaaatagagccaagatcgactttcttaggaagggggagaggagggaactcttcacgaagggaggtgggagtccacctcagacctctattggaaggaaatcgagttgttccgggggactgaggtctcttgcataaggcatgggatccttattattattattattatttttaaatcccccgcggaggagctctgggcaaatgaataccgaggcgccgctctagctggttaggcttgggatgcgataactcagtgccctcttgcagacttgcatagaaataattactgggttgtcgtggaggggacacgagacagagggagttctccgtaatgtgccttgcggagagaaaggtccaagaatgcaattcgtcccagagtggcccggcaggggcggggtgcgagtgggtggtggagtaggggtgggagtggagagaggtggtttctgtagagaataattattgtaccagggcccgccgaggcacgaggcactctattttgttttgtaatcacgacgactattatttttagtctgatcaatgggcacaatttctaagcagcgcagtggtggatgctcgcaaacttttgcgcaccgctggaaacccactaggttgagttgcaaaacgtaccgcgtagacgcccctggtggcgccgagagaagagctaggcctgcccagcacagagccggagagcgtcgggccttccggaagggtaagttctccgccaaggggtcccgagggagctggacgtctgaatctggacttgcccccagcttcggggttcgattctgggttttgcgcgtccccaacccccagggctttccgaagcatggcctggctccaggcc

SEQ ID NO: 73861 - DNA, 122 bp, Homo sapiens; identical to SEQ ID NO: 3956
  chr12:114847042-114847164
  hyper

SEQ ID NO: 73862 - DNA, 272 bp, Homo sapiens; identical to SEQ ID NO: 3957
  chr12:114847165-114847437
  hyper

SEQ ID NO: 73863 - DNA, 78 bp, Homo sapiens; identical to SEQ ID NO: 3958
  chr12:114847577-114847655
  hyper

SEQ ID NO: 73864 - DNA, 142 bp, Homo sapiens
  chr12:114852047-114852189
  hyper
tcagtctgcggagggcgccccggtgaagtgtggagttcgcagtcggacgcggccgcccggcctctcggttccgggccttcccctcccaggcactgcgttctgcggccgggacagcacccgccaggcgcggcccttctcctat

SEQ ID NO: 73865 - DNA, 244 bp, Homo sapiens
  chr12:114877144-114877388
  hyper
attaagtctaattagcgagcccgagctaaaaggccgccacagcggcggggcccagggagaaaaagcagcgttcccaattcccatgcttccagctccaggttgtcggtcttttgtcagcctccgaagccagggtgctcaacctggccccctttctttcctgctggtgaggccacccgctttgggacagaactctgggcctgcgcctcagctctccctcttagcgccccggcgccccggcttccca

SEQ ID NO: 73866 - DNA, 350 bp, Homo sapiens
  chr12:114878244-114878594
  hyper
caaataatgtgtgtgcgcaaagacgtttctgtctacagataattacgcgtaaattatccgtggcaaacaacatatgcaaacgacatatgcaaacaacatatgcaaacgattatctatgtgcagataattccatgcccacgagccgacagatttgcaattctcaagtacttctatgtgcatgtaattctacgggcaaattgttccgagtgcaagggatttggtgtgtgtgtcagtgattgcaccgctgaaaacaattctgtagatgtgtcgatgcctttagaagaaagggctccaaagaatcgtgtctcgatggttggtcagcgcgcgcatctgcggcactggctaaatcc

SEQ ID NO: 73867 - DNA, 204 bp, Homo sapiens; identical to SEQ ID NO: 11455
  chr12:114878808-114879012
  hyper

SEQ ID NO: 73868 - DNA, 542 bp, Homo sapiens
  chr12:114881542-114882084
  hyper
aggcagagaacagcccgtcccggtggccacttttcttggccaagcccccagagcaaatccctgggggccctgcagggctagagtggaggccactgggaggggagggtcgctggggtcgctgggcgcgcgcgcgcggagcaaatttgcccgcgcgcacccagaaacgatgacataagtggcgctgatgagcgctgcgcggctgaaacgcgactacataaagggtccgccggcagcgtgggccggagggattgcttcacactccggaattgggcccagacacatttagaaatgttttgctggacgtgtgccccgcaagggcgacagcggcagccggcagcctgggtgaagctgcgccgctggtcacaggctggcgcgcggcggcggccacagaggcgtcctaggtggagaatgcttctgcctttgcctgttctcccctaacccccacgtttgtatgcctcctggggacaggggtctgtctgcagcctgcagcgccccagctgtgaccagagaagcattaaggagcggcgcgggcaagaatttgg

SEQ ID NO: 73869 - DNA, 78 bp, Homo sapiens
  chr12:114882568-114882646
  hyper
cccgtgctcggaaggcgggcgttgctacagggcacgatgaatgttgagcccgtgccccaatttcgccagacttaacga

SEQ ID NO: 73870 - DNA, 30 bp, Homo sapiens
  chr12:114883016-114883046
  hyper
actagggcgcaaacccggatcctgcgcgct

SEQ ID NO: 73871 - DNA, 83 bp, Homo sapiens; identical to SEQ ID NO: 34694
  chr12:114883452-114883535
  hyper

SEQ ID NO: 73872 - DNA, 91 bp, Homo sapiens
  chr12:114883793-114883884
  hyper
tagccaggggtttgccggactaaggcaataactgggaggtgtgccattgtgggtcggctgttgggttgtgtgtgagcgaggatcccattat

SEQ ID NO: 73873 - DNA, 86 bp, Homo sapiens
  chr12:114885098-114885184
  hyper
gagaagccgcctcagcgagcctctgggctccgggccatgtgagccggttggccagagcctggcgggttccgtgcttggctagccag

SEQ ID NO: 73874 - DNA, 295 bp, Homo sapiens
  chr12:114885371-114885666
  hyper
cgctggaagaaacgaactgggggccgagttcgggcggcgatctgccggggacccagtcctgagcggcttgtttgggatactgggattaaggcctcagaggagcacatggctagcctctgcagccctcggagggtcactgacgccccctgcttttccttccaaatgtctttccccgaggctggggacacctgttctgagcagaagagggcaatggttcaacctgtttgaccccgcccgggtctccttctgcgggaacatacgccccagtcagctgaggtgccggctgactttcccc

SEQ ID NO: 73875 - DNA, 388 bp, Homo sapiens
  chr12:114886043-114886431
  hyper
agagaaaatgcggatcggaggtcaggtgcacccttaccggcaacttggggtacacaaccggggtcccagcatcacctcccctcgccccgcgctcatgtccccactctgaggcccgtgggcactgaggtggcaccgacctcccaggacccctgcattgcctcacactttcacttccctccctgctccgcagtgtccataaaataccagccgttcacctgcctatagcgaacggatccgagggtggaggcaatgacttacctggttgtgggtggatggatgaagaaggcctttacttggagcctaagccctggcgcgcgcgcaccacggcgcgaactgctccatcaagcatccactggcctccagccgcgtttccggttgtagcactggg

SEQ ID NO: 73876 - DNA, 421 bp, Homo sapiens; identical to SEQ ID NO: 34699
  chr12:114917674-114918095
  hyper

SEQ ID NO: 73877 - DNA, 150 bp, Homo sapiens
  chr12:114918587-114918737
  hyper
ggagaaggcaagatccggcaggcgacgctgattagctgggggtctccgatgcgaccccggactcggagcaggaaatcctgggtgctcctgaagctccgcctgccccgggttccagcgagagcacctcgtcacactcggggcgctgtcccc

SEQ ID NO: 73878 - DNA, 66 bp, Homo sapiens
  chr12:114939117-114939183
  hyper
gggcaggcctgctggcggtcagtgatgcatgatggaaggaaccgggaggcgcgccctggaagcagc

SEQ ID NO: 73879 - DNA, 30 bp, Homo sapiens
  chr12:115106216-115106246
  hyper
atcccctccaccccccgcccatcagcgcta

SEQ ID NO: 73880 - DNA, 38 bp, Homo sapiens; identical to SEQ ID NO: 11459
  chr12:115106464-115106502
  hyper

SEQ ID NO: 73881 - DNA, 38 bp, Homo sapiens
  chr12:115120626-115120664
  hyper
tggtaatgaccatctcggtgccccgcttgtgaaactga

SEQ ID NO: 73882 - DNA, 39 bp, Homo sapiens
  chr12:115121505-115121544
  hyper
cctctccctctttctcgctggtggcgtctgcagctgtgc

SEQ ID NO: 73883 - DNA, 130 bp, Homo sapiens; identical to SEQ ID NO: 34702
  chr12:115121885-115122015
  hyper

SEQ ID NO: 73884 - DNA, 288 bp, Homo sapiens
  chr12:115122236-115122524
  hyper
gcgcgcgcacagagtcgcctctaggtggcttatcgagagatcgctgcagcccctgagctcgctcgctcgctctggttcagcccacgtctgaaatgcctcagtcatccagccggggatcgagggaggaggcagggccaaggaggaagggggagggagagagggagggagccagcgagcaggcgagccgggcggggaaggcggagagcgcgcccgggcgccgggcaggggcgctcgcctctcttgcactccgctcgcctctccgaccgccgcggccggttctctctccag

SEQ ID NO: 73885 - DNA, 102 bp, Homo sapiens
  chr12:115130675-115130777
  hyper
caggctcagagagaacgcagccgagcgggggaatcttcgtgcgcgaagccgggagggttgcggggagggagagttctcctctcccaccgctggggtgtgttt

SEQ ID NO: 73886 - DNA, 65 bp, Homo sapiens
  chr12:115135302-115135367
  hyper
ctccctagtagatttcgttcttgaacttctcggccttggaatcagacgcccgggtcattgcgcag

SEQ ID NO: 73887 - DNA, 123 bp, Homo sapiens
  chr12:115136240-115136363
  hyper
ttgggcggagtggggcgcggtggggaacacagcttggacgcctaggcgtcctgagcccggcaccctgcgcgcagagcagacccaggcgctctcgcgagctctagcgtccgtcatgtttcctct

SEQ ID NO: 73888 - DNA, 73 bp, Homo sapiens; identical to SEQ ID NO: 34704
  chr12:115889703-115889776
  hyper

SEQ ID NO: 73889 - DNA, 15 bp, Homo sapiens
  chr12:11653449-11653464
  hyper
ggagctcagggccat

SEQ ID NO: 73890 - DNA, 279 bp, Homo sapiens; identical to SEQ ID NO: 34245
  chr12:11653509-11653788
  hyper

SEQ ID NO: 73891 - DNA, 352 bp, Homo sapiens
  chr12:116755878-116756230
  hypo
gagcctcaggttcttcgtatgggaaacaggggtagtgctttgcctacctcgggagatagggggatgattcattagctatgcctggtatgtacctggcatgcagaaattgtttcatgaacgtctgctgtgatggcaaacctttcgggtagatccatctagtttctcacgcgtgcggcaagcggctgccgtgtttaccgaccgtcctgtgactgtggggactggcaaagctaaatggcctgagtgggttgaactgtggccgcacctggttagcaccgttctttttcttcttctgaaggaaaggcgtggctgttccgaggtgccttgtgaaatagccagccgtcctgggctgccc

SEQ ID NO: 73892 - DNA, 142 bp, Homo sapiens
  chr12:116842262-116842404
  hypo
ttggtgtctggtcaccgcacgtcgttattcagttcacacacagctaagcgtgcagctgtgttgcctccttctctctgggtgataactcacttgacattttacataaatggatagtaaaaagaaggaattagccaacaaagat

SEQ ID NO: 73893 - DNA, 186 bp, Homo sapiens
  chr12:116941184-116941370
  hypo
atggtgtacacagggcgtgggacgctggataaaacctaaagagacctgacccactgccctctaggtgcttagcctctgaccacaccaagctagcgacattccaatctctcataaaaagcatttcaaaatgaaagagactgggcaaataaatcgtggtacatgcacggaatgcgatggccttcaggc

SEQ ID NO: 73894 - DNA, 114 bp, Homo sapiens
  chr12:116946086-116946200
  hyper
tctgcaagctctcagcggctccagcgttttcaaggagcggggtcaaggtcaaagggcccctcccaggctgcccgggcggggctgtagtgggatgctggtccccaggctgcgcct

SEQ ID NO: 73895 - DNA, 298 bp, Homo sapiens
  chr12:116946250-116946548
  hyper
cgccgccggagagggtcccagcgcgcccaggcctcccgcaggcgggacgcggcgtcggggggctgctgcgctgctcggccccagcgggcccgccgcgccgccgcggctctggctgcctcctgcatgccaattaggccctaatttgatttctgttctatctgtgcgaaccccattaaaacccaattccgcttattaccaacagctttcttgcaacgcgacgcctctccctcccagggccgctgctcaggcgcgccgaggagccaggctccgcgcaccaggctggcggggacaccttccc

SEQ ID NO: 73896 - DNA, 39 bp, Homo sapiens
  chr12:117155588-117155627
  hypo
aggctggagcaagtccgctgcacccgtcaagcggggaag

SEQ ID NO: 73897 - DNA, 30 bp, Homo sapiens
  chr12:117157142-117157172
  hypo
tcctaaaataaacagcgactccatcccaga

SEQ ID NO: 73898 - DNA, 41 bp, Homo sapiens
  chr12:117300848-117300889
  hypo
ggacagataaggtggctataagttagcgggggagataagaa

SEQ ID NO: 73899 - DNA, 30 bp, Homo sapiens
  chr12:117316744-117316774
  hyper
cgccctcccctgcagcgcaggccccagtta

SEQ ID NO: 73900 - DNA, 32 bp, Homo sapiens
  chr12:117317256-117317288
  hyper
cctttttctgcaccccgcgatccatccaaaat

SEQ ID NO: 73901 - DNA, 47 bp, Homo sapiens
  chr12:117318318-117318365
  hyper
caaaggtgatggagacgggggcgactcaggaacggcaagaggattgg

SEQ ID NO: 73902 - DNA, 110 bp, Homo sapiens
  chr12:117319409-117319519
  hyper
gcgaggtttgggagacggggagcgcggcgcggggcggcgcgagaaggctccccgcagcggaggtcctgggctttgggggtctcgggggacccccgcggaggcgcggagcg

SEQ ID NO: 73903 - DNA, 338 bp, Homo sapiens
  chr12:117319758-117320096
  hyper
tcagcctgaccctaacgtgcccccagcgcctggctagaaacctgaccctaaagtgcccccagcgcccggtgggaggctggatgggcccacctgagctcgcgtggggcgcggacggaggcattctcgctgcccggcacccgcacccaaaagaccctcgcaaggggctttctaaagggaaacttcttgtctgctttctttgtgaacattattttcctgatggcgttacagttttctgcgatgaccccgatttaatgcgcagtggagaccctaaggggtcggcgagaggaggggcgcgggggactttaattcccccttttccaatccgacagccactcctg

SEQ ID NO: 73904 - DNA, 30 bp, Homo sapiens
  chr12:117408106-117408136
  hypo
atgaggaagcctggacgggacagccagcag

SEQ ID NO: 73905 - DNA, 41 bp, Homo sapiens
  chr12:11745619-11745660
  hypo
gcattcctcccagtgcgcagacaggtcggaggttctgcagg

SEQ ID NO: 73906 - DNA, 502 bp, Homo sapiens
  chr12:117472595-117473097
  hypo
gcccgaggcacagaccgcagtgcccagatggtggggctgactgagatccgtgcccggggcagcaaccctcggtctgtgttgatcaaaggccagcagccccacaagacgcatcagcctgccccttctgggatcaggtttgcaccaactcatcgccaaccctgatcgttcccgggatgccacagacaatgccaggagccgggcaggagagcgccaggtgatttctgcatccacgctctggcggaaatgagccctaaccctgccaattagaggacaccctcagtgattatgcacaaatgagctttcttctgagcagtgtggactgggctcacggtaactcaacctcattttaattagctgtttagataagcggtggcccaaagcttcaaagacatcaggcaggcctcagtggcccaaacaggggagcacatttgatgtgtgcccatcgtggccacatctcccaaactaaaactcggggcacaggggctgacggaagatgatttat

SEQ ID NO: 73907 - DNA, 211 bp, Homo sapiens; identical to SEQ ID NO: 43581
  chr12:117473987-117474198
  hypo

SEQ ID NO: 73908 - DNA, 198 bp, Homo sapiens; identical to SEQ ID NO: 43582
  chr12:117474577-117474775
  hypo

SEQ ID NO: 73909 - DNA, 30 bp, Homo sapiens; identical to SEQ ID NO: 43583
  chr12:117484341-117484371
  hypo

SEQ ID NO: 73910 - DNA, 89 bp, Homo sapiens
  chr12:117498335-117498424
  hypo
cagggagatgatctacgaaatcacgatcggatgacaatgacagctacagctcacaaccgtgcaagcaacttggccggagccacctcgct

SEQ ID NO: 73911 - DNA, 38 bp, Homo sapiens
  chr12:117512545-117512583
  hypo
tgaagagcccttcctcgcttccacgatagttataattt

SEQ ID NO: 73912 - DNA, 30 bp, Homo sapiens
  chr12:117512972-117513002
  hypo
gaaaacaactacccccgctactcagcactc

SEQ ID NO: 73913 - DNA, 523 bp, Homo sapiens
  chr12:117529736-117530259
  hypo
ggggttctcggcatgcgggagaggcggtttctcccggcactgcacttggcaaatcccactagaaggcctggttttgagtctggattccctacccagcaactaagtgatcttgggcagtcatttcctctgtccaaacctcagtttgcccatctataaactggcagcaatagtcccaccctcaaagggcttttcggcagatcagatgattgacaagtgctcaagaaagagcagctgtcacctcattcacagctggctgcgttttttaaggagcggaactggtggctcaaagaaggacacagcctggatgagacatctgagcgaagtggcacaggacggctccagcaccgagctcagtgcacatggaacgccatcctccagggtcccgctctgtggctgcgacagatggtgagatgatggggcccaggtgaacagaatgaaaaataccagcatgggctagagcaggcaggtgcctttggttgatccccagccctgtgggaagcttccacagcgggcattctcctgc

SEQ ID NO: 73914 - DNA, 136 bp, Homo sapiens
  chr12:117530986-117531122
  hypo
ctggagggcagggaccgcatctggtccaccctggtagcagaatatggcaattggtgaatgagccgaggccaccgtctgaggccacttaaagactttagaaccaagaagtattacccaggggcgagaacgcagtgga

SEQ ID NO: 73915 - DNA, 141 bp, Homo sapiens
  chr12:117532388-117532529
  hypo
tgatgcctgctattgcgggctccaggagcgctgaggatgggtgtttaacccttaaaggtcggatggagagatggctttctggatgggagcagcaggtaagccaacccctgaacaataatgagcattcgtttcataaagaga

SEQ ID NO: 73916 - DNA, 148 bp, Homo sapiens
  chr12:117533174-117533322
  hypo
gcctagaccttaccctgggtggagacagagaaaggctcccgtacgtaaacacctgattgtacacatcaaatgaaaacagtgctccaggcagaggaacagcttttgtgcaaaggcctgaaggtgagaaaaaatacgggagtcttttcct

SEQ ID NO: 73917 - DNA, 67 bp, Homo sapiens; identical to SEQ ID NO: 43588
  chr12:117544227-117544294
  hypo

SEQ ID NO: 73918 - DNA, 82 bp, Homo sapiens
  chr12:117563218-117563300
  hypo
gggttgctgtgcagccgagactgagggtgactcatgccgaatatatactgcctagacagtgacaattcgcagcatctctcac

SEQ ID NO: 73919 - DNA, 100 bp, Homo sapiens
  chr12:117564823-117564923
  hypo
aaagcatgtaacacacgtatgagaatgctaccatgtaatatgcatgacagtggcacgtaattgccacatgataggcatgccttaacgtgagtggcatgta

SEQ ID NO: 73920 - DNA, 30 bp, Homo sapiens
  chr12:117669835-117669865
  hypo
cagaggcgttggtggcgtggtgatgtccag

SEQ ID NO: 73921 - DNA, 24 bp, Homo sapiens
  chr12:117716889-117716913
  hypo
aaatgatcaatgggccgggcgcgg

SEQ ID NO: 73922 - DNA, 152 bp, Homo sapiens
  chr12:117718680-117718832
  hypo
agagaggggaacacccggcatcagggcgggacttgcgctgtgggaacatactaaacatggcgccacccagggcgacagctgcttgaggctcagggtagattacctccgtgccaaggtccccagggccaatggagcagcggtcggaagggatg

SEQ ID NO: 73923 - DNA, 34 bp, Homo sapiens
  chr12:117796936-117796970
  hyper
tgtcagtggcagagccgtgcgcccctcagggcgc

SEQ ID NO: 73924 - DNA, 36 bp, Homo sapiens
  chr12:117797434-117797470
  hyper
cctccgtggtggctgcgtgcgcgcttttcttaggcc

SEQ ID NO: 73925 - DNA, 371 bp, Homo sapiens
  chr12:117798084-117798455
  hyper
tggcgtcctctggggcgcagtcccgagagagccccttccgggacctcggacgcaaggcccctgagtggccctggaagttggatcccccggggaccctgctccgaaccctggccacctggaagcaacctcatcgagcgctccttccactgcccagccccgaaccgtggcggaacgcgcccctcggcctccctagagcctcctttgcgggagaagcacaactttcccaggttttggagacggcgctcttacaccccaatctcgcccagacggaagaagtgagaggtgcgggcggccccgccatgaccgcgggaggagagcgcaaggaggctcctcgcaaagttggaggccaggccggagcgatgttccgggag

SEQ ID NO: 73926 - DNA, 193 bp, Homo sapiens; identical to SEQ ID NO: 34709
  chr12:117799086-117799279
  hyper

SEQ ID NO: 73927 - DNA, 261 bp, Homo sapiens
  chr12:117799330-117799591
  hyper
cgctgctcgctgcccggccgcccctcggaggagccgcggcgctaagtagctcctcacccagcggctggaaacgcggcataaatatgtagggactgagccgtgagctcagcgagggtcgtgagggggaatttatttcttaatgtccctcctttatcctatcatcactgaaacgaattagcagtgacgtccaacccgactggtttatgggtgtggggagggagacgtcgcaaccctcattaaaagagccgctctgggctccaa

SEQ ID NO: 73928 - DNA, 36 bp, Homo sapiens
  chr12:118177132-118177168
  hypo
ctgggcgacagagcaagactccgcctcaaaaatata

SEQ ID NO: 73929 - DNA, 265 bp, Homo sapiens
  chr12:118198608-118198873
  hypo
atcgtattttttaaacggccaattctgggaaattctgttctattcatttgctcagaaccctctgtgaaaagccatttttcattcaaccagagtctggaacgcaagtctgttcccggtttccttgacctgggcagttcctgggaccaaggggcagcccctcgcaggccgggtttcgaccgccccagggcacccaccgatcgcactcacttgggcgtgtgggcctcgtccacgcggtgccccagctggaactcgtgggatttgctcc

SEQ ID NO: 73930 - DNA, 45 bp, Homo sapiens
  chr12:118324438-118324483
  hypo
catttctcagaacgtatccccgtcatttagcgacatatgacagta

SEQ ID NO: 73931 - DNA, 30 bp, Homo sapiens
  chr12:118331639-118331669
  hypo
ataaatatattttaacgcagcattttaaaa

SEQ ID NO: 73932 - DNA, 16 bp, Homo sapiens
  chr12:118711017-118711033
  hypo
aaaaaatagggccagc

SEQ ID NO: 73933 - DNA, 157 bp, Homo sapiens
  chr12:118795285-118795442
  hyper
agagaaggttaagcacgttttaagtaattcaggagtttaaaacttgtcatctatgtataaaacaagcaaacagttataagtggttaaataaacatgtacaaattaataggatggagtttgtaacttctacttttcccttcaacgagtgtcattttgg

SEQ ID NO: 73934 - DNA, 30 bp, Homo sapiens
  chr12:118830447-118830477
  hypo
taccagtctgcctgccggcttttggacctg

SEQ ID NO: 73935 - DNA, 39 bp, Homo sapiens; identical to SEQ ID NO: 43592
  chr12:118860397-118860436
  hypo

SEQ ID NO: 73936 - DNA, 88 bp, Homo sapiens; identical to SEQ ID NO: 34711
  chr12:119212112-119212200
  hyper

SEQ ID NO: 73937 - DNA, 88 bp, Homo sapiens; identical to SEQ ID NO: 34712
  chr12:119212318-119212406
  hyper

SEQ ID NO: 73938 - DNA, 99 bp, Homo sapiens
  chr12:119417727-119417826
  hyper
agcaaatgcacctctcgttgttgaccagaaggggtcactgcagagcaagtagcgctctcaggcactcaaataagcggacgcaggcgtgtcgaacacaca

SEQ ID NO: 73939 - DNA, 808 bp, Homo sapiens; identical to SEQ ID NO: 34714
  chr12:119418516-119419324
  hyper

SEQ ID NO: 73940 - DNA, 455 bp, Homo sapiens
  chr12:119419368-119419823
  hyper
cgtcgcctcttctctcctggtgctgcccagaaagccagccctcccttcccttcttggggcgcagaggctcagccagctcagagcgcagcctggagccgacccagaagggcgaagaaagcccagcggacgagcctcctttctctgctgcctgcccgggctggggcgtcccatcccccgccctgaactccgatctctcccaccccacccctctctgggtttcacccggacagagccgggagctgggtgtcgcccccgtttggaatccacgtttcagcactttggacagcgccccggacgccccggcccctttgggttggcgatggcgagcgttcagcaaggcgagaagcagctttttgagaagttctggcgaggaaccttcaaagcggtggccaccccccgtcccgagagcatcattgtcgccagtatcacggcccgcaagccgctgccaaggtaat

SEQ ID NO: 73941 - DNA, 80 bp, Homo sapiens
  chr12:119446570-119446650
  hyper
accagccagagccaacgggccgccccttcctccaccagctctccggcctttgacactaattgatacggagtttccccctc

SEQ ID NO: 73942 - DNA, 91 bp, Homo sapiens; identical to SEQ ID NO: 34717
  chr12:119458719-119458810
  hyper

SEQ ID NO: 73943 - DNA, 318 bp, Homo sapiens
  chr12:119499049-119499367
  hyper
attatcttgttccaacggtgggggcagagtgtccttgagatgtggttagaaaagaaaaaaaggtgtagccctgcgtgtgcacttgggtgtgttggcagaacttccgctcaaatccaggggctttgctgattcatgtttcctagagcctgacggcggttcagcaccagggacagcgaccactgattaaataacaggctgcagtgaatccaaccatgaaagcactacctggctgttgcagccgtccttgcctattgaacctactagttacattacttttcaggtgtctctcacttttacggaatgcgtgctattgaaaag

SEQ ID NO: 73944 - DNA, 83 bp, Homo sapiens
  chr12:119616507-119616590
  hyper
gagggcggagctgagcggagtggccaggggaggagagagtgtccggagaggccggctgaacttggacgcggcccctcccagct

SEQ ID NO: 73945 - DNA, 32 bp, Homo sapiens
  chr12:119730037-119730069
  hypo
ggatgtacatacccacgcgggcttgcagaaac

SEQ ID NO: 73946 - DNA, 36 bp, Homo sapiens
  chr12:120001632-120001668
  hypo
taaaaataagccgggcgcagtgattcacacctgtaa

SEQ ID NO: 73947 - DNA, 380 bp, Homo sapiens
  chr12:120031519-120031899
  hyper
gaaggggtgaggtcacgtctcccttgagccccgagccgctggcttttcagagcctcgccacaagccggcggccagagccccagaccacacagaccgtgcgctcctccgccctcccggcgccgccggcctcgcccatgtctcagtacgcccctagcccggacttcaagagggctttggacagcagtcccgaggccaacactgaagatgacaagaccgaggaggacgtgcccatgcccaagaactacctgtggctcaccatcgtctcgtgtttttgccctgcgtaccccatcaacatcgtggctttggtcttttccatcatggtgagtgaatcacggccagaggcagcctgggaggagagacccgggcggctttgagcccct

SEQ ID NO: 73948 - DNA, 118 bp, Homo sapiens
  chr12:120032256-120032374
  hyper
agcatgcaggctctacgttcctttccctgccgctccgggggctcctgctctccagcgcccaggactgtctctatctcagcctgtgctcccttctctctttgctgcgcccaagggcacc

SEQ ID NO: 73949 - DNA, 56 bp, Homo sapiens; identical to SEQ ID NO: 34721
  chr12:120032375-120032431
  hyper

SEQ ID NO: 73950 - DNA, 866 bp, Homo sapiens
  chr12:120032454-120033320
  hyper
cgctctgtccaggcaacagtttcctctcgcttcttcctacacccaacttcctctccttgcctccctccggcgccccctttttaacgcgcccgaggctggctcacacccactacctctttaggcctttcttaggctccccgtgtgcccccctcaccagcaaagtgggtgcgcctctcttactctttctacccagcgcgtcgtagttcctccccgtttgctgcgcactggccctaacctctcttctcttggtgtcccccagagctcccaggcgcccctccaccgctctgtcctgcgcccggggctctcccgggaatgaactaggggattccacgcaacgtgcggctccgcccgccctctgcgctcagacctcccgagctgcccgcctctctaggagtggccgctggggcctctagtccgcccttccggagctcagctccctagccctcttcaaccctggtaggaacacccgagcgaaccccaccaggagggcgacgagcgcctgctaggccctcgccttattgactgcagcagctggcccgggggtggcggcggggtgaggttcgtaccggcactgtcccgggacaacccttgcagttgcgctccctcccccaccggctcacctcgcctgcagctgggccacggaactccccggccacagacgcagagccctgattcagcgctgtgaaaatcgctagccacccgtcccccatcaagtccgcccacacttgcccacgggtggtggcaccatattcgattcgtgggcacctgcaaggctccatttgcacccgtaacttgccctttcccaaacccggtttgtggacagcgtctgcaccgatatgaaagcgtgcagccgctgaagttcagac

SEQ ID NO: 73951 - DNA, 25 bp, Homo sapiens
  chr12:120087669-120087694
  hypo
aaaaaaaaaaagggccgggcgcgtt

SEQ ID NO: 73952 - DNA, 184 bp, Homo sapiens
  chr12:120148212-120148396
  hypo
ggcagaacataagcacggtcacgtcaccagaacaatctctagtaagagcaacaaggcctccacagccctttctttcttgatggggtgtggctgtaaccagacaccagctggccgtgcccatgcaagcattacctggtcactgaagggcagcgtgcagttcatgtctagacggtcatcaccttcc

SEQ ID NO: 73953 - DNA, 380 bp, Homo sapiens
  chr12:120148731-120149111
  hypo
aggagatttcacctgcgcagggttaataagacacatgaaagactccttcccccataaggctgcagcagaagtgcaaaggcgccgtgttagcagcgagccagcacgcctctgcatctctttacctgaacccaggcaggcagaagctcgtaagaaacacagtcgcgggcctattgtacacatattaacaaggatttcagtaaaagctcacgtgtgaaacgaccaacaagtcatccaaacaggtctaaccactgagtaaagcccttttcaggaggcttgtggttaagaatctgccaattgctaacacataaagtgtttattaggagtgaagagtctgaaaagagctgtttggtcttcgctggagcaaacgtcaatgagcaatg

SEQ ID NO: 73954 - DNA, 54 bp, Homo sapiens
  chr12:120152051-120152105
  hypo
gcacactttgtggctcgcatgttcagtcctacgttgaatcggtgaggaatattg

SEQ ID NO: 73955 - DNA, 81 bp, Homo sapiens
  chr12:120173056-120173137
  hypo
cgccagaagcctcatcgagttgtttggacaagtagaagttttggttgttgagttcagcgttgtcctcggtcagctggttta

SEQ ID NO: 73956 - DNA, 30 bp, Homo sapiens
  chr12:120353676-120353706
  hypo
agctccaggcaaccacgactctactttctg

SEQ ID NO: 73957 - DNA, 22 bp, Homo sapiens
  chr12:120411854-120411876
  hypo
aggcgcggtggctcacgcctgt

SEQ ID NO: 73958 - DNA, 67 bp, Homo sapiens
  chr12:120574326-120574393
  hypo
tgtctcgagcagagccgccttcacattccagctgaacctgtcccccaggatgcggatcagagggcca

SEQ ID NO: 73959 - DNA, 63 bp, Homo sapiens; identical to SEQ ID NO: 43596
  chr12:120580446-120580509
  hypo

SEQ ID NO: 73960 - DNA, 30 bp, Homo sapiens
  chr12:120620325-120620355
  hypo
cgaaacctggctttgcgacaactctttgag

SEQ ID NO: 73961 - DNA, 30 bp, Homo sapiens
  chr12:120661930-120661960
  hypo
cccagccactgtccccgcctcacctgctgg

SEQ ID NO: 73962 - DNA, 30 bp, Homo sapiens
  chr12:120724619-120724649
  hypo
acaaaagatactcaccgaacctctctggta

SEQ ID NO: 73963 - DNA, 42 bp, Homo sapiens
  chr12:120728061-120728103
  hypo
gcactcttcttttcacgttatttctaagttttggataacttt

SEQ ID NO: 73964 - DNA, 30 bp, Homo sapiens; identical to SEQ ID NO: 43597
  chr12:120740933-120740963
  hypo

SEQ ID NO: 73965 - DNA, 30 bp, Homo sapiens
  chr12:120750504-120750534
  hypo
gcgtgtaaaagaagccgactccctcttggt

SEQ ID NO: 73966 - DNA, 26 bp, Homo sapiens
  chr12:120758797-120758823
  hypo
tttagaaaagaaagtcgtggccgtgt

SEQ ID NO: 73967 - DNA, 444 bp, Homo sapiens
  chr12:120806287-120806731
  hyper
gggctggaagggggacggctccggccgggttcccgccgctccgggagcagcctcacaaaagtttgagccgcaggtgcgagcggagttggcgctgccgccggcgggtcccgggggcccagcccaccccccgataccccctgaacccctcatctgctcccctccacccgctgggccgggtgcgctcgcggatcgccctgcgctctcggggtctccgggcggggcgcgaaagagggcgcgagggcgcccggggtcagcagggcgcagggccgggctggggtgtccgggtccggggcgccggggggtccggggtgccctgccggaccggcgggcgctcccgggctcgctcaccctgcgtagtctgccaactgagtcccccgatgaacatcttgctgcgggaggaggagagacacaaagggcccgcgtgagcgccgggcgccagggcgc

SEQ ID NO: 73968 - DNA, 580 bp, Homo sapiens
  chr12:120807457-120808037
  hyper
ctccatttccccagtcggagcgagaagccgccctcagagcccccagtttcctcccaacctaatttacagccccccacccccaccccagggctctaatttagagccctcgctccgttcccaggatcccatatccagtttgggggacccactcagtgcctcgcgtcccgagtggggaacctccatcagcaccccagtagaaaccgtatcctcttccccaatccgtcctcagcccttggtgtccaaagtgagagtcccccttagtttccccaaatccctgccgtccacattagtggaccctatggtctgttgagaaaatcccgcgccccaagcccgggttctcagtttgccgccacccccacctcccggtgtgaggagtctcccctggttctctccctccctggccggtttttgtgagatccattcagactcctgtcctgattcgggaaacccggttccagacactcaccacccccaccacaccgaggctggaggaaaaggcagtgcctcttagagcctcctgtttccagtttaggagcccaacgcctcagctgtgcaccgtcccctccgaatgacccccttc

SEQ ID NO: 73969 - DNA, 165 bp, Homo sapiens
  chr12:120826806-120826971
  hyper
agccagtcggcatcacgtgatctttcgggaagaaaaggtgggcagagccctgggtcggtggccacctgcttttgggtagggcactaatacagggtgctgaagcgggaaggtgaggccgagctgggcggccctgggaacccgggaaggaggcgaggctggagtgga

SEQ ID NO: 73970 - DNA, 26 bp, Homo sapiens
  chr12:120868614-120868640
  hypo
tttttttttttgagacggagtttcgc

SEQ ID NO: 73971 - DNA, 20 bp, Homo sapiens
  chr12:120877324-120877344
  hypo
aactccgtctcaaaaaaaaa

SEQ ID NO: 73972 - DNA, 27 bp, Homo sapiens
  chr12:120885154-120885181
  hypo
ggtgtgagccaccgcgcctggcctaat

SEQ ID NO: 73973 - DNA, 42 bp, Homo sapiens; identical to SEQ ID NO: 43598
  chr12:120932999-120933041
  hypo

SEQ ID NO: 73974 - DNA, 62 bp, Homo sapiens
  chr12:121163445-121163507
  hyper
tagcattttgattaacgaatgtgggcacgaacagccagctgaccgaccgcgcgcgcagtcga

SEQ ID NO: 73975 - DNA, 30 bp, Homo sapiens
  chr12:121163726-121163756
  hyper
ccgcagaggtgagtgcgctggggatccgta

SEQ ID NO: 73976 - DNA, 30 bp, Homo sapiens
  chr12:121197853-121197883
  hypo
aaagctagaagctcacgtggtggctacact

SEQ ID NO: 73977 - DNA, 30 bp, Homo sapiens
  chr12:121204975-121205005
  hypo
ctgcttttcctacaacgttcttcagataca

SEQ ID NO: 73978 - DNA, 30 bp, Homo sapiens
  chr12:121211742-121211772
  hypo
acttcatcctaactgcgcaggagccttgaa

SEQ ID NO: 73979 - DNA, 209 bp, Homo sapiens
  chr12:121366974-121367183
  hypo
caagtgagccctcttcgtctcagagcagtgaaggctatgggaggatgaggaggggctgaatctgggggttcaaacacagcctcagattgtttctggaaccccccttctctccaatctccagactcagccctcaagtcaggcgggctgggtgtcttccttctgcagttttctcctggagcacccccatcccctcccgcccctgcaacttc

SEQ ID NO: 73980 - DNA, 169 bp, Homo sapiens
  chr12:121394362-121394531
  hypo
gtgtatgtgcactcacgctgtggagtgaagatgcaaatgactgtgatgatccaaaccctggcaggaaggtggcagccccgtagggcatggggatcagaggtaactccactgtgtgtgccttccgctgtgtgtgccctccactgtgtgtgccctccgctgtgtgtgccct

SEQ ID NO: 73981 - DNA, 191 bp, Homo sapiens; identical to SEQ ID NO: 34727
  chr12:121566850-121567041
  hyper

SEQ ID NO: 73982 - DNA, 93 bp, Homo sapiens
  chr12:121622470-121622563
  hypo
tgctacgccacctggcgcttcggctcccaggacatggctgactttgccaacctgcccagctgctgccgctggaggatccggaaagagtttccg

SEQ ID NO: 73983 - DNA, 30 bp, Homo sapiens; identical to SEQ ID NO: 43600
  chr12:121641645-121641675
  hypo

SEQ ID NO: 73984 - DNA, 30 bp, Homo sapiens
  chr12:121653407-121653437
  hypo
taggattccttatgacgtattcactgtctc

SEQ ID NO: 73985 - DNA, 44 bp, Homo sapiens
  chr12:121667860-121667904
  hypo
ccaggtaaatttccacgtaccctttgttgcatttttcacagtcc

SEQ ID NO: 73986 - DNA, 30 bp, Homo sapiens; identical to SEQ ID NO: 43601
  chr12:121688301-121688331
  hypo

SEQ ID NO: 73987 - DNA, 30 bp, Homo sapiens
  chr12:121740282-121740312
  hypo
ttatcttcacaggtgcgggggacataggac

SEQ ID NO: 73988 - DNA, 82 bp, Homo sapiens; identical to SEQ ID NO: 43602
  chr12:122107201-122107283
  hypo

SEQ ID NO: 73989 - DNA, 46 bp, Homo sapiens; identical to SEQ ID NO: 15700
  chr12:122141060-122141106
  hypo

SEQ ID NO: 73990 - DNA, 30 bp, Homo sapiens
  chr12:122186181-122186211
  hypo
cctccctctgagtgacgccccttcccctgt

SEQ ID NO: 73991 - DNA, 30 bp, Homo sapiens
  chr12:122192959-122192989
  hypo
accggttagcatcaccgttgttttgggcta

SEQ ID NO: 73992 - DNA, 81 bp, Homo sapiens
  chr12:122204974-122205055
  hypo
gacatgctgtccctacgtctggccattgatgcacctgctcctcctggagctcataaaataaaaaaaggccgtgagctcctg

SEQ ID NO: 73993 - DNA, 200 bp, Homo sapiens
  chr12:122205355-122205555
  hypo
gcgcccagctgcccctgcaagctttaacttctgtggtgaaatgagcccagagagtgactgcaaatgggtgtaggtttctttctgcaatgataaaaaggttttaaaacagattctggtgacagttgcacaactctgtgaatatactaaaagccactcagttgtgcactttcagtgagtgaattgtacggtatctgaatcac

SEQ ID NO: 73994 - DNA, 66 bp, Homo sapiens
  chr12:122208388-122208454
  hypo
agcaggcaggcttggcgggttctaggagagcccacattcctggagggcctgcgtgctggggagaag

SEQ ID NO: 73995 - DNA, 30 bp, Homo sapiens
  chr12:122208777-122208807
  hypo
ctcctgagcactttccgttctctccctctc

SEQ ID NO: 73996 - DNA, 123 bp, Homo sapiens
  chr12:122212425-122212548
  hypo
tgagggctgaccccccgcatgtgtgactgtccctggctcatcttagggtgactggtgtggctgggggtgggcgtctggtggagctgtgggggcagcggaccccctcagcgggtcctttttctt

SEQ ID NO: 73997 - DNA, 85 bp, Homo sapiens; identical to SEQ ID NO: 43605
  chr12:122213608-122213693
  hypo

SEQ ID NO: 73998 - DNA, 30 bp, Homo sapiens
  chr12:122219029-122219059
  hypo
catagcagatgagcacgaggtgggtgttct

SEQ ID NO: 73999 - DNA, 176 bp, Homo sapiens
  chr12:122231347-122231523
  hyper
gctcagggtaaggggcgtccctcgcccccaccccagccccgctgcgggcctcacctcggggaaggagccctggctgtacaccatgagcagcgaggtcttgccgcagccgccgtcgcccacgatcacgatcttcagctccttcctgcccggaccgggggcggcggtctgggccaggg

SEQ ID NO: 74000 - DNA, 166 bp, Homo sapiens; identical to SEQ ID NO: 43606
  chr12:122281163-122281329
  hypo

SEQ ID NO: 74001 - DNA, 139 bp, Homo sapiens
  chr12:122284969-122285108
  hypo
cttcttcttgccaggcgctggctcattgatgggcatcttgatggactcttcatagttggccaccacaatggatcgcagagagctatattccgtgtgcacctgcgtgtcatccacggaccagaagcggtggaactgcagg

SEQ ID NO: 74002 - DNA, 30 bp, Homo sapiens; identical to SEQ ID NO: 15703
  chr12:122292767-122292797
  hypo

SEQ ID NO: 74003 - DNA, 21 bp, Homo sapiens
  chr12:122301174-122301195
  hypo
ccactgcgcccagccagctct

SEQ ID NO: 74004 - DNA, 140 bp, Homo sapiens
  chr12:122343727-122343867
  hypo
gtggcctgccattcccgtgagttttcacaaatgtatgtagtatgtcattgccaccacgatgaaggtcaagagcattccaacaccccataaaattgcctcaggcttctttgtagttaatccctcaccgtcaacttccagaa

SEQ ID NO: 74005 - DNA, 112 bp, Homo sapiens; identical to SEQ ID NO: 43609
  chr12:122439399-122439511
  hypo

SEQ ID NO: 74006 - DNA, 53 bp, Homo sapiens; identical to SEQ ID NO: 43610
  chr12:122458643-122458696
  hypo

SEQ ID NO: 74007 - DNA, 30 bp, Homo sapiens
  chr12:122487551-122487581
  hypo
aactataatacttcccgttcaagtctgtga

SEQ ID NO: 74008 - DNA, 68 bp, Homo sapiens
  chr12:122591572-122591640
  hypo
ctggcaggggttcaacgtcaccagccctcctccttgtgttctcctctgtctgtcgccctctcccaggt

SEQ ID NO: 74009 - DNA, 23 bp, Homo sapiens
  chr12:122596891-122596914
  hypo
aatgtatgtacaggccgggcgtg

SEQ ID NO: 74010 - DNA, 86 bp, Homo sapiens
  chr12:122602862-122602948
  hypo
gggtaaagcacaataccgcagaaaagggaggaatgccgtacattccagtgttatatttcaacaatacaaaacggtgttcagtgaac

SEQ ID NO: 74011 - DNA, 352 bp, Homo sapiens
  chr12:122622033-122622385
  hypo
cagggcaggcctctccgtgtgcatcggagcagagccccagtcctcaatctccccagaacaactgctcagggaaatccgaccccaaaaatgtggctgcactaaaggtaccgcatgtctcctcttggttcccttgggaggaggggagaggagtgcaggacatcaaggatctgtgtcttgtctggaacggagacctcagacccagccagagctgcccaggcaggggtggatcagaaatgggcttctccttgccccatgccacgaaccagccctgtggggatggtgggccccctggaggcttttgggtgagccccaagcctgggagccaacgctgagtccacgtagtgtgcaggta

SEQ ID NO: 74012 - DNA, 48 bp, Homo sapiens
  chr12:122622594-122622642
  hypo
gagccttcagcttctcgtcgtgccctcctcccacgtagctctctagcc

SEQ ID NO: 74013 - DNA, 114 bp, Homo sapiens
  chr12:122623990-122624104
  hypo
gcagcacggctctcacggggagtggttcccgcctggtcactccccaccctgccaccgctctgcctctgagtaaacggtcggcacatgtgttgggttgaccgtggcattggggca

SEQ ID NO: 74014 - DNA, 30 bp, Homo sapiens
  chr12:122643546-122643576
  hypo
ggccaaatatagagacgacccaagtgtact

SEQ ID NO: 74015 - DNA, 33 bp, Homo sapiens
  chr12:122658513-122658546
  hypo
cagaaagagcacagacgtcgaggggcctggaga

SEQ ID NO: 74016 - DNA, 163 bp, Homo sapiens
  chr12:122667736-122667899
  hyper
gggcctgggactcagcggcccgggaccgggaccgtgagcgcggccgtgcgcgagcacttgcggaagctgtgtctgcgcgagttcccgtgcggtgccggcagctgggtgcgggcgccggggccggaactctgggggcctggaccggctgcggggaggcacgggc

SEQ ID NO: 74017 - DNA, 573 bp, Homo sapiens
  chr12:122688648-122689221
  hyper
cggcccgggggtccccgcagagtgggtctctgctgccgtcagcccttcggagactgtcgcgttgaaagaatgaaccagagttcgccccctgcccgcgccagggcgttttgggtcaccgagtcctgtggggatccgaggcggctgccgcccaaggccgagcgcagcctcaggacccgcgccccaccagacggggtcgtgcgctccgcggcgggtggagagccgggctctggggtctccgcggctcggagggcggcggggcgaggccgtgcggccagcgcctggggacgcccgcggcgggacaggggccacccgggccgcggcgcagcctgggctgaaacctcctgggacggaaccaagccacctgctgtgcgcccttctcggtgaatggcaccgccgcccgcccgggcctctcgtccacagcccgcggtgctcgcacacctgagactcatctcgcttcgaccccgccgccgccgccgcccggcatcctgagcacggagacagtctccagctgccgttcatgcttcctccccagccttccgcagcccaccagggaaggggcggtaggagtggcct

SEQ ID NO: 74018 - DNA, 42 bp, Homo sapiens
  chr12:122691182-122691224
  hypo
ggtcacgtggagcgacgtgcggctatccgcagcacgtggggc

SEQ ID NO: 74019 - DNA, 30 bp, Homo sapiens
  chr12:122958549-122958579
  hypo
cgctgtttacgctctcggcctgctcaagag

SEQ ID NO: 74020 - DNA, 180 bp, Homo sapiens
  chr12:123128959-123129139
  hypo
gtcgggcggcttcttcgcagcccgggctctcctccgactgcccaggccaaactccgcctcattcccccagtcaatggcctgatggcctgtaggcatgccagtgtctgactatgtgctcttccgccagcgtgctaccctcgatgtcctctcgatgtccagccacctgtgtctgcctgctag

SEQ ID NO: 74021 - DNA, 29 bp, Homo sapiens
  chr12:123233817-123233846
  hypo
tcagccaccgcgcccgccctattactatt

SEQ ID NO: 74022 - DNA, 171 bp, Homo sapiens
  chr12:123333222-123333393
  hypo
ccctgttcctgtccccgtagctccgggctgttcctcccgcctcgggtggggagtgcgtgtctcagggccctgccacacggtcctggacactcccccactcccgtattccctgcgctgcaggtgctgcatgactgccagcggtaccgcagcaacatccgggagattggagac

SEQ ID NO: 74023 - DNA, 16 bp, Homo sapiens
  chr12:123373979-123373995
  hypo
cagtttcaggccgggc

SEQ ID NO: 74024 - DNA, 30 bp, Homo sapiens
  chr12:123428902-123428932
  hypo
ttctctctggatccccggacacactggcct

SEQ ID NO: 74025 - DNA, 216 bp, Homo sapiens
  chr12:123436083-123436299
  hypo
ttgaatgagatgactcgtccaggccacatggcaatcagtggctgattgacgccaaagttgatttcattcttctcaatgggttcagagtccaaattctggaacctcagaagacgttgctattctggttccaagcaatgctggaaattgccaccccacccctcctggtggggcacttgacaccttgctgggtgctttcttacccgcttgccttactgt

SEQ ID NO: 74026 - DNA, 30 bp, Homo sapiens
  chr12:123636606-123636636
  hypo
ccctgaccatgaccacgcagaggaggacca

SEQ ID NO: 74027 - DNA, 123 bp, Homo sapiens
  chr12:123753196-123753319
  hyper
gagcctcagtttccacgcctcccacgtggggatgatgagacacatgcggatgatgagacacgtgcgctataggggcgggttgcttgggagggggacgcacaacgcccacgatatctggcacgt

SEQ ID NO: 74028 - DNA, 38 bp, Homo sapiens; identical to SEQ ID NO: 43619
  chr12:123881693-123881731
  hypo

SEQ ID NO: 74029 - DNA, 214 bp, Homo sapiens
  chr12:123920513-123920727
  hyper
aaaagaaaaaagagaaaagagaagagaaaagaaaaggaaggcgtctccctgccagtaggtgccctcctacgccccgcaggcgccgtgggcccggaaccctcgctcccacactcacctccccgctggccggagggctctgtctccgcagcccctccacctccttcctgaggtggtccctctccatcttcagctcctccagcgccaggctgccctc

SEQ ID NO: 74030 - DNA, 34 bp, Homo sapiens
  chr12:123921841-123921875
  hypo
ggaagcactcacatacgtgactgcaatccttcat

SEQ ID NO: 74031 - DNA, 30 bp, Homo sapiens
  chr12:12397276-12397306
  hypo
ttagaaacttcaatccgattagtttcagaa

SEQ ID NO: 74032 - DNA, 84 bp, Homo sapiens
  chr12:123998069-123998153
  hypo
ctcctatcccagcttcggcctcttagttgctttcccttcaggcctcggtgctctcgagaggcctgtgcacgcttcatcgatgtg

SEQ ID NO: 74033 - DNA, 30 bp, Homo sapiens
  chr12:124092980-124093010
  hypo
agcccaggtttggtccgggagctggagttt

SEQ ID NO: 74034 - DNA, 38 bp, Homo sapiens
  chr12:124117199-124117237
  hypo
aaagctactggtggccgggcgcggtggctcacgcctgt

SEQ ID NO: 74035 - DNA, 30 bp, Homo sapiens
  chr12:124152701-124152731
  hypo
ttcaagtgccccgtccgacccttcactggg

SEQ ID NO: 74036 - DNA, 30 bp, Homo sapiens
  chr12:12419446-12419476
  hyper
cgcagcccctgctcccgggcccctttctct

SEQ ID NO: 74037 - DNA, 78 bp, Homo sapiens
  chr12:124195871-124195949
  hypo
ctgtggtggccaggccgggcgggaaggggagactgcaactgagcaggaggagtcttgcgaggtcggtgggaaatgttt

SEQ ID NO: 74038 - DNA, 30 bp, Homo sapiens; identical to SEQ ID NO: 43621
  chr12:124284067-124284097
  hypo

SEQ ID NO: 74039 - DNA, 30 bp, Homo sapiens
  chr12:124285872-124285902
  hypo
cataggaacgttaaacgatgcggagtctgt

SEQ ID NO: 74040 - DNA, 30 bp, Homo sapiens
  chr12:124323044-124323074
  hypo
tgtgaagccccaaaccgcctcagtgaccta

SEQ ID NO: 74041 - DNA, 44 bp, Homo sapiens
  chr12:124393560-124393604
  hypo
ttttaatgctgcccccgcaccattccaggcgcctggtctggaac

SEQ ID NO: 74042 - DNA, 30 bp, Homo sapiens; identical to SEQ ID NO: 43623
  chr12:124397588-124397618
  hypo

SEQ ID NO: 74043 - DNA, 92 bp, Homo sapiens; identical to SEQ ID NO: 43624
  chr12:124404180-124404272
  hypo

SEQ ID NO: 74044 - DNA, 30 bp, Homo sapiens
  chr12:124566628-124566658
  hypo
tatacttggctctgtcgatggaagctttct

SEQ ID NO: 74045 - DNA, 78 bp, Homo sapiens
  chr12:124651773-124651851
  hypo
gccgcctcccccactcgggtctgtttttcagccgtggctccggcagtgggtctgattttatcccgcaaagtgatgtcc

SEQ ID NO: 74046 - DNA, 207 bp, Homo sapiens; identical to SEQ ID NO: 43626
  chr12:124716795-124717002
  hypo

SEQ ID NO: 74047 - DNA, 30 bp, Homo sapiens
  chr12:124723968-124723998
  hypo
tcctaccaaatgttgcgttggaaaatcaaa

SEQ ID NO: 74048 - DNA, 169 bp, Homo sapiens
  chr12:124726523-124726692
  hypo
tgagagcagcagggacggacggcagggagccgcgactcgatccgccgtaaggggtactgtgagcatacattattttcctctgcctggtcaaaacaaagacaaatgcaaattacaagaacattgcagacaacaaaagaaaaatcccggaatccctcgtctctagaagttt

SEQ ID NO: 74049 - DNA, 283 bp, Homo sapiens
  chr12:124778114-124778397
  hypo
gaagcaaatggaatccgtagtcccattgtttttttcccagaatgttccaaatattcaaacctctggttagttgggtctgtttgggcagcagacttccagcgttctttcctgggcgacatggaaatgggctgtaaattcacctggtgacaggtgcatgcctgtcaccctgtgggctctcaggaagcggccccaccctctgtcagtgtccggcatgcaccttactcctgctgctgcagggcctgcgccctgctgttccctccacatggtgcgctaattctcactg

SEQ ID NO: 74050 - DNA, 88 bp, Homo sapiens
  chr12:124779505-124779593
  hyper
cgcagtgcccaggagcgggagggcctcggcggaggcgccgggccggggctgttgcccaccgcgcaggccggggcggggagaggaaggg

SEQ ID NO: 74051 - DNA, 36 bp, Homo sapiens
  chr12:124780202-124780238
  hyper
ccaaacgggggaccgcgtgggcgggtgggtgagggc

SEQ ID NO: 74052 - DNA, 143 bp, Homo sapiens
  chr12:124780828-124780971
  hyper
gggaggctggaacctcgggtcaggaaactcaggagtttgtctcctgccagactaagtccagcctgggggtggactccggtggggacccagcttggcgccttgcctgagactgggcaccccccggcaggcggggaagcatatgg

SEQ ID NO: 74053 - DNA, 30 bp, Homo sapiens; identical to SEQ ID NO: 43628
  chr12:124782655-124782685
  hypo

SEQ ID NO: 74054 - DNA, 223 bp, Homo sapiens; identical to SEQ ID NO: 43629
  chr12:124788775-124788998
  hypo

SEQ ID NO: 74055 - DNA, 52 bp, Homo sapiens
  chr12:124799068-124799120
  hypo
tgacggggctggggccggcccggggtgctggaggagccgggagccctgggga

SEQ ID NO: 74056 - DNA, 30 bp, Homo sapiens
  chr12:124832960-124832990
  hypo
cttccatgctggccccgtcacaaagcctca

SEQ ID NO: 74057 - DNA, 33 bp, Homo sapiens; identical to SEQ ID NO: 43630
  chr12:124843830-124843863
  hypo

SEQ ID NO: 74058 - DNA, 276 bp, Homo sapiens
  chr12:124869876-124870152
  hypo
ggcaggggagccactcgctcaggacccatttgcctccgggtcctcattccaacgcgctgacagcccgaattcctggctgagtcagtctggtccaccgcgctccttcccccacaccgtgagacagggctgagggcccccagaggtgtctgtctgagaggagtggggtgcagggtgggggtggagggcagcctggcccggcccgtctccaaggcagggacactcatagcagcattgccgcctgcagccatctcggggtactcccgggcttgaaccccc

SEQ ID NO: 74059 - DNA, 239 bp, Homo sapiens
  chr12:124880121-124880360
  hypo
acacgggctcctctccgccggtgagtcatccccagccgtcctcccagcctccggatctgcccttccagaaggcaaacagagggcaggcactgtcttcccagttctcaggcaatgggcggtgggggcgggggtggtcaccggtgaggaggtggtagtgacaacacgagacacgagaagggatggagaggcggtgggaccctgggctgaccgtttggggatgtccacgcggagtcctccga

SEQ ID NO: 74060 - DNA, 108 bp, Homo sapiens
  chr12:124890812-124890920
  hypo
tggcctgtgggctttcgttagagcactctgctccaggccagtgttacccacacctgcaggtgcacacacatcccctgccaattcccactcagtcggtctggggtgggg

SEQ ID NO: 74061 - DNA, 168 bp, Homo sapiens
  chr12:124893402-124893570
  hypo
cgtggaggtgacttccgccaactccatgcacagggtgagaacaggataagacagcctggtgctaggggcatctttccccagttccaagtcagcggcagcacgttgtcacgtggcactgggcacggtgagaggatttatttacaccatggcaaccggcacatgctacaa

SEQ ID NO: 74062 - DNA, 30 bp, Homo sapiens
  chr12:124985749-124985779
  hypo
cccagcctggccctgcgaagacaggcaggc

SEQ ID NO: 74063 - DNA, 165 bp, Homo sapiens
  chr12:124989245-124989410
  hypo
ccacgcaaaggtaagcgctgactcagccacaacgcaggtgagccctgaagacatggcacaaaaggcaaagaagccgctcagaaaggccacgcactgcatgattccattaacttcacaggaggggcagattcccaggacagaacaaaggcccgaggctgccagggg

SEQ ID NO: 74064 - DNA, 30 bp, Homo sapiens
  chr12:125001347-125001377
  hypo
cctcagaccaggtgccggtattgtcagcat

SEQ ID NO: 74065 - DNA, 54 bp, Homo sapiens; identical to SEQ ID NO: 15714
  chr12:125009346-125009400
  hypo

SEQ ID NO: 74066 - DNA, 40 bp, Homo sapiens
  chr12:125027278-125027318
  hypo
cctcccagggccggccggggtccaccggatacatcttccc

SEQ ID NO: 74067 - DNA, 45 bp, Homo sapiens
  chr12:12504479-12504524
  hypo
tagaaacttcgtattcggtgctttaatacaatgaacctgtttctt

SEQ ID NO: 74068 - DNA, 51 bp, Homo sapiens
  chr12:125062836-125062887
  hypo
ggaagaaaaattccacgcatgtccccgcgagcccttcgaagctcttcgtgg

SEQ ID NO: 74069 - DNA, 30 bp, Homo sapiens
  chr12:125091024-125091054
  hypo
taaatccagtatgaccggtgcccttataaa

SEQ ID NO: 74070 - DNA, 84 bp, Homo sapiens
  chr12:125092412-125092496
  hypo
tactgcagcaaaagccgaaagccaagctccgtgtccatcgcgaaggcactgggcatgtggctatgcagccgtgacaaaggatga

SEQ ID NO: 74071 - DNA, 493 bp, Homo sapiens
  chr12:125102096-125102589
  hypo
cctctcccaacccagcgctgtcttggggaacagggtgaagctcaggaggagccccccaaccccggcgtgcccccattttgcctcctcagaaggccctgcagctggcctttcctgggaggcgcagagcccacagagcccaactctggtggcagaattagcctgtcctcgggctgcgctggctccagtcccagtgaggtggtgactgtcactctccataggagaggacgcctctcgccatggcaacggggacgtcaccagggacgtgtttgccggagcacaaaagagggtgtcggggaaacacccgcactctggcggcagaaacacagtgcacggcctcactccccatctggggatggctgctgggaggtgaccgagcctccctaggcagccggggccctcctcagccctcgtgcttgccttccaaagagctgtggctgttttctccgctcccctgcggtggagaaggaagagggcacatcgctggaggcatctt

SEQ ID NO: 74072 - DNA, 65 bp, Homo sapiens; identical to SEQ ID NO: 43638
  chr12:125102819-125102884
  hypo

SEQ ID NO: 74073 - DNA, 58 bp, Homo sapiens; identical to SEQ ID NO: 43639
  chr12:125119323-125119381
  hypo

SEQ ID NO: 74074 - DNA, 232 bp, Homo sapiens
  chr12:125122425-125122657
  hypo
gccaccccagggggacgctggcacccgaggtaggctgtggcaggctcactcctgtgcagcaagagctggcctccgggaaaccggggggagtctccggagcatgtacaggagacctgccccgcccagcacacacgctccttcactcccaggtcagcatcctggggcctccgtgtccttgtctggaccatgggtgtaaagaagccacatttcatcacaacgaagccagcaccga

SEQ ID NO: 74075 - DNA, 146 bp, Homo sapiens; identical to SEQ ID NO: 43640
  chr12:125152108-125152254
  hypo

SEQ ID NO: 74076 - DNA, 85 bp, Homo sapiens
  chr12:125167660-125167745
  hypo
caattttaacaactgcgtagaactcacaactgcctccaatcctcatgttcatttatttatctacctgccacgtcctgagtgtcta

SEQ ID NO: 74077 - DNA, 30 bp, Homo sapiens
  chr12:125184551-125184581
  hypo
gtccttttcacttagcgttccacttgtgtc

SEQ ID NO: 74078 - DNA, 30 bp, Homo sapiens; identical to SEQ ID NO: 43642
  chr12:125200849-125200879
  hypo

SEQ ID NO: 74079 - DNA, 30 bp, Homo sapiens
  chr12:125336074-125336104
  hypo
aagcagaatggacctcggtctcctgactca

SEQ ID NO: 74080 - DNA, 485 bp, Homo sapiens
  chr12:125533937-125534422
  hyper
ctaggggctcatctgcgtatttgaatacgcatacggaagaataaacatcccccaggtacttcaggcacaaccctcctttggcagcgcagaagtcaagctagaggtcgtgaccccctggagtctcggtggtttcgggttggggagcagagcgggtggggcaggaccgactcgccggtgccagtcaggatatcaaggtgacagcgcccggcactggccttggtcgaagggtgactccgccccattgctaagctccgattgggcacgcccttttctggttcttcttcaggattggctgggaggtgcggcctatgaaccggaacgcgtcgcgattggttggcgctcaggccgatcttccagacgcggaggcctgggccgatgtggcccaactctctgccagccaatcagcgctcgggctgagtgtggcgcgtgagtgtgtccgggatccctccgccgcccgggcgttggggtcgcgggaagggagggga

SEQ ID NO: 74081 - DNA, 191 bp, Homo sapiens
  chr12:125565948-125566139
  hypo
aagggcctaagcagccgattattggctcgggggctttaagatcattgtgcttcgttttctgcatgtttttcctgacttgttccttacccagctgggtgcaggtgctcacggagctctgctccatgctcactcaggcgttctcagcaaaactcatctctcctatgggtaatccccgtcgaggccatgcgatg

SEQ ID NO: 74082 - DNA, 159 bp, Homo sapiens
  chr12:125578406-125578565
  hypo
tggcagggagtctgtcggcatttggtggcttcgtggcaggcattattgggcagcactcctggccgtgtgcacccagcgtgggagggcctgcgtggatgccatgttcatagcgcttggtcccacagacacctggacacccgctgtcggagctgagtaagg

SEQ ID NO: 74083 - DNA, 98 bp, Homo sapiens
  chr12:125609670-125609768
  hypo
gctgggcagccaatacgcacagtcccttctcatgatctgaggcagtgatgttccacgaagtcactgtgaacacggaacccatacggaacccttgctcc

SEQ ID NO: 74084 - DNA, 159 bp, Homo sapiens; identical to SEQ ID NO: 34733
  chr12:125670102-125670261
  hyper

SEQ ID NO: 74085 - DNA, 111 bp, Homo sapiens; identical to SEQ ID NO: 34734
  chr12:125670334-125670445
  hyper

SEQ ID NO: 74086 - DNA, 551 bp, Homo sapiens
  chr12:125671499-125672050
  hyper
gcagcgcgcatctcccggacttggacagacctggggagaccctgggaacccaggagcccccggcgcgttcccctttgcctagcgcctggggagagcccgcctgccttctcccccaaacccttagcttccttgcggatcctttcgggacgcacgggggccacagaccggggcactcagcctctcgaggcgggtggggacgcgactgcaggaatcgagccccctccccgccctgccttgggccaaatcccccccaggtcccagttcctccaggggttttgctgggcgggggcgtcgacgcagcccttctccagtgtcttgctgcccgcggtcgcacagtggtgcgttcccgggacacctgcgggccccggagatgtctcggccggcgctgtctggcttgtccgcagcccctccccacgccccgcggccctcccctgctttcacactgccctccccaagctacccaccctcgccaaatggcctcctcttggccaaagagcagcccgctgcgcgcctcctgcaaacgcggtctactccagcgccctgaccccaag

SEQ ID NO: 74087 - DNA, 268 bp, Homo sapiens; identical to SEQ ID NO: 34736
  chr12:125672764-125673032
  hyper

SEQ ID NO: 74088 - DNA, 199 bp, Homo sapiens
  chr12:125812590-125812789
  hypo
ttggggctgggccatcgcattcatttccctgtcttggcctttcctgcttttagtccattctccgtaatagcagagtgatgtcttaaccgtgttatatcaagtggtgccatgaacctgggacctcagtcactcaggtggcttcccattaccctgggataaagtccaaacacaatgcagtggcctccgccagccctgaagg

SEQ ID NO: 74089 - DNA, 186 bp, Homo sapiens; identical to SEQ ID NO: 43645
  chr12:125813536-125813722
  hypo

SEQ ID NO: 74090 - DNA, 161 bp, Homo sapiens
  chr12:125977237-125977398
  hypo
ctgggctcaggagggcgcacccttgggagggtctgtcctgtgaagaaacctgcatgttgtccactcagccactcagccacgcccgcagatctcacttggctccaaaatgggctgggccctgtgtcaggctccagggatagacacagcgccaaccaaaggct

SEQ ID NO: 74091 - DNA, 4 bp, Homo sapiens
  chr12:126018151-126018155
  hyper
gggc

SEQ ID NO: 74092 - DNA, 109 bp, Homo sapiens
  chr12:126018156-126018265
  hyper
atggtcctggcgcacccgctagatggcgccgcagaccggcttgtacaggccgcgcgccctcccctccccggcggaggctcctggagcccctgcccggcctgactggctg

SEQ ID NO: 74093 - DNA, 246 bp, Homo sapiens
  chr12:126168425-126168671
  hyper
ctgcacaggtggccccgcgcctctcacacaggttcagctcccgccggtccctgtgcagagcgccccctgccggtccctcttggaggctgggccagcgttgcgagtcttgccagggacgcgcgctctagcgccggaggctgggaacgcaccgcggtgccaccgcgtcctgcaggggcggggcgcgcacctggggatgcacctgtcctagaccccctgcgcctattcctcgcccgccccatccttccc

SEQ ID NO: 74094 - DNA, 29 bp, Homo sapiens
  chr12:126243099-126243128
  hypo
tgagccaccgcgcccggctgatgattgtg

SEQ ID NO: 74095 - DNA, 45 bp, Homo sapiens
  chr12:126288373-126288418
  hypo
ttacctgagagtggccgggcgctgtggctcacgcctgtaatccca

SEQ ID NO: 74096 - DNA, 280 bp, Homo sapiens
  chr12:126675639-126675919
  hyper
aactctccagagctgcgccgcagacggcgaaaaccagaggtggttacagtcaagtttagggactgcaggagcgaattcccgaaggcttgcaggagccgcccggctctgcctccagcctttctctctgggcctagcgggactctcccaggcaggcccctccctgcccgcgggcgcactttccccgcctgcatctgaggcgtggcgcagctgggagcaaagcacaggtgggctgggcgcggtttggggttcgggcgtggcagagtggcggcggggtctgggg

SEQ ID NO: 74097 - DNA, 139 bp, Homo sapiens
  chr12:127051874-127052013
  hypo
cagtgggctcctgcacggcctgagccttcccgaagggagccgcccctgctccccggcacctgctcccatcatccacccaagggctgaggagtgcaagtaggcagcgtgggactggtaggcagctccgcccacggccctg

SEQ ID NO: 74098 - DNA, 69 bp, Homo sapiens
  chr12:127211316-127211385
  hyper
cgggcagtggcgggagctggagccgcggtggagacgactcgaggggacgcagcccgcctggcacaaagg

SEQ ID NO: 74099 - DNA, 60 bp, Homo sapiens
  chr12:127212512-127212572
  hyper
acttaccgtaaggtgcggggtcttcttaggtctctgctctcaatgcggagagctctacct

SEQ ID NO: 74100 - DNA, 30 bp, Homo sapiens
  chr12:127519655-127519685
  hypo
acaaggtggtgtatacgcactttctcctac

SEQ ID NO: 74101 - DNA, 387 bp, Homo sapiens
  chr12:127765141-127765528
  hyper
agtgaggtcctgccacgccctgctgagttctacgtgcttgcgcgcttcttcctcgggagagcttccactgatttaattggatatggggatggagagaggaaacagaaacagggaaagaagtgaaaaagggaaggacggggcgcgcgcggcaggggggcaggcggcctggtgcaggtgcatccccaggtgcgcgccacgcccctgcgggacccggcggcaccgcggtgcgttcccagccgccggcgctagagggcgtgtctgcggaaagactcgctgcgctggcccaggctccacgaggggccgacagggggcgctctgcacagggaccggagggagcgggagccgaacttgcgtgagaggcgcggggccacccgtgcaggtgtaggt

SEQ ID NO: 74102 - DNA, 33 bp, Homo sapiens
  chr12:127865670-127865703
  hyper
ggaaggcctggaaatcgcaggtcctgaggacgc

SEQ ID NO: 74103 - DNA, 158 bp, Homo sapiens
  chr12:127865704-127865862
  hyper
gcgagttcacggagaggacctgccgggcaggggctctgggagcctccgcggggaggggagggcgcgcggccggcgcggccacaacccggtctgcggcgccatctagcgggcgcgccgggaccgtcgcccactaggcccttttccggaggagaagctga

SEQ ID NO: 74104 - DNA, 165 bp, Homo sapiens
  chr12:127939926-127940091
  hyper
gtgctgccccccccccgccccgcagggcctcgggagggtgaaggggccgactgggtctctgctccctgggaatctggccggaattccacagggctgcagggcccgccgcccagcgccaagaaagcgggtggccacatcgaagtttctcaacgggaggagcggatt

SEQ ID NO: 74105 - DNA, 37 bp, Homo sapiens
  chr12:127940356-127940393
  hyper
ccggggccggaaaggcgaggcggggctggggctgggg

SEQ ID NO: 74106 - DNA, 89 bp, Homo sapiens
  chr12:127940454-127940543
  hyper
cgggcggatcagcggcacccgctgcagacgcggtcggcgaaacgtcgtcccggccccagctcgagcagcggctccgggtggacctcgca

SEQ ID NO: 74107 - DNA, 30 bp, Homo sapiens
  chr12:128142127-128142157
  hypo
tttgatctgtgttgtcgcccaaatctcatg

SEQ ID NO: 74108 - DNA, 30 bp, Homo sapiens
  chr12:128245440-128245470
  hypo
tccaactcctcgagacggtctccaggtagc

SEQ ID NO: 74109 - DNA, 81 bp, Homo sapiens
  chr12:128310374-128310455
  hypo
taaaagggtccaaagcgatctgagttttccccttcctgccaagtgaggaaacagcacggagacaaccggtgaatgaggaag

SEQ ID NO: 74110 - DNA, 28 bp, Homo sapiens
  chr12:128310875-128310903
  hypo
cttcaggaaggaagccgggaccctcgcg

SEQ ID NO: 74111 - DNA, 28 bp, Homo sapiens
  chr12:128311023-128311051
  hypo
ccttcgcagtgaacgttacagctcttaa

SEQ ID NO: 74112 - DNA, 215 bp, Homo sapiens
  chr12:12848341-12848556
  hypo
gccaggaggctccatcggaaggaggcagacacttcaggtgttgggtggtacctttaagatgttgcggggccaaatccaatgccggtgcaggtgtcccatatatcctgagagacaaaaagaggtcagattggtcagatccctcgagacagttcccaaattcctgacttctgttaccgcgactgttcttcgcaattccacctcggcctgtgttcagg

SEQ ID NO: 74113 - DNA, 224 bp, Homo sapiens
  chr12:12869188-12869412
  hyper
tctggagtttgaccccgaggggagtattttcacccttcagccctctgaaagcattcactagcatctgaatattgttctgagtttgttggagcagtgaaatctggtgagagagaagggtggaggaaggaaggagctgttgtatttggcggctggactcaggtagaggaaactgctacaatcccgggaaagaacagaaaagtagaaagggacgagttcccacacgc

SEQ ID NO: 74114 - DNA, 760 bp, Homo sapiens
  chr12:128751118-128751878
  hyper
catctgtcttgagcccgcaccccgccttcacgctccgctgcgcgctgcttttccgcgctcagtgatccagttaggagctctccccgcagcagctgcgcgggactttgcattccagatgtccccagccctccaggctaaagcagcggccacctgaagttgaggaatggggcgtgacgaccaccaggtcccgcagtgaccacgggagggtggggagaaggagtccagctccgccttgagcgtcgggtccctgggcaggaccctccgggccacgggccgctgtccgttgggcacccgggcaggagtctgcgaacgctgagtttctctggaaaggcgcggacccccggaggagccgtcccagccgcctggggagacgccccctcctctcccggtcttctttcccgggcacaccctccctagcccgggcgggggggttctccatctgccgcccctcccggcgggcaggcgaactctctcctaccgcaccctcaatctgtccgcggtcgcggggctcggcgggggcggggcccgggcgggggcgggggcggggccgggggcggggcgggccggcggctgcggaggctgcggaggctgcgggagaaaagttgtcccggccggagcgcgagcagcggcggagccggagccgccagagccagagccggagctgcggcggcgtggacccggcaggggcgggcctcggacagcagagacgcagcgggcccggccgaccgggctgcgggagtggccccgggcatggggcggc

SEQ ID NO: 74115 - DNA, 1126 bp, Homo sapiens
  chr12:128752114-128753240
  hyper
cgaggggtgcggcgggggcctcggcgggggctcggatcccatcaacagcgcctctgcgggtgccgagccgcccctaatccagaagggcgctcccagctgggcgccgggatccgggcaagttaggctggtcccgagtcccgaatctcccaccccggaccccccagacccagagctgccccgcggatgaggagggggcgtggctgagggacacggtgtttgttccccatccctgagttccgtgcggacctgccccagccccagcacagtcaccctgtggaactggcatccaggagaggtgctccgctctgtgcgctccttcctcccggctgtgtgctccctgtccacagctccccatccacagcttcggcactgtggggctggtgctccaggagggaaggcccggttctttgcatcccctttccgcaaccgctagggtctctgtgcgggccctagaggaacgctcactcatcgcgcagctcaccagggaccccagcttggcagaaaccaggggctctctgcgggttctctcaaatgagtcctttgcggtgggggagcgcggatggggaggtgggtgcgtccctcgcgacgggaactacctcaccagcggtcctgtccggggctccttcacctcagtgtcctcttctctacaatgggagtgacggccctgctttgggttggaggaatttaaaggagttaacgtatggcgcccgcagggctcacgaaaggtagccgtgtggtttttccgaccttttttattatgtgcgtgtgcggccgagtggccgcgcggatgcggcggcgggaagggcggggagaggcggtctccagccccaggagccgcggggcaggcggggagcaaggcctaggctctgccagggcagcagctgcccgagtcccggggcgcgcccagggcgtagaaaaaggagagcgtcgctttcctgctccccgcgccctggcgaaggtctcgggttcatttggttaaacggaggtgcgcacatgggtgccctgagccttcgcgcggcgccgcgggtccagtatcggccccaggctctgagcagagaacactcaaagccacccttctcccgcctaatgctctgaggctgagctagaaatgcgttcagagagacaa

SEQ ID NO: 74116 - DNA, 96 bp, Homo sapiens
  chr12:128850534-128850630
  hyper
aaactcagctggatccgcgggccgtgattaaacacattgcccgctttgttgccgagatggtgtttcggaaggcgctgtgaatgcacttccctttgc

SEQ ID NO: 74117 - DNA, 137 bp, Homo sapiens
  chr12:128850631-128850768
  hyper
gggctcacacagacaagatgtgtgttgcaaggatgaggcgcctgctcggcctccagcccagggccgggaagggagaaggtgctgtgcgtcgctgcctgtgtcgcccgcggctctcctcccagcgacagactccagac

SEQ ID NO: 74118 - DNA, 166 bp, Homo sapiens; identical to SEQ ID NO: 43651
  chr12:128899701-128899867
  hypo

SEQ ID NO: 74119 - DNA, 91 bp, Homo sapiens
  chr12:128944040-128944131
  hypo
agatagagcatgactcggaagtctctctcctggatgatagtggtgtcattggtgaaaataagaaaaacagacagaagaccaagttttgagg

SEQ ID NO: 74120 - DNA, 193 bp, Homo sapiens; identical to SEQ ID NO: 43652
  chr12:128964823-128965016
  hypo

SEQ ID NO: 74121 - DNA, 30 bp, Homo sapiens; identical to SEQ ID NO: 43653
  chr12:129028675-129028705
  hypo

SEQ ID NO: 74122 - DNA, 30 bp, Homo sapiens
  chr12:129189879-129189909
  hypo
tgtgggcgtcggcaacgtcagggtcaagtt

SEQ ID NO: 74123 - DNA, 30 bp, Homo sapiens
  chr12:129190114-129190144
  hypo
gtggtgaagaacagtcgggcagacgggggc

SEQ ID NO: 74124 - DNA, 105 bp, Homo sapiens
  chr12:129337805-129337910
  hyper
gatggtcctggtccccgtggaagggactgtggtcaccgctggtcctggtccaggtggaaacagaccgcggctaccctggtgatggaccccacggggcacacccgc

SEQ ID NO: 74125 - DNA, 239 bp, Homo sapiens; identical to SEQ ID NO: 1076
  chr12:129338587-129338826
  hyper

SEQ ID NO: 74126 - DNA, 68 bp, Homo sapiens
  chr12:129338851-129338919
  hyper
cgctcggcctgtattagccggataaacatattccttgaggcgaagcctgggaagtgccaggattagag

SEQ ID NO: 74127 - DNA, 30 bp, Homo sapiens; identical to SEQ ID NO: 43654
  chr12:129441934-129441964
  hypo

SEQ ID NO: 74128 - DNA, 120 bp, Homo sapiens
  chr12:129520236-129520356
  hypo
aactgtctgtggagctgcattgagtgctgctgggagaggcagtgttcccagattttactctgaaatcgagagtgaaggaaagcacttgcacagtcaaaaaaatggaagtatggccgggcg

SEQ ID NO: 74129 - DNA, 77 bp, Homo sapiens
  chr12:129615016-129615093
  hypo
cctagtgctaaccaccgtccgcggtctgctgcctgagaggacccacctgccacgttctagaacgttcttgacacttg

SEQ ID NO: 74130 - DNA, 30 bp, Homo sapiens
  chr12:129728999-129729029
  hypo
aacttcttgctcctacggtgcatagacaat

SEQ ID NO: 74131 - DNA, 170 bp, Homo sapiens
  chr12:129821969-129822139
  hypo
atatagatacacacacgcacacacacacacacacacacacacacacacataacgattggctattggcagtcaactttgtggtttcgtttctcactgtcctgattcttggctcctccccttttccccacccagcctgggactcagtgcggcgccggcgccttcccctcccc

SEQ ID NO: 74132 - DNA, 194 bp, Homo sapiens
  chr12:130037653-130037847
  hypo
ccccttttgagactccgagagtgttgcgcgtttgctcccagctgtgtctgagtcactgcttgtggctcatcagtcaggctccctgctggtcgctctcaccactgctgccccgatgcccagctcttcactctgccacagtggcccgtggtccctggctgcgtgagtccatcctggggctacgagactttgcacct

SEQ ID NO: 74133 - DNA, 30 bp, Homo sapiens
  chr12:130184730-130184760
  hypo
gctccagctcggccacgcacagccccaggt

SEQ ID NO: 74134 - DNA, 34 bp, Homo sapiens
  chr12:130195436-130195470
  hypo
tgttcagcctcagtgcgcacgctgcctctcccct

SEQ ID NO: 74135 - DNA, 52 bp, Homo sapiens
  chr12:130216130-130216182
  hypo
gaggggaatgcaacacgttactgaaggtgcagtgggccgatataaggaaatt

SEQ ID NO: 74136 - DNA, 93 bp, Homo sapiens; identical to SEQ ID NO: 43389
  chr12:13025675-13025768
  hypo

SEQ ID NO: 74137 - DNA, 187 bp, Homo sapiens; identical to SEQ ID NO: 43390
  chr12:13030748-13030935
  hypo

SEQ ID NO: 74138 - DNA, 30 bp, Homo sapiens; identical to SEQ ID NO: 43658
  chr12:130308451-130308481
  hypo

SEQ ID NO: 74139 - DNA, 74 bp, Homo sapiens
  chr12:130325114-130325188
  hypo
tatcttttatgtctccgagaaggcacacacagaaagtaaaaagcccagggcgggggctgcgcagcctgccctca

SEQ ID NO: 74140 - DNA, 42 bp, Homo sapiens
  chr12:13035995-13036037
  hypo
caacgtgtttaaggccgggcgcggtggctcatgcctgtaatc

SEQ ID NO: 74141 - DNA, 111 bp, Homo sapiens
  chr12:130387439-130387550
  hyper
tcctcccccgacagccggctcggccctccagaggccacctttcctctcaagggtccccacgccctctccctttacagaaaaggctttcaggaaacagccttcctttccttt

SEQ ID NO: 74142 - DNA, 222 bp, Homo sapiens
  chr12:130387796-130388018
  hyper
cgtcctcacctttggaaaacagggcggccaggctgatgagtaccggcgaccagtggtgccacagcgtccccatctcagacgggcacatcctggagacccggagcgcagatcctccgctccccggcgccgtccaggcgaacaagagaccgtctcagtcccctagaggcccgcagcggggccggtggcgagggagcgcccggctaggggcccgagcagcccggg

SEQ ID NO: 74143 - DNA, 166 bp, Homo sapiens
  chr12:130388269-130388435
  hyper
tcccgggctggctagcgggcgctggcgcaggcggcgccggggtggcggggctgcggagcccgggacgcgggcagaggcggctcggagccccccgggcgggtggccgggctcgctgggcggcccggggctccctggcccgcagcccccatcccaggccggccgctgc

SEQ ID NO: 74144 - DNA, 140 bp, Homo sapiens; identical to SEQ ID NO: 3968
  chr12:130389012-130389152
  hyper

SEQ ID NO: 74145 - DNA, 30 bp, Homo sapiens
  chr12:130414807-130414837
  hypo
tgcccaccctgaccccgggccacttcatgg

SEQ ID NO: 74146 - DNA, 30 bp, Homo sapiens; identical to SEQ ID NO: 34754
  chr12:130498725-130498755
  hyper

SEQ ID NO: 74147 - DNA, 30 bp, Homo sapiens
  chr12:130499052-130499082
  hyper
acacctgggatcccccggcctaagggcaac

SEQ ID NO: 74148 - DNA, 109 bp, Homo sapiens
  chr12:130501672-130501781
  hypo
tttctgtaaagccttcgccaccgccatcgccatcggggatgatctccactccgtccgccctgtcacagtggtgccagatttcagccgccagcttcggttcttacgagcg

SEQ ID NO: 74149 - DNA, 68 bp, Homo sapiens
  chr12:130526820-130526888
  hyper
cacacagatgtgggtcgctgccttcccaacaggctcctgcccggttcacctggggaagcgcagggctg

SEQ ID NO: 74150 - DNA, 199 bp, Homo sapiens
  chr12:130526931-130527130
  hyper
cggcagcttgcagggcccgctgtctccactagggggcggcgtacgcgcgtctctcgaagccgggacccgcgcggggaggctgcactggctggaaacagcgcctgggcgctcccgcggctcccacctcagagatgtccccaggtgccccacgccccccgcgcgagccccgacacgcgagccccaccgcactcctcaaggg

SEQ ID NO: 74151 - DNA, 30 bp, Homo sapiens
  chr12:13054219-13054249
  hypo
cctgggagccacctgcggccactaagatag

SEQ ID NO: 74152 - DNA, 125 bp, Homo sapiens
  chr12:130589202-130589327
  hyper
gagaggaaaatgactcggaaaccctgttgtgagaagcacgttgctatcccggatgaagggccatttcagccctaagctcaaagccggagctccgaccagcactctcaggacgcctgggtgctggc

SEQ ID NO: 74153 - DNA, 130 bp, Homo sapiens
  chr12:130604031-130604161
  hypo
ggagagctgggcacacggctggtgtgtagtagcggctcactgctgggacactgctgtctgctgagggttgctcacttggctgtggttgctgctctcaggcctctcatggagccaccgtgacacacccccc

SEQ ID NO: 74154 - DNA, 620 bp, Homo sapiens
  chr12:130645186-130645806
  hyper
ccccaagtttcttaccgatgtaaaaattgtagggcttgttttaattaaaagccaatactctccgaggaagtggccccctcctgcacggcgtgcagaaagctggtcagtgaggggggttcctggcgggccccatctccttcccgggcgcttcctagggagaccttgccccgtgcgcagcgtccccaccgcgggggcccgtgcagccgccccccacgccgggtggagcgccgccaacgcgggaagccccagcactgcctccaaagatgtccgcacactccaccctgctccctggaactatcctcaaacgggcagggggcaagcgaggccggtggacgcgggactcgctcctctgacctctccccggccccccgggaggtagcgggagattgcacacgcgatcctgcgagtttccgaactttggaagatcgtgacccggagagaccctgggaggagagggccggccacctcctaggggtgctgtttttttaagggtcaacccaggacgctacgggaagcacctggcgcatccttgggaacagtggggcttggcggtgggcgcccaccgcgaacgccctgggcgggggaagggaatggcggggggacgtcgtgtcctaagtgac

SEQ ID NO: 74155 - DNA, 260 bp, Homo sapiens
  chr12:130646084-130646344
  hyper
ataaataaactcagccgccaagaaggcatctccagccctgctggcgcgaggccccggctctgcggcttcggagggggcgggggtcaccgcggtacaaaccaagcccgcacttcccgcggggtgggaggcggtgttcaaagtcccgggacgcttcccgcccctcccccttcccgccttcttagaggagacctcggatgagcggccctaaaatccggattctcgagcccctccccctccccttagctcgtctctttgaaatt

SEQ ID NO: 74156 - DNA, 99 bp, Homo sapiens
  chr12:130646555-130646654
  hyper
ccaaaccccttctcccgccagtccccgaacttcccgtaacctcggcgtcctcggggtgccggggaccatcccggggaccgccgggaaagggggcgccgg

SEQ ID NO: 74157 - DNA, 137 bp, Homo sapiens
  chr12:130646945-130647082
  hyper
gcggcccgggggcggggcctgtcagcgctcggcttttctgcccccctttgcctttttgcgagtcttctcatcccgggacgcaaacctcgaaacagctgccggctggtcccggccgaggccggcgcagggagggagga

SEQ ID NO: 74158 - DNA, 336 bp, Homo sapiens
  chr12:130647573-130647909
  hyper
gggcgacggcaaatgccagcccatcgagatcccgatgtgcaaggacatcggctacaacatgactcgtatgcccaacctgatgggccacgagaaccagcgcgaggcagccatccagttgcacgagttcgcgccgctggtggagtacggctgccacggccacctccgcttcttcctgtgctcgctgtacgcgccgatgtgcaccgagcaggtctctacccccatccccgcctgccgggtcatgtgcgagcaggcccggctcaagtgctccccgattatggagcagttcaacttcaagtggcccgactccctggactgccggaaactccccaacaagaa

SEQ ID NO: 74159 - DNA, 120 bp, Homo sapiens; identical to SEQ ID NO: 1078
  chr12:130647950-130648070
  hyper

SEQ ID NO: 74160 - DNA, 43 bp, Homo sapiens; identical to SEQ ID NO: 34247
  chr12:13069440-13069483
  hyper

SEQ ID NO: 74161 - DNA, 72 bp, Homo sapiens
  chr12:130726962-130727034
  hypo
cctggatatagatgacgatagaagtgacagcgatggaaatgcaggtgtggtgtagaccgagttgtagatatg

SEQ ID NO: 74162 - DNA, 388 bp, Homo sapiens
  chr12:13079623-13080011
  hypo
ccagagcaagtatcccggcgattcttctgcttggacagggttgggacaaggcgtcggccagtcatccacattgtctttttgcagatccactaatcttccatgcaggctccaacagctccttcccggcctgggaacccaaatccgcaggaagaatctcggggtgttgtcttggcttattcattcagagctgtcgtgtgtggttctgcaaacagtactcagatgcgttccctctccccgtagggatcttgctggagatgcccagggttaacagtggaactccatatggagacagaggcatggggggagcttcgctggagatgggacagcctgctccaccgcgaagcctactgaggctctcttcttacgtaccccgcgcaatctcatctcc

SEQ ID NO: 74163 - DNA, 301 bp, Homo sapiens; identical to SEQ ID NO: 5141
  chr12:130821371-130821672
  hypo

SEQ ID NO: 74164 - DNA, 30 bp, Homo sapiens
  chr12:130889105-130889135
  hypo
atgagtcaccgtgcccggccgttggatcta

SEQ ID NO: 74165 - DNA, 153 bp, Homo sapiens
  chr12:130909584-130909737
  hypo
gttacggggctggggcggggtggaggctgaggcagagcacacgcagagccagcgggccgggcaggagccagcgccatgcatccagccaaggagagggcaggtgagatcccggcggcacatcaggccccacagtgcccacggtaccgctgctgt

SEQ ID NO: 74166 - DNA, 30 bp, Homo sapiens
  chr12:130910571-130910601
  hypo
agcgaataaggacatcgaaaacaaaccatc

SEQ ID NO: 74167 - DNA, 177 bp, Homo sapiens
  chr12:130918507-130918684
  hypo
catggccggaggagtcgggggacttgttcacctgtggtctgtaaccagccgggacataaacccaggcctgagagatgccagtccccctctccgggtatggggctgttttgctgtgggagtgggttcagaggatactgtgtgatctgataactgcagcgtcttcgagctcccactatt

SEQ ID NO: 74168 - DNA, 188 bp, Homo sapiens
  chr12:130920592-130920780
  hypo
cacctcaggtggaaacgggctcaacacaacaggagagatgagagcgggttctgggtggggatgcgggcacacgttctggctcccagccccacatctcttcccctagccctgcacggggggcattgctctgcaggtgatttctcaaaaacgcacgtcccgttgtgtgtatcatccggaacatgccctac

SEQ ID NO: 74169 - DNA, 35 bp, Homo sapiens
  chr12:130921348-130921383
  hypo
ggactgaggagccaccgaggcgggagccccagcct

SEQ ID NO: 74170 - DNA, 30 bp, Homo sapiens
  chr12:130941083-130941113
  hypo
aggcttgctgggggccgtggagatgtccag

SEQ ID NO: 74171 - DNA, 30 bp, Homo sapiens
  chr12:130947017-130947047
  hypo
aagggatgggagaaacgggcattcgttggt

SEQ ID NO: 74172 - DNA, 30 bp, Homo sapiens; identical to SEQ ID NO: 43663
  chr12:130947254-130947284
  hypo

SEQ ID NO: 74173 - DNA, 112 bp, Homo sapiens
  chr12:130956148-130956260
  hypo
cgccaggggcctggacggcttattgctctgtgccccatctgacccagctagatgcccagcacttcggccacagggaatctgccctcccttctgtgagcgccatccccccaga

SEQ ID NO: 74174 - DNA, 30 bp, Homo sapiens
  chr12:130968660-130968690
  hypo
tggccggaaggagcccgatgccccccgaag

SEQ ID NO: 74175 - DNA, 251 bp, Homo sapiens
  chr12:131042217-131042468
  hypo
ttattacacagcaatcggtgacaaataggtcacagctatagatgacaaattcagctacctgcggagattgatttttaaaaacatattttaaaatcctcttttttcctgtacttatctgtagacaagagtgtcaccttgttcgatgccccgccttcatctagagacaccaccacagaccctggggtcaaagcgccttgctccaattcctgccccttcccagtgagcagctgtggcttcggcaagttacttac

SEQ ID NO: 74176 - DNA, 237 bp, Homo sapiens
  chr12:131060814-131061051
  hypo
aactacaaacaggaacggagagtttcatgaccatagacatgggcatttgcttccaagagcaatggccctgcatgctttgagaatcgctgtgagctgtgcttctagatcctcagcaggttggcgcatgaccctcagagccctaaacacactacccgtgggcagctggcaggtggccagctgcatgccggcatccaagctgtgcgggctaagtatctcctcccgcgggaagcagatggc

SEQ ID NO: 74177 - DNA, 39 bp, Homo sapiens; identical to SEQ ID NO: 43664
  chr12:131077323-131077362
  hypo

SEQ ID NO: 74178 - DNA, 30 bp, Homo sapiens
  chr12:131088329-131088359
  hypo
acaaacccactgcaccgccagtcctagaaa

SEQ ID NO: 74179 - DNA, 63 bp, Homo sapiens
  chr12:131098650-131098713
  hypo
ctacactttatgtttcggtagcacttcagacttggtaacacagttgcacgtatactatgtgac

SEQ ID NO: 74180 - DNA, 85 bp, Homo sapiens
  chr12:131159445-131159530
  hypo
tccgcaaggttcatccgtgtggtggcgtgtgtcaggcttcattccttttcgcggctgaatcagattccatcgtgtggatggaaca

SEQ ID NO: 74181 - DNA, 30 bp, Homo sapiens; identical to SEQ ID NO: 43665
  chr12:131159790-131159820
  hypo

SEQ ID NO: 74182 - DNA, 254 bp, Homo sapiens
  chr12:131199288-131199542
  hyper
cccccagggaacctccggagccggtcagaccctgcccatcccactgggagcttgggatcatgtctcacaggacaagccaagaccccacagcccagcgggggatgagtctgaagctgattcccggacagcccagcaaggctgggagggagccagggaggggccatgtgcgtgggggaggtggtgattttttagagccttcccccactgttccccttagaaaccgggtgagtgagcctgcacgccagctcccctcc

SEQ ID NO: 74183 - DNA, 77 bp, Homo sapiens
  chr12:131199859-131199936
  hyper
ggccagtgaccaggccgggaggtgaagcagtcctccctccctccggccagccgccaccccgacctcagccagcgtgc

SEQ ID NO: 74184 - DNA, 70 bp, Homo sapiens
  chr12:131199937-131200007
  hyper
ctccccggggacaggagggaggctgcttccaccgaggcctctgctgacagatgtccgggcccccacctgg

SEQ ID NO: 74185 - DNA, 215 bp, Homo sapiens
  chr12:131200331-131200546
  hyper
gtccaggccctgagccgctgctgtctgagaagcctggggcgcactccccaggcgagcggggccgtgtccatcgggtgccaaactttgcctggaggggcctttcttaaaagcctggggtgggggccatgacagagccacagcacccctgcagctgacacccggcacccaggaagaagcccgtcagcccttcccttccgagacgatcctgaattcca

SEQ ID NO: 74186 - DNA, 30 bp, Homo sapiens
  chr12:131201356-131201386
  hyper
ttccctgcaggaggccgggggtctcctgca

SEQ ID NO: 74187 - DNA, 30 bp, Homo sapiens; identical to SEQ ID NO: 43666
  chr12:131229952-131229982
  hypo

SEQ ID NO: 74188 - DNA, 30 bp, Homo sapiens
  chr12:131261499-131261529
  hypo
gtaaatagccagagccgaaatattcacgca

SEQ ID NO: 74189 - DNA, 123 bp, Homo sapiens; identical to SEQ ID NO: 43667
  chr12:131268359-131268482
  hypo

SEQ ID NO: 74190 - DNA, 56 bp, Homo sapiens; identical to SEQ ID NO: 43668
  chr12:131271976-131272032
  hypo

SEQ ID NO: 74191 - DNA, 37 bp, Homo sapiens
  chr12:131272330-131272367
  hypo
cattgtcactctccccgcctgacgaccagccttgtac

SEQ ID NO: 74192 - DNA, 245 bp, Homo sapiens
  chr12:131290735-131290980
  hypo
tctgagggggatgtgcggcgttgggagccgggatgggcctgaggcttcatctgacctgcgagctgacacgctggcctgccagggctccgtgggggccggcagaaggtccaaggccccaggtcagggacaaagggatttcctactcacagcacagcaggcaacctgaggctcatgagcagctgtccacggcccccagtctcatggggagaggcagagcagctgcagtgggacgtcctcacagtggg

SEQ ID NO: 74193 - DNA, 134 bp, Homo sapiens
  chr12:131335189-131335323
  hypo
gtatgtgccatataccgttctatgctctaggaatatagaattgtatagcatatagaatataaaatccgtgccttcacagagcttctattcaagggtggaagtgtgtgtgtattcatgtgcgtgtgtgtgagaat

SEQ ID NO: 74194 - DNA, 166 bp, Homo sapiens; identical to SEQ ID NO: 43670
  chr12:131383570-131383736
  hypo

SEQ ID NO: 74195 - DNA, 30 bp, Homo sapiens; identical to SEQ ID NO: 43671
  chr12:131387248-131387278
  hypo

SEQ ID NO: 74196 - DNA, 44 bp, Homo sapiens
  chr12:131389290-131389334
  hypo
acgggatctgggagccggccgcctgggcacgggctgatccacat

SEQ ID NO: 74197 - DNA, 103 bp, Homo sapiens
  chr12:131400816-131400919
  hyper
ccggcacgcaggacccggccgggctgccgcctctcagaatcgctgtgcaattggcgattgcgacattcatggaataaattccccttcgcgacacatggggacg

SEQ ID NO: 74198 - DNA, 76 bp, Homo sapiens
  chr12:131402548-131402624
  hypo
tggaggtgaggctagcgttggtgggatcctggtaatcccgctaggacaccgggtcatcctccgtcattagatgatg

SEQ ID NO: 74199 - DNA, 179 bp, Homo sapiens
  chr12:131403032-131403211
  hypo
cacccctccctgacccgcgttgcactcgtcaggaacgtggcacaacctcccagtattaattcccaccgcgccctgtggcggggccctggcagacatgtagatttgccagacggccaacgtgattgcatccttcattagctatgaggtggtgcaggaggagccgtcgactccaggggtgg

SEQ ID NO: 74200 - DNA, 30 bp, Homo sapiens
  chr12:131417941-131417971
  hypo
tcggggtgcgggaggcggggagattctcac

SEQ ID NO: 74201 - DNA, 42 bp, Homo sapiens
  chr12:131418388-131418430
  hypo
ccacacggacccgggcgggcaggacctcggatgctgactccc

SEQ ID NO: 74202 - DNA, 310 bp, Homo sapiens
  chr12:131433135-131433445
  hypo
ggagacaacaaaccccggggatttccccagacaaacgatgctgcttcattgggactaacttacgcgagtgtctcgttcttggttctctgagagcagagcccagtgccaacactcacgtgtgagcagtgctttagagtgtgagtccagggggccaaagtgggggacgggggcaacagacacagaagtggggaagcggcaatgcagggaaatgctaccgtgttgcaaccatgatggttggagggagaaaagcgggtttgtccactggatcctgcacttcatgggctcgagtacctcacgtttctgggtgctt

SEQ ID NO: 74203 - DNA, 30 bp, Homo sapiens
  chr12:131434432-131434462
  hypo
ctttcacagtgaattcgcccccaggcttct

SEQ ID NO: 74204 - DNA, 30 bp, Homo sapiens
  chr12:131436515-131436545
  hypo
aataaatgaaataaacgtctaagatatgaa

SEQ ID NO: 74205 - DNA, 30 bp, Homo sapiens
  chr12:131438610-131438640
  hyper
cctgactgagacaaacggaggctcttgaaa

SEQ ID NO: 74206 - DNA, 66 bp, Homo sapiens
  chr12:131499103-131499169
  hypo
atgttggggaagaggcgtcgaggtggctctcctagacgtgtggagcgatcacggatcttcctcatt

SEQ ID NO: 74207 - DNA, 53 bp, Homo sapiens; identical to SEQ ID NO: 43675
  chr12:131500873-131500926
  hypo

SEQ ID NO: 74208 - DNA, 248 bp, Homo sapiens
  chr12:131513257-131513505
  hypo
tggtgccgcctttgccgtcagtcacgggaggggcgacgtggctgtttctggactctgctctgtccgtcatcccatttgcatgccggtacgattgcaactgccacgtcctatgccaaggcctgagaccggctcgtgtaaaccctccagcttgttattccaggcggcctcggctatttttggtgagacgcatttaaaaatttgatgcgcgtcgtgaaactgcccttcagaaaggtcgtaaccatttatcc

SEQ ID NO: 74209 - DNA, 56 bp, Homo sapiens
  chr12:131518701-131518757
  hypo
caagtaagatctacacgcccttcttcccctgcccaccctgccgcactctgggccac

SEQ ID NO: 74210 - DNA, 70 bp, Homo sapiens
  chr12:131535487-131535557
  hypo
tgtgtgctgtgtgcccggttcctaacaggccacgggctggtcccggttcacggcccgggtgttgggaacc

SEQ ID NO: 74211 - DNA, 30 bp, Homo sapiens
  chr12:131544833-131544863
  hypo
ggccacactttctcccgtggtatttggagt

SEQ ID NO: 74212 - DNA, 269 bp, Homo sapiens
  chr12:13154515-13154784
  hyper
gcccgacctgagccccgacggtggcgccgaaccggtcgcggtctccgggacgccgcatctgctgagcgggggcccccgaggtgacggccagcccggcgcccacctgggacgcaaccccgggcaatgcctccggccgcggggagcaaatcaagaaagggccgagaaagttgtgatcggctctgtcctgacgctcatctctctgcgatcgcgggcaactgcctggtggtatctccgtgtgcttcgtcaagaagctccgccagccctccaac

SEQ ID NO: 74213 - DNA, 27 bp, Homo sapiens
  chr12:131547329-131547356
  hypo
atacaagggtcacgtggtaaatatatt

SEQ ID NO: 74214 - DNA, 38 bp, Homo sapiens
  chr12:131556190-131556228
  hypo
agggcaacttgtgcacgcactggcgggtcctatgtgtc

SEQ ID NO: 74215 - DNA, 115 bp, Homo sapiens
  chr12:131569132-131569247
  hypo
aaacctcacctactccgtctgccgctgcactcacctcaccaactttgccatcctcatgcaggtggtcccgctggaggtaagagccaggcctcaggggtcgcgggacctgggggac

SEQ ID NO: 74216 - DNA, 30 bp, Homo sapiens
  chr12:131579447-131579477
  hypo
ctcacccgggggaggcgcaggggcatgcgt

SEQ ID NO: 74217 - DNA, 33 bp, Homo sapiens
  chr12:131588532-131588565
  hypo
tcagaaccgagggggcgccgtctggattgtgcg

SEQ ID NO: 74218 - DNA, 119 bp, Homo sapiens
  chr12:131615224-131615343
  hypo
aggggtgcaggtgtgcggaacagcgatgctggcccatcccgtgcgggggaagagcgaggccggcccatcccgtgcggggggagagcgaagctggccatcccgtgcggggccccagtggc

SEQ ID NO: 74219 - DNA, 198 bp, Homo sapiens
  chr12:131619032-131619230
  hypo
tgatcctttcagatacggtttcccgggacctaaagattgtagctgaataatgcatgatattgttgtttcccagaaacaggtgttttatttttattgcattagcattatgagaacaagctggctgcggcttctctgagagctgaagtgctggaacacttctgggttttacaggcaccggttgcccggagctgtcagtgc

SEQ ID NO: 74220 - DNA, 62 bp, Homo sapiens
  chr12:131620158-131620220
  hypo
ttgcacccttccaagcgtctcacaggaggcctgggttctggacgctgcgggggatgctctgc

SEQ ID NO: 74221 - DNA, 171 bp, Homo sapiens
  chr12:131621480-131621651
  hypo
gggctctaatctctgcgtttcttccctttcttcccagggactgttcatattcctctttcattgtctcctgaattcagaggtacgtccgctctgcttgctggcaggtgcaggtgcagctggcttttcctttccgaaaggtcacaggagcaggaacagcgctgccctgtcagg

SEQ ID NO: 74222 - DNA, 73 bp, Homo sapiens
  chr12:131623324-131623397
  hypo
gctgctctagccccacggctacagctgcgccgggtgtgtggcacgctccatgagtcaccgtggaatgaacgca

SEQ ID NO: 74223 - DNA, 30 bp, Homo sapiens; identical to SEQ ID NO: 43683
  chr12:131624881-131624911
  hypo

SEQ ID NO: 74224 - DNA, 53 bp, Homo sapiens
  chr12:131649098-131649151
  hypo
ctcctgagtgaaactcgggaggtcccggaaggagggggcgaggccctcagcag

SEQ ID NO: 74225 - DNA, 42 bp, Homo sapiens; identical to SEQ ID NO: 43684
  chr12:131687270-131687312
  hypo

SEQ ID NO: 74226 - DNA, 91 bp, Homo sapiens
  chr12:131699434-131699525
  hypo
tgactttctcactgcatggtgttttgtaaatggttcttcatgacaataaaacaaccctcccaggcctccgcttcagcggctgcacagcatc

SEQ ID NO: 74227 - DNA, 122 bp, Homo sapiens
  chr12:131700501-131700623
  hypo
cagcctgggaaaattcggagagaaatgagggggccgtggagagccaggttctgaggctgtgcccgctgcacccctcccaccacttaggtgggccgatgtttaggaaacgctacttccatcaa

SEQ ID NO: 74228 - DNA, 87 bp, Homo sapiens; identical to SEQ ID NO: 43685
  chr12:131725445-131725532
  hypo

SEQ ID NO: 74229 - DNA, 30 bp, Homo sapiens
  chr12:131746673-131746703
  hypo
aaggctgaacactaccggccgtgttcgggg

SEQ ID NO: 74230 - DNA, 36 bp, Homo sapiens
  chr12:131750463-131750499
  hypo
tggtggcagtggtttcgtgagcgtacactcatctcc

SEQ ID NO: 74231 - DNA, 33 bp, Homo sapiens; identical to SEQ ID NO: 43686
  chr12:131767017-131767050
  hypo

SEQ ID NO: 74232 - DNA, 266 bp, Homo sapiens
  chr12:131768368-131768634
  hypo
cacaacacaccacaacgccatgaccgcagcaccacaacacaacaccccatgtggttctgtcaagggtgccccagcccagacatgctggatgagaaggaactcggttacagacgacaaggacactccggcctcgctggggctgagcgcttccctcctggggctccctccacatcttgtcctgaccccccgtcgcctcctggggcagagcattctcttctcttctctcctctcttctcctctcccctcccctccgctcccctcccctc

SEQ ID NO: 74233 - DNA, 30 bp, Homo sapiens; identical to SEQ ID NO: 43688
  chr12:131769387-131769417
  hypo

SEQ ID NO: 74234 - DNA, 37 bp, Homo sapiens; identical to SEQ ID NO: 43689
  chr12:131772177-131772214
  hypo

SEQ ID NO: 74235 - DNA, 71 bp, Homo sapiens
  chr12:131780201-131780272
  hypo
catctgactgaggaacggactccccacttccaccaacccaactcgtcatggctgctcggaaatctcatatt

SEQ ID NO: 74236 - DNA, 201 bp, Homo sapiens
  chr12:131801478-131801679
  hypo
ctgtctcctgacccacggcctagggtggcaggataagaaggggacctggtgagtgcagccatgacagacactcaattggacacagtgctccctctgtgctgggttttggacgggtgtccattgtgatttgcccatgttccattccaatgggaaaatgctccagcctgattggctggtgctccgttgcgattggctcatgct

SEQ ID NO: 74237 - DNA, 67 bp, Homo sapiens
  chr12:131834197-131834264
  hypo
cgtgctcttcgctgccgtcatttccaacatcgtccgagaatttatgaagtgccgagaatccctctta

SEQ ID NO: 74238 - DNA, 30 bp, Homo sapiens
  chr12:131836813-131836843
  hypo
ctccgcagcaggctgcgggtaccagccatt

SEQ ID NO: 74239 - DNA, 30 bp, Homo sapiens; identical to SEQ ID NO: 43691
  chr12:131850690-131850720
  hypo

SEQ ID NO: 74240 - DNA, 259 bp, Homo sapiens
  chr12:131852223-131852482
  hypo
tggggtcgggggagccggatggggcctgcagggcagcgggtcccacccaggcccacctgcagacatcaggggcctcatctgggaatgcggggccaggatgctcttgaacaaatggaagttttggcaactctggactttggggtaataggctgggaccatagagatgtgacccacagctcctgtccatgctggctctcatggccactggtctccctcacttggtctccggcctgccctctgcttccgagtccgccactcc

SEQ ID NO: 74241 - DNA, 30 bp, Homo sapiens
  chr12:131856761-131856791
  hypo
ggaagttgcccactgcgggtgaccacagat

SEQ ID NO: 74242 - DNA, 34 bp, Homo sapiens
  chr12:131927584-131927618
  hypo
caagctcaacccacccgatcgggttgtcagggga

SEQ ID NO: 74243 - DNA, 329 bp, Homo sapiens
  chr12:131928780-131929109
  hypo
cacctgcacccagggcgcccttctgggaacggctcctgaacctgggcctgtgctgaagagtcagggacgctgggctctgagcggttctggccagtcccctccatcagggcccccgagtccctccggctgggccaaggtggagcccacggcgggtgaggcaggaggagcagctctgccttcaaggggagactcactcccaagcacccctgggcccatcttaggccacggtgggaccgaggctggcgggaccaggacctgagggcactggggcagcctgagaagccaggccttggtggatggagaggctgccgccccgggctctgctcaga

SEQ ID NO: 74244 - DNA, 127 bp, Homo sapiens
  chr12:131943696-131943823
  hypo
cttccacgggtccctcgggtccccaaatccaaactcacgccgggaagtacctcaacgcacttccgccctggcccaggctggacaaagcccaggtgctgctgagctggaaactcgctcttcaatgagg

SEQ ID NO: 74245 - DNA, 30 bp, Homo sapiens
  chr12:131966801-131966831
  hypo
cttccttcccactcccgctgagtccaccag

SEQ ID NO: 74246 - DNA, 83 bp, Homo sapiens
  chr12:131977760-131977843
  hypo
cgggcccagaggaggcgcaggacgaggggggccgagccccaccaggaccgtcccggaggcctgaaggccgtgcctggtgcccg

SEQ ID NO: 74247 - DNA, 436 bp, Homo sapiens
  chr12:131978755-131979191
  hypo
gggccaaccgagcctcgatgccagccccaagcccgtggagcccgctgtccccttgtatgtcggcggcagacagagggacagggtcaggtggggcagagtccacagaaggcccactgcactcgctacctgggcagtaggggagccgcccaagccgggcctccgacgtcccctggttggagggcgagtggttcaggctcactcccgagggtcctgaccagcagaaggaggggcccagggacaggtgaggagatgcagtcctggtcccggcgaggacagcggccggctcttcccgtggcccggagggccctgtcggaaacagcttgaggacccggagttcccaggagtctcctgccagccttcgtctctgcctgcccctctcgccatagtagcgggaagggtggtaggaacacgtgggtattcacgaggccccacgcct

SEQ ID NO: 74248 - DNA, 24 bp, Homo sapiens
  chr12:13199095-13199119
  hypo
ataccaccctgaacgcgcccgatc

SEQ ID NO: 74249 - DNA, 24 bp, Homo sapiens
  chr12:13199179-13199203
  hypo
gttcacttgcgtttttccttgtct

SEQ ID NO: 74250 - DNA, 34 bp, Homo sapiens
  chr12:132025011-132025045
  hypo
atgacggtgatggtgatgacgtggttgaggagga

SEQ ID NO: 74251 - DNA, 286 bp, Homo sapiens
  chr12:132044061-132044347
  hypo
tctatgaaccagcagcgctgaggtcactggtgctgaggccatgggactcgtggaggtgttctgtccatgggagagaagccctgagcatctgggagccatgaggaggaatctccagagacaaacgggagaattaaccagaggccccgccccattatcataactcggctccactcacatggccccgccctgttcattcacatgaccccacatgaccccactcacatggcccctccccactcacatgaccccaccccacttacatgaccccacccgtcacagggctcct

SEQ ID NO: 74252 - DNA, 211 bp, Homo sapiens
  chr12:132057357-132057568
  hypo
tgacacggcagacaccggccatcctgatgcgtggtcctgtccccagccacgcgcccaggcgggcacctgggaaactcacatgtgtacacagagacacaccggtgggattatggcagctttgtttatagcagcaaaaataaaaatgaaatatttgaaactagccaaatacctaccaggaagaaaactactcaattaacgtagaaaatacata

SEQ ID NO: 74253 - DNA, 99 bp, Homo sapiens
  chr12:132060675-132060774
  hypo
gcagtgaattagacccggtgcagtgagtgagacctgctgcagtgagtgagacctgctgcagtgagtgagagccggtgcagtaagacctgctgcagttga

SEQ ID NO: 74254 - DNA, 30 bp, Homo sapiens; identical to SEQ ID NO: 43696
  chr12:132068982-132069012
  hypo

SEQ ID NO: 74255 - DNA, 30 bp, Homo sapiens
  chr12:132076155-132076185
  hypo
ggcatttattatgcccgtggtgtctatcgt

SEQ ID NO: 74256 - DNA, 402 bp, Homo sapiens
  chr12:132076426-132076828
  hypo
gtcactgcaggaggacgcccccgctgggactcggcgtccgctgcgctgagccgctaaggagccggtctacttgctcccgcagcagcccgggggccggagctgccgacaccagggagacgcgttttctgcactgactcctacgctcccgcgtggacatccccagcatgatttctgtctccacccacttcgcacacaccccgccccggccagacacccccaaacccacacagggtgcagggacaccgccctggccttggctgtggctgtcacactcgcctgtcccgccttggccccaagtcctgccagcccggctccgtccccgccccactcccagtggctctgtgcctgcctccctcccgggctctgccagccctgcctctcccgccacgcacagctcaggcg

SEQ ID NO: 74257 - DNA, 66 bp, Homo sapiens
  chr12:132097008-132097074
  hypo
gcaggctatgggacccgcagggagtgagcatctgggggtggctgcccagcccggcacttgctgcca

SEQ ID NO: 74258 - DNA, 30 bp, Homo sapiens
  chr12:132104755-132104785
  hypo
atcatggtgaggtgccgtggggctctgatg

SEQ ID NO: 74259 - DNA, 160 bp, Homo sapiens
  chr12:132106063-132106223
  hypo
atcttcagctctgggcgacgctgccgggctgcttcccaagttccagatccaccacacccccagggggttccagcctgcagcgggggctgagacccacagctctgctgtgtacatgagaacacacacaggcacatgcacacctacgcgcatgtacacacat

SEQ ID NO: 74260 - DNA, 94 bp, Homo sapiens; identical to SEQ ID NO: 15639
  chr12:13215216-13215310
  hypo

SEQ ID NO: 74261 - DNA, 155 bp, Homo sapiens
  chr12:132168266-132168421
  hypo
atttctgggtggggccgtgcctggcgctaggaggtgagctgggcccaggcctgggggcagctctgcgtccccaccaccttcgtcccacccatgggctccagagcttctctcctgcaccgatgggtcagcggccgccacctcgatttctacatctc

SEQ ID NO: 74262 - DNA, 103 bp, Homo sapiens
  chr12:132169254-132169357
  hypo
agaatgggaatcatgcgtgtctgattcctgctctgtagattgagaatcacggcgtctctgtttcctgctctgtagaaaatgggaatcacgtgtgtccgtttcc

SEQ ID NO: 74263 - DNA, 139 bp, Homo sapiens
  chr12:132171649-132171788
  hypo
gtagaatgggaatcacgcgtgcgtgtttcctgctctatagaatgggaatcaccacgtcatgacttgggtgtgtctttcactcgagtctggcacatatgcatctgatggtcagcggatccctgcacgcccaaaggccctg

SEQ ID NO: 74264 - DNA, 83 bp, Homo sapiens
  chr12:132197162-132197245
  hypo
tttttccatccctgacgtttccttttggaattagagctcgaaaacgagaactggtgaagggagggccgcggaatcagatcatg

SEQ ID NO: 74265 - DNA, 628 bp, Homo sapiens
  chr12:132221496-132222124
  hypo
tcagtctaaaacacacgtgcctccaacccaggatgtctgctctcatttactagtatatgggtgaacatagccacatagatactcatcatagtacagttttagtagtagcaaaagactgaggcgacgcacatcctcggtggaggactaatggagtccctctggtgtgctctcgcggtgggctgcagagctctgggggtgggccagggcccgagcgctgcagggccacccaccggaatggctcttcctgagggtggaggcgaggtgactcaaggggagggcagcacgaggcagtctgttcacgtcagaaggggagggaagtgtctgtagtgcttctgtatcggcacctaaaagggcaggtaagaaggaccagtggccagcacagagaggggaactggaaggacgaggtcgcagacaggagtggctgactcacctgcccgtttgcgctgcttgcattttttcagcgtgactcgtcaccctctcaaaacatgcagattgacgtggtacttattttgagactaaactggtatcctgagttaattccttacaactctgtattttaataatacgtgcttttatcattttgtttcatcagctcagtgtgtttttgtttaggcggaagtggcccccg

SEQ ID NO: 74266 - DNA, 161 bp, Homo sapiens
  chr12:132240161-132240322
  hypo
atactccatctttcacgtcccccttagctctggaacctgatctgttgaaagcatctgcccacgttcacagcattgatgattgtttgtccagcacgttctaaacaaacaaaaaaaatcctgttccttcaactgttcgatgttttggccgtctacagttacta

SEQ ID NO: 74267 - DNA, 30 bp, Homo sapiens
  chr12:132242801-132242831
  hypo
gctgctgccaaccagcgtgaccttctccac

SEQ ID NO: 74268 - DNA, 21 bp, Homo sapiens
  chr12:132244054-132244075
  hypo
aaatagtaggccgggcgcggt

SEQ ID NO: 74269 - DNA, 30 bp, Homo sapiens
  chr12:132259853-132259883
  hypo
ttcctggggaaatcccgggccttgttgaaa

SEQ ID NO: 74270 - DNA, 30 bp, Homo sapiens; identical to SEQ ID NO: 43704
  chr12:132279981-132280011
  hypo

SEQ ID NO: 74271 - DNA, 173 bp, Homo sapiens
  chr12:132280837-132281010
  hypo
tggccaagacagccacgtggctcaggtgtggaatgaagctagaccaggtggaagccgaagggtcggcctctccaggcaggagagaaggatgatctaagggcaggtgcaggccagaatgtctggaaagcatttctggtgcgggattgccagtttggtgacgtggactctgggaa

SEQ ID NO: 74272 - DNA, 227 bp, Homo sapiens
  chr12:132284411-132284638
  hypo
gggcccccagccctccgacagcagccactggactccccttccccgtctccacgcctcctgcggtcaccgcacaccccttcttcccaggccgtcagctccccgtgggcatgtgtccctgccggcacccatgctgcaactgccggacaggccctccctgcggcagtggtgcacagcaggggagcagcccagccccgcctcaccatgctgagcaccgcatgttgccttga

SEQ ID NO: 74273 - DNA, 221 bp, Homo sapiens
  chr12:132286008-132286229
  hypo
atgtttgccgtggctcgtgtttgccgtggctcgtgtttgccgtggctcgtgtttgccgtggctcgtgtttgccatggcccgtgtttgccgtggcccgtgtttgctgtggctgttcgtgtttgccgtggcccgtgtttgccgtggctcgtgtttgctgtggcctgtgtttgccgtggctgttcatgtttgctgtggctcatgtttgccgtggctcgtctttg

SEQ ID NO: 74274 - DNA, 30 bp, Homo sapiens; identical to SEQ ID NO: 43394
  chr12:13229039-13229069
  hypo

SEQ ID NO: 74275 - DNA, 30 bp, Homo sapiens
  chr12:132291006-132291036
  hypo
aggaccacagaagcacgagcaacgagagaa

SEQ ID NO: 74276 - DNA, 272 bp, Homo sapiens
  chr12:132312558-132312830
  hyper
gcgggctccaccaagcgcccacctgctgcgctgcggcggcggctccggggcctgaacccgggtctgaacccgggcctcggcgccgtggggggtggacccgggagcgcggccggagaggggagtcagggtcagctccccgcaggcgccccgacccccgcctccgcgcccatcccgcgcgtccccgccgccccaagagcgtcctaagacacccggggaaacgccttccctgtgatgccgcggacccagtcccgtcgcggacacggcggggcggg

SEQ ID NO: 74277 - DNA, 803 bp, Homo sapiens
  chr12:132312856-132313659
  hyper
cgggccctttaaggcggccggcctcgttagcatacatttgcatggccccgccccgccgcttgaggctgccgcgcggggctcagtccggcgggggcgccgcggagagcggagggcgccgggctgcggaacgcgaagcggagggcgcgggaccctgcacgccgcccgcgggcccatgtgagcgccatgcggcgccgcgcagcccggggacccggcccgccgcccccagggcccggactctcgcggctgccgctgccgctgctgctgctgctggcgctggggacccgcgggggctgcgccgcgcccgcacccgcgccgcgcgccgaggacctcagcctgggagtggtgagcgcgcgggcgggacgggcgcggagctcctgggccggagccgggggtctccgcgggccgggtggcggggaccgggaagaccccagcagtgcacgtcggcgtcgcgcgggagccctggcgccctggacccatttcctgggtggggagactgaggcagggacgcgggctgagcgaccgggcgagcgcacgcgagtcctggggaggcgccggctgccgtcccggctccgtgcgctgggagcgcgccgcagccgcaggagcccgtggagttgtgagggggtcgcccacccggagcccgggtcgccggcttgcagcagccccggagcagccgggctgggcgagagcaggcatcgcggccgccccgagctctgcgcgctgcgtgcgttccgggtgggagtggcgggggcaggagcacgcacccacaaagcgaggaagggcaggggctacggagtgggggcacc

SEQ ID NO: 74278 - DNA, 30 bp, Homo sapiens; identical to SEQ ID NO: 34771
  chr12:132314800-132314830
  hyper

SEQ ID NO: 74279 - DNA, 30 bp, Homo sapiens; identical to SEQ ID NO: 34772
  chr12:132315470-132315500
  hyper

SEQ ID NO: 74280 - DNA, 47 bp, Homo sapiens
  chr12:132323460-132323507
  hypo
ggccagggtggggaacggggtctccgtggaggcgggtgcgtggccag

SEQ ID NO: 74281 - DNA, 321 bp, Homo sapiens
  chr12:132325069-132325390
  hypo
acgtggcctgttctccgtgactcactctgggctgacccctgcctgcagggtccggacgttcccacgggactcaccactggggcacgacacggtgcgtgcactcatgtactacgccctcaaggtctggagcgacattgcgcccctgaacttccacgaggtggcgggcagcgccgccgacatccagatcgacttctccaaggccgaccataacgacggctaccccttcgacggccccggcggcaccgtggcccacgccttcttccccggccaccaccacaccgccggggacacccactttgacgatgacgaggcctggacctt

SEQ ID NO: 74282 - DNA, 511 bp, Homo sapiens
  chr12:132329560-132330071
  hypo
atgcctgtcccatgccgctcaggtcaggggctctgccgcaggatgccctgtcccgcgctgcccaggccccgcctcccagcccacctggctctctccctgcaggcccaggaaggacgtgccccacagatgcagcactcactttgacgcggtggcccagatccggggtgaagctttcttcttcaaaggtacctccagggttcccgtggcggttggctgagggccatggcccactctgggtgcagaccgtctctgcagcccggccctcccctctgtgcccccaggcaagtacttctggcggctgacgcgggaccggcacctggtgtccctgcagccggcacagatgcaccgcttctggcggggcctgccgctgcacctggacagcgtggacgccgtgtacgagcgcaccagcgaccacaagatcgtcttctttaaaggtgggtgggcctccccgtcgcactccgggcttcccgggccctctgtccgcctcatggagggacggagagggtccagc

SEQ ID NO: 74283 - DNA, 197 bp, Homo sapiens
  chr12:132332952-132333149
  hypo
tgtgggcgtggtgagcacactttactatttcagccattttgaagccacagctcggtggcatgaagcacgttcacgttgctgtgcagctgtcacctgcgtccacctcccgaagatttccaccttcccaaacggaaacgctgccccgtgaaacacggatgccccgccccgcccctgggcagccccgcccctcccctggg

SEQ ID NO: 74284 - DNA, 32 bp, Homo sapiens
  chr12:132333386-132333418
  hypo
ggctcctgtgaaggacgctgctatgagcgtga

SEQ ID NO: 74285 - DNA, 211 bp, Homo sapiens
  chr12:132333478-132333689
  hypo
ggaatgctggatcacgtggtaattctatttttgacgttttggggagcctatgttctgtctcccgcagcggctgcacaatttcatactccctccccggcagcgcccggctctgccgtccccatatcctcccgacacaggtgactttccacgttcttgacagtgggggcgagggggcgtctcattgtggttttgagggcgtttctagtgacgt

SEQ ID NO: 74286 - DNA, 30 bp, Homo sapiens
  chr12:132334483-132334513
  hypo
gaccagctgtactggcgctacgatgaccac

SEQ ID NO: 74287 - DNA, 224 bp, Homo sapiens
  chr12:132335471-132335695
  hypo
gcctcctacttcttccgtggccaggagtactggaaagtgctggatggcgagctggaggtggcacccgggtacccacagtccacggcccgggactggctggtgtgtggagactcacaggccgatggatctgtggctgcgggcgtggacgcggcagaggggccccgcgcccctccaggacaacatgaccagagccgctcggaggacggttacgaggtctgctcatg

SEQ ID NO: 74288 - DNA, 393 bp, Homo sapiens
  chr12:132336227-132336620
  hypo
agccctccccacagacgagccccccacatggtgccgcggcacgtcccccctgtgacgcgttccagaccaacatgacctctccctgctttctagcggctcggctgggctccctggtgctccagggccatgggagtgggtaccctcgggcctcaaggggcttgaccctgaccaggggcccacgcacctgcacttggggtgggggcttcccaggaggtctcggcagtcgcattcctccttgttcatcagcccgtcccgcgctgtctcttccagtcctcgtgccccgaggagtccccacgcccctgtcacagatgggagagttgaggcccagcgggggatgagcctcagtgctacaggcaggggcatcacgggcgggcggggcgccagctggcccag

SEQ ID NO: 74289 - DNA, 35 bp, Homo sapiens
  chr12:132338738-132338773
  hypo
acctatgagggctgccggcccgtccttctgtggtc

SEQ ID NO: 74290 - DNA, 176 bp, Homo sapiens
  chr12:132348560-132348736
  hypo
gtgtctgagaagaaacggtgaagaaatccaccctggctgtctgtcgggcagccccggcgaggagttgagtccccttaccgctgcgaatgagctgtcctccaccccacgtcggagacctcagcgcccggggccccggcctgttagcacctgcatgcctttgacggcaacccctggca

SEQ ID NO: 74291 - DNA, 376 bp, Homo sapiens
  chr12:132349603-132349979
  hypo
aaaaagcaaagctggaaaagatagcttctaggtatacacatgcacatacgcactaagatcgcttctaggtatacacacacatacgtgctaagatagcttctaggtatacacacgcacatatgcactaagatcacttctaggtatacacacacatacgtgctaagatagcttctaggtatacacacgcacatacgcgctaagactgtttagtgagaagcaaggagatgatgcagtgtcagcggggagtctcgcagctgacacagggtgagtcctgtctgactccatttatgtgcagtccggggatgggcacgctaatgtccagaggctgagatcaggacagtgactcactcgtcaggaacgacggggcacctgccag

SEQ ID NO: 74292 - DNA, 49 bp, Homo sapiens
  chr12:132377450-132377499
  hypo
tcccccacccctaagcgctgggagctcctgcaggcgggtcttgttctca

SEQ ID NO: 74293 - DNA, 129 bp, Homo sapiens
  chr12:132377954-132378083
  hypo
agcgcgcaacgtgtacggtgaacagcactaacttttccccggtcctctctcccagagcaatcgctgttggctgtgtcttctgtgagtgagcccccgggctcttttggctgccggcggtgtgactttgga

SEQ ID NO: 74294 - DNA, 30 bp, Homo sapiens
  chr12:132406501-132406531
  hypo
ccgagcaccggaccacgttgctgcccaggt

SEQ ID NO: 74295 - DNA, 37 bp, Homo sapiens; identical to SEQ ID NO: 43716
  chr12:132415173-132415210
  hypo

SEQ ID NO: 74296 - DNA, 37 bp, Homo sapiens; identical to SEQ ID NO: 43717
  chr12:132415270-132415307
  hypo

SEQ ID NO: 74297 - DNA, 157 bp, Homo sapiens; identical to SEQ ID NO: 43718
  chr12:132423589-132423746
  hypo

SEQ ID NO: 74298 - DNA, 30 bp, Homo sapiens
  chr12:132429244-132429274
  hypo
gcctcagcactgtcccggtgccaggcaggt

SEQ ID NO: 74299 - DNA, 44 bp, Homo sapiens
  chr12:132566992-132567036
  hypo
tttgtgtggtgggggcggggtgggggtggggacagtctcactca

SEQ ID NO: 74300 - DNA, 249 bp, Homo sapiens
  chr12:132593124-132593373
  hypo
tgtggccagaaagcacgggcagcctgggactcctgttgccatagcaacccagctaccgccgaggacttctgcggcttttccagcccagcagcagccgctccaggtactttctgatggctccacagtgcagctccccagactttcctcactcggatttgaggactcgatgtgctgaggcaggacccagaggggtcccaagagcctgtcctcttttgttcaaaatacatcttgaaacgtctttgtgaaggc

SEQ ID NO: 74301 - DNA, 38 bp, Homo sapiens
  chr12:132616617-132616655
  hypo
tgtgtggcattgaggcgaggaggcggggagtggccgcc

SEQ ID NO: 74302 - DNA, 522 bp, Homo sapiens
  chr12:132617183-132617705
  hypo
cctgggagcaggagccgtggggagggctggactgcagtaaggacgcctcgtgggatgtgccaaaccgctgcgtggagcctgggctgacttctctggatcttggtgcaactggcgtggcccttccaggaagccgggccacctggctcagagacgccagaccctggccggcaatggggctgccaggggcggggacgctggaggagctaggggtgtgggccactgtgctgcctgccccggcctggcggcctctccgtagcagagctgaggctgggacgcaggtgggggagcctggatgcgcctccttcctcagccacgggaggatgaggtccaggagcgcagcggggcccacgggggagcgccttcgggtgcggctcgtcgctgccacccgtacagtggtttctttttatttcccacgcctccccacaatgatgtggacgccatcagtgtcattggcaagggagggccttgtgccaccctccagagacgtggctgccaccctgacctgggcggagtgtgggggtg

SEQ ID NO: 74303 - DNA, 150 bp, Homo sapiens
  chr12:132619054-132619204
  hypo
agctgctgtccctcccgctcctctcccctctcacatctcgaaactctggggaaggatccaggcccccgtgccactgtggaagggccgggacgggcctgcccaatgcactgcagatgccccggtgcccactcctcctacctccccgagtgt

SEQ ID NO: 74304 - DNA, 70 bp, Homo sapiens
  chr12:132643455-132643525
  hypo
tgtcctagtcagaggcgtgaagaggagggcggaggccggaactatccatcggctccgagggtggagcagg

SEQ ID NO: 74305 - DNA, 163 bp, Homo sapiens
  chr12:132643845-132644008
  hypo
ctgaggatggtgcctcgcggagcctccactgcccctgtgtgctccgcaccacgtctgtctcgatggcgcccctcgaagacctcgggaagctccccgttcgctgtggccccccggggtctgtcccctgcagcactgttctctgggggctcgtggtccgagttct

SEQ ID NO: 74306 - DNA, 30 bp, Homo sapiens
  chr12:132644527-132644557
  hypo
tcttctcgcctctctcggccccttttcctt

SEQ ID NO: 74307 - DNA, 337 bp, Homo sapiens
  chr12:132648196-132648533
  hypo
gcccttgccaccctgcgtgggctgcccctgccatgtgagctcctctccctgctctacacatattttaaaggacaggtgagtaaccaaaaaccaggtaggtgctgtgcagagccaggatgtgtggcccagccctgaaccacgctcacttgcaggctgcccagggtcccctgggcgcaggtcacccacataatggggcccgcatcggggcgcagagggtgacaccccagcctccaggaaggtgcctcatgggtggctcagccctggttagccccatggctaacaaagccaggaattaccgcagagcctgggcgtgcaggtggcacggcctctggaattt

SEQ ID NO: 74308 - DNA, 30 bp, Homo sapiens
  chr12:132651886-132651916
  hypo
tcgtttctgcctgtgcgtgctgaggctgtt

SEQ ID NO: 74309 - DNA, 231 bp, Homo sapiens
  chr12:132652953-132653184
  hypo
gtgaggccggccacacgtcccagcacagtgagcttgtggggaggggggcccactggggtcctctgggggccgatgctgagacggggtctaggccgggataacgggatagtccattgctgggccagggctgctgagcgtgggtggggactgccgactgcagtacagacccagacggcaggagcccggcaaagcctgcccttccgaggagcctcacgtcggaggagctgcctg

SEQ ID NO: 74310 - DNA, 30 bp, Homo sapiens
  chr12:132654109-132654139
  hypo
ctgagcctgggccaccgccagaatcacgtg

SEQ ID NO: 74311 - DNA, 30 bp, Homo sapiens
  chr12:132656988-132657018
  hypo
catgagcccggagcccgccattcccgctgc

SEQ ID NO: 74312 - DNA, 30 bp, Homo sapiens
  chr12:132658236-132658266
  hypo
gcggggctccgacaccggctttctggacac

SEQ ID NO: 74313 - DNA, 125 bp, Homo sapiens
  chr12:132666377-132666502
  hypo
ctcgtgtgcccgccacgctgtcttcctgccgctggtgaagtctgtctcccccccccccccccccgagtgatggggcgcctccgactgcccggccacggtgcctgcacctccgctcctcctctccc

SEQ ID NO: 74314 - DNA, 30 bp, Homo sapiens
  chr12:132672104-132672134
  hypo
agcctcctctgcatccgaacccgccaccgg

SEQ ID NO: 74315 - DNA, 30 bp, Homo sapiens
  chr12:132675830-132675860
  hypo
cagtgagctccagcacggggactggtcacc

SEQ ID NO: 74316 - DNA, 219 bp, Homo sapiens
  chr12:132677480-132677699
  hypo
gctctgcgtctcggtcgcgtccgtcggactggggaggtgctctgcgtgtctcggtcgcgtccgtcggactggggaggtgctctgcgtgtctcggtcgcgtccgtcggactggggaggtgctctgcgtgtctcggtcgcgtccgtcggactggggaggttctctgcgtgtctcggtcgcgtccgtcggactggggaggtgctctgcgtctgggggttttg

SEQ ID NO: 74317 - DNA, 123 bp, Homo sapiens
  chr12:132682557-132682680
  hypo
tgagcactgacaggccgtgcgagctgccttgagctgcaaacggggccctgcgcggctgccttggagcctcccaccccggggacgctgttgcgggcgggagaggaccgccgggcagggcccacg

SEQ ID NO: 74318 - DNA, 157 bp, Homo sapiens
  chr12:132683736-132683893
  hypo
gcaggggtagaggatcgcccggtcgccgtcctccgctccctggtccagacagtaggcactggctttgctgtttctcacctgcaagcagaagccccaggagaaagtccagagtcacccgagggtgcggccccagggagcttcacgcagccagctctgc

SEQ ID NO: 74319 - DNA, 288 bp, Homo sapiens; identical to SEQ ID NO: 43726
  chr12:132687989-132688277
  hypo

SEQ ID NO: 74320 - DNA, 198 bp, Homo sapiens
  chr12:132691172-132691370
  hypo
cagagcgagactccgtctcaaaaaaaaaaaaaaaggaccaaaaccacaggcagagaggagccagtgctggtgccgctgagggaggaccgtggacctgaccgtgacccagccggcaactgggaggaggagccgagcccccacacaaggaaatggcaaatgtggagatggcggctgacctgagtgcggcacgccataccc

SEQ ID NO: 74321 - DNA, 232 bp, Homo sapiens
  chr12:132694804-132695036
  hypo
tacattcaggactgacgttgtctttggcggcgctgtgggcctggcaaagggcctgcgggcgaggccgtcccgtgaagtcggacctgttcttctggtcaaggcaagcaaagcaacagggctcgtagggttctcctggaagcgctggggacatgcggccttcatcgtgaaactgtcatctagaggggaggcaggcgaggctcagacgtcacactcatcacgtgtgggtgcagct

SEQ ID NO: 74322 - DNA, 64 bp, Homo sapiens
  chr12:132699804-132699868
  hypo
acaaaagtacttcctcgcacaccgagctgcaatttaccagccctcctgtcgggctgtaggcccc

SEQ ID NO: 74323 - DNA, 373 bp, Homo sapiens
  chr12:132983393-132983766
  hypo
caccttcagctccgccgagaacgcccgacactcagagaccctgctctttgttaaatgggaatgagacatgacacagacgcggggcagcggccactgcagcacgggttgtccactgcccagctctggggccaaaccctcggcgtcgcgcaaaccatacctcccgcgtgacggccgtgtccggcctgctcacctgtgcgaggcagccctgcagagcaggtcaccaggccacaggagcaccagaagagaagccacgtccactgcgagggccatccggtgtcatgtccctgcctccactcagccccaggcccacagctgcagccacgcagccccgcacagcgtcaccgtctccaggatccatcggcagtgggggggg

SEQ ID NO: 74324 - DNA, 48 bp, Homo sapiens; identical to SEQ ID NO: 43730
  chr12:132985665-132985713
  hypo

SEQ ID NO: 74325 - DNA, 250 bp, Homo sapiens
  chr12:132986451-132986701
  hypo
acccagagctgccaccgtcctgtgggtgacggcagaacatctggctgccgggtggcctccgtaaccgccacacacctgcctctgctggaatcacctgaggctctggtgcctcacacggattggccaaaacagggagcggagccgggaaggccacggacatctgtgtggtgtcacgaacaaggtccggccacgtgtgtgggagacgcgggcgccgaggcaggcgccaaactaagcccggccaccaagggga

SEQ ID NO: 74326 - DNA, 211 bp, Homo sapiens
  chr12:132987301-132987512
  hypo
cagcagctctgtccccgtgaagccacgtgtggaggaacgggggtgaggatggcaaaggacctttttgggggatgtgattcaagccgtagagaaaggaaaccccagcaatgactgagttgggatttctcaccacctagagcgtgggatcgagctctagagccgcggaggcagggatgggaaccgaactcttgtccaccgaggagcctgggag

SEQ ID NO: 74327 - DNA, 106 bp, Homo sapiens
  chr12:132988517-132988623
  hypo
gaggaactgcctcctcggacagggcttggccagtcagttccactgaccagagggtctggggtattggctatgggatctgggggagtccagccgggggtcacagggt

SEQ ID NO: 74328 - DNA, 30 bp, Homo sapiens
  chr12:132993581-132993611
  hypo
caacacccaggggtccgcatggagcccccc

SEQ ID NO: 74329 - DNA, 30 bp, Homo sapiens
  chr12:133000092-133000122
  hypo
gggcctgggtggccacgcccctcccctgaa

SEQ ID NO: 74330 - DNA, 583 bp, Homo sapiens
  chr12:133002792-133003375
  hypo
gagtctacagtcagccggctcttccagctttctgggagtgtcatattttgaaatctccttgttcactttcacgcctgctggcaggatggacaattcctgtctgggtctggctcctcaaaagatctcactggcatgtctgccgacgtgcgattttccagcctttccctagagctgcggtttcgtcaggttcatggtccaacttccaagttgccgagtccagtctgaccgagtgttccacaccgagtgtgctccggcctctgccccgccttctctctgtcctccacgtgagcaggacacgtgctccaggtgccctgtggctgcggcagcacctcatttcttggagctggtttctgcgctgtcaggattgcttggttctgctgctctaacaaacagtccccagactcagtgccttcaatggcgaaggcgtatctctcactcaggcaactgctctcacacgtcctcaggggacctgctgtttgtcctcactcagggatgcaggtggaggaatgatctgtttgacacacctttctgcgaggactcagttggccagaggagatgtggcgaaacgcgctgggcgggggag

SEQ ID NO: 74331 - DNA, 318 bp, Homo sapiens
  chr12:133019701-133020019
  hypo
aacccacagtgcactgtgaatattttgtttaaacagtcaattaccttcgacggatacttcatccatttgtcaaatctcaggtatctaattcaccacgccgtggctgttccgggggctccgcgtctgtcgtcccacatctgcgctgctcctgccgggaggacacgcccgtgccccacagcgggtccgctcaccactgctctttcaggcattacctccggagacactcgttccacctttgtctctgagagatgttcttgctgacaggtttcttcttacgacgctgcccttgcgtgggttcactcgcgttgctcctcagga

SEQ ID NO: 74332 - DNA, 30 bp, Homo sapiens
  chr12:133035008-133035038
  hypo
tctttgcagcatccacgagggaggtgctgc

SEQ ID NO: 74333 - DNA, 190 bp, Homo sapiens; identical to SEQ ID NO: 43736
  chr12:133035657-133035847
  hypo

SEQ ID NO: 74334 - DNA, 30 bp, Homo sapiens
  chr12:133036250-133036280
  hypo
agcagtggggagggtcgggggggcatccag

SEQ ID NO: 74335 - DNA, 92 bp, Homo sapiens
  chr12:133056788-133056880
  hypo
gcaccccagaacacacgcccgtatcttggtgcgctccaaagctcacacttgctgaaaaaataaggttccgagtgtggcggcagggggccacc

SEQ ID NO: 74336 - DNA, 30 bp, Homo sapiens
  chr12:133058946-133058976
  hypo
cagccccctcatgtccggtcccattggcac

SEQ ID NO: 74337 - DNA, 244 bp, Homo sapiens
  chr12:133060744-133060988
  hypo
agccctgcctgaagccggggcctgtcaggaaccccacggggtacggggtgctgcctgaatccagccctgcctgaagccggggcatgtcgggaaccccagcgggtacggggtgctgcctgaatccagccctgcctgaagccagggcgtgtcgggaaccccagcgggtacggggtgctgcctgaatccagccctgcctgaagccggggcctgtcaggaaccccacggggtacggggtgctgcctga

SEQ ID NO: 74338 - DNA, 179 bp, Homo sapiens
  chr12:133098374-133098553
  hypo
ccattgcacattccccgggagggcaccttctgctcagtttgcacaagaggacacgggggctggtgtggggcctcttgggtgctccactttgggcggggcctgcgcaggacagtgcgtgcttagagccttggggcgggtctggggagcaggtggggcgatgagtccgtgtgcatggggtg

SEQ ID NO: 74339 - DNA, 80 bp, Homo sapiens
  chr12:133100375-133100455
  hypo
gcaggctctgggagacgatgatgcattcccgggaccccgcgttgagaaccgctaggagtgggacacgtggcttcctgcag

SEQ ID NO: 74340 - DNA, 264 bp, Homo sapiens
  chr12:133100756-133101020
  hypo
agtgccaggaagagccgggcagcctggccagggcctgtgagggctactgtgcagctgagcaggtcactagcccaccaccctgcccccggctcccgcccagtaaggctcagactcctcggggctgcatccctgcccggccagggcctcctccagtgtgggtgcctgctactgtgcggcttgatggacctcatgggccgggggcatttgacctcaggggcctgggtgacatcccttaattcgcactggcaccgtctgccttgtgtg

SEQ ID NO: 74341 - DNA, 30 bp, Homo sapiens
  chr12:133101497-133101527
  hypo
ctctgttttctcatccgtgaaatgtaaagg

SEQ ID NO: 74342 - DNA, 40 bp, Homo sapiens
  chr12:133122176-133122216
  hypo
cagacctgaaacccacggggagatccgtaaccaggtccgg

SEQ ID NO: 74343 - DNA, 93 bp, Homo sapiens
  chr12:133130872-133130965
  hypo
gtgccgcccctgcctcggaagcctcgagggcaacctgcaccctcaggaggcccagctgggggcgtcactgcagggcaccggcagaaactgggg

SEQ ID NO: 74344 - DNA, 30 bp, Homo sapiens
  chr12:133161681-133161711
  hypo
tcagccacatttccacggtggaccctgttt

SEQ ID NO: 74345 - DNA, 30 bp, Homo sapiens; identical to SEQ ID NO: 43741
  chr12:133167902-133167932
  hypo

SEQ ID NO: 74346 - DNA, 95 bp, Homo sapiens
  chr12:133168198-133168293
  hypo
ctctttcccctcaaacgttccctgcacgcatcaattacatcagcgcagctgggccttcccctgagcgtgatgtccaggggcgaggccagtggctt

SEQ ID NO: 74347 - DNA, 30 bp, Homo sapiens
  chr12:133168945-133168975
  hypo
ccggggccgcccacccggcacagcgcctgc

SEQ ID NO: 74348 - DNA, 256 bp, Homo sapiens; identical to SEQ ID NO: 43742
  chr12:133169847-133170103
  hypo

SEQ ID NO: 74349 - DNA, 30 bp, Homo sapiens
  chr12:133172661-133172691
  hypo
gcccggagcactcagcgctggcatcatcct

SEQ ID NO: 74350 - DNA, 24 bp, Homo sapiens
  chr12:133174537-133174561
  hyper
cgcctcctctccgcgcgcccctcc

SEQ ID NO: 74351 - DNA, 87 bp, Homo sapiens
  chr12:133175277-133175364
  hyper
cagtcaggatgcaggaggtttccaagtttgcatcctcactgttgctcttcctgctctgagaaaccctcctagcgaccaggctgactg

SEQ ID NO: 74352 - DNA, 30 bp, Homo sapiens
  chr12:133178414-133178444
  hypo
ggaggctgtgtctgtcgcccacacacgccc

SEQ ID NO: 74353 - DNA, 170 bp, Homo sapiens
  chr12:133187664-133187834
  hypo
gcgtcgttaggggcacgacggaggtgccagggggacaccgcacagcagggatgccagggagacttcacagagacacctgcaggacacctgctgccaggagcacggcccagtggggatgggagagcgaggagagcgccgggcacggggaggaggggcggggcacggcccag

SEQ ID NO: 74354 - DNA, 136 bp, Homo sapiens
  chr12:133188323-133188459
  hypo
atgacttgtgatggtcgctgtgtctgtgggttgactgtgctcagctgggcggttctcacacgtgttgcttaggcatcagctttcaggtagtttgactgtgctcagctgggcggttctcacacgtgttgcttaggca

SEQ ID NO: 74355 - DNA, 208 bp, Homo sapiens
  chr12:133194853-133195061
  hyper
ttgcaaagaagaaaacggatcggccgtggatccctctccagctcgagggctggagctgcggcggaggcaggagctggaagcgaggcgtctgctggcaaaggcgggagtgcaggttgcgctcgaagccccggcagccgcggcaggaaccggcctggacggggtggggggcgccgcggaggccggcgggacttcccatgtctttctcctc

SEQ ID NO: 74356 - DNA, 167 bp, Homo sapiens; identical to SEQ ID NO: 34775
  chr12:133195062-133195229
  hyper

SEQ ID NO: 74357 - DNA, 200 bp, Homo sapiens
  chr12:133195428-133195628
  hyper
cgccggggcgaccgcccggcgcctggcccggggctgctggtccgccctctgggactacgagacgcccaaggtgatcgtggtgaggaaccggcgcctgggggtcctgtaccgcgccgtgcagctgctcatcctgctctacttcgtgtggtgcgcggggcgcggggtgcggggcgcggggtgcggggcgcaggggaggggct

SEQ ID NO: 74358 - DNA, 62 bp, Homo sapiens
  chr12:133195878-133195940
  hyper
ggctggggctgggaccgagggcgcggggcaggccccaagagccccgcagagcggacccgggt

SEQ ID NO: 74359 - DNA, 19 bp, Homo sapiens
  chr12:133195965-133195984
  hyper
cgggcgggactcagccttc

SEQ ID NO: 74360 - DNA, 49 bp, Homo sapiens
  chr12:133199652-133199701
  hypo
ccaaaggtcaaagagcggagaagggcgggtaagacgaccctggtctgac

SEQ ID NO: 74361 - DNA, 89 bp, Homo sapiens
  chr12:133200001-133200090
  hypo
acccaggctgactggcgcccacggctgcaccgggcgacccctggtcctgctaggtggccttcctgggggacgagcggctgtcccctggc

SEQ ID NO: 74362 - DNA, 34 bp, Homo sapiens
  chr12:133262748-133262782
  hypo
caccgcgccgggcctcatccgttttctgcttatg

SEQ ID NO: 74363 - DNA, 30 bp, Homo sapiens
  chr12:133295960-133295990
  hypo
cagctcccagaaagtcgaggatgtacgggc

SEQ ID NO: 74364 - DNA, 24 bp, Homo sapiens
  chr12:133334005-133334029
  hypo
cacctgtcaccccagcgcttgggg

SEQ ID NO: 74365 - DNA, 363 bp, Homo sapiens
  chr12:133428083-133428446
  hypo
atggaaaaaaagaaacggcatccttacttcacaggttaccctaaggccaacaccgctttgaaacctgacccctgaaggacagataggaacccgcctgcgtgcggtggcgcgggcactcacactgctgaggggcgacacgcgggtcctgctcgcgctccgctctccggtcgggcatgggctggaagcagcaggtgcacagggcgtggcttccttgcagagggcacacgtaatcctggactgctgaagcacacgcacattcagccggagcacgtgggacccagggcagaaagacagcaggttagagaggccgccgggaagcacagcgaggagaggtgcacctgagacagccggggaagaagcaga

SEQ ID NO: 74366 - DNA, 40 bp, Homo sapiens
  chr12:133453650-133453690
  hypo
gattacaggtgtgagccaccgcgcccgggctgataataat

SEQ ID NO: 74367 - DNA, 85 bp, Homo sapiens
  chr12:133463015-133463100
  hypo
tttagagtataatgtcggagctaattcattaattttcagacaaactaaacatttttgttgacaggaccagcgcatttctctcccc

SEQ ID NO: 74368 - DNA, 402 bp, Homo sapiens
  chr12:133463573-133463975
  hyper
cttatacagttgtaacgaaggctaaatgatgtgcgtgaatcatgcgcaagaatcggtgggcagaacaccgaataaataccagttcttacatgacatttcactccacggaaaaatctggagcgcacactgcaccgccgcccgtgtggcctgcccgcaacccggtggctctgcccggccccggcccccggccccggcctcagccccgcacctcgtctccgcccgatggtccactcccgcttcctcaggaggacgtgcggctcgccctcctccgcgcccagacgcaggagccgtccccagggctgcggcggcggcgactgcttgccttcctcgggccgctccatcgggattcacatctgcggagaccccggaaacgcccatggagactcccgaccccagaggccg

SEQ ID NO: 74369 - DNA, 152 bp, Homo sapiens
  chr12:133464403-133464555
  hyper
ttggggcagaagggacggggaacttccggattggaagccccaaggattctgagagccccgctaatctggggatgactcctaggagtagaagacggtccatcttagttgtcacgaggtagtgcacgtggggaccctttcgggtacagttgcac

SEQ ID NO: 74370 - DNA, 147 bp, Homo sapiens
  chr12:133464773-133464920
  hyper
ctgaaagtgaaaggtcggcgaaagaggagtaaagacggcgagacgcgtccacgcagggggagtctgtgcggtttggaggaacgcgccaatgtctgcactcatgaggagcccccaagggcggttttaagagggtgaagcaggaccggg

SEQ ID NO: 74371 - DNA, 15 bp, Homo sapiens
  chr12:133481368-133481383
  hyper
gaagcttttcctcac

SEQ ID NO: 74372 - DNA, 31 bp, Homo sapiens; identical to SEQ ID NO: 1080
  chr12:133481489-133481520
  hyper

SEQ ID NO: 74373 - DNA, 134 bp, Homo sapiens; identical to SEQ ID NO: 1081
  chr12:133481521-133481655
  hyper

SEQ ID NO: 74374 - DNA, 34 bp, Homo sapiens
  chr12:133483182-133483216
  hypo
gattgttattattgccgagtgtggtggctcgtgc

SEQ ID NO: 74375 - DNA, 267 bp, Homo sapiens
  chr12:133484586-133484853
  hyper
cgcccggcctcagacgtttttctctaggtaaagccgcgggatgaaccagcccctgtggaaatttagaagtaacgacgtccgtcaatttctgtatgaaaaatatacagatcgtgtgacacgtcttctgggaatgaaagtctgctaaactcgccgtcacgagtagatgaacacatttaaagtttgtagttaagaggaaaacaacgccaacgacacaaatgccccaagcgctggatgaagcagcgacctaggatggggctggcctggaac

SEQ ID NO: 74376 - DNA, 187 bp, Homo sapiens; identical to SEQ ID NO: 1082
  chr12:133485161-133485348
  hyper

SEQ ID NO: 74377 - DNA, 251 bp, Homo sapiens; identical to SEQ ID NO: 1083
  chr12:133485439-133485690
  hyper

SEQ ID NO: 74378 - DNA, 55 bp, Homo sapiens
  chr12:133485815-133485870
  hyper
cgtcatctggggtcttacgtgtcagtgatgtggggtctgccgggtcagtgagggg

SEQ ID NO: 74379 - DNA, 91 bp, Homo sapiens
  chr12:133705743-133705834
  hypo
atctaaaacagaatacgaactaaaaaacctaatcaatgagactttttaaaaaattgagtcagggccgggtgcggtggctcacgcttgtaat

SEQ ID NO: 74380 - DNA, 231 bp, Homo sapiens
  chr12:133757970-133758201
  hyper
ccggtggcccttggccggagccctccggcgcgggagtaactcctcgcagaggcctctgggagttgtagtttttttgcctttgcctctccatgacgcaattcctgtgcgacatacgtagcggccgccattgttccgcgccgatggcgagatccttgttcctcagatagcgttcatcgcccgtcgtggtcaacgggccagccgagtctggagtggttgcgaacccttctggct

SEQ ID NO: 74381 - DNA, 49 bp, Homo sapiens
  chr12:133758523-133758572
  hyper
tcttctagcatccctcgcgtcctgtcacttccagcgaggcacacaaaac

SEQ ID NO: 74382 - DNA, 30 bp, Homo sapiens
  chr12:133808200-133808230
  hypo
ctcctggctgcctcccggcacctggcaccc

SEQ ID NO: 74383 - DNA, 128 bp, Homo sapiens
  chr12:13431237-13431365
  hyper
tcgattttgaagctccgcagagagtgcctccagcggccgccaggggtcgcagtcgagcagctggcgccgcctctgtgcaggggagcaggggccgctggccgggaatcgcaagccggtctcctgtacat

SEQ ID NO: 74384 - DNA, 32 bp, Homo sapiens
  chr12:13519032-13519064
  hypo
acatcttgtagcggtcgcgggtctgacacaca

SEQ ID NO: 74385 - DNA, 60 bp, Homo sapiens
  chr12:13716048-13716108
  hypo
tgctgagcatgtacccgccgccggggttgttgtggtggtgatgtccggcagtgggcactg

SEQ ID NO: 74386 - DNA, 114 bp, Homo sapiens
  chr12:13716358-13716472
  hypo
cgccactggggcagccggctggtccagttcctgcagggagttgtcctcactgatgtcatacaggttgcctgctttcttgcaagcctcacaccggatgcacgcctgcctgcccga

SEQ ID NO: 74387 - DNA, 2142 bp, Homo sapiens
  chr12:14133113-14135255
  hyper
ccagagtaattattccgtgtgcatgtgaggttagtggctggaatagatttttaacgcttcttctggcaattacggtttttggtttttggagcgttagtggaggaggctctgtgtggagaagctgggggccggctccgtccctcggtggagcatggtcattcccaaagcgtccccttcctaagggggaaaaagaggcggtcagggcttgattcgcgtgtcccccggagggtgagaaaaatgcattccgaaaaagatatcaattcgttttaaggaaaggggggaggaaaccccgcatttcccacagagtgcacacgagaggaattgaaaacagctggtaccggtctataaataattcagaaaaggtctggctataccattcctgggacaggcacggatgagaggtgggaaagccaacctgaatggaagaggagagagggagggagcgagcgaaggagggaagtgggaaggaaggaggaagggggggagaagcggcaccatacagcaacacacactcacacacacgcagaaacacaattcccacttaactcgccagcgagtgcggcccccagccccatctgcattgctgctgacttgtctcgctcgctctccccatcgcctccagcagcagcgccgcctcccaccccgggcttgtgctgaatgggttctgattgtgcacggggtgcacactgggcatttcttggaaggggcacactgacgcgcgcacacacgcccccgacgcgcacgcgccccgcgcgcactcacactcacccccgcgcacactcacccccgcgcacactcacgctgccgccgcgctgaggtgcagcgcacggggcttcacctgcaacgtgtcgattggacggatgggctcggcgcgtgggtccggcccggggcgccgctgccctgcccctctgctaggtgaagggatgaaaccccccaaaagaccagagacagccctacccagtcacagcaccccctcccccacaaaaaaaaaaaacctttaaaaaagccacgtccaaattagcaagtgccgggttctgctggatttcagagctttacctcatgccagattcgttcacgatttcacggcttcgaccctttatctgcctgacacccccaaacccctacattcaaaggagagactccaaagcccatctttacgtaccggctccgagcgcctccgcggttgcagtctgcggagaggggtggccggtggctgggaatggagggttttcctttcctgcaaagcaggattaatgatccgtctcgggggttttgaagttcatgactcttctttgcaaggcaaaaggatatgcattcggacgccagcactactggatggtggtgatcaagaatcacccttgacgagcactctcgatagagcgaagccccgagatttcctagaggtgaagaagccggaggaagtggtttttgaaagggggtggggggaaccttcctttctcaaaaagaggtggggggtggagaggcaggagcccagattccagttggtgaggatcggagccgggggaagggaagcgggcgggggcaggctgtgcaagtcaaccgcgcggcagccggagagggagagcaggaggggaggaggggagcgtcagaaaaatgggtattaatcaccggggacggggggaggcgcggggaacgcaggttgcctggtctggatttgggtctcacactcaaaaacgtgccgcgcacacacacacagacacacacacaccccctacctcgcacaccctgactccggggggaggagaaacccacgaagctggggaagatactgcttctgctcccaggggcgggtgtgagcgcgcgtgtcctctttctccacaccccccaccccaccccacccccaagcccctgcaccccctcactcctcttgctaagactctggcggaggcagcttcccacgtcatgtgctggggaagtggggtggtaaggtggatggaagggggacggaagggggaagaagcttagcccgagtccgtggcgcctcctcccggccgcagcggggaacagcaccgacggagagcggctgaggggcgaggggagctagacagtgccccccgtgggcggcccgcgggctgcggaaagcatctccaaggcggagctgtagttcgaaattgaagaccc

SEQ ID NO: 74388 - DNA, 41 bp, Homo sapiens
  chr12:14720466-14720507
  hyper
tcctaggagcctccccgggcgccccccgcccagggcgcgct

SEQ ID NO: 74389 - DNA, 36 bp, Homo sapiens; identical to SEQ ID NO: 43396
  chr12:14817857-14817893
  hypo

SEQ ID NO: 74390 - DNA, 18 bp, Homo sapiens
  chr12:14905519-14905537
  hypo
aaaaaaaaagctggccgg

SEQ ID NO: 74391 - DNA, 30 bp, Homo sapiens; identical to SEQ ID NO: 43398
  chr12:14926203-14926233
  hypo

SEQ ID NO: 74392 - DNA, 1175 bp, Homo sapiens
  chr12:14927036-14928211
  hyper
ttttcttatttcctacgagtttatgtgcttggaagcgagcgtggtcgtggaaaacccgtaaccgctaaattcatctgggtccccaaagactgagccggctggcctcgttatttatgtgagcggctatgtaaatgaggattcggagattgctctattgattggagagagctggaggaggcggtctctcttccagagcgctagttgggagcggagcctgcctgtcattggtcaccagagccaatggaaaggggctgccgcgcggccgtaaagagtttgtagaggcagttcgggtgcggtacgttgcattccggtaccggacgccgagagcggtttgtctccgtctctggagttgtaggcgagaggtgatcatgtccggtcgcgggaaacagggcggcaaagtgcgagcaaaggccaaatcccgctcctcccgcgcgggcctgcagttcccggtgggccgagtgcacagactgctgcgcaaagggaactacgcggagcgagtgggcgccggggcgccggtgtacctggcggcggtgttggagtaccttacggcggagatcctggagctggctggcaacgccgcgcgtgacaacaagaagaccaggataattccccgccacctgcagctcgccatccgcaacgacgaggagttaaacaagctgctgggcaaagtgaccatcgctcagggcggcgtcctgcccaacatccaggccgtgctgctgcccaagaagacggagagtcagaagacgaagagcaaatgaccctgacgccgccctcagggagctggctcccccagcaaaggcccttttcatggtcgtcccgcaatgcttttgaatgtgctggatgtcatggagggccggtgacatctagcggggaggtgggcggcgagggtcccggcgggagccaataaagttggtgaaaatcgtttggtcgagagagctgtgtagtcgcggggacatgtcggatggccccaggggaggggggcgaccgggaaacccctggagcaggcactggtgggtgggcttgagccactctggacggctttagtccgcaggtcaccctcgaggcgtcaggggagggtggcctggaggtgggcagggtggaagccacctcgctgtcagtagggcaaaggggaggcagagtcggtgcggtgaggcctccttcggaattatttttac

SEQ ID NO: 74393 - DNA, 172 bp, Homo sapiens
  chr12:14929885-14930057
  hypo
aacatagacaagatacgaggcattgtaactgccctgtcgccacccgcctctcccaccactacccaaaggattcttagcatcccctcacatactctgcctgcctcaacgttcagtcagcccctcaccatttttgtttttgagagttttttttttaacccgaatagtttacggg

SEQ ID NO: 74394 - DNA, 30 bp, Homo sapiens
  chr12:14930753-14930783
  hypo
atgtaaagtgagtagcggtagttgatggga

SEQ ID NO: 74395 - DNA, 107 bp, Homo sapiens
  chr12:15037662-15037769
  hyper
tttctaagagggttccgaaagcctcttaagaacctgtgttaaattggcagccacagaaaccactagctccagctgacagctcaccctgggcacgatgccagttcaga

SEQ ID NO: 74396 - DNA, 448 bp, Homo sapiens
  chr12:15374143-15374591
  hyper
aggccaggagagctacggtcctctgcaagttcggaatgggtcccccaagatcgcgaagccctcccacactgcgcagcccaggcttcaggttgcgtttgcgagttgctgggctgcggtcgtgggtgggactcgccgcagaagcaagtgccagtggcccggcgggggtctcctcactcgcgctcgctccgactagcggcggagggactgcggcaggacgcgagctgagcccggccaaggccgctgcgctcagcggccaggatgctgcagtgcggcgcttcggcgccccctactgggggcaggggcaggctcctcccgccgcgctgcctcccaggcttgcgagcttgggtctttaacgtgctgcacccaagacgggcttccctttttcactggttatttccaagcctccaggctcccaccgaagggcggctttcctcggtcaaaaccttgc

SEQ ID NO: 74397 - DNA, 73 bp, Homo sapiens
  chr12:15475263-15475336
  hyper
tgtcattttatgggtcggcagccagagtgagagtgtccctgctgccagaggactacggcgggctgggcgcggg

SEQ ID NO: 74398 - DNA, 291 bp, Homo sapiens
  chr12:15475751-15476042
  hyper
acccctttttcccagcggtccgggcggcagccgcgctccggcgccctcgctctgccgttgggagcggcgcgccccagggcacgatggcccagccgcgggaagcgcctgccgtgcagcctgggcgcacgctttgttgtcctcgcgtgtgcgtgttcctggtggtcttgagaggtagggggcggggggaagaataagggaagtttgctccctccggctttcgccctttgtgctcttttatcgctgctgaaatccacatcaaaggtgggcttgttggatcgtgctttctcaggc

SEQ ID NO: 74399 - DNA, 637 bp, Homo sapiens
  chr12:1639018-1639655
  hyper
ggattcaaaggaggacgcgtagcaagaaagcggaggacataactctcttcccctctcagagcctcgggccccgcagacgccgaggtgggcgctcgtgccaggatcgcggggcgcgggtacgggctccttgggcgccccgagggggctgctggccggggtaagagccgcggtttcttcggaggatcgggtcgagttccaggagaagggggcagcaggcgtgcggcgccgggagaagggggccgggcggcggagactccccgtccgcacccccgcggcgaggcccccgggccgctctgcttaggggccgagggagccgggcgggaggcaggtgcggaggtcgcggtcccagcgcctgggaggagccctcgggagggtgtcgcggcccggctggtgggcaggagcgagccggggccggcgcggctgtcgggggcggggaggaggcgcgggaggcggggcggaggcggcggcgcccccaggatccactcgcccagcgccgggccctgcactccgagccgcggccgccacccgccccgcagccaacttgggccgaaacttccccgggtcccgcgctccggagcagggcgcgcagcccggcgagatcgacggcggcctcccgagcccgcgcctcgggcccagg

SEQ ID NO: 74400 - DNA, 83 bp, Homo sapiens
  chr12:1639894-1639977
  hyper
gccccgcgccccggccgcggatgaagagtcggaggcggcggcccgagcggcccgcgcgctgagaggagcgggcagggtctgcc

SEQ ID NO: 74401 - DNA, 155 bp, Homo sapiens
  chr12:1640321-1640476
  hyper
aaagctggggaccgccgggccctcgcgcgggcaggcataggaggctccggggtcggcggcgcaggcggggcggcctctgagcttcgcgctcactctcccgggtctggtcgggcccagccccgaccctccgccgaggtctgcgccggcatcgagga

SEQ ID NO: 74402 - DNA, 103 bp, Homo sapiens
  chr12:16500483-16500586
  hyper
tggcgaggttggggtcgggctttaaacgtgggagggctaattaacaggagattaactggagaggggcggtgcctgcgtccggcccgcgcggccacagtccctg

SEQ ID NO: 74403 - DNA, 38 bp, Homo sapiens
  chr12:1650724-1650762
  hypo
gcaacaggtgctggctcaaccctcgccccaaaacctca

SEQ ID NO: 74404 - DNA, 76 bp, Homo sapiens; identical to SEQ ID NO: 43309
  chr12:1651130-1651206
  hypo

SEQ ID NO: 74405 - DNA, 175 bp, Homo sapiens
  chr12:16757916-16758091
  hyper
agtgtggacctggtgcgcagcctacaccgccgaggaccgactattgtgaagccactttgggagcgggtcggagtggcggcagggggtgggggaagggatgaggacggccagacaagacagggcgcacacacggagcccctcgcagtgtgcaaaatgatggcgaatgacaaagcca

SEQ ID NO: 74406 - DNA, 30 bp, Homo sapiens; identical to SEQ ID NO: 34260
  chr12:16758398-16758428
  hyper

SEQ ID NO: 74407 - DNA, 40 bp, Homo sapiens
  chr12:16758692-16758732
  hyper
gagtcgtacttgagacgttccgcgccgcagccgctctccc

SEQ ID NO: 74408 - DNA, 160 bp, Homo sapiens
  chr12:1716717-1716877
  hypo
actttctcagggtcacgggaacaattcaggttgaacgcatctctcctccgacatgccgagcgtctttgagtctcctcacccaggcgcacactcaggattgcagtcatctgctattgttgcctttatttattttgagacggagtctcgctcttgtcaccca

SEQ ID NO: 74409 - DNA, 41 bp, Homo sapiens
  chr12:1738826-1738867
  hyper
ctcgtcctccctactcgggacctggtcgcctcccctccata

SEQ ID NO: 74410 - DNA, 186 bp, Homo sapiens
  chr12:1739589-1739775
  hyper
caggaggccaagaggcgggaggcccgggagccagcagggaagggctgtggcatctggaagatgcgtcctcagctcaggcatttgatgccagagctgccgcctggcgtcggcagtgtccccggtgcagctgctgggcaaggtactcggtgccgccctcgaggaccacggtgccgggaggggcagggg

SEQ ID NO: 74411 - DNA, 66 bp, Homo sapiens
  chr12:1762161-1762227
  hyper
gtgaccacacagtgtcgctatcttctcagttctagccgaatagctctggcccgcaccttggttcaa

SEQ ID NO: 74412 - DNA, 82 bp, Homo sapiens; identical to SEQ ID NO: 43400
  chr12:17629461-17629543
  hypo

SEQ ID NO: 74413 - DNA, 56 bp, Homo sapiens
  chr12:1905770-1905826
  hyper
acgctgcacagaacccggggtgaaacccgcgcagcacgacgcgcagggagtggggg

SEQ ID NO: 74414 - DNA, 292 bp, Homo sapiens
  chr12:1906030-1906322
  hyper
tccccggggccagggcgggttataactagcggcttccacacagcaggaagcctgacagaggctgcccgcggggctcccagcgacccgaggacatcgcacacttccggccttctcttctcacactccctctgccttccaagttctccccacgcagctcaggcgcgggcactggcaccgccctgggcaccgcctgagcagggctgggggagacccgccgaagggcccactcgcccagagacgccgtggggtcacggctgcggcctcggcggggtgggctcgacacacagggtca

SEQ ID NO: 74415 - DNA, 30 bp, Homo sapiens
  chr12:1911756-1911786
  hypo
tttggtgttggatttcgactttaatgtagg

SEQ ID NO: 74416 - DNA, 122 bp, Homo sapiens
  chr12:1914195-1914317
  hypo
gagccccagaccgcccgtggagtggcacccaaagcatagcacgatgcaggggcctgaccaccccagcccccctttcatgggggacaattcacaaataagcagtggcccgtgggctgcctgaa

SEQ ID NO: 74417 - DNA, 222 bp, Homo sapiens
  chr12:19283203-19283425
  hyper
caggtagaggggccacggggactccgccgccgggagttctctccagtctcggggcgcctctttctcctcagcctttcatcagcacttggagacggcgccctcttcctgcgccttctccccccatcccagcctagacgaccctcgcgaccctagagtggcgacgctcccctccctgaaacctggagtcctgagtttttcctccgcggccgctactcactcccc

SEQ ID NO: 74418 - DNA, 109 bp, Homo sapiens
  chr12:19283674-19283783
  hyper
gaacggctcgggaaacgcttggcgcgttccctcctgccacgggaggagcagccggagccggaggaggcgttcgcagcctcagttgctggcgatccggatctaaagtccc

SEQ ID NO: 74419 - DNA, 71 bp, Homo sapiens
  chr12:1937150-1937221
  hypo
gtgtaaagagacacccgggccctctccctaacccctgggctggaacggggctcccgcgcctgcctgtgctc

SEQ ID NO: 74420 - DNA, 42 bp, Homo sapiens; identical to SEQ ID NO: 43311
  chr12:1948142-1948184
  hypo

SEQ ID NO: 74421 - DNA, 270 bp, Homo sapiens
  chr12:1948392-1948662
  hypo
ggtgcctgccagctgcgttcacggagccaggatggctgagctcgaatgcctgttggatcgcgcaacttttcagaacacagctgggtcccaggtactgaagctaaaacaagggtaaggagcgcttcatcgcagggacctgatcgttctcagacagctaggcagagacaccaaggactctgcaggcacgaagaaactgaaagtcaggagaagcttgtgagggtcacagttgctctcatcatgtaagccatggcaaaccgcagcacagggcag

SEQ ID NO: 74422 - DNA, 118 bp, Homo sapiens
  chr12:1951151-1951269
  hypo
gtgatgtggcagccccgacaatattccctgggtcccacagcccattttctgggacagaccttccgtcgcatttgtaccccagccagcagaggcttgtaggaaacgcagatgtgagcat

SEQ ID NO: 74423 - DNA, 80 bp, Homo sapiens
  chr12:1957154-1957234
  hypo
gctcacgcatggcaacgggtatctcttatttgtctgtctgtctctctctgtctttattgagatatcgttcaaataccatc

SEQ ID NO: 74424 - DNA, 35 bp, Homo sapiens; identical to SEQ ID NO: 43401
  chr12:19636251-19636286
  hypo

SEQ ID NO: 74425 - DNA, 97 bp, Homo sapiens
  chr12:19780563-19780660
  hypo
gcccagagaaaccagcgtgtaaccactagtagaacctgagcgctcagaccgaggagtggggactgtattaagaagtggacatcgtctggcaggagcc

SEQ ID NO: 74426 - DNA, 30 bp, Homo sapiens
  chr12:1987670-1987700
  hypo
tgttttcaataggaacgtaactgagccagt

SEQ ID NO: 74427 - DNA, 77 bp, Homo sapiens
  chr12:1990410-1990487
  hypo
gtggaggtaagagagcgtcagaaggtcaggctgtccatagaatgctaaggacatcctagcaccgtctgacatcagtt

SEQ ID NO: 74428 - DNA, 113 bp, Homo sapiens
  chr12:2017761-2017874
  hypo
caccccccaggactgcgtcacggacatccccacgccaactcccacgccggactgcctcacggacatccccacgccaactcccacgccggactgcgtcacggacatccccacgc

SEQ ID NO: 74429 - DNA, 58 bp, Homo sapiens
  chr12:2018087-2018145
  hypo
cctgcaccccacacccggctcctcctcacgacactgtggcccgcgctggccttccacg

SEQ ID NO: 74430 - DNA, 35 bp, Homo sapiens
  chr12:20198455-20198490
  hypo
tagtagagaccgggtttcaccgtgttagccaggat

SEQ ID NO: 74431 - DNA, 30 bp, Homo sapiens
  chr12:2022315-2022345
  hypo
aaagtgggagagatgcgtgcatgtggtttt

SEQ ID NO: 74432 - DNA, 162 bp, Homo sapiens
  chr12:2028903-2029065
  hypo
agaatataattacaccgtacattgctttgtgttctgatgagagttacacaaattagaattgatcaaaattcttgtgttgtgagcccaaaccagtagtagtaccacatgggttctccgggggtgaagtcatagattttatgcagtccccgtatcagattattt

SEQ ID NO: 74433 - DNA, 30 bp, Homo sapiens
  chr12:2029674-2029704
  hypo
ttaaacactagctcccgttccctcctcccc

SEQ ID NO: 74434 - DNA, 30 bp, Homo sapiens
  chr12:2036436-2036466
  hypo
agtaccaaccaagcacgtgtgcagcacttg

SEQ ID NO: 74435 - DNA, 49 bp, Homo sapiens
  chr12:2038007-2038056
  hypo
gagaagggccctcctcggtgtcatgccccattcacgaaagagccaggac

SEQ ID NO: 74436 - DNA, 151 bp, Homo sapiens
  chr12:2040511-2040662
  hypo
ctggtggcagagtggcggatgccgtggtggagcactgcatggagcactgacggatgacacgtgcacatggcgatgaggacgacacctaaacgtggcagtcagtggagggaaagccagaacgggattcatgacacagaaccacagaaattaa

SEQ ID NO: 74437 - DNA, 30 bp, Homo sapiens; identical to SEQ ID NO: 43316
  chr12:2046347-2046377
  hypo

SEQ ID NO: 74438 - DNA, 697 bp, Homo sapiens
  chr12:20521144-20521841
  hyper
cagcaaaggagcaatcgagctgagggtagcgcctcctccgcaggagggggcgggagctcggctgagaaagctttcctagggagttgccttaaagaaagaaagcggaattgtcgatcactccagttgccagttttatacaattttaagcagtcgtcgccactcgtttcccctttgcaaaactgcaaatcaccaccaaccttgcatcaaatagaagtggggagggaaaaaaaaagcaaatctccttctcccttctcaccctccctttcttctcaccctcccttcctctcttactcgctccttctccctccctcccttctgcggctgccgctagtctctcggtctggctctctctccgacgggacttagcaacttcttatttctcagccccttgtccatttttttttttccatcctttgccatgaattggattgacagaggcgggggaggctttgctttctgccccagggaatggcgattcgcgtcctggggccgtgccggggagaatcggccgaggagaaagaaagagtgatagaaaaagagctgcaggaaggaggagaagggagacctccatctgccgcgggcccggcgcgctgcagcgcagcgcagcgccgagctgcgcctcggaatggcccggagcccgccctgcgcccccggctcctccagcgtcagcggctcctgcgcgcgggatgcattgggc

SEQ ID NO: 74439 - DNA, 124 bp, Homo sapiens
  chr12:20522108-20522232
  hyper
ggaagagcgtgcgtgcgtgtgtgtgtgtgtgtgtgtgcgcgcgcgcgcgtgggtcggggcgggggcgtcggggggccactgggaattcagtgaagagggcaccctataccatggcagtgcccgg

SEQ ID NO: 74440 - DNA, 425 bp, Homo sapiens; identical to SEQ ID NO: 34263
  chr12:20522347-20522772
  hyper

SEQ ID NO: 74441 - DNA, 44 bp, Homo sapiens
  chr12:20523073-20523117
  hyper
tttaagaggaggaggcggtccagctccgtcgtgtccgccgagat

SEQ ID NO: 74442 - DNA, 19 bp, Homo sapiens
  chr12:20685629-20685648
  hypo
tttttttttttgagacgga

SEQ ID NO: 74443 - DNA, 81 bp, Homo sapiens
  chr12:2088757-2088838
  hypo
gtgagccaccgtgcccagcccatttctcttaagtaaataactacgaacggaacttgttggatcatacgctagttatatgtt

SEQ ID NO: 74444 - DNA, 99 bp, Homo sapiens
  chr12:2138539-2138638
  hypo
ctttttcattagtcccgaaggaaaccctgtacccattaagaagacactccctattcccgcctcacccagggccctggcagccaccgctctgctttctgt

SEQ ID NO: 74445 - DNA, 150 bp, Homo sapiens
  chr12:2144292-2144442
  hyper
tcccctgcgccggcgcgtgtgcccgggccctccgcggggcgccggcgtctgcgccaaggcacgttctcctgctgctccagaactgccaccttccaagtcctgaaggaggccgttttcctgtcatttgcacctggccggagccattctgga

SEQ ID NO: 74446 - DNA, 594 bp, Homo sapiens
  chr12:2161460-2162054
  hyper
cctcgctgcccctcccgcttcccctcccctcctctatctgtcacttctacaaccgctctgattataattgatcaaacagaatcacggaatcacggctcatcttgccgttttgttcagtggcccgatccgaaacgagactctggtagtcgggcaaattgtattcctcctccttggaattccgctcacagaggccttcccggcgtggccggcccagcagggacgcgccgccgcagcggaggagagaacgcgggcggggggctgcaggccggcgcggggggcgcgacgccgccggcggggcgcgagggggtgtgtccgcgccgcggccaccgcggccaccgcggctggcgcccgggtgcgccgcgcgccccggcctccccgggggctcctcacgccgcccctcgcccgccggcggccggggcccgctccctttgacgtcatgcgggcggagggctcgctcgggcggcgctgccgcgggcgccgggagggggcccgacttcgggctccagtccgccgccgtgcgccccgcgccgtgcgcccggctccctgcgcgccgccgcagccacatctggaagcgttcagcgcgtctgcctccgg

SEQ ID NO: 74447 - DNA, 1443 bp, Homo sapiens; identical to SEQ ID NO: 34201
  chr12:2162067-2163510
  hyper

SEQ ID NO: 74448 - DNA, 656 bp, Homo sapiens
  chr12:21680364-21681020
  hyper
gtccaaatggggactcgggttgcctgggaaatatctcagtaacccgacctccgctccaaagcgcccttgcggcgtccggtcaggcgcggggctttcctccagagctccagggcccctggctcagcccggggttgcgctgggagcgctggaaactcggcagccccgcgcgaccctatcctggagcaacctgccccctccccacgcccggggactgcgctgtgccgggaggagctgaggtttaagcccgggttgtcccgggccaggctgtcgctgagccccaggtctcgtttttgcagagggtcgccgcttcatctccgaccagagccggagaaaggacctctccgaccggccactgccgggtgagtgaccaagggtgcaagggcgctagtcctgcgcttttggaataggatggggcgggcagggcttgctccgcgctggtgccgaaagaaagcgtctcctcaccggaaagacgcggctctgaggcgccctcagatacagtccgcccgagggcagcccgggttggcagcagcagcagctggatgccgagcgccggagctgggagctcgcgcgtccagccccgcgccaatggtggcaagggcggcccaggctggcgctgcggctccccaagccttattggcttgcggctgttcagccag

SEQ ID NO: 74449 - DNA, 501 bp, Homo sapiens
  chr12:21810473-21810974
  hyper
tgccttctgctcctccgccagggcacggccccccctgcgccccaaactgagcggcaaagtcagggcccgcggccggatgctcagagctaaaggccgcggaggacagatgtgcttcttcctccttcccgcgtctccccatacaagtactaccccgcacgtcccatcaggcttgcctgtgggccaggattcagggtcctgagccgaaacctaccaggagagagaaggctctggagacctctgtaacagtcgtgcggagaagacaaagtcagctgcgtgcgtctcctccggcgccggctctgcaaggagggaggagggggcggggccccacaaccaccgcagcctcttaggtttctccattgtgattggaaatccgagtaccgcctacccctcccctcggctcgctcaatccccttcaaggacaagggctcaagtatgcacactccctcccccaccctccagatgaggaggtctccttccagaggcttccgctctcagctggtc

SEQ ID NO: 74450 - DNA, 27 bp, Homo sapiens
  chr12:21833068-21833095
  hypo
aattcaagtttgggccgaagtttaaag

SEQ ID NO: 74451 - DNA, 30 bp, Homo sapiens
  chr12:21860015-21860045
  hypo
tttaactttgaataacgttgattaactttg

SEQ ID NO: 74452 - DNA, 665 bp, Homo sapiens
  chr12:21927174-21927839
  hyper
gaattattttaaatgcgaaagaagtatgagttgcatctaaaaagagttaaaaaggttcctgtggaaatcataatattataaattgaaaacttttttttttttttttttttacaacgaaggaatcaaatatacaaggtgcgggggggaaaaaacccaagacaacagcctgcgggttgcagtagggagtgtgccccgaaaagtccatccatcactgcaagcctctgcggtgttttgcattttaaatcatttacgggaacacggacagcctcccccctccgctcccccggagcagctttgaaacttacagactccgggtagcgggcgcggcggctggacctccttgcacacgccggcgggccgcgggcaggtccctcgctctcccatgctggcgcgcgggaccaggggccgcccaggccggagggacaaattgggggctgcgtgtcctaaggagaagagttaaaataataaaaggtgcaactgaatctaaacgcagggagggctagaggaagggggatgggtgtagatcttcccctccccctgctcagctcaactcccttggccacttcagtggaaggaggagggactgggggggcgggggcgggggggcgatgctccacaaatcagcctcccagttagggctttgacgcacgccagacctcggaagc

SEQ ID NO: 74453 - DNA, 75 bp, Homo sapiens
  chr12:21927877-21927952
  hyper
cgagcgcaagtccccgggaggtagggagcaggccagagggagggacgacccgggggagggcgggacctgcagagc

SEQ ID NO: 74454 - DNA, 34 bp, Homo sapiens; identical to SEQ ID NO: 34269
  chr12:21928417-21928451
  hyper

SEQ ID NO: 74455 - DNA, 296 bp, Homo sapiens
  chr12:22093664-22093960
  hyper
gcttcaaacccctgccggtgcacttgagctaccttcaaaacaccgacttcctacactgtcttaagatgtaaatttcaaacccggacgcagaactcctaaaaaaaagtaaagagtaacaaaaattaagcagatagaaaactacttcttgaacatacaagaattgtctacaagaaaggcggtaataataactcctaataataataactcctttcactgtttccagttgatttgagtaggagacggcagttttgaagtaaaactggaaacctgatccccaccccttcacttctcgagcc

SEQ ID NO: 74456 - DNA, 308 bp, Homo sapiens; identical to SEQ ID NO: 1025
  chr12:22093961-22094269
  hyper

SEQ ID NO: 74457 - DNA, 471 bp, Homo sapiens; identical to SEQ ID NO: 1026
  chr12:22094577-22095048
  hyper

SEQ ID NO: 74458 - DNA, 15 bp, Homo sapiens
  chr12:22095181-22095196
  hyper
cgactccagccctgc

SEQ ID NO: 74459 - DNA, 40 bp, Homo sapiens; identical to SEQ ID NO: 43318
  chr12:2245461-2245501
  hypo

SEQ ID NO: 74460 - DNA, 83 bp, Homo sapiens; identical to SEQ ID NO: 1027
  chr12:22486799-22486882
  hyper

SEQ ID NO: 74461 - DNA, 326 bp, Homo sapiens; identical to SEQ ID NO: 34274
  chr12:22487133-22487459
  hyper

SEQ ID NO: 74462 - DNA, 802 bp, Homo sapiens
  chr12:22487460-22488262
  hyper
cagagagcggcggcggcgagtcgctcccgccggttctgcagcatcacggtcgccctcggcgagggtccgggagaaggctcggctccctcctaaacatgtggcccgtggcgtccccttgtcccctccgagcgatgctcctgcgcccttcgccgcctcccgcgctgctgcgccgccaggcaacccccccccccccaccccgccccgagacgcgctctctgcgccgcaccaagtccttggaaatttccacggcggcccgggaccgctatcctgccccgggctcctccgcctcgcccgccgggaccctcgctccccacccctcccggagaagaaaagaactcgctctcatcagttaattcagcggcgcgccgcagccttccgctgcgccccggacttcgcagacaaacgcccggggattggtggaaatcaaggtctccccctccctcccccacccgcaaaattgcctccttcgacccgatccgagccgcgacactcgcccagagcgcgcacccctcactcgtgcccttgttctttggagataacggcagacaataaaaaccaacagccccccgccaatagaaatatatcagtccctgagtgtggcggagactggctaatatcctgatccttcgacaagcggccggtgtgcccaggctgtcaccctgctgccgtcaccctagtctttctctagctggttggatattaacccgcagccaggcgcgaggaggctggcggagatttattccttcctgggcccccacccccattagccggtcccggagccgcggcccgtgtgtgtgcgcgc

SEQ ID NO: 74463 - DNA, 366 bp, Homo sapiens
  chr12:22488339-22488705
  hyper
cgaggaggtgcgtgcactccggggtcctccgcctcgcctcctccctgaaaggaagtgctgcatccagatgtgcaggcagctggtgcccaaacactagacctcaagatgtcacattgccttggaggcgcgcggccttttagattaaaggaccgttggttcttagacgtccttcttgcccttcttgcttgtgataagcgataagcttatcgcaaccccgaccttggaaaagcaccacccgccttgacccaccgagccgagagagtcgctgttagccatttctgctcgccccggcggccgacgcatagctcgggtacctcctagcggtcgcctattctatttgcttaagcatctcgtcaagcataaagt

SEQ ID NO: 74464 - DNA, 215 bp, Homo sapiens
  chr12:22634363-22634578
  hypo
gagaatttccataaacgtggttcatcagattccatatgatcaatacactttttgcaggcacctggttctctgagtcctacactacttatagaagcagcactggctttcctcattaacatctttccagtcagaatttatttgctaacaagccaaaatgaacattaagctgagacacagctttttcttgtctcatatttcatcggcacttaagaaac

SEQ ID NO: 74465 - DNA, 95 bp, Homo sapiens
  chr12:22698101-22698196
  hypo
ttgcagtgagccgagatcactcctctgtctccaaaaaaagaaaaaaaagaaagaaagaaatagagataccaggcacatctcgaatagtgaaataa

SEQ ID NO: 74466 - DNA, 134 bp, Homo sapiens
  chr12:22852676-22852810
  hypo
gacacctgagagcttcgccctgctaggattagcgtctgtataaagagagacacctgagagcttcgccctgctaggattagcgtctgtataaagagagacacctgagagcttcgcctacacgcttccccactgag

SEQ ID NO: 74467 - DNA, 27 bp, Homo sapiens
  chr12:22987972-22987999
  hypo
agccaccgcgcccggcctcatttttta

SEQ ID NO: 74468 - DNA, 57 bp, Homo sapiens
  chr12:2300563-2300620
  hypo
ggccctctgcagtcacgctggctccaggctcaccgggagtcacgttctctggctgtg

SEQ ID NO: 74469 - DNA, 30 bp, Homo sapiens
  chr12:2403723-2403753
  hypo
aagattcctcttgtgcgtgctgtcgggata

SEQ ID NO: 74470 - DNA, 30 bp, Homo sapiens
  chr12:2412108-2412138
  hypo
gggctcttgcggccccgggaggggggcctg

SEQ ID NO: 74471 - DNA, 17 bp, Homo sapiens
  chr12:24596179-24596196
  hypo
cccggccagtttatgga

SEQ ID NO: 74472 - DNA, 196 bp, Homo sapiens
  chr12:24632145-24632341
  hypo
actccctggtaactccgaccactcctctccacaccccactgctgtcccattagaagtatgcacagtaattaacatcttatctctcttattgtatgtgtcattttctactccgcgtatttgttttatacatgttttatctcctatactagaaaataaggcagcacctattaagtgcttacctcggccaagcactagc

SEQ ID NO: 74473 - DNA, 1030 bp, Homo sapiens
  chr12:24714475-24715505
  hyper
gccccaaagtgcaagcgagatttcccaaacccgcgcttaaagtgacacaacacgtgagtggtcttcacttggtacactgagtgaggtggggggaaaaagtagttgcaattagaattaaagcttccggtctctgaaatccctagaatcctgaaggatgagacttgtttcagaaattccgggcgggagggagggggagtggtagggagaaggattgcagaaagcgaaacaaaaagacgaaagagtcgggaggtgggggtgactaaggttagggggtgggccaggggtcgctctgatatcctagaagggttaaggggctttgtccaacttttagggtctggccttggacattggccgcgatgcccagcacagcccagggttctccccgcactctcctctcgcatcaaccacctccaccgccaccacttacaaaacaataccagcaacagtacgcaggcttcccaacaaaaatagaaagttatcccgtctccgggtcggggtccaagccggcgctccagggtcccccggccagccgcccccggggatgacagggccactccgcgcctcgggccgcctcccacctctccgccacccccagcccagtccccctccctctgtacttgaggaaactccggcggcggccccctccctcctccgcggctctccagctggagccgggaaggagtgctgagtggcgggcccggcgagcggcagaggggagctctgcgccttggaggtctgcccacaacaacatcgggacgaacaacaaagttaaaacgcagcgattcacgcaccttacccggtctcgttaatgcctcctccggcgtgggatgcaaagtggcacagaggcgggctgggggcccccgggaggagactggagatgggttttggtggctcgcctttttcactctgtgtgtgtgtgtctgtgtgtgtgcgtgtgtgccggtgtgtgtgtgtgtgcgcgcgcgtgtccctctctctccccccgtctctcgctcgcccgctcgctcgcgctccccgtgttgctctcaag

SEQ ID NO: 74474 - DNA, 447 bp, Homo sapiens; identical to SEQ ID NO: 34279
  chr12:24715757-24716204
  hyper

SEQ ID NO: 74475 - DNA, 212 bp, Homo sapiens; identical to SEQ ID NO: 11164
  chr12:24716205-24716417
  hyper

SEQ ID NO: 74476 - DNA, 177 bp, Homo sapiens
  chr12:2482588-2482765
  hypo
tgcaaagtgagtggtcggcagaggtctcctgaggtgacactgaggcccgactgccctgaggagcctgccctgggacaagctagagagagggtgtcccaggcagcatgcagaggccagcatggagcgctctgaactgggcagagcaatggggcaggagtttggcgtggattcaggggc

SEQ ID NO: 74477 - DNA, 161 bp, Homo sapiens
  chr12:25055472-25055633
  hyper
ggaggcagaaggctgcggtcaaaatattttggggtggcagagtcacgtaggatgtggctgtgggttctggcagcccagagattcagctcccgcctcctccctcagagcgagtccatagctaccctcacgtcccccgtggcggtcctcgccacgctccggag

SEQ ID NO: 74478 - DNA, 301 bp, Homo sapiens
  chr12:25056242-25056543
  hyper
cgcgagcatccttgtttattaaacaacctctaggtgaatggccgggaagcgcccctcggtcaaggctaaggaaacctcggagaaactacattagggcagcttttccaccgactccaaatccaactgacaaaaagcagtttctgccctcgagagtttgcgggcggggattgacatttgtgcgtctgctcttgtctgccactgaccgctatgtgcaaactgaagggggagaacgtgaatccagcttttagatttccctgcgccacctacccaaaccgaatttgtaactcggggtgttatgggg

SEQ ID NO: 74479 - DNA, 187 bp, Homo sapiens; identical to SEQ ID NO: 43404
  chr12:25059405-25059592
  hypo

SEQ ID NO: 74480 - DNA, 97 bp, Homo sapiens
  chr12:25081512-25081609
  hypo
gcagcgagctgtgattgtgccatgccagcctgcaatacagagcgagacagtctcaaaaaaaaaaaaaaaaaaccaagaaaaacgaaaatacaaaccc

SEQ ID NO: 74481 - DNA, 623 bp, Homo sapiens; identical to SEQ ID NO: 34282
  chr12:25101375-25101998
  hyper

SEQ ID NO: 74482 - DNA, 279 bp, Homo sapiens
  chr12:25102009-25102288
  hyper
cgagtacacgtggcgggctggattgcagaccggccctctcgcggcggagactcgcgacctagcggattgcatcagcaggaagacactaaggctgctcccccaggccgcccccagatggtggagtctctcccagcccgaagattcggagccagcgcccagacccgagcctcactcactgctcactcccggggtgcagggcagaggtgccagtgttgcaagcaaatgacacggttacccccgaatcagccactgtgggtgcgtatccgagtgtggggatgc

SEQ ID NO: 74483 - DNA, 30 bp, Homo sapiens
  chr12:25154975-25155005
  hypo
acaggccatcgtgcccggccttaactactg

SEQ ID NO: 74484 - DNA, 25 bp, Homo sapiens
  chr12:25191255-25191280
  hypo
caaaattgcaaatgacgaactataa

SEQ ID NO: 74485 - DNA, 30 bp, Homo sapiens; identical to SEQ ID NO: 43407
  chr12:25195744-25195774
  hypo

SEQ ID NO: 74486 - DNA, 120 bp, Homo sapiens
  chr12:25202526-25202646
  hypo
tcaaacaggtgtacaaacatactcaacataactaatcattaggaaaatgcaagttaagactataattagatattgtatcatacctgttaggatggctattattttaaaagacggccggat

SEQ ID NO: 74487 - DNA, 214 bp, Homo sapiens
  chr12:25256767-25256981
  hypo
tagccatcttctctacgaagagtgactattgcctctttacccagaaatattggaaatgcaggaatggtaagacaattcctaagtgttcttagtcaaaggtaaattcattttcatatgacagaaaatataaacgtatattttatcatttcttttaacatttgaacttctactaaaggtggctgggatggaaaataatgatcgattcagtagaagg

SEQ ID NO: 74488 - DNA, 32 bp, Homo sapiens
  chr12:25262917-25262949
  hypo
ttgaaattttaaaattccgtattgaatgttaa

SEQ ID NO: 74489 - DNA, 23 bp, Homo sapiens
  chr12:25273331-25273354
  hypo
ggaagcaagccaccacgaggtta

SEQ ID NO: 74490 - DNA, 40 bp, Homo sapiens
  chr12:25537400-25537440
  hypo
tcacctgacaccttccgtgtttaaccgggactaggtttat

SEQ ID NO: 74491 - DNA, 194 bp, Homo sapiens; identical to SEQ ID NO: 5128
  chr12:2566053-2566247
  hypo

SEQ ID NO: 74492 - DNA, 30 bp, Homo sapiens; identical to SEQ ID NO: 15624
  chr12:2590465-2590495
  hypo

SEQ ID NO: 74493 - DNA, 193 bp, Homo sapiens
  chr12:25922413-25922606
  hypo
atcaatcaatatacacgcatttttattttcaaatttattgttaacaatatccctagataatgatccctggggatctttatccccaaatacagatgagggagctgaggatctgataaggcaacttgtccaaggccgcttgaacccagttccgtctgtgcccttagtcaccatgctttcccgaaagaaagtgccc

SEQ ID NO: 74494 - DNA, 130 bp, Homo sapiens
  chr12:25956132-25956262
  hypo
ctggggttgtcttaccgcagtgagtaccacgcggtactacagagaccggctgcccgtgtgcctggcaggtggagctgcccgcatcagcggcctcggggaatggaagcggagaacgcgggcagctactccc

SEQ ID NO: 74495 - DNA, 30 bp, Homo sapiens
  chr12:26168478-26168508
  hypo
attaatgtgtgaggccgtggaaaactgctt

SEQ ID NO: 74496 - DNA, 141 bp, Homo sapiens
  chr12:26348161-26348302
  hyper
ttaattaagctcaaacgatttcaacattcatcaccttgcattgcacttcacagaaagcaaaaccaaaacaatcctggagttttgagtgaggaaaacagacgccccgcactcgcacacgcgcgcactcgcagcctgtctgaa

SEQ ID NO: 74497 - DNA, 168 bp, Homo sapiens
  chr12:26555243-26555411
  hypo
acttcccatcactaccgtctatctagcgtcacgatctgcattcatttattcattcaggaactacctggtcatgtcacaggtgtttgttaaaggcttagtaaatgctgattaatcagcacataaacgctacaggagagggcttctacctctctccgagaatttagaaat

SEQ ID NO: 74498 - DNA, 37 bp, Homo sapiens; identical to SEQ ID NO: 43411
  chr12:26555819-26555856
  hypo

SEQ ID NO: 74499 - DNA, 30 bp, Homo sapiens
  chr12:26844976-26845006
  hypo
taaaacaaggaaattcgggggtcagaatct

SEQ ID NO: 74500 - DNA, 18 bp, Homo sapiens
  chr12:27072768-27072786
  hypo
ctggaatttaggggccgg

SEQ ID NO: 74501 - DNA, 232 bp, Homo sapiens
  chr12:27426203-27426435
  hypo
gccgaatggtgcctccgtttctatatgtgtgaccctagacaaggcttgccaaacacctgcccacctacgcatggcttgggagagcagtactgaatagtggaagagtcctaggctaatgagtgttgacaggcttgttttggttttataacatttataacatacacatctctgagcccattttttctgttgcaaaatggcagtaacattatttaccactcgttagggctaatgt

SEQ ID NO: 74502 - DNA, 153 bp, Homo sapiens; identical to SEQ ID NO: 43412
  chr12:27489449-27489602
  hypo

SEQ ID NO: 74503 - DNA, 44 bp, Homo sapiens
  chr12:2778028-2778072
  hypo
gccacggtgttctgcggtcccctaagcaccgcctgccatcatca

SEQ ID NO: 74504 - DNA, 123 bp, Homo sapiens
  chr12:2783720-2783843
  hypo
gccaatgaggagctgcgggcgatcatcaagaagatctggaagcggaccagcatgaagctgctggaccaggtggtgccccctgcaggtggtgagtgctccctggactcccgcaccttggccact

SEQ ID NO: 74505 - DNA, 52 bp, Homo sapiens
  chr12:2788862-2788914
  hypo
ccggctaccccagcacggtcagcactgtggagggccacgggccccccttgtc

SEQ ID NO: 74506 - DNA, 43 bp, Homo sapiens
  chr12:2797716-2797759
  hypo
ctggcccccacagcccgtccccaccctgcggcttgagggggtc

SEQ ID NO: 74507 - DNA, 63 bp, Homo sapiens; identical to SEQ ID NO: 34202
  chr12:2800100-2800163
  hyper

SEQ ID NO: 74508 - DNA, 358 bp, Homo sapiens
  chr12:28122168-28122526
  hyper
cccgggctcaggccccggcaggtatccgggatggtccctctccctaacccgggcaaggagcatcggtgaccgctgcaagccctcggcagcatcccagcttggcagcccctccccctggcctccccaacccggcgccctggggaggatggggcacttacaggcggcggctgagaccctccaccgagcgcccgcaggagggcaccgcgtagctcagcaggaacaccgcgacgctccactgctgaaccagtctccgctgcatcgtctccgctcgcgctcgggacctgcaacagaagggaatgggacccgagtgtcagtctggactctccatctccccgcactactccgctcccccttttta

SEQ ID NO: 74509 - DNA, 140 bp, Homo sapiens
  chr12:28123065-28123205
  hyper
gtcgttagtggcagccggagcggcagggaggcggcagccccgcttcacgggcggggagacatgctggccgggcggcgcaggttggaggcgagttgaaaaccgagcggaggaatgttcacacgctccgaggcaaacctgcc

SEQ ID NO: 74510 - DNA, 238 bp, Homo sapiens
  chr12:28123548-28123786
  hyper
gggagccgagatccccgagggcgtgcggactgccccgggcagccggcggtccccggcgcgccgagctggacgagcgggcgccaagaccaccaggggcggaccgacgaggaggaggccaaggagctgggccggggaccgcgggcaaccgggagcctgcgcggagaggacgcgggctgttggcctgtgaatttaaggagcccgaagctcgcctggcagctcggggcgatgcatgagaacc

SEQ ID NO: 74511 - DNA, 1436 bp, Homo sapiens
  chr12:28127648-28129084
  hyper
ctgccctggtgtttgcgctcccactgcagcaagggaggcctgagtctcttagggcaggggtccagggtcttgggagaggccttagggcaagggggatgatctttttcagcctcccctcccctcctcccacccagcgtcctcatccccaccgcctgcgatagacttgggtcgcccattaggaagctgatccgcagggacggggcaggcttggctcctggggatcttaggctccatgggaacttcgggggtctcggggcccgtgagcggatctagctactacttcccctaggttctcctcgggcttcagtccctaagagtctggactccggactgccgcacagaatccttcttgcccggagcggtattattgaggtctttgcgttctgccccgccctgtcccgccggcttgggtgcttggtttctaacccgagtatactcggagtctctggtcctgcgcgcccccctcctcccgggagagccccgtatctggctgcgggtaagggaaaacttcgggaaccccgagacccaaggacagggtcggagggagcgcgcgaacttcctctgagcagggctcttcctcccctcccctctccctccaggtcaatttatgactcaaacatgagataagccctaggcagacggtgacgctgacttccccgtgggggcgcggggagagaaggatgaggcagacgtaccccctccctggcctggccctgtccggggccgcgtcggggtgtggaggggcgactcccttcctccgggagccccgactcgctctctcccagcgcgcctcccctgcgcccgtaaagctcggccctgccggagccccgggacccgtctgttttatttcacttaaagcgatctgcaaagtcaaggccgggtgaggtgcggcgcgggagaggagaggatatgaacggacgtggaacgaagttctgtctgccaactccctccgtctgattcttggaatccggtggcatcttaaaggacggaattgagggcaaggagaagattattaatccccgaagcccgctctgtctatatataactgctcagtggttacagttggcgatcgcagggtgggggttgggggtgtagaccgtgggccatggaacacgtggcatctctccagggcataaaaatcaatctagctggtggctcctatggagtttgtaaattgcgcagagctggctgggggaagccagtgagctgtccatggtggttaaggctcgttgatgtgcgtcctcgggctgtcctggtgaggcacagacccccctaccccaggggccgcaacgccccagagccccagcctgccagcgatccagccggtgtgcgcccgacacgaggctggacgtgtgtttgcacaactccaggacgcgctcttgcacagaggccgaattccagagatagacggaaaaatctcccgattccaaattgtg

SEQ ID NO: 74512 - DNA, 500 bp, Homo sapiens
  chr12:2861643-2862143
  hyper
cacgccacatcaccccggtcctttagactcctgcgcattctatttccccgtttccttctcacacccactttcttccctggctcccaccacagcagtgcccatctgctcctccccgctcactcaggtctcctgctcaggacgcccttgccgagggcgcggggcatttgtactgaagaagggctgcaggagagtcggtgacccctccttctacttgtatgtagcggccccaagtgtcccgggagctggtggggcgcttgggctgtatgagcccggccgccaggaggctggggctgcgtcaggagctgtccgtggtgcttaagcggcgtctgctcgggcgcggggtgtggcgcggcgggtgagcgctgtccctggtcctggagaggttcctggcccccagtggcaacggtgagagcagtggcccagaaggccagtaccgggaacgacgatggcgggcacaagggtgggcttgcagcagctgctgctggtgctcccacaggctg

SEQ ID NO: 74513 - DNA, 324 bp, Homo sapiens; identical to SEQ ID NO: 34204
  chr12:2862267-2862591
  hyper

SEQ ID NO: 74514 - DNA, 105 bp, Homo sapiens
  chr12:2903684-2903789
  hyper
cgccgcccgtggtgacggccggtcccggggagggggcgccgccactgccatcccgcagcctgcgctccccacaccccgccgcaggcgcagcggactggtggagtg

SEQ ID NO: 74515 - DNA, 43 bp, Homo sapiens
  chr12:29123308-29123351
  hypo
agggtttcttttcccatttaatcctccacgtgacccctattct

SEQ ID NO: 74516 - DNA, 145 bp, Homo sapiens
  chr12:2920998-2921143
  hypo
aagacagagcagatccggaatccaggcaaccttcacttccagcctgaagactctcctacgaactatgatagtaaatgatggagaggccctagggtttgggatcaaacaattctggtttgagcacgcaccccgccccacaatcctt

SEQ ID NO: 74517 - DNA, 30 bp, Homo sapiens
  chr12:29268148-29268178
  hypo
caagtccccaccggacggagaagcccctct

SEQ ID NO: 74518 - DNA, 33 bp, Homo sapiens
  chr12:29298795-29298828
  hypo
gaaaagattggattggaacgaggccgacattcc

SEQ ID NO: 74519 - DNA, 32 bp, Homo sapiens
  chr12:29302656-29302688
  hyper
gttaatgtggggggccgcgccttggggactgg

SEQ ID NO: 74520 - DNA, 120 bp, Homo sapiens
  chr12:29373965-29374085
  hypo
ggagttgtgcgcatgctcacttgaggcatgaagtgagcgtgcgtacaactccaataactggtaacaacactcccttaccaggggcgtattcctgtaaggtcatatacccgtaaaatcagc

SEQ ID NO: 74521 - DNA, 548 bp, Homo sapiens
  chr12:2964264-2964812
  hypo
ggggatggggtgctccgtgggggggcatctgtgggcattggagtcggtcagccagcgccagacattgctatcgtagggcctgtcaggctgggtggggaaggtggcaggcagacggcacacatcgagccacgtgtgaaagccccaggtgtgctgggcgccacccttccaagggtggatgagccgctgacgcaccttggacttcatatctgtgcagggcggcagcttcagagccagctggtggtaggcttgccgggtgaagccagggaactcccaggactcgctggggaggaagaactcacgctgagcccacgtttgggagggtgggagggactcgctggcctggaccatctagggagagacaaaagggagcctggggaaggttgtgcagacaggggtgcagaaaggtgggtgaggcactccgctctccttcccaggcacgacctctgccagcccaggattctcatgaggacgcagaagtcctggcagggccgcatctccatccctctccttcccggcggaagttatggctgctgcgtatcatcttcaca

SEQ ID NO: 74522 - DNA, 366 bp, Homo sapiens
  chr12:298173-298539
  hyper
cagcagagaggatggcgaattggtgcagggcgaaggaatctgaaagagggctgtgcggtccgcagagagcgaggcttgggagcccgacccaaagcgtgccctccagggtgcagcaccgacgggtgccgcggcgtttgcaggcggggagaaggcggcgggaagtactggactagctgcgggcaggggccggctgaggcgcgcgcccgcgtgctaggggccccgggggagggcggcggggacgcggcgctactcccctctgccacccggcggccgcagacagcgctgcgccggcctcgcgtttttcgttttccgccagacccggcctcgtaactgagagcatctggctgaagccgttgctctccttct

SEQ ID NO: 74523 - DNA, 421 bp, Homo sapiens; identical to SEQ ID NO: 34289
  chr12:29935902-29936323
  hyper

SEQ ID NO: 74524 - DNA, 121 bp, Homo sapiens
  chr12:29936395-29936516
  hyper
cgcagagcggccggtaggacttgtggctggtgttctcggccatgcccttgccccagaagtcgttggtgaagatgccccagcggagcggggcgccgggccgcacgtcggggttgttcacgat

SEQ ID NO: 74525 - DNA, 101 bp, Homo sapiens
  chr12:29936542-29936643
  hyper
cgccctgcagggagcggccgtagcacaggcagcttgccccggccagcagcgccgcggccccggccggcgctagcccgcagccccgccgccgggagggtgtg

SEQ ID NO: 74526 - DNA, 15 bp, Homo sapiens
  chr12:29936661-29936676
  hyper
cgggcagaggtggtc

SEQ ID NO: 74527 - DNA, 367 bp, Homo sapiens
  chr12:29936976-29937343
  hyper
cggttcccccgcacagcccggcgccctctgcccccggcccgccttgcttgcaggtggaccggggttcgcggcgcgcggctgcccgggagctgcggggaaggacaccccaggttcccacttgcggtgtccggctgtgctcacccccacgcccccgcccccatccttctcccccgaatggggctgggaaggggcacatctggcggacccctcccgggggacccaggagggtttagcaggtgcgcagtctggaacccccacacccaccttccagggagaaaagtgccgctgcttcccgggaagttcccggcttttcagcacccgggacaacagcagcggcgcccggagagacgctctccacccgccccgc

SEQ ID NO: 74528 - DNA, 58 bp, Homo sapiens; identical to SEQ ID NO: 11172
  chr12:29937344-29937402
  hyper

SEQ ID NO: 74529 - DNA, 46 bp, Homo sapiens
  chr12:29937496-29937542
  hyper
cgccctgcccgggtgtgttcagaggcgccaccggctctttaacttt

SEQ ID NO: 74530 - DNA, 139 bp, Homo sapiens
  chr12:299633-299772
  hypo
actgcaagaacagtgcggaactagggcaggagctggagatgccatgagagactcggaggaaactccagactgacggcatgcaaaggcttgcctctgtcgttaagcctaaggaaggatcccctaacggaacctccgatcc

SEQ ID NO: 74531 - DNA, 31 bp, Homo sapiens
  chr12:2999407-2999438
  hypo
agtctctggattccctcgtgtgctttagggg

SEQ ID NO: 74532 - DNA, 90 bp, Homo sapiens
  chr12:300471-300561
  hypo
gcacatggccagcaccgcacagtatgagtgagtcaatgaatgaaccgtttgaggtgagaagggaggcagcaataccgtgactacgaatga

SEQ ID NO: 74533 - DNA, 30 bp, Homo sapiens
  chr12:30260329-30260359
  hypo
tatttttatttataacgacttgcagaaaaa

SEQ ID NO: 74534 - DNA, 175 bp, Homo sapiens
  chr12:30322750-30322925
  hyper
agtcccacaactccgcgacacgtcccagccaaggcgcggcggggagccttggacaggagtgcacttgaaggtgagggtgcagagtggccggtgggacttgtggctggtgttctcggccatgccctggccccagaagtcgttggtgaagatgccccagcagagcgaggcgctgggc

SEQ ID NO: 74535 - DNA, 426 bp, Homo sapiens; identical to SEQ ID NO: 3863
  chr12:30323014-30323440
  hyper

SEQ ID NO: 74536 - DNA, 57 bp, Homo sapiens
  chr12:30323502-30323559
  hyper
cgccagcttcgtgatcttctgcccggactttctctcacccgccgggcgctgcgtcct

SEQ ID NO: 74537 - DNA, 112 bp, Homo sapiens
  chr12:30354005-30354117
  hyper
cttcccggaaagcagcggcacttttctccctggaaggtgggtgtgggggttccaggcttcgcacctgctaaacctgcctcgtcacctgggaggggtccgccagatgtgcccc

SEQ ID NO: 74538 - DNA, 20 bp, Homo sapiens
  chr12:30859424-30859444
  hypo
acaagcgtaagccactgtac

SEQ ID NO: 74539 - DNA, 41 bp, Homo sapiens; identical to SEQ ID NO: 43415
  chr12:30947564-30947605
  hypo

SEQ ID NO: 74540 - DNA, 45 bp, Homo sapiens
  chr12:30948625-30948670
  hyper
tgaagtcagtcgggccgcccgcttgctgcacggcagccgtgggac

SEQ ID NO: 74541 - DNA, 20 bp, Homo sapiens
  chr12:30959879-30959899
  hypo
caccgcgcccagcccagaat

SEQ ID NO: 74542 - DNA, 15 bp, Homo sapiens
  chr12:30975310-30975325
  hyper
cacaaaacaaaagag

SEQ ID NO: 74543 - DNA, 551 bp, Homo sapiens; identical to SEQ ID NO: 34297
  chr12:30975388-30975939
  hyper

SEQ ID NO: 74544 - DNA, 110 bp, Homo sapiens; identical to SEQ ID NO: 34298
  chr12:31079258-31079368
  hyper

SEQ ID NO: 74545 - DNA, 247 bp, Homo sapiens; identical to SEQ ID NO: 3867
  chr12:31079417-31079664
  hyper

SEQ ID NO: 74546 - DNA, 245 bp, Homo sapiens
  chr12:31079693-31079938
  hyper
cgcagctcccttcgccgcttccggagcccctggcagggtaagtgcagaagcgcgcccgaggagtgggggcgccgcgggagggggctgggggtccaggagaggcgcctccacctccgctgcccgccccgccggcagtcccgagctagactgtcccgagcttcccccgggcgggcagagggaagccggctggggatgaggagtggaggaggcaggaatgcctgggacactcgcggggcatgtgagca

SEQ ID NO: 74547 - DNA, 30 bp, Homo sapiens
  chr12:31134289-31134319
  hypo
cttcaccactgatggcgccgggctctcttc

SEQ ID NO: 74548 - DNA, 101 bp, Homo sapiens
  chr12:31230802-31230903
  hypo
acgtgtatgttaacttgcgctatccaaacaacaagctgtgcttatggtcctctgcctgtgcgtcatgattttccaggacttcacaacgggataaagtgaag

SEQ ID NO: 74549 - DNA, 174 bp, Homo sapiens
  chr12:31255181-31255355
  hypo
ccaggaacctaagagcgcacaccaggtggagcaggtgctgctggcatattccaggtgcatccaggtgcgggcgtcatgctgggcttgggtctgagatcgtgtgggggtggcagctggaaacgttgtgggtgtcatccaagttttggctcagcaactcagcgtctgggtttctcc

SEQ ID NO: 74550 - DNA, 30 bp, Homo sapiens
  chr12:31744505-31744535
  hyper
ctcccttcccccagccgtcaccccatttac

SEQ ID NO: 74551 - DNA, 105 bp, Homo sapiens
  chr12:3198028-3198133
  hypo
ttggagcagctcaggcgcgggaggctggtggtgggagccagtgttggtctttgaacagtggaatgacaggatgaaaagggacactataggctgggtgtgatggct

SEQ ID NO: 74552 - DNA, 22 bp, Homo sapiens
  chr12:32086687-32086709
  hypo
ttttattttgaaattcggggac

SEQ ID NO: 74553 - DNA, 180 bp, Homo sapiens
  chr12:32087009-32087189
  hypo
agcaaagccagttaccttctcatttctgtgagatgaattcatagtgaaggagtgaaggatgtgccactccaaaatctgctgaattagtatactgattatttaagctaaagacactttagaaactgtagttgcagaaagggcgagctagccaggcatggtggcacacgcctgtgccacagc

SEQ ID NO: 74554 - DNA, 77 bp, Homo sapiens
  chr12:32188978-32189055
  hypo
tcactctgtgaagtacgcatcccatttagggcaaatgacagcctttttaagttaattttgctctttttttttttttt

SEQ ID NO: 74555 - DNA, 30 bp, Homo sapiens
  chr12:32251556-32251586
  hypo
agaaatgaaaacatacgtccacaagaaagt

SEQ ID NO: 74556 - DNA, 27 bp, Homo sapiens
  chr12:32340317-32340344
  hypo
aatctatgggctgggcgcggtggctca

SEQ ID NO: 74557 - DNA, 151 bp, Homo sapiens; identical to SEQ ID NO: 15647
  chr12:32597645-32597796
  hypo

SEQ ID NO: 74558 - DNA, 40 bp, Homo sapiens; identical to SEQ ID NO: 43420
  chr12:32831140-32831180
  hypo

SEQ ID NO: 74559 - DNA, 240 bp, Homo sapiens; identical to SEQ ID NO: 43421
  chr12:32831300-32831540
  hypo

SEQ ID NO: 74560 - DNA, 30 bp, Homo sapiens
  chr12:330158-330188
  hypo
gggggtggcgggagccgagggtcctgctgg

SEQ ID NO: 74561 - DNA, 30 bp, Homo sapiens
  chr12:33047302-33047332
  hypo
tcagcacctgcacagcgcccggcatgaaga

SEQ ID NO: 74562 - DNA, 55 bp, Homo sapiens
  chr12:33048730-33048785
  hyper
atcagacttgcatcacgcccgcactggtgggggtaggaagcgcagctaggcgggc

SEQ ID NO: 74563 - DNA, 64 bp, Homo sapiens; identical to SEQ ID NO: 34302
  chr12:33049326-33049390
  hyper

SEQ ID NO: 74564 - DNA, 244 bp, Homo sapiens
  chr12:33050001-33050245
  hyper
ggtcgcgcacgttgtcggagtcccagcggataccgcctgccggggccgcgccccgctctgcccacgccccgcgctggacaggatggatttccgctcgatgcagggaggggctgccctgcaggcaggtgagccctcgagagtcactcctgttcttggactgaggcttgcctccgggatccccgagcgagtagtatgtctggttagtcaggctttgtcgcactgttggaaacgtttcctggttttc

SEQ ID NO: 74565 - DNA, 30 bp, Homo sapiens
  chr12:33139125-33139155
  hypo
cacgggaaaggggagcgatcaggtccagtt

SEQ ID NO: 74566 - DNA, 345 bp, Homo sapiens
  chr12:33205376-33205721
  hypo
gccaggcctcctggccgccacgcagaatacctcgaatctggcgggctgtgatcgagcccccctgacctgtcagcctcgagcccaacacccgactcggggccgaggctaggctgcccctccctgtgggctcagggtctcctgccggggaggcagccaagagctctgtccacaaaaccaaatctgggtgtcagaggccaagaccccggggtgggatcagggaccatcccctcacggggcataaggtcatttttcccccagagcctggatccctgtcccccacggggcaagctgggtccctggagccctggagtggagcggcgagtcccggggcggtgcctgtctcag

SEQ ID NO: 74567 - DNA, 30 bp, Homo sapiens
  chr12:33205934-33205964
  hypo
gggaccccagcccatcgtgggcgtcgtcag

SEQ ID NO: 74568 - DNA, 38 bp, Homo sapiens
  chr12:3340974-3341012
  hypo
ctctgccttttcacccgctgtcgcgtgcatgcccagcc

SEQ ID NO: 74569 - DNA, 265 bp, Homo sapiens
  chr12:33591748-33592013
  hyper
aaattgtcaggtgcccgacaggttgcagccgcgggttacctcggaggccaaggcagccacctctgcaagggagttctgcgtccaagcatggcttgtccgtcccgcctggcccccatcaacaaggccgggaccagcggccggtggaacgagcgagagcagccctagtcccacaggtgagccgcccccacaagcagccaagccgcgagccgtcccggcgccgtcaccgcccgcactcacttctccactccgggagggagatgggagg

SEQ ID NO: 74570 - DNA, 35 bp, Homo sapiens
  chr12:33592057-33592092
  hyper
cggcgccgggaggcgggaagcggaccagagaatgg

SEQ ID NO: 74571 - DNA, 64 bp, Homo sapiens; identical to SEQ ID NO: 34305
  chr12:33592578-33592642
  hyper

SEQ ID NO: 74572 - DNA, 205 bp, Homo sapiens; identical to SEQ ID NO: 34306
  chr12:33592643-33592848
  hyper

SEQ ID NO: 74573 - DNA, 102 bp, Homo sapiens; identical to SEQ ID NO: 34307
  chr12:33592932-33593034
  hyper

SEQ ID NO: 74574 - DNA, 40 bp, Homo sapiens; identical to SEQ ID NO: 11185
  chr12:33593092-33593132
  hyper

SEQ ID NO: 74575 - DNA, 33 bp, Homo sapiens
  chr12:3414273-3414306
  hypo
cacttttgtgatcatcgtcgtgtgaatgcaggt

SEQ ID NO: 74576 - DNA, 195 bp, Homo sapiens
  chr12:3419740-3419935
  hypo
ccgactccctgctgccgcccagaacctagagggagtgaggtgctgcagcgtctgtaactgaacgggagacccaggccgctggcagcagggagggctgcatcctggcatctcaccaccttccttctattaccaccatgggctgggagtcaggcccagaagatagtcctgaagaggtggcagcgtcacgctgctccc

SEQ ID NO: 74577 - DNA, 34 bp, Homo sapiens
  chr12:3421073-3421107
  hypo
tgattaaggtgtgggcgtgcgctgtcttacaaag

SEQ ID NO: 74578 - DNA, 30 bp, Homo sapiens
  chr12:34261260-34261290
  hyper
ggctgccacagggaccgctcgagatccgaa

SEQ ID NO: 74579 - DNA, 30 bp, Homo sapiens
  chr12:34358492-34358522
  hypo
agggggagagcagcccggcagggggcgagt

SEQ ID NO: 74580 - DNA, 43 bp, Homo sapiens; identical to SEQ ID NO: 43423
  chr12:34362659-34362702
  hypo

SEQ ID NO: 74581 - DNA, 105 bp, Homo sapiens
  chr12:34364426-34364531
  hypo
cccccccagtctcggcgcagaggctgccgggaaggcactgtggtccgtgggagtaccccggcccaccgctttttccccttgcagcctcaacgtcccctttcaagc

SEQ ID NO: 74582 - DNA, 30 bp, Homo sapiens
  chr12:34463923-34463953
  hypo
acccatggtgcgtgtcgtgctcacggggac

SEQ ID NO: 74583 - DNA, 90 bp, Homo sapiens
  chr12:34464013-34464103
  hypo
gctggtgcctctccctccctttcaagccttatcttcccttctgggtcttcttgccactttgggctgcacgccgcgcgtgccacacgctct

SEQ ID NO: 74584 - DNA, 58 bp, Homo sapiens
  chr12:34471693-34471751
  hypo
ggatccttggggtaccgagctggggctgctgggaaggcactttcgtcagtgggggacc

SEQ ID NO: 74585 - DNA, 30 bp, Homo sapiens
  chr12:34472580-34472610
  hypo
gaaggcacttttgtccgttgggcgacccag

SEQ ID NO: 74586 - DNA, 115 bp, Homo sapiens
  chr12:34474495-34474610
  hypo
ttttttccatccacacgtgctccacctcacctttcaagccttatcgtcccttctgaaccctcttgcccctttgcggtaatgccgttgtcgcgacatgcaccgtgggtgtgaacca

SEQ ID NO: 74587 - DNA, 36 bp, Homo sapiens
  chr12:34478137-34478173
  hypo
acattggggtacacccgtgggcgcgacacacaccgt

SEQ ID NO: 74588 - DNA, 81 bp, Homo sapiens; identical to SEQ ID NO: 43427
  chr12:34494888-34494969
  hypo

SEQ ID NO: 74589 - DNA, 30 bp, Homo sapiens
  chr12:34501815-34501845
  hypo
tctccaccggtgcctcgacctcccctttca

SEQ ID NO: 74590 - DNA, 268 bp, Homo sapiens; identical to SEQ ID NO: 43428
  chr12:34502619-34502887
  hypo

SEQ ID NO: 74591 - DNA, 136 bp, Homo sapiens
  chr12:34519267-34519403
  hypo
ctggccctggtggaccgtaggcactccgtggccatgagtcagggatgccaagggtcccctgggccccgcgcatgctcagtagagaggcaatgcctcccatgttgggggacctctgcctcgccgtttgtgttttcct

SEQ ID NO: 74592 - DNA, 113 bp, Homo sapiens; identical to SEQ ID NO: 43430
  chr12:34520137-34520250
  hypo

SEQ ID NO: 74593 - DNA, 65 bp, Homo sapiens
  chr12:34522274-34522339
  hypo
acatagatgccaacccgggatgcccaaggtttccagggatccacgcattgcggtggggaggcact

SEQ ID NO: 74594 - DNA, 38 bp, Homo sapiens
  chr12:34527377-34527415
  hypo
tttccctaggccccacgcatgtacggtggggaggcaat

SEQ ID NO: 74595 - DNA, 785 bp, Homo sapiens
  chr12:3474882-3475667
  hyper
gggacagccatgtcccgggagggcacacggcccccagaggcccagagctcttcccaaggcacaagtgcagaaggcggactcaggcgtgtggttaaggaccccctgctgcgggcccctgcacacaccaacgcgtgctcccacgcgccgcgactcccccgggatgcctgccccacccctatccgcagccagcgtccccctgcccgccggccccgccacggtccatcagggactgcgggcggcggaggtggcggcgccttgccgggacccccagcctccctcccccgcccccggcgccccaccccacgcgggcgcgcttctcccgccgcagccgcccgcgctcacctggcccggacacgggctccgccacgcggtgatggaagctgagcctagagaggcggagagcggcggctcgcagggccacccagcggcacacggcccgcgcctcggcccgccccttccttgccggccgggggagtgtccgcgcgcctccagcccgccccgcgccccgctgcggtgcccagtgcccgccgtcctcacctggccagcgggacgcgcccgggaaccccgcacgcgggcgggccgcctctttgttagcaagtttgcctttctgtgattcagagcacgcggagcgaattaagtggagtgaggggtactgtgcgactgtctgcgggaaacctgcggggagcgcgggaagggatggacttgatgagccgcggcgcagcggctttcaaacctccccgcgctccgcagcccccagcccccgccctacccgccctctcagatcc

SEQ ID NO: 74596 - DNA, 106 bp, Homo sapiens
  chr12:3562914-3563020
  hypo
tgtcctgacgtggcccgactgtggacccccttgtcctcctgcccgctgtgtctatttctcagctcctgctatgctaggtctgggcttccgacgccggccctgctcc

SEQ ID NO: 74597 - DNA, 256 bp, Homo sapiens; identical to SEQ ID NO: 34207
  chr12:3599973-3600229
  hyper

SEQ ID NO: 74598 - DNA, 304 bp, Homo sapiens
  chr12:3600230-3600534
  hyper
gagactaggggagggggcgggcccgggggcgctgggggccctcggtctgcgcccagccgccgccggctccagcgaacctcctaccccgcccccactcacccggctcagcccctaggagagacgcgcaggaagcgtgttgcttcgcccagcggatcggcagaagttgagaggagttggcggctgcctccggccggccggactttgcgagcagcctggagaggatccgcgaccgccgccgccgccgccgcggaggcttcggggctgcttccctcgagcttagcccgcagcgcgggtggagaggggc

SEQ ID NO: 74599 - DNA, 15 bp, Homo sapiens
  chr12:3600768-3600783
  hyper
tcaccaaacccttgc

SEQ ID NO: 74600 - DNA, 8 bp, Homo sapiens
  chr12:3600974-3600982
  hyper
cgctcgct

SEQ ID NO: 74601 - DNA, 214 bp, Homo sapiens; identical to SEQ ID NO: 34211
  chr12:3601042-3601256
  hyper

SEQ ID NO: 74602 - DNA, 147 bp, Homo sapiens
  chr12:3601478-3601625
  hyper
ctcagatatcagagccgcctctgggtagctaaacccggcagggcacacgggccgcggccaccttcagcaccagggacagcgtccgcccctgcagcagccgagcctgcgcggactgtgggggctgcgcgccgccggctgcagtgagaa

SEQ ID NO: 74603 - DNA, 696 bp, Homo sapiens; identical to SEQ ID NO: 34213
  chr12:3602021-3602717
  hyper

SEQ ID NO: 74604 - DNA, 97 bp, Homo sapiens
  chr12:3602864-3602961
  hyper
cgctcccccttctcagcagttgcacatgccagctctgctgaaggcatcaatgaaaacagcagtaggggcggccgggctcctgcgaacaacaacaaaa

SEQ ID NO: 74605 - DNA, 37 bp, Homo sapiens
  chr12:3640833-3640870
  hypo
tgagggcggccttcgcgtcaagcgtctcagtgaccct

SEQ ID NO: 74606 - DNA, 113 bp, Homo sapiens
  chr12:3724027-3724140
  hypo
gactatccctttggccgccgcagaacaggggccaagaaagattaactaccccggtggcacctgagtgctgtacctttggcctgcaggaagccgcaagtcgagccctgcatagt

SEQ ID NO: 74607 - DNA, 40 bp, Homo sapiens
  chr12:37937804-37937844
  hypo
ggatgaagaaacccccggcgaagtccgtgggaagcaccac

SEQ ID NO: 74608 - DNA, 148 bp, Homo sapiens
  chr12:38471923-38472071
  hypo
atgatgtcggcagagcgatatcaacaagagtgattataaagtagctggccttataagtcaagagttatgatctttgatccactgctcaatcaatttcaagatctgatctacattcttttcttttctttcttttttttttctaggctgg

SEQ ID NO: 74609 - DNA, 183 bp, Homo sapiens
  chr12:38543382-38543565
  hypo
aggcttgacctgagacgcaggggcattgtgcgggtggctggggatgcccttcctggcccagcggcaggccagtgcaggtcctggccatctgaggcatctgctgaattattttccaagtccctggtggagtcagggaccatcctgcactgtcctctggttaccaaggagcggtcacagggccca

SEQ ID NO: 74610 - DNA, 30 bp, Homo sapiens
  chr12:38548005-38548035
  hypo
ctgcgctggcctcagcgaggtcgtggagtc

SEQ ID NO: 74611 - DNA, 30 bp, Homo sapiens
  chr12:38548938-38548968
  hypo
gaagttgaggcagcacggggaaaaaagcag

SEQ ID NO: 74612 - DNA, 98 bp, Homo sapiens
  chr12:38549408-38549506
  hypo
tccctgcagcccctgcgccgggcccgggggagttgtggagtccctgtcttataccagggtaggtttctcgcccatggcgggggcgcatcccaaagcgg

SEQ ID NO: 74613 - DNA, 60 bp, Homo sapiens
  chr12:38550213-38550273
  hypo
agtacagtggctccccgacaggccctgcgccgggtctagagaggtcgtggaatccctggc

SEQ ID NO: 74614 - DNA, 236 bp, Homo sapiens
  chr12:38550662-38550898
  hypo
attgcacccagggtgcgtgtcgcccccacggcgggcaccccaaagcgtcaagaatgaccccacgggaaggggaaagcatgtcggtcttaaagagggacgttgaggcagcccggagaaaaaaacagggaggctggggtccttccaccgatgacagtgccttcccggcatcccatgtgccatctccgggcgggtcgtggagtccctggctttcacccagggtgcgtgtatctcccatt

SEQ ID NO: 74615 - DNA, 152 bp, Homo sapiens
  chr12:38551153-38551305
  hypo
aggcgtgaaaggtgacgttgaggcagcacgagggaaaaagcagcaggcagcgatcgtcacacggacgacagtgccttcccggcagcccctgcgccagactcggggttgtcgtggagttcctgacttgaacccagggtgcgtgtcgcgcccac

SEQ ID NO: 74616 - DNA, 92 bp, Homo sapiens
  chr12:38551365-38551457
  hypo
aaaggggactttgaagcagtccaggaaaaaacttcccacggaccacggtgccttcccggcagcccctttgccaggcccgagggggttgttgt

SEQ ID NO: 74617 - DNA, 234 bp, Homo sapiens
  chr12:38551828-38552062
  hypo
cccctgcgtcaggcccggggtggtcgtggagtccctggcttgcaccgagggtgcgggtcgcacccatgggggcaccccaaagtggcaagaaggccgccgggcgaacgccacagaaggccaggctttaatggggatgctgaggcagcacagagagaaaagcggctagtcgggttcctcctacggatgacagtgccttcctggcagtccctgcgctgggcccggggggatcgtgga

SEQ ID NO: 74618 - DNA, 36 bp, Homo sapiens; identical to SEQ ID NO: 43437
  chr12:38553830-38553866
  hypo

SEQ ID NO: 74619 - DNA, 54 bp, Homo sapiens
  chr12:38554204-38554258
  hypo
atgacagtgccttcccggaagccgctgcgcagggcccggcgtgtttgtggagtc

SEQ ID NO: 74620 - DNA, 80 bp, Homo sapiens
  chr12:38595481-38595561
  hypo
tgttggtagcggcagtggtggggctggcgcccctgcgttgcggcccctgggctccctgccagggacgcagtggaactggc

SEQ ID NO: 74621 - DNA, 34 bp, Homo sapiens
  chr12:38836094-38836128
  hypo
cacacccagtcccatcgaccgcccaagactgagg

SEQ ID NO: 74622 - DNA, 17 bp, Homo sapiens
  chr12:39142109-39142126
  hypo
aacgcaatactattaat

SEQ ID NO: 74623 - DNA, 131 bp, Homo sapiens
  chr12:39298556-39298687
  hyper
tgtactgagccactgcgcccggccgagagtcagtttttacaagcactcagatgtgggcccgaaaacaaatcaaaacaaaagtcgtgacttcccagatcttaggtaaggcatagattcgtctgcaaggaggg

SEQ ID NO: 74624 - DNA, 194 bp, Homo sapiens
  chr12:39298908-39299102
  hyper
cccaaccatccagcccgggtttggggcggaaaaccggcttgtaaagtgggcggcggccggtgttcccacagctgagtcacagcccagccaacttttacagcgtttcccagaaagaaaatacaaagtctcagtcccggagcccaccgcttctaattcccgctcccctgtgtcacctgacccggggtaactccagc

SEQ ID NO: 74625 - DNA, 640 bp, Homo sapiens
  chr12:39299368-39300008
  hyper
cccacaaccacagctcgggcggactgagggctagctcccgtcaggcggggatgggggttgagggtggaggcagaagaaggaggcggaggcagcgcgcgggatgggggagggaagggaggaggcggacctccgcgcagagccacgagggaaccgctagccagtcctgggtgaaactgacgctgccaggcaagtggcgcgcggggatcccggtttcccagcccccttccggcaggcagcagcccgggcgggggacacactccgtgatcccctcctggctggaggggtcaggcttggtggacccagcaagcagcctgatggagaaggtggcaccagacgcagacccctaccgtccaggaccgcaagccctcgccggctctgcgtgcttttaggttttgtctccacctctgcacacccacactcgcctcctgggccgcgacagcttccttctgtcaatcaggtgtggacgggaaggtctcgaagtttcctcgcctgagttgaaagctggaggtgggggcacctctgcccgttcctaactgccccgttataaggtccccctccccacaattggttctcacctcgccctcggagctcttgggagatccctccgtccctcctactgtgccctcgggcagatgagtct

SEQ ID NO: 74626 - DNA, 75 bp, Homo sapiens
  chr12:39300330-39300405
  hyper
gtcacaaccatataacgcagctccttcagccgactcccacccgcaagaactgagacctgacggataaaagcagag

SEQ ID NO: 74627 - DNA, 30 bp, Homo sapiens
  chr12:39300876-39300906
  hyper
gatttccccacccaccgctttttcttcttt

SEQ ID NO: 74628 - DNA, 189 bp, Homo sapiens
  chr12:39539283-39539472
  hyper
cgccgccccggaaggtcgcgaactcgccgcctccagcgccggcgccttaaccccgccggtcccggcgccaaagtcccgacagtggcggacgccggcaccaggggcgatggagagcaggcgacaccgagggtgtccatccggtccacccaacctggtgcaaggctctgggaagcgcgctgacaggatttc

SEQ ID NO: 74629 - DNA, 33 bp, Homo sapiens
  chr12:39726877-39726910
  hypo
atgggtcttacttgccgacgaagagccgtaacc

SEQ ID NO: 74630 - DNA, 205 bp, Homo sapiens
  chr12:4018922-4019127
  hypo
ttaaagagaaatgggcgaaattaaatatttgtatcatttcgacatgtaatcaatacaaaaatgaatgagatgttttatttttttaatactgcatcttcaaaatctgttgtgtgtttttcactcacagcgcagcttaacttggactcaccacctatcaagtgctcgacagccacgtgtgcagtggttcctacgtggagcagcatac

SEQ ID NO: 74631 - DNA, 60 bp, Homo sapiens
  chr12:40501737-40501797
  hypo
acagttatgtatctgcggtcaggttacattttaaaagaaatgtgacgtgaaaaaaaaggc

SEQ ID NO: 74632 - DNA, 18 bp, Homo sapiens
  chr12:4051745-4051763
  hypo
aaccgtgtctccaaaaaa

SEQ ID NO: 74633 - DNA, 35 bp, Homo sapiens
  chr12:40540758-40540793
  hypo
tcctggagagccatgcgtggtggcgcatgcctgta

SEQ ID NO: 74634 - DNA, 34 bp, Homo sapiens
  chr12:40540853-40540887
  hypo
gggcgacagagtgagaccccgtctctaaaaaaaa

SEQ ID NO: 74635 - DNA, 708 bp, Homo sapiens
  chr12:40618340-40619048
  hyper
agttcccagaccttccgtggggccgcaggatccccggctggcgggtcgcggagggtggccggccgggctgcgcactgcgcgcctccgctgcggggctccgggcctgtggactcagcggagtccgctgagtcagtttcttcccgcgcgactcccggccgcgccgccgctgcggtggaatctggtcccaggaggcggcgtccgcccggggtccggtctaggcgtgcgtgggggccacggtcacggtcatcccagccaggcccggctccagcagccccacggccgccgccagagttctgcgcggcccgtcgcctcggcggagcctctggcaggcccctgagctcgtttttggggcctgagtgggggaggaggaagccgagcaggagggctccggagagggagggcaacgcggggcggggagctgcctccttcctcataaacaggcgggcgtgggcgccgatggggcccgcggggagcgctggctgcgggcggtgagctgagctcgcccccggggagctgtggccggcgcccctgccggttccctgagcagcggacgttcatgctgggagggcggcgggttggaagcaggtgccaccatggctagtggcagctgtcaggggtgcgaagaggacgaggaaactctgaagaagttgatagtcaggctgaacaatgtccaggaaggaaaacagatagaaacgctggtccaaatcc

SEQ ID NO: 74636 - DNA, 32 bp, Homo sapiens
  chr12:41012036-41012068
  hypo
ttacaggcctgagccaccgctcccggctgtga

SEQ ID NO: 74637 - DNA, 45 bp, Homo sapiens
  chr12:41086182-41086227
  hyper
tttccctgtggtccccgccccactttccctgctgccccaataacc

SEQ ID NO: 74638 - DNA, 226 bp, Homo sapiens
  chr12:41086228-41086454
  hyper
ccctaaaaggccgggcttctgctgtcaagtagccagggtgggctccgccgaggcgaggaggggcgccggtggggagatgcgctcccaggtgtttgcagcggaagtgggaaacctgtagggtatggtccagctgtgccgcaccgaggcgagcaggagcagggaacaggtaggaagctggacttttccttctttgcagataaaataaagaatgcgcatttccatgctg

SEQ ID NO: 74639 - DNA, 393 bp, Homo sapiens
  chr12:41086713-41087106
  hyper
ccagggatgccatatcgcctcggcaggggaggggtggggaagcagagaggtcggcagcccggggcctgcaggtctttttctcccgacgccggcccgcacctgctcatctttcccatcccacctgggcgcctggctagcgcatcccggaaaacctgggagcggttgcggagaggggaggaagcgacttgtttgtcccctgacccctctgttaagatctagctcccttcaggagatgggggtggggaagaatccctgcaactcgaagggcacgttccgattaattacgtctccgttgagaaggcaccggcccttctccacgatctgcggcaggtgggagggagagaccgcggagccacggccccttccctcctagcctggcgctgtctacgggaa

SEQ ID NO: 74640 - DNA, 349 bp, Homo sapiens
  chr12:4140405-4140754
  hyper
actgcctgagcctcccgcccgcccgccgcgcccccgcccggggccgggaaacgagcagggacaactccccgcccgcgcctccccgcgcccggcggcccggctagcaacccagaggcgcggcgctgcgattggctgcgcgggggagaaggggcgctgcgctgctccaatcgccggccgcgcccggaggccgcgccgccaggaggccgcggacgcgtgctcgcatgcctgtggtatttgctcagaggggcatgaccacttcgggcaagcctttaaatgtgagtcagctttcggccgatccctgggaaaaattccttcggtgttgtcaggcagggttcgctagctgcagctt

SEQ ID NO: 74641 - DNA, 46 bp, Homo sapiens
  chr12:4154674-4154720
  hypo
acccccaccacttgccgtgtcagatgctgcgcgggagccgagctca

SEQ ID NO: 74642 - DNA, 979 bp, Homo sapiens
  chr12:41582398-41583377
  hyper
cggaggcgccggtgcccgctgcagtgccagcccttggcgcccggcgagctgtaccgggtgctgccgctgcgcagcctcatccagaagctgcgagtccagtgcgactaccgcgcccgcggctgcggccactcggtcaggctgcacgagctggaggcgcacgtcgagcactgcgacttcggccctgcccgccggctccgcagccgcgggggctgcgcttcggggctgggcggtggtgaggtgcccgcgcgggggggctgcggtccgacacccagggctggccggggcgggggcgcgcgcggggggccgccgggcggccgctggggccgcgggcggggacccgggcctcgggtcctcgcctggaggcggcgcgagaaggcgctgctggcgcagctctgggcgctgcagggcgaggtgcagctcacggcgcgcaggtaccaggagaagttcacccaatacatggctcacgtccgcaacttcgtcggcgacctcggtggcggccaccgcagggtaagcaaaggggggtgggcaccgcgggcatggtcgattggggtgggaaaaggagcggttctttctgacgcttcaggattcctttggaattgggcatccttcctcactatgcagcaggaaacatccacaccctgatcatactttcctgtcattatcttacgaatggattggcgtcgaagttaaggattgtcccttttctgattatattacgattggaaagagttaaacagattcgattctaactttcccccgggaaagtaggaattgtgaaaactcattttccatccagactctcgttttccatctttcaccctcctgcccaccgtctctgcctattttttgagcacttgtcccgtgcctgaagcaaatccgagaaggaaagacagaaagcgaagactttcccggcccagcctttcctctcccgcggccaccagcatccccgcggccctggcagccgcgcacgcacacctgg

SEQ ID NO: 74643 - DNA, 145 bp, Homo sapiens
  chr12:41583648-41583793
  hyper
gtcagaccggccctgcgagcccccaggcagcggttgtttcccttctttgtctaagctgctggccccgaactgcgctcctggtcctcccgccggctttcataccgaataaacaagcctctttgcagcatcccgtgtgaagaggctt

SEQ ID NO: 74644 - DNA, 164 bp, Homo sapiens
  chr12:41584085-41584249
  hyper
tgtgtattaaacgaccggtttcaaggagtatttctctagttcatatatgcatatacatatacgcatatatacaggtaaatttacaaaacgggaggacccggggaaaagcacagatagaagctttgtattaccagtccaggtttcaaggtcgtaggaaaccaatg

SEQ ID NO: 74645 - DNA, 30 bp, Homo sapiens; identical to SEQ ID NO: 43440
  chr12:41925162-41925192
  hypo

SEQ ID NO: 74646 - DNA, 30 bp, Homo sapiens
  chr12:41934689-41934719
  hypo
gttgtcccttttcttcgttgttgttgttgt

SEQ ID NO: 74647 - DNA, 196 bp, Homo sapiens; identical to SEQ ID NO: 43325
  chr12:4194712-4194908
  hypo

SEQ ID NO: 74648 - DNA, 30 bp, Homo sapiens
  chr12:41957024-41957054
  hypo
ttccattactctgagcgaagaaagatgaac

SEQ ID NO: 74649 - DNA, 30 bp, Homo sapiens
  chr12:42047159-42047189
  hypo
tcaggtgcattagtccgttttcacactgct

SEQ ID NO: 74650 - DNA, 30 bp, Homo sapiens
  chr12:4206588-4206618
  hypo
ttggagccaggcctacgtgccagccaccat

SEQ ID NO: 74651 - DNA, 165 bp, Homo sapiens
  chr12:4212424-4212589
  hypo
atccaaaacaaggaaagtctgagaaactctcacagacaagaaaggctggcaaagaaaagtaatgtggtatccagagccagaaggacagtggggcaaactagtaacatgcaaatcaactgcagagtttagttagtaccagtgcgctggtgccggctccttagttgt

SEQ ID NO: 74652 - DNA, 148 bp, Homo sapiens
  chr12:4214009-4214157
  hypo
ataaggcttttatctttaattaattcatgcactcatgcatgacattacttgttattagagttagacaaggaatagcatccattctattcatacttttcatttttatagaagtaatgctgggaaaccttgttcacgtaaataagtttgg

SEQ ID NO: 74653 - DNA, 125 bp, Homo sapiens
  chr12:4217500-4217625
  hypo
cccacaatggaggaccgggtcccctcaggtttgccgaacagaccataaagcttgttaaccttggctgggcgccgaggcaggataatcctaatttcttggcactccctacacggatgcccatggat

SEQ ID NO: 74654 - DNA, 35 bp, Homo sapiens; identical to SEQ ID NO: 34320
  chr12:42326337-42326372
  hyper

SEQ ID NO: 74655 - DNA, 126 bp, Homo sapiens
  chr12:42326595-42326721
  hyper
taactacaaccattacgggctccttgccgacagcacgcccacctggcatccctgcactacacctttgcgcgcaccgggcccagccggcccagtccctcaagcatcagtagacggaaaatgctcctg

SEQ ID NO: 74656 - DNA, 23 bp, Homo sapiens
  chr12:42443414-42443437
  hypo
ttcctattcggccatcttggctc

SEQ ID NO: 74657 - DNA, 24 bp, Homo sapiens
  chr12:42654216-42654240
  hypo
gataatagtacttgccgggaggcg

SEQ ID NO: 74658 - DNA, 83 bp, Homo sapiens; identical to SEQ ID NO: 43442
  chr12:42654300-42654383
  hypo

SEQ ID NO: 74659 - DNA, 84 bp, Homo sapiens; identical to SEQ ID NO: 43327
  chr12:4268526-4268610
  hypo

SEQ ID NO: 74660 - DNA, 17 bp, Homo sapiens
  chr12:4272614-4272631
  hypo
agcgagactctgtctca

SEQ ID NO: 74661 - DNA, 15 bp, Homo sapiens
  chr12:4273871-4273886
  hyper
gcggcacccgggcct

SEQ ID NO: 74662 - DNA, 419 bp, Homo sapiens; identical to SEQ ID NO: 34216
  chr12:4274001-4274420
  hyper

SEQ ID NO: 74663 - DNA, 30 bp, Homo sapiens
  chr12:4274474-4274504
  hyper
cgcatcccccatacccgtcctaactcactc

SEQ ID NO: 74664 - DNA, 87 bp, Homo sapiens
  chr12:4280838-4280925
  hypo
gggtaatttttcctccgtcaccccctcccaccctcccaccttttgcagcctccagtgtctgttatgctactctgtacgtccgtgtgt

SEQ ID NO: 74665 - DNA, 30 bp, Homo sapiens
  chr12:4286260-4286290
  hypo
aggcatgagccaccacgcttggctttatgc

SEQ ID NO: 74666 - DNA, 76 bp, Homo sapiens
  chr12:42970333-42970409
  hypo
attaccatctgatagcgtttgatctttgagtcatggctgaagtgacccagattcaaactggcgattattaatgtca

SEQ ID NO: 74667 - DNA, 863 bp, Homo sapiens
  chr12:42983011-42983874
  hyper
caaacaggagccatgcggagagcctctgcggagccctggcgatgctgcagccaatatctgctttccctgtctacacagcccaacaaaccgattatgaccttctccctgatcttctgcgacaccgacccagtctgggtgtcacagactccggcggtgccagcgaaggtgcccggccctacccctgcggcgctcgccccccaccaccgcgccgcagccccctctgcggaatccgccgggatccaggctgccactcacctcgcgcgagggagacgcaactcggctgcactgtcctcggcgccgctgcggggctgctgggctgcggggctgcggggctgaggagctgcggtccgcggcgtcaggggtgggcgagggtgagcagcgcacgaaccatccagagcccagaaagtctccgtgccgaccgcggcgcgtctcggggaagtcagcgcaggctgcgcgaggctggcatgttccgggcgcgctgtcgggcggcggcggccgcgggagacggcgctggcagctgggctgcaggcggagtgcgctcgggctccggagccgcgcgctgcggcgccgccgcgcaccccgccctcggccgcggggcccggcgcgagcgaaaacgcggagcgcggacgccgccgcgggatcgaggccgctgggcgcgcgcccacgcgtaccccggctcggccctgaaagcgaggtcgggcccggctcgggccgcgcccgggggcagggctgcgagcaggcctgggaccggctccacgcgcagccagtggggcagagcagcaggcggattatgcgcagggagaaaaaagttcaccaaccgcggtccagagtcgcaagtgcggctcgctcggagcctctgcccc

SEQ ID NO: 74668 - DNA, 42 bp, Homo sapiens; identical to SEQ ID NO: 34323
  chr12:42984438-42984480
  hyper

SEQ ID NO: 74669 - DNA, 101 bp, Homo sapiens
  chr12:4301350-4301451
  hypo
accgcacctggttggttgcagactttgaatatcaccctgcatgccaatacctacaggcgtgtctcacttcatttatatcgctgtgtcgtgttcttgagcat

SEQ ID NO: 74670 - DNA, 30 bp, Homo sapiens
  chr12:4307938-4307968
  hypo
gacatttagactattcgagggcactggatg

SEQ ID NO: 74671 - DNA, 34 bp, Homo sapiens
  chr12:4309680-4309714
  hypo
accaagatggagagccgtgcggtgcagcgtggtg

SEQ ID NO: 74672 - DNA, 30 bp, Homo sapiens
  chr12:4315483-4315513
  hypo
agaaatcttacttcacggtataattacagg

SEQ ID NO: 74673 - DNA, 36 bp, Homo sapiens
  chr12:4322949-4322985
  hypo
ccaaagtccacctaccgcctgcgaggacatgtattt

SEQ ID NO: 74674 - DNA, 30 bp, Homo sapiens
  chr12:4334601-4334631
  hypo
catatcgagcggccacgttttcagaggagg

SEQ ID NO: 74675 - DNA, 30 bp, Homo sapiens; identical to SEQ ID NO: 43330
  chr12:4356247-4356277
  hypo

SEQ ID NO: 74676 - DNA, 30 bp, Homo sapiens
  chr12:4358486-4358516
  hypo
gactcggaacatggccgggcatggtggatc

SEQ ID NO: 74677 - DNA, 30 bp, Homo sapiens
  chr12:4362436-4362466
  hypo
cctcacgtaccctgacgaaacgtccttttc

SEQ ID NO: 74678 - DNA, 190 bp, Homo sapiens
  chr12:4373080-4373270
  hypo
gggtccattccaaaccgtgtctatatgcgctctgatgggggctctgtttgaattgtaggaataagctttaggttagtttaagctttaggttaaactaacctgctaagatttccttaagcaccctggagcagtgttatagtccatatattcttatgctctctatatttttgaagaccgctattctattaac

SEQ ID NO: 74679 - DNA, 664 bp, Homo sapiens
  chr12:4377894-4378558
  hyper
gagtgggaagggagtcgccctacatgttttcacatcgatttgtaaaactgttttgaaagggtatttctagatccatttgttccaaatgcagcaaaattcatccgatatcgctcacaatgcatgcacgggttatcttacatgtaatagccatcgtattaaccaacccagctgatactgagatggtgaatggggcgggggagcagggaggaatatgtcgcgcatgaaaaactccgggtgtaaaagtcaatgcagaactcactccccgaggaaccgaaaaagacattcacgactctcaagtggagagaggatagaaagtcaagtggcgggggtcgcgaccagtgatcgggatttcagtctgatctcagtacccagcggaacaggaccataacctaaagaaatgagctttttccggagcaaagagcggccccgatttcaaagtagaaaaaataaactgcttgggggtggaagatggcgaggggcggggggcggggagggaggcgggtcgcggcgctggctccggggtccgcggcacggcctcctctgccgcgctgcccagggcccggaccctgcccggcgctgcgcccaccgcgagggtgccagacccgccgcgccgccgccgcgctctcccagccgcggccccctcccccgccgcttcctcttgctc

SEQ ID NO: 74680 - DNA, 1118 bp, Homo sapiens; identical to SEQ ID NO: 34218
  chr12:4378802-4379920
  hyper

SEQ ID NO: 74681 - DNA, 30 bp, Homo sapiens; identical to SEQ ID NO: 34219
  chr12:4380166-4380196
  hyper

SEQ ID NO: 74682 - DNA, 553 bp, Homo sapiens
  chr12:4380480-4381033
  hyper
cttcttcctcgcccccgctgcccccacttcgggagacccagagctctggatgcctttccccggagaagggggggtgtgcggagtcggggtggaagagaccttgctcgcagagctatatcaagtgatgtccagaggctgggagccccggcggcctctgtcccttgcctgtcgggttagatttatactttaaaaatacctcccgccctccctccttctctcgcctctccccgctgcaactttctttgatccgctcaaaggtggcttaggtgaaattggagtaattcccttatgggggtcttaaaatgtaagtgaatgtccttatccggggtgactcaaaagcttaagtcgggaagcccaacgtgactaaaaccaataggtgattgttcggggccgactgtgtgcgggtgtacacggtattcggcccgggtgtcatccgcggcgctggactgtttcattttgagtttgcaacttgggtttttcagcgagctttttttcttcctgaaagctaatggcttccacagcaattagacattttcctcgcccgccccttccc

SEQ ID NO: 74683 - DNA, 637 bp, Homo sapiens
  chr12:4381802-4382439
  hyper
cgacttcaccgcagtcggctcccagggagaaagcctggcgagtgaggcgcgaaaccggaggggtcggcgaggatgcgggcgaaggaccgagcgtggaggcctcatgcctccggggaaaggaaggggtggtggtgtttgcgcagggggagcgagggggagccggacctaatccctcactcgccccctccccctcccgggccatttcctagaaagctgcatcggtgtggccacgctcagcgcagacacctcgggcggcttgtcagcagatgcaggggcgaggaagcgggtttttcctgcgtggccgctggccgcgggggaaccgctgggagccctgcccccggcctgcggcggccctagacgctgcaccgcgtcgccccacggcgcccgaagagcccccagaaacacgatggtttctgctcgaggatcacattctatccctccagagaagcaccccccttccttcctaatacccacctctccctccctcttcttcctctgcacacactctgcaggggggggcagaagggacgttgttctggtccctttaatcggggctttcgaaacagcttcgaagttatcaggaacacagacttcagggacatgacctttatctctgggtatgcgaggttgctatttt

SEQ ID NO: 74684 - DNA, 851 bp, Homo sapiens
  chr12:4383208-4384059
  hyper
ggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtaggtcggggggtggcgctcgccaggagccaggacccctccggatgctcgggtccccggccggagccctaaacctgggagagggcaatccccgcgccggcctcccggctcctgtgcgggagtttaccgcgcgccttctggcgagacgcgtggctttatttctgttcctctccagataaactggggaggcagaggggggaggaaaatctgggagaagcgaggctgtcctgggcgggggtaggggagcatcccgcgcgcgtgttcctgcatgtggctgcctcttcttcccacccccctcgcgacctgtcttttgcgaagccgccgcggctgcttgcgctgcggccaggaagagagtcggggcctgaaatcgggaccccgagtagaaaggcaaccccccccaaaaggccagagcaaattcgtcttggcctcaggtccccgcctgtggtcgcgactccgcgctggcacttcaccggggaggtggagggaggagggagaaggagagaaacggggaattcgggagccccggaagtcccattgaagaaacgcgtgtttcaggggaacccaaaagaaccgcttcttgcccctcactccaagtctttgcccagcgagccgtgtgcccacgtatgcacagctctggacctgccgtggtttcgccatg

SEQ ID NO: 74685 - DNA, 220 bp, Homo sapiens
  chr12:4384313-4384533
  hyper
agggctctctgctcccgtctttcccctcgctcgtcaccgcgttccctagtttctgtccttgtgggccgcagccggacactcccgccgcggcgctcaccccttcaagtttcctcccgggatccaaagccccaggggtcggaatacagacctttctggcacccgaaacctctgtttcgggaagcctggctcttctttggggttttcacgccaaaagggcttt

SEQ ID NO: 74686 - DNA, 30 bp, Homo sapiens
  chr12:4390499-4390529
  hypo
acaaacaccgaaggccgcttttcttgaagg

SEQ ID NO: 74687 - DNA, 229 bp, Homo sapiens
  chr12:4391671-4391900
  hypo
tagagtgggagatttcgccttgatgggtgctgggaaggaagaatggaaacccgtctttccatctgcaagtctctgagctacccctgaagccgcgaggtcatgggactgagggggagtcgttagcatgccctgtggggacaagcagccaggcagtgtggtgcttgccatcgctcttccctctggctgtaagatgaatgggtagcaggctgctcatcgccctccaaccagc

SEQ ID NO: 74688 - DNA, 55 bp, Homo sapiens
  chr12:4392892-4392947
  hypo
gggaggcgggaatgtcgggtgttcctggttatctgggcatcgttccttggctcgg

SEQ ID NO: 74689 - DNA, 93 bp, Homo sapiens
  chr12:43944788-43944881
  hyper
ggtccgagggccctgcgtcgctctcccaggccccgcgctccggggttcccaagtgcacctcggtgtagccggcggccagaaaggatgcatcgg

SEQ ID NO: 74690 - DNA, 271 bp, Homo sapiens
  chr12:43945109-43945380
  hyper
cgttcctcattgtccaactctaaacttcttccaccaaacgtccccgctaaaggtcccaggtcccagtacagccaggggcaagacaaatgcacacatgctgatgcgcacgcacacacacacacgtgcactgggacggttagtgctctgctttcccacacccccaacttgccctaccctccccaagcaaagaccctaccactaatggccctaagcaacccacttccttccccagtacctcctaacctccccgcagcccccaactcgttccctc

SEQ ID NO: 74691 - DNA, 365 bp, Homo sapiens; identical to SEQ ID NO: 34326
  chr12:43945416-43945781
  hyper

SEQ ID NO: 74692 - DNA, 217 bp, Homo sapiens; identical to SEQ ID NO: 11197
  chr12:43946202-43946419
  hyper

SEQ ID NO: 74693 - DNA, 120 bp, Homo sapiens
  chr12:43957403-43957523
  hypo
cctcagagggagttttaaaacaactcgagtcaagtagaaaatgcaaacatttatatttgcattgtatccatgtgcatgtttatatgcatattttgaacattgttttagaaaatcatcaat

SEQ ID NO: 74694 - DNA, 55 bp, Homo sapiens
  chr12:4397850-4397905
  hypo
ccttgtgaaagaactcgagggaggacatgcctgtagggcacggggtcactcgcgc

SEQ ID NO: 74695 - DNA, 30 bp, Homo sapiens
  chr12:4399394-4399424
  hypo
agctcagagaaatggcgcagggagatgctg

SEQ ID NO: 74696 - DNA, 159 bp, Homo sapiens
  chr12:4405568-4405727
  hypo
aagggctgtgccatgcgaaaccctctttaaaggaaccgcatcgctacgcctaacgggcatttcttttttaatgtaatggttcagagctattgtctaccacgcctcgtgtgcacacgcacacacacgcaagttccctcagtcagccgagaatcctgccat

SEQ ID NO: 74697 - DNA, 30 bp, Homo sapiens; identical to SEQ ID NO: 43332
  chr12:4411192-4411222
  hypo

SEQ ID NO: 74698 - DNA, 30 bp, Homo sapiens
  chr12:44319436-44319466
  hypo
aatgaaggtgaattacgtgaaatccttcct

SEQ ID NO: 74699 - DNA, 465 bp, Homo sapiens
  chr12:45268922-45269387
  hyper
caaagttaggacaagcggcaagagcaactcctgccggggttatcggaactgaaatcacagtggggatgcagcacgccgggcataccttgaaagagaaaggctttcgtcccattatgcagccccgggacctgacgcactccggtcgtggactccccaagttctaactctgttaagacgtcaatctgtagggaagggtccacaccaagcccccaaactggtgaggggtatgaggtgggagagagaaaaaggaaaagctccatcaaaatgcaagtctcttcctccagggcagcaaagaaccgcgttttcgcgacaatattgggaactgaagatgagaggcgactgcctcctcctccgccgagagccttacctgagatcagcagccaagctttaaatagcggagcacccagtcccgtttccatgacctcctttaaacccttctctctgcaaagttccccctcagccctc

SEQ ID NO: 74700 - DNA, 670 bp, Homo sapiens
  chr12:45269416-45270086
  hyper
cgcggtctccaaggcaagcacagaaaaaaaaaaaatccatatccaaacccgcccccttactccaagcttcccactccagacctactttgggtccgggaaaagcgaggcttccccagccagcccatgctgccccgaggcgggagccatccctttccccagccccagctctgcggccactcacctgctccgagaccgaagatcaaacagaatgttctcagtaagacccgagactccatggtgcggatcagctcagtccatcgtctccctctttaaaaataaaaataaaaatcgaagaggttcttggaatcaagcgggaaaataacgtttgtctctcctgctgctgcctcggatttactgatcagtaggattaatacgctttggttgcctaagaaagaaaagggaggcctccccaggcgcgtgaagaacttagaccctccaatgcgcacatcattcccacacgcagggccgaggcggcagcgcggcccggagggggcccggagggaggggtcggactcgccccggcgcggctccgtcggggaattagctcccgagccgaataaaagcagccaaagactcgcacacccggtagaaggggggcggccccaagaaagcccgggctggggcggccccgcacccccccgtcttccccgccgcccgaacctgttgtaaa

SEQ ID NO: 74701 - DNA, 535 bp, Homo sapiens
  chr12:45270378-45270913
  hyper
tttgctctcacccctcgatttcgggcgcgtgtcttgaaagacaggagagaaaaaagaccacccagctgcaggaggcaaggctggagcgagtagcgctcgcctgccctttaagcaaaggagggaagcccatgtgcactcgtgcactgggctccggagcagccccggggtgcagggcactccccctccagggcgtgcggaggaaggccaccaaaacacgctgcactgccgaggtggagctgggcaaagtaggtagagactggtggggacggatggcgagcctgggaagccccgggtgtcctggtggagaggttccctgccgggggcggggcgctggagagcttccccggcgcggagagcttcccgggcgcggagagcgcagagaacttggccaggaggtgctggacagctccggaacccgcgcgccccctgccaaataaagcgtggagacccggactcgggctctctgggaccagcatacagcagaaggcaaggggaactgagccagggcgtctgttcacgccgaaatatctaccta

SEQ ID NO: 74702 - DNA, 825 bp, Homo sapiens
  chr12:45443857-45444682
  hyper
ctccccaagttgggccgcgcaaagctctccttgtcaagaacttttctgagagctggtgtcgtgcagcccgggaaacaggaccgggcaggttagaaacgttgaacttggtgaaaccccttgagactgatccaggcaggccgtagaaccctcagagtttcccagttaaggccaaaaagttaagcagccctaccacctgttgaaagaagggaacagcaaagaagctggtggaatgggatgggatggggcaaaaaagaatcacagaaagtggtgtgcctccgcctgggccccctactcccgaagtggcatctccactaaagctcgagatgctccaggaagttcccaaaccggctctccctgggcgcagtgcgcaccgccggcgctcccagatccctggaccacccggcctgggggcgcgggcgcggctggggagggaggggagagctggctcacctggcgctgaaggctggaaggtacagtctcggtcccccggagcccggcccggcagcctcgcactgtccgcagagggactgagcacttgaaaagcccaccgcgttccgtagggcgccccggcggggctaacttgttcggctgcggggcacagctttaggggaactgggctagcaggcaggggccggagctgcgcgcccgcggtggccagggcggtcgccgggtcgtggggcgcgggcggctgcagcctgggcgttggggcgcccccgacccgcagcaaattctcgatcaggaaactcttgcccaggttgccaaagccgggcgcagcggggaggttgaggagcgcggaggaagccacaacgtcccagtacgcaccgg

SEQ ID NO: 74703 - DNA, 129 bp, Homo sapiens; identical to SEQ ID NO: 34333
  chr12:45444714-45444843
  hyper

SEQ ID NO: 74704 - DNA, 256 bp, Homo sapiens
  chr12:45445143-45445399
  hyper
caaggggaggggactcgtagtgggaggaggtgggcgtggaggcgacgtgaatcgggcgcgctcgccacctccccgctgccgtgcagagccgtggcactctcgctagagcccaagcagtcccccaggcgtggggtctggtggacgctggcctggagcgcccggagggcggggtgggggtgggggggacgcgctgtcgtctggggtgtctccgcgtactcctgttgggcgaaccctggctctccggtgttggttgtca

SEQ ID NO: 74705 - DNA, 136 bp, Homo sapiens
  chr12:4554801-4554937
  hypo
ctccctccggcatggcggcaggggcttatttttggaaggcagatgaaggctgctgacatgaaaccaaagcctccatcgggcactcgggttgagagcagagggacccaggctgagccgcggccggtagagaccatgg

SEQ ID NO: 74706 - DNA, 29 bp, Homo sapiens
  chr12:46495833-46495862
  hypo
gagaaacacatcagcggaagaacacacaa

SEQ ID NO: 74707 - DNA, 142 bp, Homo sapiens
  chr12:46767273-46767415
  hyper
ccccagttttccactcgctgacacgttgcttctcttatcccaccaccgccgccccgggcaaaggcactgccttgtctgaatgcgggtctgaggcgctttctgcggagcctggtcctttcccttcaatggtgatgtgtgtggt

SEQ ID NO: 74708 - DNA, 201 bp, Homo sapiens
  chr12:47224753-47224954
  hyper
gcacacccgcgaccacgtatccctgagtttcctaacttagttcaccccttttcctccaagtcagcagcccggtgagcattccagggtcagtcctggtgctcaaagtaagggcaatcttccatctctgcctgctggatcacaaagaggagctgggagattcgccgttttcccccacaaccggcacctgccctggcccagagc

SEQ ID NO: 74709 - DNA, 19 bp, Homo sapiens
  chr12:47224955-47224974
  hyper
cagcgtccacctgtaccac

SEQ ID NO: 74710 - DNA, 276 bp, Homo sapiens; identical to SEQ ID NO: 34336
  chr12:47225027-47225303
  hyper

SEQ ID NO: 74711 - DNA, 158 bp, Homo sapiens; identical to SEQ ID NO: 34337
  chr12:47225319-47225477
  hyper

SEQ ID NO: 74712 - DNA, 127 bp, Homo sapiens
  chr12:47225550-47225677
  hyper
cgggtccagggactcgggtaacaccttgccagcaggatcccgggcggtcgcggagccagctcccgcgggggaagtcgggcctctcagccaggcaggcggcgcggccacggaacgcagtcccaataca

SEQ ID NO: 74713 - DNA, 30 bp, Homo sapiens; identical to SEQ ID NO: 43334
  chr12:4734872-4734902
  hypo

SEQ ID NO: 74714 - DNA, 132 bp, Homo sapiens
  chr12:47547800-47547932
  hypo
gtcacatgcatttaacgtattacatcattgatgggagacagttctccagggtctctacacaacttgcaagcaaggcgctgactgccctttgttccaaaccatttgacccaggaaacgcgtatcttctaccag

SEQ ID NO: 74715 - DNA, 86 bp, Homo sapiens; identical to SEQ ID NO: 43444
  chr12:47628723-47628809
  hypo

SEQ ID NO: 74716 - DNA, 162 bp, Homo sapiens
  chr12:47629046-47629208
  hypo
gggccacatgcacaacggccttaactaccgtgaggtccgcgagttccgctccgaccaccatctggtacgtttttacttcctcacccgcgtgtactccgattacctccagaccatcttgaaagagctgcagtcgggcgagcacgcccccgacctggtcatcat

SEQ ID NO: 74717 - DNA, 54 bp, Homo sapiens
  chr12:47629490-47629544
  hypo
tttccacttccgccacgcgagggagaacctgcactgggacggggtgcactggaa

SEQ ID NO: 74718 - DNA, 169 bp, Homo sapiens
  chr12:47659833-47660002
  hypo
agaaaagggctaaatcggcattttaaaaataaatggtcttagactgctgcaccaaacatggttgtcttctttatgagagctatatgatctgcttagaaattctctaaaacttcattcattccttcgtcactggttactcccatattgggtgccacgcactggtgctcca

SEQ ID NO: 74719 - DNA, 74 bp, Homo sapiens
  chr12:48206723-48206797
  hyper
ctggaatctggggggcgaggcctgcgctcagcccctcgcccggtgggggtggggtgctgcgccagcacctcctc

SEQ ID NO: 74720 - DNA, 138 bp, Homo sapiens
  chr12:4829055-4829193
  hypo
actcctcacacctgacgctgctcagggagaagccaggcagctataatagtgttcttggccggagaacatctggcctagcaggcagggtgtcatctatgaagctgggtggagagaaagctgttggggaaaccagcccca

SEQ ID NO: 74721 - DNA, 46 bp, Homo sapiens
  chr12:48299419-48299465
  hyper
gaccgcggctgaccacgttcccggcctgtcgcgaatctcacccaag

SEQ ID NO: 74722 - DNA, 38 bp, Homo sapiens
  chr12:48348058-48348096
  hypo
aggctaggactactccgccagggcggtgctggccagcc

SEQ ID NO: 74723 - DNA, 30 bp, Homo sapiens
  chr12:48375679-48375709
  hypo
aagccaaccttggtgcgtgctcccaccgcc

SEQ ID NO: 74724 - DNA, 266 bp, Homo sapiens
  chr12:48395916-48396182
  hyper
aataaatacgggcagcgtttcagccccatctggaagccatcgctgccaatctcccaatgcaaacaagcctcacaaaggaggattgagatctctcccctgagccaggggcactttcggaggcgagggctctgaaatgcagatgagggtcaaagacgccgccgccagtaagtttctcaaactcgtggaaagatggagaggaggggtgtggccgagctctaggtgtctgacattcctgacgtccacgcagactgcgcatttccccacgt

SEQ ID NO: 74725 - DNA, 338 bp, Homo sapiens
  chr12:48396748-48397086
  hyper
gggcccacagagcctcgaaggcagagaacttttattccccccgccgaagagtttccctctgcgattgatttacaatctgtaacatacaaagacagggctggaatcccagccgtcggaaacgtgcccaaacacgtggaaaaaaaaatcctctctacctaatacactttccaggcttcgtttgtcctgaatataatcccagacagtggaccttaccaaaggaggggtagaaaggtgcagtccgaacagcatttggacccgactacaagagccatctctaactataccggttgaaatagttgtagcaaccgtagcaatcgaccagcctgctccccttccct

SEQ ID NO: 74726 - DNA, 1598 bp, Homo sapiens
  chr12:48397146-48398744
  hyper
agttccagaatttagaaaagtaactcattgtagtacctcggggcggcggggaatggggtaagaccgcggggaagggggcgctattttcgggggcatttgaaaagcacggtctggttggaatgttatcgtctttcagatggcctctcctactggaagtttctgtaccctttatcagaagagaggcgcaggcggacggagggaagtcgagatgagcgctagggctgcaccttgctccagggccagctgggagggggagggtaccctaaagaggcgctgaggtctcagagggcctatcggaagccgttctttgtggcctgggatttcagcccaccagtgtcagagtgttagtcccctttgtctaactctgctttgagcccaccagccaccaagccttggacaggctgtgaagtcaaccctttggcgtttgcttgctccctcgctcgcgctctctctttcctacttcacctaagttcgatgagttgagatctgtttttgctgaactcgaagtgcttcgaagaggcgagctgtgtgcatgtgcgcctaattatcaaagctggtggaaaagagcccatttatatctgtgcgcaaacttctccgagccaacactttgcaagttcagtattctagcgcaacgtagggacctgcaaatacttgcaactgcgatgggcaccgaggaccctgggacagagtccttgattggcagaactcttcttggtgaacttctgcgtgtcctgtgcctaagtcggcgcgctacgaccccgggagccgttttagcccggagccgcgggctccagagctggagcgggccggggagaaggatgctgagggacgcatggaaagcaggcaggcaggcaggggcgggggaagacttacggacatcctggccctgacaccgaaggacagcggcgacgagcagcgtcagcagcaccagcgtctggggagccccgaggcgaatcatggctcaccgcggggcctggctgagccgggcccgggcggagcgcagcgaaacggcaggagcacggcgcgggtccgggtctctaccgcgccctcatgcaggaggcccttggagcaggagggggaagcgggagacccggcagcccagcagcgctctgcgtcttctccccgccgcggcgcccgttatatgcgcccggcccctttcgaggctggcgaactcgcccaaaccgcgggccgccccctgccccccgctgggctgtaacctgaaccgcccgcccccggagcccgcctgggccctgccagtgcccgcacctgcccaagccggacccccctctctgggagtcacgcttcccgccctccacccctagtgcgccgagtggcctgatcgggcggggcgcagagatggcccctgccccccaaacccggggctgcggcgctgcccccctctgaccacaggcgggaagggtggcctccggcccctcccctcggagttctgccggagttggaggggagggggtgtttgcagaggcgcaggccgagagccctagaccaaggacggaaaagacatgggagggaggagggaaagcggtagaaaggagcagcggagggcgagggggcaccgcgtcaggcgtttgggagtgggg

SEQ ID NO: 74727 - DNA, 138 bp, Homo sapiens
  chr12:48398948-48399086
  hyper
gaagttggcctgagccgacagccaggaaaagagctggtgtgttactgcacagaaggagacctgtgtgaaggtgtggggggcaggggcaggccctgggaaggggactgaaagagccacagaggacggagggagccgaga

SEQ ID NO: 74728 - DNA, 30 bp, Homo sapiens
  chr12:48565607-48565637
  hypo
gatgcttggaagatacgggatatcatgatc

SEQ ID NO: 74729 - DNA, 188 bp, Homo sapiens; identical to SEQ ID NO: 34342
  chr12:48576788-48576976
  hyper

SEQ ID NO: 74730 - DNA, 861 bp, Homo sapiens
  chr12:48577469-48578330
  hyper
ggcctgggggagtcccgagtccgacgcgccgctggcctcagcctggacgcggacccctccgcgagcgcgtctgtgacccacggaaccggcaggcgctctctgcttgtggcgcccagagggcggcgctgacacgggcgcgatccgggaggcgaggcagggcagggcactttcgtcccggggcgatcccaagagacgccggctctgggaccctcgccgggtcctcgtcccgcagcctcttctcggcctcccgcgatcctgcctgcgccctctgcccaggactcgtctctcacgtcggctccccgccagtctcgggagcctccgcttccctcggctcccgctagcccctcccgggacctctccccctccaccccctcccccaccccggaggccgggctggacgcgacccagagcctccgccacccgcttctgccactcaatggaggacggtctgctggagatcatgaccaaggacggcggcgacatgccggcgcccctggaggtgtccaccgtgccggcagtgggggacgtgatctccggggagtacaacggcggcatgaaggaactgatggagcacctgaaagcccagctgcaagccctgtttgaggacgtgagggccatgaggggggccctggacgagcaggcctcgcacatccaggtgctctcggacgacgtgtgcgccaaccagcgagccatcgtctccatgtgccagattatgaccactgcgccccgccagggcggcttgggcgtggtcggcggcaaggggagcttccagagcgacccccaagagccggagactccttcgcctgggatcggggacagcggcttgctgggtcgcgatcccgaggacgaggaggaagagga

SEQ ID NO: 74731 - DNA, 100 bp, Homo sapiens
  chr12:48590813-48590913
  hypo
taaataaataaaaagaaaagaaaactgaccgcaaaatgggctcttattttgagcatgtacaaaacacaggtaagtctgatggtctcggtacatgcgatac

SEQ ID NO: 74732 - DNA, 22 bp, Homo sapiens
  chr12:48615310-48615332
  hypo
agtgtaacgttaccacaaattt

SEQ ID NO: 74733 - DNA, 36 bp, Homo sapiens
  chr12:49074244-49074280
  hypo
gattacaggcatgagccactgcgaccagccagggac

SEQ ID NO: 74734 - DNA, 18 bp, Homo sapiens
  chr12:49108598-49108616
  hypo
tataaggcggccaggcgc

SEQ ID NO: 74735 - DNA, 36 bp, Homo sapiens
  chr12:49111559-49111595
  hypo
ggtaatttttaagtacgtttgcgaatgggtgaacta

SEQ ID NO: 74736 - DNA, 25 bp, Homo sapiens
  chr12:49174695-49174720
  hypo
cattctggccaggtgcggtggctca

SEQ ID NO: 74737 - DNA, 49 bp, Homo sapiens
  chr12:49276337-49276386
  hyper
tcagtgacctgagctcggaaattccaccccatgacgagtctctggagag

SEQ ID NO: 74738 - DNA, 197 bp, Homo sapiens; identical to SEQ ID NO: 34345
  chr12:49297738-49297935
  hyper

SEQ ID NO: 74739 - DNA, 501 bp, Homo sapiens
  chr12:49363677-49364178
  hyper
caggtggaagttaggcgcgcaggggcccagacgagtggccagacctggctcagagcggctccggggggggcggggaattccaggagaggcccctcccggagccgcgaaaccatcccttcccgcctccgcgcgcctcgccctgccgcccaccccctagcctccgcggcagcgccgacccgcccagccaggctcaccgcgcttgaggatggcgctgtggtgcggcaggcggccgccgccctcaagcgcggagcagttccagcgctggtcgcgcagctggtgctgacactcgtggaccgcgatgtgcagaccctgaagcgcggacgccgtcacgtcggggttgcgcaggcacaggcctagctgccgcttgctcaggccggacagcgtcaagcacacggtgttggccgtcagcggcggctcgccaggcaacttcaggcccagaatctcattgcttagagccctgggaaccaagaaggcgtctggggtctgcggtccagacccctc

SEQ ID NO: 74740 - DNA, 164 bp, Homo sapiens
  chr12:49366374-49366538
  hyper
gagacccagtggcagcgaacgggttaggcgccaccgtgctcccgcctgactcaccctcgaagctctaaccactgtgggctatttttgccagagaggggccccaggctttccagccgccccccgcccctgccagaccgcagcccaaggcacggctggccccacgc

SEQ ID NO: 74741 - DNA, 39 bp, Homo sapiens; identical to SEQ ID NO: 34349
  chr12:49367954-49367993
  hyper

SEQ ID NO: 74742 - DNA, 95 bp, Homo sapiens
  chr12:49372141-49372236
  hyper
gtctgcgcccctaaccggtgcgccctggtgccacagtgcggcccggaggggcagcctcctcccgtcacttcagccagcgccgcaactataagagg

SEQ ID NO: 74743 - DNA, 122 bp, Homo sapiens
  chr12:49372537-49372659
  hyper
gtaagtgagctggtgcggggtcgccacttgtcccgcggcacagagccaggggccaaccctacccagctcccacgctctgggatccgtctgccgacaggctccctccccgctctgacttccct

SEQ ID NO: 74744 - DNA, 30 bp, Homo sapiens
  chr12:49373073-49373103
  hyper
acacacaagtctggacgcccagttctttca

SEQ ID NO: 74745 - DNA, 1654 bp, Homo sapiens
  chr12:49373373-49375027
  hyper
ggggatcctgcacagcgtgagtggggggctgcagagtgccgtgcgcgagtgcaagtggcagttccggaatcgccgctggaactgtcccactgctccagggccccacctcttcggcaagatcgtcaaccgaggtgggtgcccaggaaggcgacgcttccgggagcaggggaaacgcggggtcacccccagggcatgggcgggcgagttcagagaaggtgtcccaggcgcctggagggtcacacaatcaaccttgccaagtgcctcgtgcccagcgccagctcggggccagacttctaccaggcgttttccagccgtgcaccctggaaacgaagcttaacttttctgagctactgccccagataaagaaagtttcgggtcgcggacgccggctgaccgccgctttcccccagcctctctcaaaagcgcctgggaagctgctctctgcaggcgtgtgtctggcctctcgcccagcaaggcttgcaccgccaaaatgggccgaaagttttgggctgcgaagaagtcttggggatgtatggttcttccgctcccctctcttcggtttgtctctctggggctgctccacttccgctatcgagccaaaatgcgccctagaatctcccagtaaggtgtgattacgcccgtggacgtggctgcgtgcccacgcacctgctttctctactagccctagagaccagctttccagcactgccggccctggctctcaggactcaaagtgcggagtcgggggtgggattccggtcccaagcccttcatgagggtgctggccgcgccccgcgtaccccctcgctgatccccgctcccttctcccacaggctgtcgagaaacggcgtttatcttcgctatcacctccgccggggtcacccattcggtggcgcgctcctgctcagaaggttccatcgaatcctgcacgtgtgactaccggcggcgcggccccgggggccccgactggcactgggggggctgcagcgacaacattgacttcggccgcctcttcggccgggagttcgtggactccggggagaaggggcgggacctgcgcttcctcatgaaccttcacaacaacgaggcaggccgtacggtgagctttgagaggctccgcaccctaagcggagcggcaggggccaacctcgggctggggaagtgacggtcggtgagataaggcaaggggcaccaggagagggcgtcctgggagagccggaggcttggaacgaagacggagaatagaggagacagtggctgagggcaaaggtatgtctggcccgcggacaggtagaagaggttgcaaatcaagcacagtctcttcgctgtacagattcgaaaaataagcctgagaggccgagactgactcgccgcggcggagcagggttgggcagggtttccaaatctcagcggaacatttcgcgcctcccttcccctgggctcagctaggcctgggcctttgctgaggtccggcccccgtggcgtccgggagagggcagtgtctgggagggtgactctggcccggtgccctgggacactctttcttcccctatccccgcagaccgtattctccgagatgcgccaggagtgcaagtgccacgggatgtccggctcatgcacggtgcgcacgtgctggatgcggctgcccacgctg

SEQ ID NO: 74746 - DNA, 414 bp, Homo sapiens; identical to SEQ ID NO: 34353
  chr12:49375115-49375529
  hyper

SEQ ID NO: 74747 - DNA, 32 bp, Homo sapiens
  chr12:49375761-49375793
  hyper
ttctgcctgctccatcgcgccagcgacctctc

SEQ ID NO: 74748 - DNA, 262 bp, Homo sapiens
  chr12:49388709-49388971
  hyper
ggggtggggggagggcgccagggcagtgggaagagccgacaggggtgggctgggggcaaggaagggagagtcccggctgggggagaaaagaggtgggccaggagctcccaacgaagaaagcagccccctcccctcacacagagcgggaagtagcagaggagtcccgggggagggccactgtggggaaagggtcagtgaaaggaagacgatgccaaggctggataaagggaagcttagatttattgagcgcctactgtgtgcc

SEQ ID NO: 74749 - DNA, 282 bp, Homo sapiens
  chr12:49390823-49391105
  hyper
cgcagggccccggcgtagggccctggggtccgcgcccagccccggccggcgcgccgctggaccaccgccacttccgacccctcggctctgccctgggctcccgaagctgctgggcctaaggcttggtgctctgggctacctggctgcgtgggggcgtcccgcaggtttacttcgggggccgggagccccaagatgcggaaagtgcgctcctccagtgtggagtcccccggcctcccgccctcagcttcgcccccgcggcccccgccgggctggtgtaaaagg

SEQ ID NO: 74750 - DNA, 1391 bp, Homo sapiens
  chr12:49391146-49392537
  hyper
cgtggccccttcaccctcctccttgccgggcttcgattggctgggggaatcccccaccacgcgtgtcaccccagagggcaaaagctgcacctgctgggttcggggggttggaacatattgggatcgtatcactacgcacgtggcgtcaatgacaaagacgccttccccacgggacaggccctgggaactgcggggcaaggtgtgggcacggcgggtcgccttccaaccctccagggtctccggtcctgccccctctccaagacccagagattctctccatccggtgcctccgggagcccagggtctggggagtgtctggctatggcggggcggctgctttttaggggagggaatccagcatttgggaaaccagatctgttctccttctttcccttccctcgagcccttgaggtggtgcctggatctgggagcgggatgcggggcacagggagccgcagttgcagaccccgcaggagctatctcggtgcctgcgctccctgtagctttggcttggggatggctgtcgctaccactgttcaggtcagcagcagccagccccaggcttttctccacgacccccttgccgggctctggccttgctctggccgctccacagcctggggatccccccaagagaccttgcccctgtcggagaccccaagccccgaggacgtcccggtagatccgaggatccagcctcttctttgtgcgccctccgtctgtcctggctggagtcgcagctggggctgatgaagtgggcacctgagagttcccggggcctctcttagtccccaaggtcctatgggggccttcgtaagaaggtggagccacgtagggtggcggccggtcccagcggcgtcgtggggcggtcccggcagaacctctcagcagcaggtgagcctcgtagcttgggggcccgggccgccgacctccccagggccccgcccacgccgaccctgggtcgctctgcggctgcgcggatggacggggcgctcgccccacaggcgccaggcgctccggccgcaagggagcagggagccctgccagctgggccacccgaggggcgttgcggggctccgggcggggtcgacccggggggctccgtcgggccccaccagccttgcgcctttttcgctcggtctccttggcctcccgctcctgcgacgccgctttccttttctcttgctcccgagctcggacctcggccaggggccccgcccgccagttggtcgcctcctgcagcaccctggaggcccagggccggcggggcggcggctgtggggatcccgggcgcggcccacacctgggacaatgagcaggaacccaggtgagcagtttgtgggggaagggagccgaggtccggggagctgggagcactggagaccacttgg

SEQ ID NO: 74751 - DNA, 39 bp, Homo sapiens
  chr12:49392597-49392636
  hyper
gactgaagtcgaagcgggactcctcgccatctctccatg

SEQ ID NO: 74752 - DNA, 71 bp, Homo sapiens
  chr12:49393665-49393736
  hyper
taaccagctcccatgcggtggagagaggaggcggtggcttttaccaagcttttgtgcgactctgagggaga

SEQ ID NO: 74753 - DNA, 30 bp, Homo sapiens
  chr12:49443844-49443874
  hypo
ctgtctgcttgcattcggggtagacctcca

SEQ ID NO: 74754 - DNA, 541 bp, Homo sapiens
  chr12:49483686-49484227
  hyper
ccaatgcatgccagtcggctggacggccccgccggggagcagcgcccctagcgcgtgcagcagtctcaagggggcaaaagcgcggtgcgcccactggtgactctccagaaccgcgtagcaagaggccaggacatcgttcaccagcagcgtcccgtgcgcggtgagcggcgcgaacacgcccacggcttcctcccgcgccacacgggccacgcgcgctggccgaagcgcatccccgccgggcgccagcaccgagtccccagcgcgtagccggcgcgcgaacaccggtgcaaagtcgcctggcgcgggcgccggccctcgagcggcaaacaccaggtgccagggcgtgagcaacagtttgcgtggaggccactcggtctccacagccacaaatgaagcccggcgctgcaagtcccggtccaggaagagcagcaccggcgtgggcaccacccggcctgacgcatcggccgccaaaacccagtctccgcggtgcagttcccgcagccctttccgctcgccgctccacaggcgcacagttgcattt

SEQ ID NO: 74755 - DNA, 198 bp, Homo sapiens
  chr12:49485716-49485914
  hyper
ccaagaggagctgtgcgggatcaaggctgctggaaaaaggattggggtggcgggggttgcgcgaagtacaatggccattatccgggatgacttaaccgagcgagaatcctgagcccaggccgggaacgcgctgggagaagcggactcagcagctccggccacaaaggcgcttttcagccgccccggctcagggagagg

SEQ ID NO: 74756 - DNA, 92 bp, Homo sapiens
  chr12:49486186-49486278
  hyper
cacagttatcttggccgctccagcctgggagcgggagaccttggcgcgcaccatagcagggacaccgcgggaggaggcgcagagggacagct

SEQ ID NO: 74757 - DNA, 30 bp, Homo sapiens; identical to SEQ ID NO: 34360
  chr12:49487666-49487696
  hyper

SEQ ID NO: 74758 - DNA, 34 bp, Homo sapiens
  chr12:49515539-49515573
  hypo
ttaaaaatttatattcggcagggcgcggtggctc

SEQ ID NO: 74759 - DNA, 30 bp, Homo sapiens; identical to SEQ ID NO: 43336
  chr12:4959461-4959491
  hypo

SEQ ID NO: 74760 - DNA, 37 bp, Homo sapiens
  chr12:49596183-49596220
  hypo
aataaatcagacagccgggcgcggtggctcacgcctg

SEQ ID NO: 74761 - DNA, 150 bp, Homo sapiens
  chr12:49657572-49657722
  hypo
gcacatttagtatgacgcagtacaagttagtgttgaagggtttaattcctcggagctctactttcctcatctgtaaactagggataataattcatagagtttgtcatatggatgaaatgtgatcatgtgatatgaaaagccaactactcg

SEQ ID NO: 74762 - DNA, 17 bp, Homo sapiens
  chr12:49661147-49661164
  hypo
aggtaaacatgatgccg

SEQ ID NO: 74763 - DNA, 30 bp, Homo sapiens; identical to SEQ ID NO: 34361
  chr12:49688858-49688888
  hyper

SEQ ID NO: 74764 - DNA, 38 bp, Homo sapiens
  chr12:49690563-49690601
  hyper
gcgcccacttctgttcgttcaagcgtttcttctctttt

SEQ ID NO: 74765 - DNA, 109 bp, Homo sapiens
  chr12:49690983-49691092
  hyper
caagcaggagatgaacgagtcccgacgccagatccagagtctaacgtgcgaggtggacgggctgcgcggcacggtgagtacgaagctgcgcgctcgggcccggggagcg

SEQ ID NO: 74766 - DNA, 30 bp, Homo sapiens
  chr12:4970362-4970392
  hypo
ccctgggtaaggctgcgtgccttgggtggg

SEQ ID NO: 74767 - DNA, 15 bp, Homo sapiens
  chr12:49726844-49726859
  hyper
ggtagatgatgaagc

SEQ ID NO: 74768 - DNA, 36 bp, Homo sapiens; identical to SEQ ID NO: 34363
  chr12:49727091-49727127
  hyper

SEQ ID NO: 74769 - DNA, 667 bp, Homo sapiens
  chr12:49729713-49730380
  hyper
ggcatctcacctgtccgttcttcatgaggtcggcccacatgctggtgccgtcgccgccgcgcatgagcacgtggtaagcgaagaagtagacgcctggcatggggcaagtaaacttgccgctggctgcctcgtaggcgttgcccacgttggtcaccacgtcgtcgaagcgcagcacctcgtaaccctcgtggggccgccgcaggcccgcgtagaaagcaatgcgaggcacgtagccggcagcgggcgccaccccgcccggacctggaccgggagggcccggggggcctggcctgccgggttctcctgggggccctcttggacctggtggtccagggggcccccgcaggcctgctttcccgcgccggcccacctctcccttggcgcctggcgggaaggggggcacggaagcaggcgcgccgtcgggaccagggccacggggcccatgcgggtcgcacaccatgcggcagcgacccagcatctcgtagtgcgctggcccgcgggagctgtgcaccagcagcgggatggccaccagcagcagcagcaccatggccactccgacggccgcgcccgccaccctcttgcggcggctcagccgcgacgctgccagggccagcaaatcttcctcactcttgggcgcaatggctgccggggccggggctctccgcgg

SEQ ID NO: 74770 - DNA, 117 bp, Homo sapiens
  chr12:49735966-49736083
  hyper
ccgccggcaattaggcggccagacaaagagcagcttcggatggatgagggtcccagcggatcggaaatgtgaagggtcagcgctgccgcccgcggcgcaccccgctcccccttccgc

SEQ ID NO: 74771 - DNA, 36 bp, Homo sapiens; identical to SEQ ID NO: 34366
  chr12:49736792-49736828
  hyper

SEQ ID NO: 74772 - DNA, 108 bp, Homo sapiens
  chr12:49931485-49931593
  hyper
caggcttcacaggaccggagaaggaggagcgcgtcctcccttcccaaagcgccagctcatttagatacaggtgcctggggctttggctctcgtcgctgatgaggggta

SEQ ID NO: 74773 - DNA, 30 bp, Homo sapiens
  chr12:49932996-49933026
  hyper
ccatgctccgggccccgacggcgcggacgc

SEQ ID NO: 74774 - DNA, 67 bp, Homo sapiens
  chr12:49933430-49933497
  hyper
taggcgctgtttccccgaaggttcgaaggttcggggtcaacactgcttcaggcgaggcaacagggcc

SEQ ID NO: 74775 - DNA, 36 bp, Homo sapiens
  chr12:49944080-49944116
  hypo
gctcaagggtggcaccgtgctcgccatcctaggttt

SEQ ID NO: 74776 - DNA, 35 bp, Homo sapiens
  chr12:50036399-50036434
  hypo
agatcaccctggagtcggagcggatccggctcttc

SEQ ID NO: 74777 - DNA, 54 bp, Homo sapiens
  chr12:50052209-50052263
  hypo
caaaagcacacataccggagcacagactggcgcgcagagcgagcgaggctgttg

SEQ ID NO: 74778 - DNA, 808 bp, Homo sapiens; identical to SEQ ID NO: 1018
  chr12:5017990-5018798
  hyper

SEQ ID NO: 74779 - DNA, 30 bp, Homo sapiens
  chr12:50186522-50186552
  hypo
ggcatgctggggtgccgcccactcaccagc

SEQ ID NO: 74780 - DNA, 6 bp, Homo sapiens
  chr12:5018799-5018805
  hyper
cgagcc

SEQ ID NO: 74781 - DNA, 229 bp, Homo sapiens; identical to SEQ ID NO: 1020
  chr12:5018806-5019035
  hyper

SEQ ID NO: 74782 - DNA, 659 bp, Homo sapiens; identical to SEQ ID NO: 1021
  chr12:5019084-5019743
  hyper

SEQ ID NO: 74783 - DNA, 521 bp, Homo sapiens; identical to SEQ ID NO: 34228
  chr12:5019793-5020314
  hyper

SEQ ID NO: 74784 - DNA, 32 bp, Homo sapiens
  chr12:5020440-5020472
  hyper
cgctccggtgggggggccgcttgggtcccccc

SEQ ID NO: 74785 - DNA, 30 bp, Homo sapiens
  chr12:5020739-5020769
  hyper
cctaagaaacgcatgcgctacttcgacccc

SEQ ID NO: 74786 - DNA, 94 bp, Homo sapiens; identical to SEQ ID NO: 1035
  chr12:50297461-50297555
  hyper

SEQ ID NO: 74787 - DNA, 115 bp, Homo sapiens; identical to SEQ ID NO: 1036
  chr12:50297973-50298088
  hyper

SEQ ID NO: 74788 - DNA, 199 bp, Homo sapiens
  chr12:50355598-50355797
  hyper
ggccccgcgcccggccgcccgccccctatatagcgcgccccagcagggcccgcgccaggccgccagcctcggagtgggcgcgggacagtgcgcggcgccccgcagccaggcccccgcccccgccgcatccacctcctccgccgcctgcgacccaacgggcgccccccgccgcggcagctgccgccgggcccccgcggcc

SEQ ID NO: 74789 - DNA, 146 bp, Homo sapiens
  chr12:50426748-50426894
  hyper
tcacctccccaggggcggccgcctgatccgatgtcccgacaggcgaactgtcatcgacgatccctggacgcgggcgtcgggggcagggaggcttggctaggtccctggctgccaaccgtctggccacagcccgatgcgtgtcttca

SEQ ID NO: 74790 - DNA, 241 bp, Homo sapiens; identical to SEQ ID NO: 34371
  chr12:50444182-50444423
  hyper

SEQ ID NO: 74791 - DNA, 30 bp, Homo sapiens
  chr12:50444626-50444656
  hyper
ctgcctgtgatatggcgggctgcattacaa

SEQ ID NO: 74792 - DNA, 41 bp, Homo sapiens
  chr12:50508302-50508343
  hypo
gggactacaggagtgagccactgcgccgggccttggaattt

SEQ ID NO: 74793 - DNA, 30 bp, Homo sapiens
  chr12:50575698-50575728
  hypo
ttgcaataggagcaacggaagcagctgatg

SEQ ID NO: 74794 - DNA, 19 bp, Homo sapiens
  chr12:50664625-50664644
  hypo
agcactttgggaggccgag

SEQ ID NO: 74795 - DNA, 30 bp, Homo sapiens; identical to SEQ ID NO: 43452
  chr12:50790622-50790652
  hypo

SEQ ID NO: 74796 - DNA, 24 bp, Homo sapiens
  chr12:50897742-50897766
  hypo
tttcttttctttagacggagtgtt

SEQ ID NO: 74797 - DNA, 30 bp, Homo sapiens
  chr12:50938109-50938139
  hypo
tctattcagatattccgtcactagggctgg

SEQ ID NO: 74798 - DNA, 30 bp, Homo sapiens
  chr12:51070876-51070906
  hypo
gtcccttctcccttccgtgcctcttttctc

SEQ ID NO: 74799 - DNA, 30 bp, Homo sapiens
  chr12:51237808-51237838
  hypo
taaagacgctaggtacgtattcagaacaca

SEQ ID NO: 74800 - DNA, 30 bp, Homo sapiens
  chr12:5141776-5141806
  hypo
tcaccatcaacaggtcgttgatgttaccgt

SEQ ID NO: 74801 - DNA, 520 bp, Homo sapiens
  chr12:51421126-51421646
  hypo
aaaaggatagccacctggaaggaacatttcctcgcgcccccagagccacatcatagtatctgctgccccaccaagagcaccccacacctgggaggaaccgagaaacatcagctagtgcagccagtttgaccgccttaggtgtcctcccaagcctccgtagtgaattgttttcctcctcgcccagctgactcgattctccccagacttcatcctacctacccaaaagcaatcccactctatcgccagtttcagcctcacaccgtatcttttgctctgaagatgagactgccaaactggtgaagagggaataaatggcctaacaaattaccgtaattttctgcaatgtcgtttacagccaccaaaaacattagatcctcccgccaccctcactccccgacccctcgcactgcttacagcattaaaggtaattgagcttctttattcacgtaaaaacagctaggagaaaatttcattagtaagagagaccaagaaatgaggaaaggagcgtgaactgcaaaga

SEQ ID NO: 74802 - DNA, 104 bp, Homo sapiens
  chr12:51441353-51441457
  hypo
cgacagagcaaaactgtcacaaaaacaaaacaacaaaacaaaacaaaacagagtaacatgagaataagtgtgaagtgtgtccttttcgccggcactgcttcaga

SEQ ID NO: 74803 - DNA, 372 bp, Homo sapiens; identical to SEQ ID NO: 34229
  chr12:5152915-5153287
  hyper

SEQ ID NO: 74804 - DNA, 104 bp, Homo sapiens; identical to SEQ ID NO: 11129
  chr12:5153357-5153461
  hyper

SEQ ID NO: 74805 - DNA, 69 bp, Homo sapiens
  chr12:5153656-5153725
  hyper
cgtccctgcaccaccagcgcgtccacatcaacatctccgggctgcgctttgagacgcagctgggcaccc

SEQ ID NO: 74806 - DNA, 32 bp, Homo sapiens
  chr12:51565442-51565474
  hypo
gagccaccgcacccggccgaaaggagattttt

SEQ ID NO: 74807 - DNA, 41 bp, Homo sapiens
  chr12:51749684-51749725
  hypo
gacacagctgctttgcgatgttgtggcgaaggtccctctga

SEQ ID NO: 74808 - DNA, 30 bp, Homo sapiens
  chr12:51819149-51819179
  hyper
gttgtcctgccagaacgtgggcagaaaggg

SEQ ID NO: 74809 - DNA, 86 bp, Homo sapiens
  chr12:51930708-51930794
  hypo
ctctcaccagcagtgcgtagatggatgtggtgagccactcccaagtttttgctcttaaaaagactgagcatgaagctgggcgctgt

SEQ ID NO: 74810 - DNA, 59 bp, Homo sapiens
  chr12:51985238-51985297
  hyper
agtcaggggctttgccgcagagtgcgcggcggggctccaggggccgtggagctggggct

SEQ ID NO: 74811 - DNA, 30 bp, Homo sapiens
  chr12:52074429-52074459
  hypo
cctatatttccatcacgaccaaaccaagag

SEQ ID NO: 74812 - DNA, 84 bp, Homo sapiens
  chr12:52207881-52207965
  hyper
agccctgcactgtggcgagcgggccggggctgccgggcgacgcccggtcgccgtcgccgccagtgatccatagcgtgagcagga

SEQ ID NO: 74813 - DNA, 403 bp, Homo sapiens
  chr12:52208001-52208404
  hyper
cggtgaggaggccgagcgccagcggccccgcccaacccatggggctccgctcgtacaggggctgcggcaggcgctccacgatcagctgcagggcgtcccagtccggcgcggggaccgcggcgcgccgggggcgcggggccggggcaaagggcacgcgggcggcggcgccgggccgcggcaggaagcgctgcccgaacttgcgcagctgcagcgtcgcctgctggtggaggttcttgcccagctccctggccacgtccgggcggccgctgcgccgcagggcccgagccaggcggtcccaggacagggacgcggcctggggggccagccaggccgccagcgcctcccggcagccgtcggacacctctccaggcccggctaccctgcccgccgggtcctcggccgc

SEQ ID NO: 74814 - DNA, 85 bp, Homo sapiens; identical to SEQ ID NO: 34372
  chr12:52208668-52208753
  hyper

SEQ ID NO: 74815 - DNA, 30 bp, Homo sapiens
  chr12:52241437-52241467
  hyper
ggcctcctcctctggcgggggcagggggac

SEQ ID NO: 74816 - DNA, 128 bp, Homo sapiens
  chr12:52241703-52241831
  hyper
cccctgactctgagacgcgggctctgttctcccgggccagaggagaagacatgaagagggtgggtgttaggggcgcggggaccctaagtagcctcggcctcctgtcactgccccgtcaccatgctggg

SEQ ID NO: 74817 - DNA, 307 bp, Homo sapiens
  chr12:52242119-52242426
  hyper
ccgagaagtgaccctcggctcccacgtacccgctagggtctctcgccggccctgccctccgacccccgccgagctgaaccccgcgactagcagcccccgccctctcggccctctccggccccgggccggcggacaaagctccggacaccctgaccgaacggtcacctccccccgccccatcccggcccgcccgcggccccgtacctcggcatcacggccgggtcctaggtgagtgtgcgcggcctgggggcgcgtccggcccggggaccggggcggcggcgcgggccgggggcgacaggcctgggct

SEQ ID NO: 74818 - DNA, 152 bp, Homo sapiens
  chr12:52258092-52258244
  hyper
cgcagaggctcagtccgcccaatccccggccgcccgccatcctgggcgcccccggcccggggcccggtcccgcccgtaaatcagctccgtcagcgttaatggctcctgactaattgcctggacttgggctccgggctcgggtcgccagcatt

SEQ ID NO: 74819 - DNA, 625 bp, Homo sapiens
  chr12:52262788-52263413
  hyper
cgtgaactatccacccgtgtgcacgccagccgagcgagtggccgagggacacccccgtgcttcccaaggcctggctccacgaggagcagaaccccagcggtgggattctgtcgcgcaatgctgtgtggctccgactagggcccgccctccagcaaagagatgctggtgggtgctctcggttcacccccgcactcgccccaggggggctcgcgggccacctggagctcccgcccctcggtggccagggctgcgcgtgaaagggggacgttcggacgcgggggcgcggagccagcgcgcgagcctcggagcctcccccaggctgtgggggaagaggagggaggagggagcagatggcagcaattaccgctcggaccctcccccgccgtagcctggggccggaagatcggctcggcagctcgctcctgcgggaggggcggcggcctccccggccgggaaccggcggggagggggtccgggaggggcggctctggccgccggggcgcgggcatcccagcttctaggggagagtgatgtgagggcccggtggagacacctccttctcccgggacgagggctgagagattccctttggaaaggccgagtctccggccgcccccacccccag

SEQ ID NO: 74820 - DNA, 282 bp, Homo sapiens
  chr12:52301024-52301306
  hyper
gccccctcggggaggcggatgtgggaggcccggcccgggtgcgggccagcgacccgggagctgcgggcggctgggaggggaggccgccctgaggggctgggagcggcgcgggggtgggtcccggtcctgcagccccagcgaggggcgagcggcggccagtcggcgagctgggcaataaggaaacggtttattaggagggagtggtggagctgggccaggcaggaagacgctggaataagaaacatttttgctccagcccccatcccagtcccgggaggctgc

SEQ ID NO: 74821 - DNA, 14 bp, Homo sapiens
  chr12:52301505-52301519
  hyper
gggtggcgggcggc

SEQ ID NO: 74822 - DNA, 37 bp, Homo sapiens
  chr12:52309137-52309174
  hypo
ggctagctgtgtccgcggcatgcggcctggcgcacct

SEQ ID NO: 74823 - DNA, 72 bp, Homo sapiens
  chr12:52317378-52317450
  hyper
ccgagggctgcccagcggccgcctcccatccccacacagggaccgcggggcctttcccggcagggtggggca

SEQ ID NO: 74824 - DNA, 206 bp, Homo sapiens
  chr12:52387854-52388060
  hypo
cctctcccagctcagcgtgcaggaagacgtgaagatctaactgctccctctctccacacggagctcctggcagcgagaactacgcacagctgccgcgttgagcgtacgatggaggcctacctctcgtttctgcccagccctctgtggccaggagccctggcccgcaagagggacagagcccgggagagactcgctcactcccatgt

SEQ ID NO: 74825 - DNA, 198 bp, Homo sapiens
  chr12:52388300-52388498
  hypo
cacaccaaggtggcccggaagaaccagaagtgcagcccctctcacaggcagctctgagccgcgctttcccctcctccctgggatggacgctgccgggagactgccagtggagacggaatctgccgctttgtctgtccagccgtgtgtgcatgtgccgaggtgcgtcccccgttgtgcctggttcgtgccatgccctta

SEQ ID NO: 74826 - DNA, 234 bp, Homo sapiens
  chr12:52400255-52400489
  hyper
ccacccctactcctgcgcagccccgctgccgctctccctgccctggagtctcctgcagccccttggatctccgtgactctccctacctccccgactccccaggcttcttacagtgacctcttaccgtgccccactccatgaatcgccagagctattcgtccctaaatttcaaaccttgcgcaatgtcccttcacagacccctccaggtatcacgcagccccgagccccgagccc

SEQ ID NO: 74827 - DNA, 391 bp, Homo sapiens; identical to SEQ ID NO: 34379
  chr12:52400516-52400907
  hyper

SEQ ID NO: 74828 - DNA, 629 bp, Homo sapiens; identical to SEQ ID NO: 34380
  chr12:52400908-52401537
  hyper

SEQ ID NO: 74829 - DNA, 32 bp, Homo sapiens
  chr12:52416953-52416985
  hyper
ggggttggagccccacgcgctgctcaagaggc

SEQ ID NO: 74830 - DNA, 39 bp, Homo sapiens
  chr12:52467638-52467677
  hypo
tctgaggaactggatcgtgccctgcgcaaggttgttggg

SEQ ID NO: 74831 - DNA, 53 bp, Homo sapiens
  chr12:52491074-52491127
  hypo
tattacgatacacatcgcaggggggcgggcgacccccacgatgcggggagaaa

SEQ ID NO: 74832 - DNA, 30 bp, Homo sapiens
  chr12:52514449-52514479
  hypo
aacaaagacgtggatcgcttggggaggtgt

SEQ ID NO: 74833 - DNA, 37 bp, Homo sapiens
  chr12:5252286-5252323
  hypo
cacctccacatcatccgtaatccgatcacctccacat

SEQ ID NO: 74834 - DNA, 172 bp, Homo sapiens
  chr12:52524463-52524635
  hypo
tcatacacacacacacgcacacacacaaaagagagaggctgagaggagttgttcacttctttcgggggaggagggtctctgccatctggcatcccactaggggtcctggaaaggaaggagctgaatctaagtgctgggtttagcccacagccctcggcgtgctgctcacaca

SEQ ID NO: 74835 - DNA, 30 bp, Homo sapiens; identical to SEQ ID NO: 34381
  chr12:52615930-52615960
  hyper

SEQ ID NO: 74836 - DNA, 217 bp, Homo sapiens
  chr12:52626830-52627047
  hyper
cgctcctgcctactccggaccatccctgcttggactgaaagcctgggcttcggcggggcgggcgggcagagggcggagggcggccccaggaggggcctggcagcagagaaaggtggcccgcggcagccccgcccctacctgtggaagcccagccgcccgctcccgcggataaaaggcgcggagtgtccccgaggtcagcgagtgcgcgctcctcctc

SEQ ID NO: 74837 - DNA, 14 bp, Homo sapiens
  chr12:52627272-52627286
  hyper
gaggtcaccattaa

SEQ ID NO: 74838 - DNA, 82 bp, Homo sapiens; identical to SEQ ID NO: 34384
  chr12:52652138-52652220
  hyper

SEQ ID NO: 74839 - DNA, 56 bp, Homo sapiens
  chr12:52652599-52652655
  hyper
gagtggaacccctccacctgtccgcccctccgccgggactccgagctttgccttgt

SEQ ID NO: 74840 - DNA, 76 bp, Homo sapiens
  chr12:52701967-52702043
  hyper
gcccggcgccttttccgcggcactgacctctcgccttctctccctgcaggctgtgcgagggcgtcggctcggtgaa

SEQ ID NO: 74841 - DNA, 211 bp, Homo sapiens; identical to SEQ ID NO: 11234
  chr12:52702362-52702573
  hyper

SEQ ID NO: 74842 - DNA, 30 bp, Homo sapiens; identical to SEQ ID NO: 43460
  chr12:52913808-52913838
  hypo

SEQ ID NO: 74843 - DNA, 30 bp, Homo sapiens; identical to SEQ ID NO: 43461
  chr12:52914057-52914087
  hypo

SEQ ID NO: 74844 - DNA, 41 bp, Homo sapiens
  chr12:53004285-53004326
  hyper
gtgaagtaaacacatcgccagctcgccgccccctccccccc

SEQ ID NO: 74845 - DNA, 102 bp, Homo sapiens; identical to SEQ ID NO: 43462
  chr12:53069161-53069263
  hypo

SEQ ID NO: 74846 - DNA, 196 bp, Homo sapiens
  chr12:53084865-53085061
  hyper
ggggatcaggaagggcgtggaggggaggagtttgaggagagggcggtgaggggcaggcgtgatgtgtggcagaaacgaggcctctactccaagatccgcctgtgggaggtgttggtggaggtctggatgatctgcacgcgcgaggatccgcggccgcttctgccgctccctccgtagctcccgccaccgccgccgc

SEQ ID NO: 74847 - DNA, 30 bp, Homo sapiens
  chr12:53088494-53088524
  hypo
tccaggtccagggaacggttattgtccatg

SEQ ID NO: 74848 - DNA, 615 bp, Homo sapiens
  chr12:53107999-53108614
  hyper
acaggtcagaagcagcggagggaaggggccccgcgggggtgcgggggagctcagagcggggcgtgccggagggcgaaggggactggggtccgaggacgcccctggcgcggggttcagaatttgtggcgggaccgccagctctaggaggagctttgttctctctggcggcgctgctgccgccgccgccgccaccccggctgacggcgcaggagtcccggagccagagaagccccccgagcaccgcggagctcccgcccaagccccagccgctgcggccccggctaccgccgcgggcccgggctccgactcctcctcccagggcgcagccgccgccagtgctgctgtggccagtctctgcaaagacggtcggggtcagggagcctggcagtgtccgcccggcacgccagcccctcccacagtcccgagccgcaggtcttcccggggtgacgccccgccgagatccggcaaggcgtggggaggacaggcttcaaggaggggaggggaggttggttcctccaaaacagccaccaacagctcttccagcctgcaggcctgatggcctcgcaccagcgctggcacatggcttgagaaactgcattccgaggcctccagccc

SEQ ID NO: 74849 - DNA, 156 bp, Homo sapiens
  chr12:5315378-5315534
  hypo
cgtgatctgcggcctcccaaagtgctgggattacaggcgtgacccagaaagttgagtaacttcttaaaggctatgtgaattattttcatttcacatcactattcacttgagcagtgagatttacacacttatcagctcttacgcttgctctttaaa

SEQ ID NO: 74850 - DNA, 210 bp, Homo sapiens; identical to SEQ ID NO: 43463
  chr12:53189513-53189723
  hypo

SEQ ID NO: 74851 - DNA, 146 bp, Homo sapiens
  chr12:5323880-5324026
  hypo
gcagggggctagtggcgttctattttcttgtggagtgatggcctggaaaatataatgtacgggagatgtaatggtgacccaccgacctggccgggatgccttgcttccccttcctcccacacctacacacacgtgcacacgttgag

SEQ ID NO: 74852 - DNA, 78 bp, Homo sapiens
  chr12:53241495-53241573
  hypo
gactgcgggacacctcgtttacctgtagcaggtgggcacctgagagcctggggaatggggacgcggaggggtagaggg

SEQ ID NO: 74853 - DNA, 32 bp, Homo sapiens
  chr12:53342879-53342911
  hyper
tcgggtcgcgcggctcgcgcaggccgccaccg

SEQ ID NO: 74854 - DNA, 141 bp, Homo sapiens; identical to SEQ ID NO: 43339
  chr12:5335908-5336049
  hypo

SEQ ID NO: 74855 - DNA, 41 bp, Homo sapiens; identical to SEQ ID NO: 34390
  chr12:53359275-53359316
  hyper

SEQ ID NO: 74856 - DNA, 210 bp, Homo sapiens; identical to SEQ ID NO: 34391
  chr12:53359385-53359595
  hyper

SEQ ID NO: 74857 - DNA, 21 bp, Homo sapiens
  chr12:53402530-53402551
  hypo
ttcttaaaggccgggcgcggt

SEQ ID NO: 74858 - DNA, 223 bp, Homo sapiens
  chr12:53454914-53455137
  hypo
gaaacgccacctgcccgggccggggcaacagccaggaccctggggcccagagcaggcatcatcgccagccagaggcatcagtcaccatgtcaccttcgcacctctgctctcagataatgtcccccaaaccccaggtataaaggccttgagggggttggtgccaccttgagagaaccctttctcctgggatgtagcatggatggggacccgggtaccctggggt

SEQ ID NO: 74859 - DNA, 30 bp, Homo sapiens; identical to SEQ ID NO: 43464
  chr12:53455806-53455836
  hypo

SEQ ID NO: 74860 - DNA, 38 bp, Homo sapiens
  chr12:53456042-53456080
  hypo
gcctggggaaggctacgttgggtcggtttagggagatg

SEQ ID NO: 74861 - DNA, 50 bp, Homo sapiens
  chr12:53509507-53509557
  hypo
cccccaaagagggggcggggcccacgagagggaggcgctggagaaggcat

SEQ ID NO: 74862 - DNA, 15 bp, Homo sapiens
  chr12:53535782-53535797
  hypo
cggttggagtgtgtg

SEQ ID NO: 74863 - DNA, 240 bp, Homo sapiens; identical to SEQ ID NO: 43466
  chr12:53662984-53663224
  hypo

SEQ ID NO: 74864 - DNA, 35 bp, Homo sapiens
  chr12:53668208-53668243
  hypo
tggaatgcagtggatcggtgcgagaagccaaggat

SEQ ID NO: 74865 - DNA, 87 bp, Homo sapiens
  chr12:5370466-5370553
  hypo
ggcaagagtgctctccgaaaagagattagggctggagagaatgatctcaacatgcatggagtccttaatacagggagttagtaagac

SEQ ID NO: 74866 - DNA, 330 bp, Homo sapiens
  chr12:53719553-53719883
  hyper
ttggggggcgggggccgcacaaagccctattgtggctcggggatgctgccacagagtggtttttgttcttcggctaactccgtggcgggcacgactgattgcagacccagggcagggggcgggttacgtgccaggcccagtctgcccgccgggagccgcaccaccgcccgactggggccgcgcaggagtccgcactgcaaccgcggtgcccgcgctcgggtcgcgtcactgccctgaccagggtcagttggtgcagtccagaaagggccagggtagaaaccagtgagtcttcccaactctgcagaaagcactgcacgcccaaaaactgaa

SEQ ID NO: 74867 - DNA, 120 bp, Homo sapiens
  chr12:53763895-53764015
  hypo
aaaataaataaataaaataataataataatcatttaaatcagaagagaagaaaatgaacctagaacacccatcatctgaacttagcaattattattattattattattattattattatt

SEQ ID NO: 74868 - DNA, 36 bp, Homo sapiens
  chr12:53785467-53785503
  hypo
aatgatcttgttacccgggtccggtcatgagcatag

SEQ ID NO: 74869 - DNA, 16 bp, Homo sapiens
  chr12:53810619-53810635
  hypo
aggtgtggtggctcac

SEQ ID NO: 74870 - DNA, 30 bp, Homo sapiens; identical to SEQ ID NO: 43467
  chr12:53813830-53813860
  hypo

SEQ ID NO: 74871 - DNA, 42 bp, Homo sapiens
  chr12:53832375-53832417
  hypo
ctggacaacggggccagggcgagactccgtctcaaaaaaaaa

SEQ ID NO: 74872 - DNA, 30 bp, Homo sapiens; identical to SEQ ID NO: 43340
  chr12:5384595-5384625
  hypo

SEQ ID NO: 74873 - DNA, 120 bp, Homo sapiens; identical to SEQ ID NO: 43468
  chr12:53885488-53885608
  hypo

SEQ ID NO: 74874 - DNA, 30 bp, Homo sapiens
  chr12:54021415-54021445
  hypo
tttcttaaaatttaacgaattgtagttgac

SEQ ID NO: 74875 - DNA, 564 bp, Homo sapiens; identical to SEQ ID NO: 34393
  chr12:54089081-54089645
  hyper

SEQ ID NO: 74876 - DNA, 287 bp, Homo sapiens
  chr12:54132239-54132526
  hyper
gacataaattacctgcgaggaggaaagacgcagaggctgcgcactttccttcctctcccccagacccgcgcaaggcgctgagggggtcctccctccggcaaaggcggagggacggcctgacaggaacagtgtgcacttgcctctgtcctcccccgagggacagtggcctggggtgaccgagaaacctggccctcccaaggtccccgggctgccaaggaggacccttcggccttagggcggagcctcccccgccgctcaggggaggtggagctcgttgtggtgggcgg

SEQ ID NO: 74877 - DNA, 52 bp, Homo sapiens
  chr12:54133602-54133654
  hyper
atcgtccatctgatgcgcggggcccagcactccatcgcgaacatttgggccg

SEQ ID NO: 74878 - DNA, 1019 bp, Homo sapiens
  chr12:54144839-54145858
  hyper
tcacacacacacacacgcacacactcactcctgcgcacacaggctgctccgcggacacgcttcacggagcaggtgtgcccacgcgcaataccctcctggcccacaggcctccgcacgcacaggacacacacacacactctctcctggcctccctcccgccgcccctcctctgagccctgcggcccggccttccgcacctcccaacgcctgcaggggttgggggcgctggggctcggggcgctcactcggacctcggagccaatcgccagagatctaatggctcctttggcagtgggaaggggtgtgcgtgggtgtcctctccttcactctttccccagccctgtcgcctcccaccccccttccggccgcggcagtttccgaaatcgcccggcggccgcgaattcattagtggggggcggatgtaaacgcagcgcggtggaacgttttaattaggcctgaacaataaacaagctaaacgaggcgcgcaggactccctggtgggccctcagcctcctccgcgcggcgcggactcattacggctgcagccaatttcatgccagcgccgagcactggctgggccgggagtggggtcgggggtgcgtgcgggtgcgatccgggcctgcagggtgcggagcgggggcgtcccggggcgagggcagcgggccggttcccgcccgcccggggccgcggcttccgcatttctgcaccatccacctgcctttttcagtgtccttgagatgacgctccctccccacaccagagcggccggctggagagtctagcttgctttttagggtctctctcccgcctcttttcctcccccgctccctctctccttgcggctgactccagctccccctcggtgcccgtaaccctcctttcctctttttgccgcagtctccgtctctcttccacagggtctctccctccccctctccccgtggttgtcagactttctcctggactttctccgccccgcaccgcccgccccggatgccgagcgtggtagactctgcagc

SEQ ID NO: 74879 - DNA, 92 bp, Homo sapiens; identical to SEQ ID NO: 34397
  chr12:54145880-54145972
  hyper

SEQ ID NO: 74880 - DNA, 964 bp, Homo sapiens
  chr12:54321250-54322214
  hyper
aaatttctgccctgtcgttccaatgccatgatggagaaggacccctaaaatcgcctttggcgtgtgcagctcgagcgttacaacgatgcaaagtgcggtctttggaggatgcgggagtcggtaacccctcaattcactctcgccgttccttctctccagtctgcgcgaaagccaggtccgagggcttcgaagatctgggggacccgagctgcgcacagtggcgggaaacgagcgggctcagctggccgggccgcgtcccctagccaccgcccgcccgcccgctgctttggcctccggagaagcctggagaggggcctgcgcctcttgaaaaatggcttttgggggcggtaggtctcgggagggcgactggggaaagtgacttgccgcggcttcgagtagagacgttggtgcgggacccaactcctggggaaggcggggagcgctgggcggatgcctggccctagtgcggcgccaacacatacaagttccgctgtgaatgtttgaaagtgtaagtttctctcggattgatttttttttcctttaaatgtatccccttcaaaaaaaaaaaaaaacaaacaaacaaaaaaaaaaaaaacaaagacgtggacaggcaggcgccacccggtctgggagctgaggttcgtgactgctgccgatttcgtttggttcaagttgagaaaataagggtctccccgtcccaggctgggagcgtggggacttccgtctctggactgtgcaaaccgtctggggctgcctcccagactggcatgctctccccgccccctgaaacctagggaaggtttcctggaggcactggactccagatccctgcagggcgggacggagaaaaagccctgaataccactgcccacacccctccaagtcgggagcccccacgcgccagtcgagcctacgcagctgtggggtgggaaggagaagacaagtcctccgccaagaactcccc

SEQ ID NO: 74881 - DNA, 433 bp, Homo sapiens
  chr12:54324532-54324965
  hyper
aggtagtgtcgcgggcgcttcctagtgcgggcactcatcctgccgctctccggtcggccatttattgtcttgtggggaagggctttcgccaagaaacttggtctgggttagtgaaataaaatactaaacaattactatatgtaaaattttaaaaccagcatattaaaataaactaaggaactctctgtcgtgggagaaatccacaggaaaaggaagagaaggagttagatgctggcgccgagttcctggcggagccaggcggcggtgactcctcaggctgagcggaatcgccatccaggcgccggaaacgacccgaatcccaaaatccgtggaagaaaattgcgctgaaagaacagagccaacgcccccgtcctgccaagtttggcgagacggcaagttggcttcaggagcacaatgccgctaaatgatgcct

SEQ ID NO: 74882 - DNA, 223 bp, Homo sapiens
  chr12:54329256-54329479
  hyper
gcacgcaagcgcacgcgcacacgcacatacacagacgcttcccgtgaaaaagcatattaaatatctcctttctgtgttggatcatttaaaagaaaacatttcagagttgaacttagccgagagcttggttcatgagctgtagctgagggcagagtggcttctgccgctccgcggttgtagaagtccctttgaaaaagcagccgagagcagagccggggcttcc

SEQ ID NO: 74883 - DNA, 313 bp, Homo sapiens
  chr12:54329604-54329917
  hyper
cgaaggccggcggggcgcgcccgggtgagcaccgcagccgagggtttcagcgccaggccctggaaaggctttctagggcgagatcgccttggagatgtaattactacgtttctagtggtgcatattctcctggagtgtttaatttgattttacttgtgtctcagcgagatccacatttttttttcgggggagggggaagaaaccaccccaggcttaaagttaattaaccagcaaggctttactttccaccgccctcctgcaggctcttgcctcggcgcctcccttcccgatcccggctcgccccagacttgga

SEQ ID NO: 74884 - DNA, 292 bp, Homo sapiens
  chr12:54330283-54330575
  hyper
cacccagatccttcacgccgttctggttcccactcccgccattctggttcctactcccaaaggctggggacgtgtctttgagtcctggcccgcggaaaacgggtccggcgttgggcctgaccggggagggagccccaagaatggggtgggcgtttcaggccctttgtttctcctggcagccctgcagaaccctgtccacagcgccccactacttccacctgggagcagcacttcacagaaggggaggccaggatctgggttccacttctactacccgcggctggaaaaaggc

SEQ ID NO: 74885 - DNA, 345 bp, Homo sapiens
  chr12:54330790-54331135
  hyper
ccctcaatgcacactcgagctggtctccttatgtcttaactctctttctgttgtatttttcctcctaatgccagcccagcccgcagcctgctttctgaactctgagctgacccttctggatgaagatcacgcagataagaattactatcctaactcaccgatgtccgggtgctctcaaccgtcaaacaccaccttctccccacaaagaggagggaggtggcccgaaggggtttctgcagacctgtccatttgctctccacttgaggggtgcagtaggtctggctgagcgaggcgctgctctgtggccatggtctgtgcgctggctgcacacgagcactcagcatt

SEQ ID NO: 74886 - DNA, 42 bp, Homo sapiens
  chr12:54331998-54332040
  hyper
cgggttctttccagccgcgagcggaggcgagctgccagggcc

SEQ ID NO: 74887 - DNA, 1114 bp, Homo sapiens
  chr12:54332740-54333854
  hyper
cgtctatgaggacagcgcggcggagagcggcatcggcggcggcggcggaggaggaggcggcggcacgggcggagcggggggtggctgcagcggagcgagccccggcaaagccccgagcatggatggtctgggcagcagctgcccggccagccactgccgcgacctgcttccgcaccccgtgctgggccgcccgccggctcccctgggcgcccctcagggcgccgtctatacggacatcccggccccggaggcggcgcgccagtgtgccccgccgcccgcaccccccacctcgtccagcgccaccctgggctacggctaccccttcgggggcagctactacggctgccgcctgtcgcacaacgtgaacctgcagcagaagccttgcgcctaccacccgggcgataaatacccggagccgtcgggcgccctgcccggtgacgacctgtcctctagggccaaggagttcgccttctaccccagcttcgccagctcctaccaggcgatgcccggctacctggacgtgtcggtggtgcccgggatcagcgggcacccggagccgcgtcacgacgccctcatccccgtcgaaggctaccagcactgggctctctccaatggctgggacagtcaggtgtactgctccaaggagcagtcgcagtccgcccacctctggaagtctcccttcccaggtaaggaagggacccgagcgccgccgccgccggggacccctccccgccctgcctgccccggggctccgcgccccaaccacccccgccgtctggccccggcgcgcccgctcggctgggctgcctatggagccggccgggcgagctgcactgaggaatgcgccggggaagaaatctgctccgacacgttctctgtagctgcccggccgagaatgaagcaatcacaggcgcccgaaagccgggccgccggctctgctctgtccggtagctcgcctccgcctccccttgcaggctccagcctcccgccgggctcttggcccctaaacctgcttccggcaagggatgggggcggggtgggcctatagtgccttggaatccaggacaaaacccccaacccaccgaataactggggagggcggagaataagaacc

SEQ ID NO: 74888 - DNA, 152 bp, Homo sapiens; identical to SEQ ID NO: 34406
  chr12:54338666-54338818
  hyper

SEQ ID NO: 74889 - DNA, 611 bp, Homo sapiens
  chr12:54338978-54339589
  hyper
ggcgggtcaaagagaagaaggtggtcagcaaatcgaaagcgcctcatctccactccacctgaccacccacccgctgcttgccccatctatttatgtctccgctttgtaccataaccgaacccacggaaagacgctgcgcgggtgcagaagagtatttaatgttaaggaaagagaagaaccgcgccgcccggaggcagagaggctccatggccgtgctgctgggccatccccaactccctatcccatccccagcctccacccccatccagatgggactcacgtggcttcaacagctttggaaatgggtcccgagtgggccgtgcgaggaaggctgtcgacctctactcctccttgcgctcaccttgccagaaagtctggtggcagcgcagagcccaatcattccaaccaaagcagggttggggaatcccgaatggccccaattcttgcctcatcctatgaccaggcttttagaggaccttccctaagggcgcagcttcggagcaggatctgtccagctcatactttccttcgctgtccctcccgcactccttaggcaagatttcccagtaaagattttctgtgcgtattttaaaagtcgtgttaatactcat

SEQ ID NO: 74890 - DNA, 261 bp, Homo sapiens; identical to SEQ ID NO: 34408
  chr12:54343569-54343830
  hyper

SEQ ID NO: 74891 - DNA, 196 bp, Homo sapiens
  chr12:54345040-54345236
  hyper
ggcctaatttgcatacgaggcagaaccgctttctgcaaactagacagtgaccttgaactgggccgctgcggcctctggacagaccaggggtaaggcagcactgcgcggaatcactcccgaccacgggtcggcgggggagccaaaacgcagtcactcacagccgattccccgcggtctaagccgccagcagccacgt

SEQ ID NO: 74892 - DNA, 92 bp, Homo sapiens
  chr12:54345567-54345659
  hyper
agagttcgcaccaatcgctccacggtttgggtgcctcggcctgaccacctatagttttgcgcatggtcagcgaagtgccggcgggttaagcc

SEQ ID NO: 74893 - DNA, 67 bp, Homo sapiens; identical to SEQ ID NO: 34411
  chr12:54345965-54346032
  hyper

SEQ ID NO: 74894 - DNA, 342 bp, Homo sapiens
  chr12:54348738-54349080
  hyper
ccgggtttgtggggccgctggtaaacatccacacgggagacaccttctacttccccaacttccgcgcgtccggggcgcagcttcccgggctgccttcgctgtcctacccacgccgcgacaacgtgtgctccctgtcctggccgtcggcggagccgtgcaatggctacccgcagccctacctcggcagcccagtgtctctcaaccctcccttcggccgcacgtgcgagctggcgcgcgtggaggacggcaagggttactaccgcgagccgtgcgccgagggtggcggcgggggcctgaagcgtgaggagcgcgggcgcgacccgggagccgggcccggggcag

SEQ ID NO: 74895 - DNA, 136 bp, Homo sapiens
  chr12:54349255-54349391
  hyper
cgccggcgcaggcgaccccggcagcttggtatcgccgttgaaccccggcggcgggctctcggccagcggtaaggaccccggccactcaagcggcggattcaaacccgacctcttaccagggcgggcagaacaggac

SEQ ID NO: 74896 - DNA, 218 bp, Homo sapiens
  chr12:54354476-54354694
  hyper
tctgctccactctgacgtgcacagacgaaattgagtatttaaagccactaagccgctatcgagccggcaggtgatgggtccggccgtctgggttctgtgggtgctaatgtagccggaaatccggcgcgatcgatggctgagacccagagcagagcagggaccgctggccccggtccgcgaacaaagcaaactccggggacttggggttccggccaggc

SEQ ID NO: 74897 - DNA, 273 bp, Homo sapiens; identical to SEQ ID NO: 34415
  chr12:54354814-54355087
  hyper

SEQ ID NO: 74898 - DNA, 64 bp, Homo sapiens
  chr12:54359619-54359683
  hyper
aaagataaaaagaggcgggagggaggcagaagcaagggtcggctgttgctctccctcgcccggg

SEQ ID NO: 74899 - DNA, 342 bp, Homo sapiens; identical to SEQ ID NO: 34417
  chr12:54359742-54360084
  hyper

SEQ ID NO: 74900 - DNA, 80 bp, Homo sapiens
  chr12:54360569-54360649
  hyper
gggagacagggagaccgggagcgtaaggcagcgccgcagccggcccggcgagaccgaaagagccccgtatccgccgcgac

SEQ ID NO: 74901 - DNA, 120 bp, Homo sapiens
  chr12:54363641-54363761
  hyper
ctcctttccctaccacgatctgctctctagaacccagagcagtggaggaggtagacaagctaacaggaggccccaacgctgtgtgcgggagtttgctctgggagccgcccagggtagaat

SEQ ID NO: 74902 - DNA, 526 bp, Homo sapiens
  chr12:54366849-54367375
  hyper
cccctcctacgtctgcgaagtgctccgaactgatatatgacaatatctactttggatcacgtgctcagagagagagagactaagacggataacgcgtcatctcgccttcccaaattttcccccctcgctagaccgggtccaaaacctccatccggagccggcaggagaggagaacgatgtttaactcggtcaacctgggcaacttctgctctccgtcgcgcaaggagaggggcgcagatttcggcgagcgagggagctgcgcctccaacctctatctgcccagttgcacttactacatgcccgagttctccacggtctcctccttcctgccccaggccccctctcgtcagatctcctatccctactcggcccaagtgcccccggtccgggaggtctcctacggcctggagccatccggcaagtggcaccatcggaacagctactcctcctgctatgcggcggccgacgagcttatgcaccgggagtgcctgcctccttccaccgtcaccgagatcctcatgaaaaa

SEQ ID NO: 74903 - DNA, 201 bp, Homo sapiens
  chr12:54367429-54367630
  hyper
cggcttctactcctcagtcaacaagaacagcgtcctgcctcaagccttcgaccgtttcttcgacaacgcctactgcggtggcggcgacccgcccgccgagcccccctgctccggcaagggcgaggccaagggggagcccgaggcacccccggcctcgggactggcgtcccgggctgaggcgggtgccgaggcggaggctga

SEQ ID NO: 74904 - DNA, 135 bp, Homo sapiens
  chr12:54368297-54368432
  hyper
caactctggggtcagcggcgacaggggaatggggcgaggcggcgcaggactccactgcgttccaggcgggggtctgggcgtttctcccgggtccgcggccttagtgcttgcctagaactgcggtgtggaaggcgc

SEQ ID NO: 74905 - DNA, 355 bp, Homo sapiens; identical to SEQ ID NO: 34422
  chr12:54368647-54369002
  hyper

SEQ ID NO: 74906 - DNA, 44 bp, Homo sapiens
  chr12:54369259-54369303
  hyper
ttttattttctaactcgtcttctttccgccggtggaaaactgga

SEQ ID NO: 74907 - DNA, 154 bp, Homo sapiens
  chr12:54377085-54377239
  hyper
cctcgtaaaagggaacggtttcgatcaaactggtggggaaagactaatgcagataatacaaacagagtggccataaagtctcgcccgtttcccgcgggatgggcggtgggacaaatggctccctggattgactgctgcccggactgtcccaagt

SEQ ID NO: 74908 - DNA, 94 bp, Homo sapiens
  chr12:54377853-54377947
  hyper
tgtgtgctggtttcccgtgtgatacgtgactcctccaaactgaccgaggctccgcaggttccctctttctttcccggaatattccctgttttag

SEQ ID NO: 74909 - DNA, 350 bp, Homo sapiens
  chr12:54377977-54378327
  hyper
cgccagggcctgaagtaaagcagcagaaccggctccaaggccaaagccttgtgggcccctgagatggtgacccaggagccgcccaccctgccaggcccaggccacagctctcgggtcggggatcgggtgcctctggtctctggcttcctctttcccctaccccgcgtccattcggaacctccttttccgagcagccatgaagtgaccgtgaccccctccctggcccaccctagaggctggagattcccagtcaacccccacaggaaacttgcaactccagcgccgcggcccccaagcttccagccccgagggccaagcccggggaaaagaggaggcgggagagcagaaac

SEQ ID NO: 74910 - DNA, 1211 bp, Homo sapiens
  chr12:54378720-54379931
  hyper
cgcggggaagggctccggtgcccctaccccgaggcagctgctagatggcgctgttactccactctgcgcgctccgcctgccgacaacttgaccccgctgacgtcacggccgtctgaatcatcaaggccattttcaaatcccattggtctagccgtcacatggtgagaaccgaatgcgcggataattacggagctgatatttccccccctccccttctttttcctccctcccctccaaccgcgccccccctcccggatggggaaaaaaaaagatgtcagctcctccgctgtagtattgctccttaaaaacccctctctctgaaaatgacatgccctcgcaatgtaactccgaactcgtacgcggagcccttggctgcgcccggcggaggagagcgctatagccggagcgcaggcatgtatatgcagtctgggagtgacttcaattgcggggtgatgaggggctgcgggctcgcgccctcgctctccaagagggacgagggcagcagccccagcctcgccctcaacacctatccgtcctacctctcgcagctggactcctggggcgaccccaaagccgcctatcgcctggaacaacctgttggcaggccgctgtcctcctgctcctacccacctagtgtcaaggaggagaatgtctgctgcatgtacagcgcagagaagcgggcgaaaagtggccccgaggcagctctctactcccaccccttgccggagtcctgccttggggagcacgaggtacccgtgcccagctactaccgcgccagcccgagctactccgcgctggacaagacgccccactgttctggggccaacgacttcgaagcccctttcgagcagcgggccagtctcaacccgcgcgccgaacatctggaatcgcctcagctggggggcaaagtgagtttccctgagacccccaagtccgacagccagacccccagccccaatgaaatcaagacggagcagagcctggcgggccctaaagggagcccctcggagagcgaaaaggagagggccaaagctgccgactccagcccagacacctcggataacgaagcgaaaggtaaggccgcctgggccgcgggcgccactgggacgttccggcacttggtcttcgcggccggggaggggggcaggggagagggttgggcccaggaggccccagaccatttcgggaatgcgaccctggctttcgactag

SEQ ID NO: 74911 - DNA, 434 bp, Homo sapiens; identical to SEQ ID NO: 34426
  chr12:54379958-54380392
  hyper

SEQ ID NO: 74912 - DNA, 89 bp, Homo sapiens
  chr12:54384576-54384665
  hyper
aggaggaggaggcagcgacaaggtaagagaagcggtttcttgttcttctcttggcggcggagtggggatgagcggtgtccccaggtgtc

SEQ ID NO: 74913 - DNA, 5 bp, Homo sapiens
  chr12:54384762-54384767
  hyper
cgact

SEQ ID NO: 74914 - DNA, 536 bp, Homo sapiens
  chr12:54387818-54388354
  hyper
aagagctcgccaaggcgagccttggtctctgagatctctcgtcggctgctggggctccggctcagcctggcagatccgctgtggcctctctgggacctcgccccggcccacggcctgacttcggctcggagatgcagcccttcccgagaacaggtgaagaagacggcggcagcggggactgggggcttcgggtgggaacgccagggctcagggctttgtgtgggtcgtgcagggggcgaggttcgaagtcctgggctggaccgcagcacgagtgtggcccggacggctgcgtggccagaaggggtgttcgggcagggtgcgagagcaccggcaaggtggattgtgtatggactttggccgcagacagagcagagcgggctcccgggctgtggccggcggcgaggcgggcaaccgcatgttgagtctatagaaaggaccttgaggtctgctgggtgtttgggctgccctgggggcggcggcccagagtgtggagcaagcggcgcgcggggcgcggcggtcagcgtgggagaggctgc

SEQ ID NO: 74915 - DNA, 251 bp, Homo sapiens
  chr12:54388604-54388855
  hyper
gggagggaaggagggcgggcggcggcggccgtggtggccggggcttccctccccaggcgggagccgcctgtcctgtatctatggccgtggggagcgaaggaccaggtaacgaaggcgcttccgaagcgggattggaccaaaccagagggacagagtcttctgggtctctctgcctgaggccctggagggagagaaggtagggagatcggcgcccgccgggcctggcaaagaggcctcgggaaatgttgaac

SEQ ID NO: 74916 - DNA, 210 bp, Homo sapiens
  chr12:54389111-54389321
  hyper
cacgggctgagtttccggctccaggttcgcgtgtcgccctgaggtttgaggccagacagctcgcagtcgggcagggagggcgggggagagacgagcggctctggccccttaattgtacttcgggctcgtattgtctctcctttcgccacctccgcttcctcagtctgggctccaaagtcactgcaaatttccttgcgacacatacatcac

SEQ ID NO: 74917 - DNA, 57 bp, Homo sapiens
  chr12:54391267-54391324
  hyper
gacagaagtggccgccgcgcccggagccggtcccgcggcaaaggcccggcaagccag

SEQ ID NO: 74918 - DNA, 365 bp, Homo sapiens
  chr12:54391399-54391764
  hyper
cgcctccctctctgcacgcctgcctttcccggctctcctatctcttttcatcttgccttccttcttttaattctcccccttttttccctttattctaatgctccgcttccttctttcctctcttgggcctgactccatgtttcagttggtctgtcccaggctgtctcgggttcagtctctctcaggctctgtcccctgatgtcctcttggtctcagtctggccccgggccccgctgagggctaaacgtctctgctcatcgctgccagcagccgcccaagtgccgggcccggtcctcagccgccctgggctgggggaggtgctggctgtactggggatttggagaaagcctcggcagggggactgg

SEQ ID NO: 74919 - DNA, 30 bp, Homo sapiens
  chr12:54392718-54392748
  hyper
tttctcctgttcctccgttgcttttttccc

SEQ ID NO: 74920 - DNA, 101 bp, Homo sapiens
  chr12:54393359-54393460
  hyper
cacactatttaaaaacgcatttttaaaagccacgttccgaactgacaatcgctgatctcggctcgcgcagagactgcgggagcgtcggggccgacagagac

SEQ ID NO: 74921 - DNA, 263 bp, Homo sapiens; identical to SEQ ID NO: 34433
  chr12:54393461-54393724
  hyper

SEQ ID NO: 74922 - DNA, 621 bp, Homo sapiens; identical to SEQ ID NO: 11268
  chr12:54393798-54394419
  hyper

SEQ ID NO: 74923 - DNA, 268 bp, Homo sapiens
  chr12:54394466-54394734
  hyper
cgccggcagcaagcacaaagaggagaaggccgacctggaccccagtaagttgggagcaattttcctttacaaccggcgcgggaggggaggggaggacgggcgggggcagccgaattacagccctcccgaaccgtgcagggagcgcgggagaggggcgagggggcgaggactcaataaaagcgaattaccttggggagctttcaggggcaggaggtctgagaatggggcccagggagacaggttgggagagggccgaggggagctcctc

SEQ ID NO: 74924 - DNA, 77 bp, Homo sapiens; identical to SEQ ID NO: 34436
  chr12:54398709-54398786
  hyper

SEQ ID NO: 74925 - DNA, 779 bp, Homo sapiens
  chr12:54398888-54399667
  hyper
cgcgggcttggaggaccctgaggaaagcatgggatgcagaacaggcccacccggcccggcccactgttcaatcccagcccagcctgcaggtcaggattggaatcattttttattcgctatcatttacgaattaacaacacaacacgcatctggggaaagaaatgaaagctgggggtagagaggggctagcaaacgccctcttcccctaatcttcccctcccacctctcctctgctcctttgtcagaatcacaaaaccctaaagattgttccacttgagaaggcagcggataggtacatttccgcagccccgaaatgccacttttatggcgctgtttgtctccctgttctgggttctcaatggggccgaacaaaacagcagcgcggagctggctagacgtctgggcttaattgttttatggtttaaataaggtggacactttcctttgaaatcggattataggaatgttttgtctatggcccacggagaacaggacctcactggctgagagggagaggtggagagcgcgcgcgcgagagggatgggctacaaaccaggggtcaaacagcctggagaagtccgagtcccaccccaaagtcctgcaggcggcggcggaatagtcggtgcggggccagcatcagggtaagaggagggaggactttagggtgcgcgccgcgggcaagccgtcgtgggagcctcggagcgtgcatccgcgttcgcggagatgttccaagcccagaaatgcgcctgaatggggggagatcgcggcagttgctttgc

SEQ ID NO: 74926 - DNA, 160 bp, Homo sapiens
  chr12:54402652-54402812
  hyper
tctctctctctctctcgcctgtcttcatgtcgtggattgatgaacgcgaatcgcgtgtaagcgccgccaccgccgggagtctgaggaattcgcctgggctgttagaggaaagagctaagtgagagagcgcgagctctacctaccgacagtgaggagcgcc

SEQ ID NO: 74927 - DNA, 820 bp, Homo sapiens
  chr12:54402872-54403692
  hyper
ggagctctgctgatccggccgagctcagcaccgaggcgccccccaacctgcccagcccccagcccaccagcccagcccagtcccggggagccagctggcctggggttcggtcccggggggaggggagtttcgggggtactgggcggggtactcgtgagccagaggggagggggccgcgggttttcatgtacccagcatgagctcctacttcgtcaaccccctgttctccaaatacaaagccggcgagtccctggaaccggcctattacgactgccggttccctcagagcgtgggcaggagccatgcgctggtgtacgggcccggcggctcggcgcccggcttccagcacgcttcgcaccacgttcaagacttcttccaccacggcacctccggcatctccaactcaggctaccagcagaacccgtgctcgcttagctgccacggagacgcctccaaattctatggctacgaggcgctccccagacagtccctttatggggctcagcaagaggcgagcgtggtgcaatatcccgactgtaaatcctccgccaacactaacagtagcgaaggacaaggccacttaaatcaaaactcgtctcccagcctcatgtttccatggatgagaccccacggtgagaagccttttctctttcccccttggtctcccgcgctccagggtttccccccctccctcgcctcctttttgtctgccctcgctttttctcctggctttggggtctctcccgccccacccccgtgcctgtgcctgggtggttttctcgaagttgggaaggctccgctggggcggggcagggagggg

SEQ ID NO: 74928 - DNA, 30 bp, Homo sapiens
  chr12:54404826-54404856
  hyper
aagcccccatccaaacgtaaccagactggg

SEQ ID NO: 74929 - DNA, 476 bp, Homo sapiens
  chr12:54408316-54408792
  hyper
ggcccagtagcctagcggaatgaacccagcattaaatggctccgaagggcctcgccgccttttccccacaccaaatgtgccatttatcccttgtcctgttcagcaatgtccgtggccccaagcccggcgcgtcggagggcggggtgcgtctggcgcccggctttactcgagatgccaggcatggagagggctaagccgagggagccccagccaccccctcatgcagtacccgctcccccacccctcctgcccaccgcctctgttttctcgtttggaaagaaatggaggtaaaaacccgttttatgggggaacgtaattgtgagcgggatgcgctctctttagaatcgcgtcctcccaaatgctcccgccgtcccattaccggaatggggaccattcggctgctgcagataggactttctctcccattctttacttttttattagccaatcaaagtggcttccgaaagccatttgtg

SEQ ID NO: 74930 - DNA, 78 bp, Homo sapiens
  chr12:54410286-54410364
  hyper
acaatatttaaaactcggcaagccaggagaggcaaccgaccctcagtgcttgaagctttctttcgcctgggcgtccgc

SEQ ID NO: 74931 - DNA, 30 bp, Homo sapiens
  chr12:54422111-54422141
  hyper
caacagaagcagaagcgatttttttccccc

SEQ ID NO: 74932 - DNA, 94 bp, Homo sapiens
  chr12:54422431-54422525
  hyper
gccgttgcccagaaccggatctactcgactcccttttattcgccacaggagaatgtcgtgttcagttccagccgggggccgtatgactatggat

SEQ ID NO: 74933 - DNA, 110 bp, Homo sapiens; identical to SEQ ID NO: 11275
  chr12:54425031-54425141
  hyper

SEQ ID NO: 74934 - DNA, 14 bp, Homo sapiens
  chr12:54427293-54427307
  hyper
ggactgagccagcc

SEQ ID NO: 74935 - DNA, 94 bp, Homo sapiens
  chr12:54428267-54428361
  hyper
gctctttagaggcagcgggggaggcccgcagagcgcgcccctagccggttcctgtccctgcgcctttccttttcgcctttcctctctatatttc

SEQ ID NO: 74936 - DNA, 310 bp, Homo sapiens
  chr12:54440843-54441153
  hyper
tcttctggtgcttctcgcccgccagcgcagggcccaggtgtttgaggcgaaggggctctagctccccgcaagcctggagccaggcgtcgcgcttcctccgggcttaatccagacctttcaacacacacctcattcgggggaggagaaaagcacaggaccgcggagagcccagctttgaggccaggcctgaagggataacccacacagggaacgttttcctatcagagaataatggagcacaaaataattcagaaagcgaatgggcaggaccacagcctgagagtcccgcgccgcggggccgctgcagagc

SEQ ID NO: 74937 - DNA, 30 bp, Homo sapiens; identical to SEQ ID NO: 34445
  chr12:54446784-54446814
  hyper

SEQ ID NO: 74938 - DNA, 15 bp, Homo sapiens
  chr12:54447818-54447833
  hyper
gccggaccagggaat

SEQ ID NO: 74939 - DNA, 143 bp, Homo sapiens
  chr12:54447898-54448041
  hyper
cgccagtatagctgcaccagtctccaggggcccggcaattcgcgaggccacgggccggcccaggcgggccaccaccaccccgagaaatcacagtcgctctgcgagccggcgcctctctcaggcgcctccgcctccccgtcccc

SEQ ID NO: 74940 - DNA, 30 bp, Homo sapiens
  chr12:54475536-54475566
  hyper
gagggactgcagacccgggtgcgggagacc

SEQ ID NO: 74941 - DNA, 21 bp, Homo sapiens
  chr12:54484237-54484258
  hyper
ggagggagggactcccgggct

SEQ ID NO: 74942 - DNA, 155 bp, Homo sapiens
  chr12:54484310-54484465
  hyper
cgattactgtcaggggaccatccatcagcgccgcccgggacgctgggccagactgcccgccgcccgcccgggtctctccagatcgcattagcgtggggcgagggcgcagtgcggcaccggctgctgagggagaggcgtggcggggaggggggcgg

SEQ ID NO: 74943 - DNA, 102 bp, Homo sapiens
  chr12:54500112-54500214
  hyper
tccctggggagtcctcggagcgggcagccggacgtcgctccatccttcccgcctgacggatgcgtctgctgcgcaggcacaagctgtcgggccaggccctgc

SEQ ID NO: 74944 - DNA, 264 bp, Homo sapiens
  chr12:54519930-54520194
  hyper
ttcaccctcccttttcgccatgtgggggccctgagcgccgccccagaagaggtcgagggaatgttgtgggctggggcacaccagcacggcagaaactggagaaagcgagagacgtcgccagggacccagggacctctccctccagttccccgggcccgcccggccctgatggccactcacgctatagcgcccactctgtcctgggccatcccgcgccagcagtgtagcccccagcccgggcgcctgaatgctctccctccggat

SEQ ID NO: 74945 - DNA, 790 bp, Homo sapiens; identical to SEQ ID NO: 34449
  chr12:54520221-54521011
  hyper

SEQ ID NO: 74946 - DNA, 188 bp, Homo sapiens
  chr12:54567315-54567503
  hyper
agctccacaaaacgccgcccgcgcggcccgccgccgagcccgctccaatctccagcctcatcgccgcgcgggctggttatgcatttaaatgttatttaattggattgcggaggagctgggggccagagcggccgcccgcccccgccccgcacgctccgcacgcccgggctgctcgcctcctctgcaaa

SEQ ID NO: 74947 - DNA, 30 bp, Homo sapiens
  chr12:54609854-54609884
  hyper
tgcaacccgaggctacggttcatccaaaca

SEQ ID NO: 74948 - DNA, 94 bp, Homo sapiens
  chr12:54611458-54611552
  hyper
gcagtgaaggaaggacgctcagaccaacaggggctcaggtattctgggtgtcaggacccttcctcctgcacgcatcttacgcagggtggggctg

SEQ ID NO: 74949 - DNA, 83 bp, Homo sapiens
  chr12:54720220-54720303
  hypo
gccaggaattcttattgtatgatctaggatgctaatttctccctctctggttacatgagaattgtggtcgctaaagggctgta

SEQ ID NO: 74950 - DNA, 37 bp, Homo sapiens
  chr12:54767860-54767897
  hypo
tcaatgcctttgactcgtcgggcgtggcgattacctt

SEQ ID NO: 74951 - DNA, 640 bp, Homo sapiens
  chr12:54811982-54812622
  hyper
gcccaccccccttcacgcgcgcacacacccctcccgacacatcccagcacccgcccttggctgagttcgcccccagccccagggccccagtgccagggtccccgcactcgcccccagttctcggatcccctcgcctgaacagagattgggggcggagggaggagtaggagacagaggagaaaggagagggagccgccgtcctctctcgggtctttccccggtctgagttgaggggggaggggaggatgaggctggcccccatttaaccttccgaccccctcagtctttgactttcctcctactacacgtagctcattcggcttctacccgttctctcgccgcacaatggcccctacggatcccgaggtctcctggagcccccaaaagcccttcccggcctctgcgccccctctgcgcccccacccgccccaggtcccagcagcccacagacttcagccagagaccctcagctctccattcacgcgctctcctctcccttggcccggagacccctgcccagacttctccagctccgtgtcctctccccaccggacacatgtctccccactgatctcaaacgccagggcccctcctcacccgccacggtgccctccctactccagcgcgggcccccaactct

SEQ ID NO: 74952 - DNA, 50 bp, Homo sapiens
  chr12:54812829-54812879
  hyper
tactgctggggcctccgcgtctaagttgaagcccccgaccctgggtggcg

SEQ ID NO: 74953 - DNA, 164 bp, Homo sapiens
  chr12:54914315-54914479
  hypo
gagagtggtaaatatcggtaaatgttttttgaaagaatgaatatcctctccgcctcaaagggactagctcttaaactctatttttcttttcctttatttttcactcaccactttactaataaggactaaatcttgatttaaagtcttcccgtttctctgcagct

SEQ ID NO: 74954 - DNA, 94 bp, Homo sapiens
  chr12:54936727-54936821
  hypo
tgaaaaaaggagtaacgtacaagtatattttctatcttctggtgacttgagcttgagctctgacaggcatgggcctctccgaccttcatcacta

SEQ ID NO: 74955 - DNA, 95 bp, Homo sapiens
  chr12:54942993-54943088
  hyper
ctcagacatgggacacgcaggcagctaggcacacgtggatacatggaaccacaaccacatacacagaaactcaaaacacacggagagaacccaca

SEQ ID NO: 74956 - DNA, 72 bp, Homo sapiens
  chr12:54943351-54943423
  hyper
ggaggaggagagaggcgaggaggcggctctggcagcgcgcggcggcggcggcggtagcggcagcagcagcgg

SEQ ID NO: 74957 - DNA, 125 bp, Homo sapiens
  chr12:54982532-54982657
  hyper
ggctgcgggggtcaccgccccgcgggccgccgagtccgggcgtggcccgggagccgtcgtagtggacagctcaggcagatacctcagtgtcctcggagttttgggcagggcgttggggtggggag

SEQ ID NO: 74958 - DNA, 111 bp, Homo sapiens; identical to SEQ ID NO: 43470
  chr12:55356770-55356881
  hypo

SEQ ID NO: 74959 - DNA, 30 bp, Homo sapiens
  chr12:55390771-55390801
  hypo
aagattttctgacaacgggagggatgcgat

SEQ ID NO: 74960 - DNA, 761 bp, Homo sapiens
  chr12:5540932-5541693
  hyper
acatgtaacctgttacgatacatttaacgtttcgttttttcctggatctctaaaagggaactcaagggtgggggttactgaagaatactacagatttggaagtttttgttgctgttgttgtttggtttggttttgtttttcaagaggggccaggagaaatgaccccttccccgccacgggtcccgaagtgagggcggggggggggctctggggcgcgggcgcgcgcggcgcggcgcgggccggcgggggagggcggcgcggcgcggaaggggttaaggcgctgagcgcggagccatctggccgggttggctggttataaccgcgcagattctgttcacgggactcagagttgaagctcctctcccttccgaacagctccgcgcaccgccccgcgacgcagcccggcgcaactactttcttctctctcctttctttcttcctctcctttttcccctgctgggtagtggctgcggcggggtgggggagactttgaatgaccgagctcgcgtccacctttctcttcatgtcgacgtccctggaaacggccacacggatgccatggttacttttgccacggtaaggggaggcggcgggcaccttgggtgggcaggtttggggatgggggtccacgtggggagggattttccagtggactggtgcggggggccccagatccgcatcccgccccacccccatcgcgccgcgctcactcactttcccgggcttgtgtcttccccaaagtttgcgctgggatctgctca

SEQ ID NO: 74961 - DNA, 30 bp, Homo sapiens
  chr12:55413842-55413872
  hyper
ctaaactggctgcagcggagagatcagccc

SEQ ID NO: 74962 - DNA, 959 bp, Homo sapiens
  chr12:5542015-5542974
  hyper
tggcagacagaactccgggcggggaggtgccgcggcagctcccctgcacacgccctgcactctgccggccgctgagcctgattctcagctcgccccagcaccactctggcccgggcgtgggctggggggaggggacgcgcagctcaggacccggaacctcgcgttccagttttgggagttgggactcactgccacgcgccgcgtacctgcgttggagttccccgaaagggttttttcagaaaagacctcgcgccccgggctcctcttggccagcgcccacccggtggccaccccaccctgggcctttgcgcagatgttggagctccgtacgcagcccgcacatctgggacccctccggggagcggcgggcacccgggcccggccatcccaggggatctccttgcggtatcgtccagcctgttctcggactttgagcggtggcgtgggaggccgggagacctgggcacccgcgcagccagccaggtcggagtttaaaggtcccacgacggaccgaactgtcccattgccccagagctttactcagtggtggatgctcctgatgaaatttgggacgcttgggagttgaaggttagggacaggaggggcgagggccgagggcatgggatgggggagtaggattctgcttgttgctctccgcgggagtgggtgcgcgtccaggaggcgctgcttctttgcgggagtttggctgctgcgttcattcgtcgtctgcgcttcagatgcacggcactgagacccttgcgtccgacggtgtcggggctgtggactagaaaggatcccttttgctggaatcgaggctggggtgggattgccggtgggggaaacaccgaaaagatcgtctggcctcggcctctggcggcgggcggcaggttctgagtccgaatggaggttgctcccgggagcgccgggctcagagctagagagctcgggagactgtgcgc

SEQ ID NO: 74963 - DNA, 44 bp, Homo sapiens
  chr12:5561220-5561264
  hypo
cattattgcattgtacgtatctccccatgtctttttcttttctt

SEQ ID NO: 74964 - DNA, 30 bp, Homo sapiens
  chr12:55632656-55632686
  hypo
gctctggaatgaagtcgtgaatgtccctca

SEQ ID NO: 74965 - DNA, 86 bp, Homo sapiens
  chr12:55786340-55786426
  hypo
gccgtgctgagggaccgggcgcctgcctgctccatggagccagagtcccaggtctacagcccgggattaggcgggcacccgggaag

SEQ ID NO: 74966 - DNA, 51 bp, Homo sapiens
  chr12:56031566-56031617
  hypo
gtgaggagggccctgcgacacttggtgaagaggcagcgcccctcaccctga

SEQ ID NO: 74967 - DNA, 30 bp, Homo sapiens; identical to SEQ ID NO: 43472
  chr12:56094359-56094389
  hypo

SEQ ID NO: 74968 - DNA, 41 bp, Homo sapiens
  chr12:56441277-56441318
  hypo
acctgccagataggccgggcgcggtggctcacgcctgtaat

SEQ ID NO: 74969 - DNA, 120 bp, Homo sapiens
  chr12:56881719-56881839
  hyper
ctgatcctggtgctgcggctggtggctgtgtggcgtctctctgccctgcgccgcggcctcactgaggtggtgccggacgcccccgccaaggagggggctccggctcgggtgaccccagcc

SEQ ID NO: 74970 - DNA, 30 bp, Homo sapiens
  chr12:56882439-56882469
  hyper
gaatgatggagttgtcgtgtagagaggagg

SEQ ID NO: 74971 - DNA, 243 bp, Homo sapiens
  chr12:569970-570213
  hyper
cctcggagagcgacccggagagaggctccccgcccgtcccgccgagacgctggcggagaccgggcccctccagccgctccgggcttgcggttcccggggaggaggtccgtggggtccacgcgcgagctagggattcgggtgcgggatgccctcggccgtccacacccaggcgcgcgctccagtccgcgcagcccaaactttgcccaccgccttctgtttggctcactccgtttcctctcctgc

SEQ ID NO: 74972 - DNA, 39 bp, Homo sapiens
  chr12:57054141-57054180
  hypo
attacaagcgtgagccaccgcacccggccaagcctggca

SEQ ID NO: 74973 - DNA, 30 bp, Homo sapiens
  chr12:57054388-57054418
  hypo
aaagatatttggtggcgatatacgacgctt

SEQ ID NO: 74974 - DNA, 38 bp, Homo sapiens
  chr12:57120619-57120657
  hypo
ctgggattacaggcgtgaactaccgcccctggcacttc

SEQ ID NO: 74975 - DNA, 131 bp, Homo sapiens
  chr12:5713307-5713438
  hypo
aagtggatggtggatcgtacacagaagggaaggacaatgaggaatcagcgatgattctcatggtcttagggcatgtgtgtggttggtggtgccgatggctacgatagagaatacaacgtaagaggcagttt

SEQ ID NO: 74976 - DNA, 21 bp, Homo sapiens
  chr12:5720406-5720427
  hypo
ttacagcggtgagccaccaca

SEQ ID NO: 74977 - DNA, 30 bp, Homo sapiens
  chr12:57423345-57423375
  hypo
gtcaggaggagaatccgagaagaagtctag

SEQ ID NO: 74978 - DNA, 152 bp, Homo sapiens
  chr12:57483850-57484002
  hyper
aaggaaaaggctgaccgaggaagtggggagtgtcactgctaggagaggggccactgaggagcactgggcagcctggaagggtggagaggttctgaggggagagaggaagcgtgcgttaagaatgcttaaccaggccgggcgggcccggtggc

SEQ ID NO: 74979 - DNA, 30 bp, Homo sapiens; identical to SEQ ID NO: 43474
  chr12:57493886-57493916
  hypo

SEQ ID NO: 74980 - DNA, 285 bp, Homo sapiens
  chr12:57504479-57504764
  hyper
tctggggcttgctcacgccccagccacacccttgaacaggaacctttagtggagggcaggataggggtttaacaaggatccactgccctctggcatcaaccttccagggaggggcggccacttcccccgactcagggcagaggggcactccttcacctcctttccctgactttccatggccctgggggtgcaggggtgaggctgtgaaaacgtgacccatgggggaggggagtactgaggcctggaccctcccagattcctccaggagttcgaaactgctaaaac

SEQ ID NO: 74981 - DNA, 33 bp, Homo sapiens
  chr12:57522742-57522775
  hyper
acaccatgctgaccccgccgttgctcctgctgc

SEQ ID NO: 74982 - DNA, 56 bp, Homo sapiens; identical to SEQ ID NO: 43475
  chr12:57559766-57559822
  hypo

SEQ ID NO: 74983 - DNA, 152 bp, Homo sapiens
  chr12:57570049-57570201
  hypo
acgccccgtaattatcgtcagcagaactgccagcctgataattaacaaaatgatcagccttacctttgaatggcctggagctctgctccccagatctagaattgcaggcttgaaagaaaaaagccacttaggagtggcgtacctgaacgctg

SEQ ID NO: 74984 - DNA, 78 bp, Homo sapiens
  chr12:57576610-57576688
  hypo
acaaagaaaaacaaaagaaaagaaaagaaaaagaaatgggataactgggaatgagactggcttcggagtgaccttagg

SEQ ID NO: 74985 - DNA, 146 bp, Homo sapiens
  chr12:57587641-57587787
  hypo
aaaactctggcctgacgatacggggcgggcactgttctagagacagcctgtggtgtgggcgagttccgctgccgggacgggacctgcatcgggaactccagccgctgcaaccagtttgtggattgtgaggacgcctcagatgagat

SEQ ID NO: 74986 - DNA, 30 bp, Homo sapiens
  chr12:57604796-57604826
  hypo
ggcccaagctgctggcgcttccccacaaag

SEQ ID NO: 74987 - DNA, 601 bp, Homo sapiens
  chr12:57613840-57614441
  hyper
aagatgtgtgggatccgtgagggacagggcaacagagagggggcagggtcataggagagggtcccagggctcaggcgcaggaggagtcgcagggcgtggggtgggaagcagctgcccagtggggatggggagcagggagcgctgccttgagcgctggaaattggcgcggctccccctctcccccgcctgcccctcctccacctccaccccgcccactccccctccggctccggcttcgggaaattacatccccgctccgcggctccccccaacccccaccgcgccccggagccggcgcctttataggcacatttattgcaataataaagtgaggcgcggggcggggggcgggggggcagtcgttcccgcggggaccgcgctggctccaggaagcagggaaataaaataaaataaaataaaataaaataaaaattcagataacggtgagccttgcgcggcaggccaagagaagtcaggcaggcaggggtagagggagggggcgtccagcccaagggcagagcctaccccaccccaccagcggtccccgccccctcatgcagtggtagggtctggaaagaggtgtcttcgcttcaacctgcct

SEQ ID NO: 74988 - DNA, 137 bp, Homo sapiens
  chr12:57618574-57618711
  hyper
gtggaaagggactggcgtcgatagggctctggcaggatggcgggggacaaccccagcgtctctctctcctctttcttcgtgcacaggccgtcagtgcccagataccagagtccggaaggccgcagtacctggggctg

SEQ ID NO: 74989 - DNA, 47 bp, Homo sapiens; identical to SEQ ID NO: 34458
  chr12:57619110-57619157
  hyper

SEQ ID NO: 74990 - DNA, 30 bp, Homo sapiens
  chr12:57620559-57620589
  hyper
acagtgtaggcagagcgctgacaacctgct

SEQ ID NO: 74991 - DNA, 88 bp, Homo sapiens
  chr12:57632036-57632124
  hyper
tctcgctgatacttccgccgccccctactctgacaagcgcggctgtaattaggctgcggggtcccgggctctccgcctcactccggcg

SEQ ID NO: 74992 - DNA, 64 bp, Homo sapiens; identical to SEQ ID NO: 34460
  chr12:57632479-57632543
  hyper

SEQ ID NO: 74993 - DNA, 103 bp, Homo sapiens
  chr12:57635003-57635106
  hyper
gactggcccctagggcgggtagcgccgacgttgggctgcccctgagcagcagaccgggcggaccccactgacccaaatcgggcagtttcgtggagggagagcc

SEQ ID NO: 74994 - DNA, 30 bp, Homo sapiens
  chr12:57635463-57635493
  hyper
cgctgtcacgcctgccgccctctctgggga

SEQ ID NO: 74995 - DNA, 191 bp, Homo sapiens
  chr12:5770987-5771178
  hypo
taactacccctccctcgctgtttttgctccagggcctgtattcctgtggcttgttcctctgtgaacagattctctgagaggagctcacagggtggaaacaagcttggagacaattccctcatgcatggtgtcaacacaggatccgccatgtcagctgtcaggcagccccgccaactcgccaactggctccc

SEQ ID NO: 74996 - DNA, 30 bp, Homo sapiens
  chr12:57857277-57857307
  hypo
gtgagccactgtgcccggctcagtgatgct

SEQ ID NO: 74997 - DNA, 30 bp, Homo sapiens
  chr12:57862418-57862448
  hypo
cttctttttagagatcgagtcttgctatgt

SEQ ID NO: 74998 - DNA, 343 bp, Homo sapiens
  chr12:57869912-57870255
  hyper
ggtccacgctactttcgggccggctacccgctggtccctgacaatgagggaggaaactgaggccacggtgttgtttccttcactgcttccctctccccggtgggctgtgaggaggtgggaggcttcctcacttctttactttcctctgcaccgccctccccgctgccgcccccacattggcgtgaggcggtaggcagcgcccgcacccatcctgcgcctctcgctcacactcacccagcctgaggagggcgctgtcggcggtggctctcggtagaacaccaggctgttacccgttaacaccacccaagacgggccccagttcttcctgcggggacagagaggg

SEQ ID NO: 74999 - DNA, 341 bp, Homo sapiens
  chr12:57881038-57881379
  hypo
ataagccaccgcgcccggcctatgtacatttttgttgttgttgttgataggatggatatgtacactaacttccactttgtcactaattccgcacatggtaactccgaactctaaaactctgaccgttaagagcttgcatcgagagccactgcgagtagctgctgttatgacatggccatttcattctccacaacaagagaagcagccgcggcttcagtcaccgccctccagcagcgtaagaggataaaagtgcgacttgccctaaaacctaaacgtctcttctggatctccagaaaaaaagtgctgctctaggccgggcgcagtggctcacgcctgtaatc

SEQ ID NO: 75000 - DNA, 30 bp, Homo sapiens
  chr12:57939956-57939986
  hypo
agctaacagagaaggcggggtgtgatgtca

SEQ ID NO: 75001 - DNA, 442 bp, Homo sapiens
  chr12:57943746-57944188
  hyper
agggagccccgcccccgctcctccatcgcggccccgcccaggcccgcagcgcggcgctgcagcgcgaggggcggagaggcagagagcccgaaaggaccagacgcccaggtcgcccgcatcccgctgccgcaggagagagacagcgcgccccggccctgctccccaggcttcgcccgggcgccctcaactctgtccccagagactgagcacctgtcctccgcctcggcctctgctgagagccctctcctctggagcacacaccacccctgcagcccaagaagagtcccagccccacgccggctaccaccatggcggagaccaacaacgaatgtagcatcaaggtgctctgccgattccggcccctgaaccaggctgagattctgcggggagacaagttcatccccattttccaaggggacgacagcgtcgttattggggtgag

SEQ ID NO: 75002 - DNA, 62 bp, Homo sapiens
  chr12:57963777-57963839
  hypo
gtgcctgagacagagcgcctggctggggaggaggcagccctgggagccgagctctgtgagga

SEQ ID NO: 75003 - DNA, 72 bp, Homo sapiens
  chr12:58004542-58004614
  hyper
tattagcataaagttcgcatctaatttgcatgagacccatttaatcgcagagacctccactcttcttgcctt

SEQ ID NO: 75004 - DNA, 290 bp, Homo sapiens
  chr12:58004657-58004947
  hyper
cgcaggcagagtgtccccgcgccccacccctggcccctcgccagcccgggctccaggacttcgccttaattggcgattagtcttagctggagtcccggggcctggaggaaagaagggtcctgagagagggcggcatctgggttgtgttcacccacaaaagactccccatacacgcaccccgtaccagggggcctctgtccactcggccggggacagccccaaacccagaacatcttcgcacaggccaaggccccatccactgagtcctccttcatcgcagaggccaaggg

SEQ ID NO: 75005 - DNA, 447 bp, Homo sapiens
  chr12:58014820-58015267
  hyper
cgctcaacgggttggggtagccgcggccgtggccttcgggagcggggcgttgatggtgagggaggacccggggaggaacccggggggatccctgctgaggggccagggaaattgggccggggaagagggagggaccagctttcggcttgggttcgggagggcggaggtgcgcggggttggtttgctcctcctctagatggtgacagcgcgtcttctcccccacagctggggatgttcgtgctgcagctcggcgtcttgtccacctttttgtccgagcctgtggtcaaggcgctgaccagcggggccgcgctgcacgtgctcttgtcccagctgccgagcctcttggggttgtccctcccgcgccagatcggctgcttctctctcttcaaggtgggggtggaagaagaaaggagaaggggcttctagaggtcccgtgaatagggaaac

SEQ ID NO: 75006 - DNA, 69 bp, Homo sapiens
  chr12:58015479-58015548
  hyper
cctccttgctgactgcgctgcctcggagcagtccggccgaactgaccatctccgcgctcagcctggcgc

SEQ ID NO: 75007 - DNA, 166 bp, Homo sapiens; identical to SEQ ID NO: 3900
  chr12:58021293-58021459
  hyper

SEQ ID NO: 75008 - DNA, 280 bp, Homo sapiens
  chr12:58021713-58021993
  hyper
ggtgccttcgggggtacccctgccccatcctcttccgcttcacccctgcaggacccagacagttcccaggccccacttcgtggttctctctttgtcctagggctggccgttcctggccgcagcgcccccgctgtggccttagcctgttcaaggcccttctccacccccacatcctgcagcccctgccctaccaggtccagcggcgtccgctccagcacgtccacaagcctctccagccgcgtccgcgccgtgaagacgaagtcgtcgtccacccacagca

SEQ ID NO: 75009 - DNA, 154 bp, Homo sapiens; identical to SEQ ID NO: 34469
  chr12:58025580-58025734
  hyper

SEQ ID NO: 75010 - DNA, 140 bp, Homo sapiens; identical to SEQ ID NO: 34470
  chr12:58025869-58026009
  hyper

SEQ ID NO: 75011 - DNA, 250 bp, Homo sapiens
  chr12:58026065-58026315
  hyper
cgcggttttcccggtacccctcccctcacttcccaggccccagggtctcccggcctcctttcttctcgccctctcctgcatctcggtttcctcacacacccgaggcctggcatcttaatgctgaagacatttggatgccgcggtttcgacgcggccgtgcgtaagcggaaaagccccgctctatcagggcagtggcagtccccaagcccgccgcccgccctggccggcgcgcccccgactcctcagtctg

SEQ ID NO: 75012 - DNA, 160 bp, Homo sapiens
  chr12:58125465-58125625
  hypo
gatacactgatgtgacgatagggaagatagatgaagaagggcccaacagaggagtctagggactagggaagatgggcaggtcatgggggacaggaggatgggggtcagcatgtccatgtccaataccgcaaaaaggctggtcctgcgcttggctgcccgg

SEQ ID NO: 75013 - DNA, 35 bp, Homo sapiens
  chr12:58144980-58145015
  hypo
cccactcaccttgatcgtttcggctggcaagcctg

SEQ ID NO: 75014 - DNA, 87 bp, Homo sapiens
  chr12:58158951-58159038
  hyper
tccaggcagcccaagcgcgagccgagcagaaccgcggcgatgccttgtcgggagggggcgccgtcagggttccgggaggctctggta

SEQ ID NO: 75015 - DNA, 57 bp, Homo sapiens
  chr12:58159289-58159346
  hyper
gttgaggagagagtgcgcatcgggaaggtggggacggctcgacgggactggctgcag

SEQ ID NO: 75016 - DNA, 97 bp, Homo sapiens; identical to SEQ ID NO: 34472
  chr12:58159773-58159870
  hyper

SEQ ID NO: 75017 - DNA, 124 bp, Homo sapiens
  chr12:58160215-58160339
  hyper
cctctctgatcatctcggtcgaggagaaatctctaaaagttccatgtctggactgtccatctcaggacgagtcctcagtgaatgaaaaggaacccatgtagctttaagccgcaagcaggcggag

SEQ ID NO: 75018 - DNA, 24 bp, Homo sapiens
  chr12:58177383-58177407
  hypo
tttttttttttcagacggagtctt

SEQ ID NO: 75019 - DNA, 120 bp, Homo sapiens
  chr12:58204698-58204818
  hypo
ctcatttccacctgtcgatgagaggtaaacattgttcaggaggaattcttaggtgccaggtggagaagccccgggcctggggcagagagtgtgcaggactaacctcggtagccctgatgt

SEQ ID NO: 75020 - DNA, 90 bp, Homo sapiens; identical to SEQ ID NO: 43477
  chr12:58241509-58241599
  hypo

SEQ ID NO: 75021 - DNA, 30 bp, Homo sapiens
  chr12:5840200-5840230
  hypo
cagtgtacacaattccggttccttggcatt

SEQ ID NO: 75022 - DNA, 30 bp, Homo sapiens
  chr12:58517132-58517162
  hypo
aggtgagccaaaattcggaccagcagcggg

SEQ ID NO: 75023 - DNA, 281 bp, Homo sapiens
  chr12:59313662-59313943
  hyper
ccagaaggagctatacggcaaaaaggggactgcacgccgaaccccattccccgccggctcctgttttctcgaatctccagcggcccgggccccctccccccgcgggaagaatacttacagccgagcgacccaggacgggagtggctcgggaagacgcgctagccgcttacgactgcagtccagcaggtccccgaggcagcggcaggtagtggggcatgggcgctcggcggctaccccagagggctgcccgagttccccgcgaccgccgctgtctgaccggc

SEQ ID NO: 75024 - DNA, 72 bp, Homo sapiens
  chr12:59924125-59924197
  hypo
tatccctccccaaatcgcagtgtgtgtccgcctccctgtgatattgctcataatgtccggtgggggagataa

SEQ ID NO: 75025 - DNA, 46 bp, Homo sapiens
  chr12:59989556-59989602
  hyper
ggctacagagtacttcggatacagcaagttacgacccatctggaaa

SEQ ID NO: 75026 - DNA, 491 bp, Homo sapiens
  chr12:59990053-59990544
  hyper
aggaggaggaggtgccggctaagaggagggcgagcctgcgtctgcgacccgagctgcccgcggagccgcacgcgtgtgtgcaaataatggccagcctgtgacaaacgtgccaacgcagagttggccagcgagcccttatatagacaaaaaaatcccgaagcggccgcgggagcagagctcgcgtcagccagtgcgcgccgacagctgcccgggaactgagggggcgcgcggggtcctgggcaaggagcgcctcgcgtgctttcggccaggaggtgctcacgctctcggcttttacaccgagactcagcgtggcgcggtgcaccccagtctccctggctcacgggactccgagggctgcttccagtgcggcgtgtctctagtgcgcgccccgccagcatccggcccccgagccccctagggtggcgtggcttcattgccgcagaaggtggaggcgggggtggagtgtgtggagagaacgtcttctctttgag

SEQ ID NO: 75027 - DNA, 21 bp, Homo sapiens
  chr12:60167632-60167653
  hypo
cactcccggcctaaatcaatg

SEQ ID NO: 75028 - DNA, 68 bp, Homo sapiens
  chr12:6180311-6180379
  hypo
ccagagctggggtcacgtggttgcagccaacctgtgcagagagggcaacttctcgctgccttgagttg

SEQ ID NO: 75029 - DNA, 30 bp, Homo sapiens
  chr12:62075123-62075153
  hypo
agccttcttgtctgccggcatgtaagtcat

SEQ ID NO: 75030 - DNA, 42 bp, Homo sapiens
  chr12:62253491-62253533
  hypo
ggattacaggcataagccaccacgccccgcccagaaaaagca

SEQ ID NO: 75031 - DNA, 17 bp, Homo sapiens
  chr12:62384406-62384423
  hypo
cccggcccactgtgcca

SEQ ID NO: 75032 - DNA, 31 bp, Homo sapiens; identical to SEQ ID NO: 43479
  chr12:62539074-62539105
  hypo

SEQ ID NO: 75033 - DNA, 31 bp, Homo sapiens; identical to SEQ ID NO: 43480
  chr12:62539225-62539256
  hypo

SEQ ID NO: 75034 - DNA, 42 bp, Homo sapiens; identical to SEQ ID NO: 43481
  chr12:62563338-62563380
  hypo

SEQ ID NO: 75035 - DNA, 168 bp, Homo sapiens; identical to SEQ ID NO: 43482
  chr12:62580835-62581003
  hypo

SEQ ID NO: 75036 - DNA, 763 bp, Homo sapiens
  chr12:62584250-62585013
  hyper
actagtagcaagatccgggagacatctaaccggaaagaaataaaaaaccattagtttcccgaagccattcttattctgaacgctgttcgttaagagaatcatttactaaagctctcttgtagtagcctttacaaaagctttatttcattcagtaagaaagcgccccgtcccaaatctaaataaaccttacatagatgaggctccggaaattatcagcttgattctttatgaagatagttagaggtggataaatcaatagactcgctgaaacacccaccttctgcaaacaggcctgagaattaactaatcagaagtggacaaaaagtagggatttcagaaagatgacctgacacatcccattgatcttccctggaatgcgacccccaactccttattaagagtccaaaatggttaccagccaggatgggtctgggtgaggaatcgaattacaacccacttcaatcctcgacctggtcgtttgctgttattaggagaaatggggcagagagggagggcaccgctcacggagcctcatttcgcatgctccgatcccctctcggcgtccctctactccgcccctaccctgaccgcccgcgagggagacgccggccgatggacccgcatctgccctcacctctcgccttccccgggcgatccctctacagtcccggacccccgagaaaggggaagggagacgtgtgcacacgggggcttccgggaccgcggtcctgcagttgccgctccggtccccagcgctggccgg

SEQ ID NO: 75037 - DNA, 1308 bp, Homo sapiens
  chr12:62585030-62586338
  hyper
cgcacctacctgcagccccgcttcccggtggcggcaacacctagcgatgctcctgcagcttttgcgggccggcgccagccttatcgctctcgcatcgcttccaagatgccaatccgccgtcaccatccaggggcatagggaaccgaagtctggtgctgtgtgatcgtggagggcggcgtgtgagtgtggccctgagcgtgcgagtgtgcgcgcgcgtgtgtggatgtgtttcctcctccgatggcaaagacggttcaggaatctgacatccaagctggaatccccctgaagcgggtgaaggtgagcctgatccttctccccgcttctttattccacagtgtcaaagtaatcaaaagatttgtttactgaggaaaagccaaagtcccgcagcccttggcagcgcccgcggtcgcctcctgtcctcgccggatgcgcgcggtgcgctcagctccctggactgcaagaatcaaggcggtcttgctgcaattaccgctcttattccatctctgatttgtttgcttttaaggccgactaaagacttttcctctcgcctcacgtcgtctctccctctcacacacacacacactcacacatcctccgttccctctctcccgccctccctcttgttctctggggaaaggcaattggacagaatgattcaccttcaggaaagcagcctcggccacgcacttctcgagttccctggctctcgcaggtaccgggtctccaacgtggcggagttgctgggaagctcgggacaggaaggaggagaggctctgagctcagccgatgtcccccctccagacgcccgcgttcctccgtccaggtgcccctgttcccactgctcgcagataggtccccgctggtgccctcgcggagacttggcgccttccactcgaatccacttagcagcaactcctggccagcttcagcccctcaatcccgcctcgaagtgctgcgggcagagccccacgcagcccacccgctgcccttctaggcatcgtgggctggaaggaagggaaacccgccgatgtccccctggtagcagtgccctggcaccgtcaccaccgaggaggtgcgagttccaacatcgaacacaagcgagcaggtgtcgcctgtgtcactttgctaaaggcgggaggggagaaagaaaggagcggggggagggggccgaggaaacaaatccagatcaccggcggagaaagaagccgtttagcaagcaaagcctcctctccgcgtcccaccccagatgctatactgtcaaaagacactgatgctaatcttttagaaagtcgccataaagggcag

SEQ ID NO: 75038 - DNA, 22 bp, Homo sapiens
  chr12:62603703-62603725
  hypo
aggcgcaggggctcacgcctgt

SEQ ID NO: 75039 - DNA, 24 bp, Homo sapiens
  chr12:62630991-62631015
  hypo
atgatccattctgttcgccgggcg

SEQ ID NO: 75040 - DNA, 175 bp, Homo sapiens
  chr12:62829159-62829334
  hyper
gtctgcatccctaagcgaactgctgcgatcctaagcgcggggagctcccccacccagaggtacccaggcggtgcttgggcggtagtttggagaccctgagagggcaatgcaccagacaggaaactcgccctgggtctctcaccacaccccacctgagctgcggcaggtgccattg

SEQ ID NO: 75041 - DNA, 30 bp, Homo sapiens
  chr12:62862175-62862205
  hypo
gccctaaaaattcaccgagggatttcatat

SEQ ID NO: 75042 - DNA, 565 bp, Homo sapiens
  chr12:63025691-63026256
  hyper
cgggggtgtaggccccgagtgatttcctgccacagtgccggagcgggactggcgctgcctcccgggtccaggttccagccgctcccagctgttggcggcgctgctgagatgatggcctggatcccccaggttccgggactccccaggtggctccccgaggctatttacagctgaggttcggccggtgattgctgggacggaaaactcatttctcagcctggcttttatttacactcttattaaggaggctttcattcgtgttggaatggcagcgagaggctgcgggccaggcggccgaatgggtcgtgcccgagcgacagcggccgcctgcgccgcgaccttgagggcagaggagcgtgggcggcgtgcggggacaaaggcgcgcggggagcctgggtcacggctctgcagcagacacgggacctccacgtttctaccaccccggaaagttgagcgccttgggggctgcatttctccctttattggtagctggttcggctcgcccctttgcccgaccacacgctctttgtaaatacagaataggacaaaacggaaagagtgatgt

SEQ ID NO: 75043 - DNA, 40 bp, Homo sapiens
  chr12:63033701-63033741
  hypo
cgtgcccggccaggccacattcttacgagttaattcttct

SEQ ID NO: 75044 - DNA, 48 bp, Homo sapiens
  chr12:6310255-6310303
  hyper
gcggcaggggtgcctcggccgcgggtccggccccgggacccagtccct

SEQ ID NO: 75045 - DNA, 155 bp, Homo sapiens
  chr12:6316943-6317098
  hypo
ttccagaggaggtcccggtagagagaagtttggggactactgacttggagaaaaatcagaaacccgggtcttaagagcccttcctcttcaatccttaagccaggcattgtgcctgagggaagaaatagtggctcttatgagctctgctagaaaag

SEQ ID NO: 75046 - DNA, 78 bp, Homo sapiens
  chr12:63195735-63195813
  hypo
gagtccggctgttggcgggcgtgttctcaggctcctcccccaggcaggtagggggcaggacggcggagttcttcagga

SEQ ID NO: 75047 - DNA, 139 bp, Homo sapiens
  chr12:63327187-63327326
  hyper
gagctgattggttcccggacgaaccaatcaaccagcgaggccgtgcacggataggggagggccaaaactaccgaggggatggggttaaaggaaaaggcgcaggtgtgccagccaccaggttttgcgtgcacttttgcac

SEQ ID NO: 75048 - DNA, 649 bp, Homo sapiens
  chr12:63543753-63544402
  hyper
cggatcttggcccgggaaatggacttcacgctgctgacacagggtgcgagcaggaaccccttttggaaggccacacccgcttgctctgcacccttgctctggcgcgacgccgtcttcccgcggacgttgcaccagatgttgtagcagatgaagccgtagcaggtacccaagatgaccacgggcgccacaaagatgccgcccgtcatccaggtcacgtaggcacgagaaccccagggctggatgaaggtggcccagcagtcgcgggccttggtgacattgttcacctcgatcatggagaagacgaagtactgcggcgtgctcagcacgaagctcagcacccaggcggccgcgatcatgaggcgcgagcggcgcgcgggctgttgcagagtcttgagcgggtggcacaccgcgatgtagcggtcggctgtcatgactaccagcatgtaggccgacgcaaacatgccgaacacctgcaggtgcttcaccacgcggcacagccagtcggggccgcggaagcggtaggtgatgtcccagcacatttgcggcagcacctggaagaatgccacggccaggtcggccaggctgaggtgtcggatgaagaggtgcatgcgggacgtcttgcgcggcgtccggtgcagagccagcagta

SEQ ID NO: 75049 - DNA, 102 bp, Homo sapiens; identical to SEQ ID NO: 34483
  chr12:63544498-63544600
  hyper

SEQ ID NO: 75050 - DNA, 278 bp, Homo sapiens
  chr12:63544728-63545006
  hyper
cgctcgcagcttgccgggctctgcgatccctccagtgggcgtctcccggagcagcgtcccgcctgcccactgagcagctctcagcagggtgagctggcccctctccctgctctgccttttttcaacttcggcgaggtcgggaaggtgagctccgagcttccggaagcactgggttcccaactcaagtatttatgcggtgcttgtttccttgggacgcgctccctcccgccctattgccggaagactgctggttgcctactccccgctccctggagttt

SEQ ID NO: 75051 - DNA, 256 bp, Homo sapiens
  chr12:63545267-63545523
  hyper
gaaacctccagtccacgcaccggcgtccacgcatctagctcctgcacctgaacctggctctcgacctcacctcctccagtccgggtttcttccttctcaccgagctcacccgtgcagcagtctggcaaattttattccccaggcaaattttcccggggcaaacatttctccccgctcgtgacttaaagagctatctcttcctagtaacgtctttgatgcatgctatttattaccctatgtttgcgacgggaagaac

SEQ ID NO: 75052 - DNA, 62 bp, Homo sapiens
  chr12:63545524-63545586
  hyper
cactcatcactttgcagccccagtggctgctgtgcctgtattcacagcggggtttgggggga

SEQ ID NO: 75053 - DNA, 30 bp, Homo sapiens; identical to SEQ ID NO: 43485
  chr12:63788043-63788073
  hypo

SEQ ID NO: 75054 - DNA, 720 bp, Homo sapiens; identical to SEQ ID NO: 34486
  chr12:64061778-64062498
  hyper

SEQ ID NO: 75055 - DNA, 27 bp, Homo sapiens
  chr12:64062499-64062526
  hyper
gtgcgcgcaggccccaagcccacatgc

SEQ ID NO: 75056 - DNA, 624 bp, Homo sapiens; identical to SEQ ID NO: 11301
  chr12:64062527-64063151
  hyper

SEQ ID NO: 75057 - DNA, 30 bp, Homo sapiens
  chr12:6420362-6420392
  hypo
caggccctgcccactcgagggcgggccctc

SEQ ID NO: 75058 - DNA, 116 bp, Homo sapiens; identical to SEQ ID NO: 34234
  chr12:6444922-6445038
  hyper

SEQ ID NO: 75059 - DNA, 30 bp, Homo sapiens
  chr12:6449974-6450004
  hyper
gaacaggatgattcccggaccaagacgtgg

SEQ ID NO: 75060 - DNA, 30 bp, Homo sapiens
  chr12:6450274-6450304
  hyper
ccccaggtgagaggccggggcttggccagg

SEQ ID NO: 75061 - DNA, 30 bp, Homo sapiens; identical to SEQ ID NO: 34235
  chr12:6450544-6450574
  hyper

SEQ ID NO: 75062 - DNA, 152 bp, Homo sapiens
  chr12:6472461-6472613
  hyper
acttttttttttgcccgcgagcccacgaggccccgcgtggtgtcactgggctgcgcgggcgggtcaggaaaggagcggagcccatgggtgggcggggccaggggccggcgaggggcggggcgggcccctcggcgctgcgggcctcaccagct

SEQ ID NO: 75063 - DNA, 46 bp, Homo sapiens; identical to SEQ ID NO: 34237
  chr12:6472854-6472900
  hyper

SEQ ID NO: 75064 - DNA, 44 bp, Homo sapiens
  chr12:6473627-6473671
  hypo
taattgcatttaggccgggtgtggtggctcacgcctgtaatccc

SEQ ID NO: 75065 - DNA, 137 bp, Homo sapiens
  chr12:64783185-64783322
  hypo
ttggatcaagtgagccgcctgagattgccaagcgtcctgtgcgcatctcattaacgcatctgcttattcatgcatttattcttttgctggggagggggtggaggggaacggtgtctcactcattctgtagctcaggc

SEQ ID NO: 75066 - DNA, 17 bp, Homo sapiens
  chr12:64783562-64783579
  hypo
cacggcacccggcctta

SEQ ID NO: 75067 - DNA, 593 bp, Homo sapiens
  chr12:64784107-64784700
  hyper
cgacgtcccgcagagccactacccgccggatggacttgggcgggttctcggttaggtagacgagccggtcgcttagcaccacatacttgaggatgtggttctcagagttggacaccacgatgcatggctcgtaggcgcggaccgcgtcgtagacctcgggcggcagatgccgccgcaggaacacatccaggcggctgttcctgcgcgcggggaagccggacggcaaggggctggccatgcccggcgcccgcagcgtggcggagtgctgggactcgaggccctcagctcgccctctccccgcccccgcgctggaacccgcgcgccacaaagccgccggccacgcgtcgcctcctctccaggcgcggggacccgggccgcaactgcaggaatcgacgctaggtcggcttccctggagcgccctccccagccctgtccagcctctcgatctttgtcctaacctcagacggcgatgggcggggcaagacgctggtccttcaggcccgagttgatgggcacctcgggctcatcaccgtgaagtcccctgcggccgaagggcggtggatttttagggtctctcccgcccacccctaatg

SEQ ID NO: 75068 - DNA, 30 bp, Homo sapiens
  chr12:64797450-64797480
  hypo
aaataaattttggaccggacaccgtggctc

SEQ ID NO: 75069 - DNA, 20 bp, Homo sapiens
  chr12:64799707-64799727
  hypo
ttgatcgtccaaatgccttc

SEQ ID NO: 75070 - DNA, 462 bp, Homo sapiens
  chr12:6483568-6484030
  hypo
gaagacgagcttgtccgagttgaggttgatgttgaggctgacggggtagctgaagtactctccgaaaagcaggccgaattgccagtacatcatgccaaaggtgcagagccacagcactgcccagaaggccgtcttcatgcggttgtgctgggagcacaccaggcggatggcgccgtggatggtggtgttgttgcagaagaactcgaagagctctcggtaggagcggtggaactcgatcagggcctcctcctccgccgtgggctgctggggcgccgcaggttcggggcccagcccctgctcctcacgcttgttccccttcatgagccctggagtggactgtggagggctagagtcctgctcctccagcttgttcccctccatgagacctggtatgggctgcagaggtctagggtcctgctcctccagcttgttccccttcatgagccccggagtggattgggg

SEQ ID NO: 75071 - DNA, 63 bp, Homo sapiens
  chr12:6493353-6493416
  hyper
ggagccctggaggcccggcctggccgctcccggccctggggtgcacatcggccctgagtcccg

SEQ ID NO: 75072 - DNA, 78 bp, Homo sapiens
  chr12:6495108-6495186
  hypo
gaaaggtgagagctacgcaatggggtggatgggcatcctgaggcttaaaggaaactcacaggccggcaaagggcccct

SEQ ID NO: 75073 - DNA, 24 bp, Homo sapiens
  chr12:65152388-65152412
  hypo
caccgcgcccggcccaggcttatt

SEQ ID NO: 75074 - DNA, 232 bp, Homo sapiens; identical to SEQ ID NO: 1051
  chr12:65218319-65218551
  hyper

SEQ ID NO: 75075 - DNA, 628 bp, Homo sapiens
  chr12:65218900-65219528
  hyper
ggggagctctggggaaagtccgcgtgccacctggtgcggggcaccgcgttggcacctgcagggagcgattggtctggaagggtagagggcagacgggggcctgggtggggcagcggccaccccaggcgcggagaacccgctgcttccaccctctccccgcggacccccaccctgcggcctgtgtgctcggctttctccgcgtggcggggaagtgcgggtggctgcccgggccctcagaggccgcaccacctattgtgttccaggctcgcaggaagccagaccttgcgagaggtgtgtgggggcggagagtggcacaggtttgacactgcaggtcggaggaggaagacagtggctgcaaaggcaaaatcgggtgttattttcccaagagtcccttcagcgtgagtgccggggtcagctcgaactggagcctgtaatttgtgagtgcgagtggggagcagcaggagatccttttcataggtgaggtccaggaacgagcctggtcgtgctaggcaaggcccttcccactgtcagcctgtgtttacccatccctgcttctccagactgcataactccgtgtcggctccatcacccggcatccctccccgggattttaagagcctggccctag

SEQ ID NO: 75076 - DNA, 288 bp, Homo sapiens; identical to SEQ ID NO: 34493
  chr12:65219605-65219893
  hyper

SEQ ID NO: 75077 - DNA, 327 bp, Homo sapiens; identical to SEQ ID NO: 3911
  chr12:65220112-65220439
  hyper

SEQ ID NO: 75078 - DNA, 761 bp, Homo sapiens
  chr12:65514835-65515596
  hyper
ttgcctggtgagcatcgatccataggtacaggctctcctcctgcggcggcccggcctccgcccgcagtgccagcaggcacaggaggatgctccagagccagagcgcggcggcagggaaggcgctcctccgggccatgctgctcaggacctcctcgctgccgggaaaactcctcgtgccgcacctacgcaacctggcgccgtcagatactctgctgcgctgcagctccctcagccagggctgttcccgtttagacggctgggcgcgtcgcctcccggcctgggtgccaaggagcctgcgagagcaggaggagggggcaggcaggacgcgggaggaggagggggggaccagcgggcgcgagtcgcgcaagaagatggggcgcgggcgggagtgggggcggcagagacgtaagactggcaaagctggcgaggccagcagtcagcggggcaaatagagcgagaacagaagagcgggaagggctggcgcgagcgaggtgcgagcgaggagtggggcccgcgaggcctgggcggccgccacttgggggcgctgtggggcccccccgggggcggggccgcgagggacccccgaggctgcattcacagtgcggtgcgcccagtggagcgcccgcgaagtgggcgtgtagggctggcggacccggagaagggcactcagagacccctgggacatcactcgccacctcctcgggccaagggaggcttcgggggagggaaatggggagagcagacaacgctgggcttgactg

SEQ ID NO: 75079 - DNA, 209 bp, Homo sapiens
  chr12:65516338-65516547
  hypo
tataaataaataaataaaataattttttaaaagttgccgaattcacaggtgcgtgggggcaaaaccaaggctctggcctcgtctgtgagaagcatgcttggccggcagtgggctgcagcataacctatccacctggcccagcagaaagaactgatttttgcctcctgcctaattcctcggatgcacaaagaaaacggaagcaaaagggt

SEQ ID NO: 75080 - DNA, 29 bp, Homo sapiens
  chr12:65530856-65530885
  hypo
ctagaaaaggccaggcgtggtggcctttt

SEQ ID NO: 75081 - DNA, 22 bp, Homo sapiens
  chr12:65557212-65557234
  hypo
gagaagtgatagcatcggccgg

SEQ ID NO: 75082 - DNA, 23 bp, Homo sapiens
  chr12:65562063-65562086
  hypo
ttgactaacgtttttctgtacag

SEQ ID NO: 75083 - DNA, 99 bp, Homo sapiens
  chr12:65672426-65672525
  hyper
ttggactcggctgcccgtgcccaggaatttcccgtcatgcctcccgccgccccgtccgtcgcccggagccggggagggagggagcgaggttcggacacc

SEQ ID NO: 75084 - DNA, 524 bp, Homo sapiens
  chr12:65672776-65673300
  hyper
agcccctgcctcagccgagaaggggagcagaagggttgcgccccgcgccagcggtgaggggccgaacggaaggaggtcagggctggtttccccccacccgccgaagggaggcgtctggcagcctcactgacaccttatcctgtcccgggagcgaacctgaacccgcgggagcctctcgccccgcgcgggcccaggagagagggatctggcggggcagcccgcgggaggcaggggaggggtccatcccggagccctctgctctgtgcgtcgaccctgccggggttgccgctcagataacgggcccgaggcgtgggaaccggcccgccaggcctgcgcttttcgccgcgcgcctcggagaggacgggggtgcggggcggcgggcaggcggcagggaggggcgcacccgggagcgcacccgccgcccgccctccctgcgctgctgccccgctgctgggccagactccagcgggcccgcctggcatttcacaggccaaaatcgaacagaaccccgagtttgccaggta

SEQ ID NO: 75085 - DNA, 30 bp, Homo sapiens; identical to SEQ ID NO: 43493
  chr12:65787081-65787111
  hypo

SEQ ID NO: 75086 - DNA, 151 bp, Homo sapiens; identical to SEQ ID NO: 11310
  chr12:66122419-66122570
  hyper

SEQ ID NO: 75087 - DNA, 223 bp, Homo sapiens
  chr12:66122773-66122996
  hyper
ccaatctcccttcctcgagaggtgtctgggcgcaatactctccggcccgaagcaaggggacgtttgcgaggagggagaaatttaaacccccttcgctccgcgccacctgggagcactttggcgccgcagactcaggagccgacgccatctccaggacggcctcggtggcctcggcaggaggcaccttcggggagcggtcccgcactcctccttcctcagtccc

SEQ ID NO: 75088 - DNA, 186 bp, Homo sapiens
  chr12:66123380-66123566
  hyper
gggaggtggagcacgaaacacaaaagctgtttgaaccacaaacgccaggctggacacccaacgaatattaatgacctgcagcctccacccacccgcaaacataatattatgtgtacgtgcttaccggttagcttaacagacttgccatcataaattcctttttcactgcagcgccactagatttgt

SEQ ID NO: 75089 - DNA, 22 bp, Homo sapiens
  chr12:66133735-66133757
  hypo
aaagatgttcttggccgggcac

SEQ ID NO: 75090 - DNA, 1179 bp, Homo sapiens
  chr12:66135064-66136243
  hyper
aacctcctgggtgtccgggaccaccggccttagccttctccaagcccagggcagggcgagaagaacatggcccggttcccctcggggtctctggcccagctgcggagggggaaaggtgatcgatcttgctgggggccaccgctagcccaccgcttcctgccgcgacctgccgcggcggccggagcccgggagcttcccattggctcacgggccgacgccatgcagtctgggggggcgtggccgggcggcggggcgtggccaggcggtgcggggaactgcggagagaggagaggagaggagaggaggggaggggaggggagaggagtggagaggagaggaggggaggggagggcaggggcggggcggggccgggcggcgggggcgcacaccccaatctccctagcgctgtgggggtggctgcagctccccgcgcgctccctcctttgggggggtttctgggctcgtgacttttttttaaataaagaatgagcggatgcccgtgacaagttaatagctctcgccgcgctctaaagttaagttgtatctccttcccgccgcgagtctccttccacagacccgccggagctgccgggacgggcgctgcgcgggactgggcgttaggtgctcccggctggttccggcgagcagcccccacccctcgcccacgctcggggttagagaccccagcaccccacgcagacggcccgggcttagacctctccacgtcgctgtggcgcgcgccccgccaacacccccaccccacgcgcagcccgtgtcttctttacccccgcgcacttaacgcagggcgcacgcacgcatcccggccccctcacactcacactgcgtcttctgtcacaccccctgtcgcacacacactgttctctgactcccaccatctcctgtctcacacccactccagtttcgtgttgagcggccgccagttctccctcggtcgcgccggcgcacgctcgtccccttctgccccggagcccgcccgcgccgcacggtggccccttgcgctggcctgatcgtgggaaccaggcggggccccagcgtccctgcccctgcccggtcatccatctccctcccggtcggccagccgagacttcaaaggcgcctcctccggccgggcctgccaaaccccgacgcagcctggatgtgggccgggggcgctccccg

SEQ ID NO: 75091 - DNA, 30 bp, Homo sapiens
  chr12:66188703-66188733
  hypo
gatttgtgattttaccgagtaagatctata

SEQ ID NO: 75092 - DNA, 33 bp, Homo sapiens
  chr12:66208320-66208353
  hypo
aatagacagataggccgggcgccgtggctcacg

SEQ ID NO: 75093 - DNA, 30 bp, Homo sapiens; identical to SEQ ID NO: 43495
  chr12:66211140-66211170
  hypo

SEQ ID NO: 75094 - DNA, 60 bp, Homo sapiens
  chr12:66216864-66216924
  hyper
acgcggaccaatcagcgctgccgcgccaaagcagacatttacacgcgcctcctccacatg

SEQ ID NO: 75095 - DNA, 148 bp, Homo sapiens
  chr12:66217502-66217650
  hyper
gtgtgtgtgtaaatgcgggtgtttaccagcgcatgaatgcccccgtgtccacgtgtatctgcgtgcatgtgcttacacgcgtgttcgtgtgtatctgcatgcatgtctccgtgtatgtgcgcgctcgcccgcccgcaggctctgtggt

SEQ ID NO: 75096 - DNA, 33 bp, Homo sapiens
  chr12:66217887-66217920
  hyper
gtggagctaggcccacggcgagccagcccggga

SEQ ID NO: 75097 - DNA, 544 bp, Homo sapiens
  chr12:66218783-66219327
  hyper
cccacccaccgccgccgccgccaccggcagcgcctcctcctctcctcctcctcctcccctcttctctttttggcagccgctggacgtccggtgttgatggtggcagcggcggcagcctaagcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagtcagtacgagggcgcggtgggggcaccagcccaccccgtccccactgccggggcccagacacgcgcggggcggccggagtgcgggagcccagtcgccgcggccgtcgcacactgcccgccggccggccggggggagcggcgcagaccccacgagtgcgccgcgcg

SEQ ID NO: 75098 - DNA, 506 bp, Homo sapiens
  chr12:66219688-66220194
  hyper
cctcctccaagctctcggtggcccaagactcgcgccctcccgacaaagaacgcatggagacccggctgcctggtcctttttgggctctttaaatatgcggcggccgccggagggagcccggggcaggggctacggggagcctggttccccgcaggacggggttaactcgcccagctaagggcgcgttgaaaggagtgtccaagagagtgcagggtagccagggtcgcttccttgtcaggggcccggtcccccttttgcccctggatctcgcgcctcagagctgcagccattaaatgctcttctccaaggccagtggccgggggttgagtaggggacgatcgaggggcgcccgggaccctgcggagtggagggttttgtctgcggatgcaaccaattaagcgtgcagccggcgcttgcagagctgcgctcagcgcgcagggctgggggttttgttcgctgtaatttccaagccgcggcgggcagagttggagcgggatatgtctatt

SEQ ID NO: 75099 - DNA, 111 bp, Homo sapiens
  chr12:6623485-6623596
  hypo
aagaaccgccccactcgggaagccataacacacctgcttggtgtagccttgacccgttataaccatatgctcagtaagttaccagtcgctttgccccgccttttttgtatt

SEQ ID NO: 75100 - DNA, 22 bp, Homo sapiens
  chr12:66242342-66242364
  hypo
ttaaaagtttaaggccgggtgc

SEQ ID NO: 75101 - DNA, 28 bp, Homo sapiens
  chr12:66255902-66255930
  hypo
gtgtgagccaccacgcctggctgtgcaa

SEQ ID NO: 75102 - DNA, 76 bp, Homo sapiens
  chr12:66282638-66282714
  hypo
ggccccgtggtgtgctaactcttatgacaatgatgacatagggacccagggaccaccctcccgttagagatgcacc

SEQ ID NO: 75103 - DNA, 30 bp, Homo sapiens
  chr12:66317501-66317531
  hypo
cattctcgccgggtgcggcagctcatgcct

SEQ ID NO: 75104 - DNA, 22 bp, Homo sapiens
  chr12:66340919-66340941
  hypo
ggcagagtcttgctccgtcacc

SEQ ID NO: 75105 - DNA, 22 bp, Homo sapiens
  chr12:66341181-66341203
  hypo
acagtttcgttttaacatctgt

SEQ ID NO: 75106 - DNA, 30 bp, Homo sapiens
  chr12:66343834-66343864
  hypo
gcattggcatgtatacggagcaattggaac

SEQ ID NO: 75107 - DNA, 37 bp, Homo sapiens
  chr12:66523437-66523474
  hypo
tacaggcttgagccaccgcgcccggctgaatttcttt

SEQ ID NO: 75108 - DNA, 327 bp, Homo sapiens
  chr12:66582721-66583048
  hyper
cctagccgtggggcacggtgggctcctgggagctctgagctctgggctttctccagttcgcactctgcttgtctcggcagctccgtccccaccgcagaggtgtgaaggggcgcaaagccagcgaagggagaacccgggtcgggtaacccccaggcctggccaggcggacgcaggggcatctcgggcgaggcgcgccttgcgtcacgtgggcaccgcccctgcagtgaccggagaacggcgtgttcctagggctctgctgccgtcgtggaagcaggatttccgcggttgtgtaacggcctgtcgcaggcgtgcagggacctggactcc

SEQ ID NO: 75109 - DNA, 396 bp, Homo sapiens
  chr12:66583049-66583445
  hyper
cctcgtccccggggctcgggcagccgagccatggcggggaactgtggggcccgcggcgcgctgtcggcgcacacgctgctgttcgacctgccgcccgcgctgctcggagagctctgcgctgttctggacagctgcgacggcgcgctgggctggcgcggcctgggtgagtcggcggggaccggccgggggcggcgggggagcccagcgcgccgcggggcccgctcggcgtcgccctgcatggctggggtccctcgcggggctggcgcggcctccgggaagttcccgccagggagccggccccctcctttcctgggttggatgcagagactccctgggacccagatgccttccctcccttctctttcaaagaattttgggtatcgctgcaaagtcaag

SEQ ID NO: 75110 - DNA, 71 bp, Homo sapiens
  chr12:665830-665901
  hypo
gagtatgtgtctgcacgaggctggcagggcatcgatccagctggtggggaggaggtcgaggcccggaacct

SEQ ID NO: 75111 - DNA, 427 bp, Homo sapiens
  chr12:66628990-66629417
  hyper
agagactgctgcttgcgatagggcgtccggcagttgctgctgcccccggggttgccgctgctgctggggaagatcatcgctgcgggccgcggcggcgggcgcgggcgcggggcagcctgggcgcggggcagcctcgccgcgagggggaggacgcaaggagggggccggccgggccccgggccgaggcagctttgggaactccctctcgccgcgcggcggcggccggcgggggctgcagctccgcgctgacttcccctccgcactcgtctaaaagtgcggcgcggcgcggggcgagactcgagcagctcgggcagccgccgctctgcgtgccatggacgggagttcgcgcgcggagctggcggcgtcgccgactctcccggcggcagcggaggagcagcgccgccgcgtcctccgatattattaagtt

SEQ ID NO: 75112 - DNA, 181 bp, Homo sapiens
  chr12:6664165-6664346
  hyper
atggcagagacaagccggaaaagtaggaatccccccgtgttccgctcccagcgtccttcttcctgtcacgagcagggcttctgcattctctgcggattctagtctccctgcatccaattgcttccaagctcctcattacacagcacaaactttactctcattcttttcacccctgattctt

SEQ ID NO: 75113 - DNA, 153 bp, Homo sapiens; identical to SEQ ID NO: 3849
  chr12:6664370-6664523
  hyper

SEQ ID NO: 75114 - DNA, 178 bp, Homo sapiens
  chr12:6803722-6803900
  hypo
agagagtgagcacgccgcacaccaccacaacatcaggccgggaaacgcacatgagaggtaaagtgtgcaggaaacgctgaccactgagtgagctgagcacagaatgtgggaaggagagagtgcaaatgtgagacgagagaacatgagagtcagctgagcggagcggtatggacgggga

SEQ ID NO: 75115 - DNA, 70 bp, Homo sapiens
  chr12:6804640-6804710
  hypo
ggccggggtccccctcggggctcctcatggtcaggggtgggggtaggtgagtccccgaaggcccccagca

SEQ ID NO: 75116 - DNA, 493 bp, Homo sapiens
  chr12:6809199-6809692
  hyper
ccagtccctgggccccgcacagcttcagccgccccctccaggaagcccgcagtccccgggctggcgcgccacccccacccctctcccagcttctcaccgacctgttgtgcgcaggagacgagctgggggtggggcaggagcctcggggtgcgggagccgggccccagccccagcgtggcccccatcccacccatcccgcaggcccgcactccccgcacagggctggagagcggcgagagtggggggagacgaggaaaaggaggtcggcgaagggaccccgaggcagggagtgccgagagcggactggggacccgaagcaggagactgcgcggagccgcccgccgagccgaggcgggatggaggcagccgcggggacggggacggctgcgccagggagggcgggagcgagccaggaccgcggagggatggagagcccttcggggaaggggcgctgggaggctggaggccttgtcccgggcgagggaccgcgtcg

SEQ ID NO: 75117 - DNA, 76 bp, Homo sapiens
  chr12:6809993-6810069
  hyper
cgcggcggctgggaccgctccgtctccgtctccgcctcccccccgcgccggaggccacgcacggtttaaccctcct

SEQ ID NO: 75118 - DNA, 30 bp, Homo sapiens
  chr12:6812993-6813023
  hyper
ctgccctcttgcttgcgtgtccctgacagc

SEQ ID NO: 75119 - DNA, 91 bp, Homo sapiens
  chr12:6861239-6861330
  hypo
tatggatggcagaagcgccaaactgtcaatccctccaccaccctgcaaaaaaatacgcacagagcaacagtggcaccgatgcctacttcct

SEQ ID NO: 75120 - DNA, 78 bp, Homo sapiens
  chr12:68759053-68759131
  hyper
tgctgaattgggcaacgtgggctgcggttcacagggcaacagagacttcaccacctaacacatcggggctggtgcagc

SEQ ID NO: 75121 - DNA, 78 bp, Homo sapiens
  chr12:68978219-68978297
  hypo
aaatctcatagtctccgaggtcactaagagctttatttccttgccaggagcggtggctcacacctgtaatcccagcac

SEQ ID NO: 75122 - DNA, 78 bp, Homo sapiens
  chr12:68978597-68978675
  hypo
ctttttttccgttttcactagaaatgatcagcacagggatttactatttactcagatttgcttcgagcatgatgtcag

SEQ ID NO: 75123 - DNA, 30 bp, Homo sapiens
  chr12:69128689-69128719
  hypo
tcagcaactatctttcgatcataacaggta

SEQ ID NO: 75124 - DNA, 39 bp, Homo sapiens
  chr12:69203803-69203842
  hypo
attataggctggcctcggtggctcacccctgtaatccca

SEQ ID NO: 75125 - DNA, 95 bp, Homo sapiens
  chr12:69225853-69225948
  hypo
caacaacaacaaaatctcgtttttcaggttaagtccctagttgtgaaagcttttggtagggccagtttttttttcttcttcgttttaatttccct

SEQ ID NO: 75126 - DNA, 30 bp, Homo sapiens
  chr12:69326349-69326379
  hyper
cactcagagtaggtgcgtggaagagcagac

SEQ ID NO: 75127 - DNA, 868 bp, Homo sapiens
  chr12:69326653-69327521
  hyper
acacatgagggcaggcgggggcatcaccagctacgtctcggtactccggtctcagggtctcccgacactgacgctccctgcctcctaaggaggcaaaagctggaagcaacaccttcgggagtgagccgtgcaaccagagaccgggagcacgggcagcctcggtgccctcgacccagccgcccgcgcctccctctcctcctcctcctggcgcctccgccgtccggcagctgccacagctgcgcccggccccgcgcacccccagcctcaccaggtcccaggcgcgcacctctacccacccgcggccgcccggcggggccgggtgttatagcccggtcagagggcgggcgcgcccgggccccgcccccggacgtccctccggcccactccggagccgcgcgggtgcctcccgggcggggcctcagccgccttcgcacctaggagagacggcgcccgcgcggtgcgccctttcgtggcgcggctgctggtgcccgcggccgggcggctgagctgggcggagggctgcgggcatggagtcgccgctcgcggacagtctttgctggagccccaggtcagaagtgtgtcctcgcctcggccacggctgtagcctgggcagccacagggcgctccaccgagggacactctctgtcgcagactgcagccgcttgggagacgtttagggctcggcgggtttcctgcggttggcggtgccggggcccacctggagccgggacgcatgcggagtcctgagtgccctgagccccgcgcgggctcctgcgggacgggcggcgtcggccccggcagggcgagccaagctcccagcagtgccaagctgcccagcgaggctaagcaatcacggggcttcgagaaa

SEQ ID NO: 75128 - DNA, 46 bp, Homo sapiens
  chr12:69551179-69551225
  hyper
attctcaaactctgacgtgcttatcagtcaccgggaatgtgagaca

SEQ ID NO: 75129 - DNA, 22 bp, Homo sapiens
  chr12:69751028-69751050
  hypo
tttttgtttttgagacggagtc

SEQ ID NO: 75130 - DNA, 102 bp, Homo sapiens
  chr12:69754377-69754479
  hypo
taccatagaccctagcgtaatgtttgacattgtaatatttatttccctcacacagcccctggcacgttaatttttttttttttttgagacgaagtgtctgtc

SEQ ID NO: 75131 - DNA, 120 bp, Homo sapiens
  chr12:69754599-69754719
  hypo
aaaatttcctttcctttataaataaaaatcagaaggggtacaaatagttgtttttatcaggagccagtgggtcctgccttaaaaattaacgtgcagggccgggcaaggtggctcacgcct

SEQ ID NO: 75132 - DNA, 30 bp, Homo sapiens
  chr12:69799375-69799405
  hypo
agcactgtgatactacgacagtgaatttga

SEQ ID NO: 75133 - DNA, 30 bp, Homo sapiens
  chr12:69810460-69810490
  hypo
tatgacaggctacttcgctcagatcaatgt

SEQ ID NO: 75134 - DNA, 239 bp, Homo sapiens
  chr12:69964051-69964290
  hypo
aatgcattttcctgacgaattggtgacatatttgcatgactgtcaccttctttttttaggtcattaatgtggatgatgatgggaatgagttaggttctggcataatggaacttacagacacagaactgattttatacacccgcaaacgtgactcagtaaaatggcactacctctgcctgcgacgctatggctatgactcgaatctcttttcttttgaaagtggtcgaaggtgtcaaact

SEQ ID NO: 75135 - DNA, 43 bp, Homo sapiens
  chr12:69999350-69999393
  hypo
atcacaattactggccgggcgcggtggctcacgcctgtaatcc

SEQ ID NO: 75136 - DNA, 30 bp, Homo sapiens; identical to SEQ ID NO: 43504
  chr12:70024017-70024047
  hypo

SEQ ID NO: 75137 - DNA, 22 bp, Homo sapiens
  chr12:70030627-70030649
  hypo
ccgcgcccggccccctcagact

SEQ ID NO: 75138 - DNA, 254 bp, Homo sapiens; identical to SEQ ID NO: 43505
  chr12:70087493-70087747
  hypo

SEQ ID NO: 75139 - DNA, 41 bp, Homo sapiens
  chr12:70173234-70173275
  hypo
ttattccctcttgaactccaattactcgaacattttctctt

SEQ ID NO: 75140 - DNA, 16 bp, Homo sapiens
  chr12:70651436-70651452
  hypo
gcgcccggccccaact

SEQ ID NO: 75141 - DNA, 173 bp, Homo sapiens
  chr12:70760956-70761129
  hyper
gaggagaccaggtggcgcaggctgtgctcaaaccaggaatgactacatcagggagccccagggctccggtcttttcaggtgggtttacgcgcggcgaccagtggtgcccagaggcttactttaaaacctgtcttgcctggtctcagattttgaggcctcgacccagtccgggt

SEQ ID NO: 75142 - DNA, 35 bp, Homo sapiens; identical to SEQ ID NO: 43307
  chr12:709027-709062
  hypo

SEQ ID NO: 75143 - DNA, 87 bp, Homo sapiens
  chr12:70931093-70931180
  hypo
aaatacagattcccaggccctgcctcagccctgatggatcagaatctgccttttcacaagatcctcagatggcgcagacatctttca

SEQ ID NO: 75144 - DNA, 568 bp, Homo sapiens
  chr12:71003477-71004045
  hyper
tgggaatttggttttcggcggggagggggcgcatcagctctgaccccttctcgggccactcacctgcagcaggctcagtgtgatccacaaggccaacccggctccatggctcagcattgcgctcagtagttaagatccagaggagaccgagggggctggacgtgggacggcccgagggccggggcagggggtcacctgttgcgcgcgctcagcgcgccccgtgggcgcagcgcgcttccctcggggctggcgacgcgcaggggccactgcggccaccgctgctgctgctgctcctgccgccccgggcgggctgcggacgcgagaggcggcggggacaggcagcgcgccgcccttcccacgctgccattctgacccgcgctgcctcgccccagccccgtccgctgacttccgcaatcaaaaggcaatttcctcgtctcccggcaaaggaacaatgcgccggcgagggagggagccccgaggagccaacgcctgagcctgccaaggggcccgatgtgggccaagctgcccccgctgccccgcgccgataccttcccggccaggggtccgg

SEQ ID NO: 75145 - DNA, 244 bp, Homo sapiens
  chr12:71314368-71314612
  hyper
agcagtaggaggttgcgggtaaggggaacagaagcgctcagaggcggcaaatgcctggccttctggacgcccagaagccaaggcggagacggcagggtggactccgcgccagcccagcagcccagcagcagcgccgcggctactgagcatgcccagcgccggccctcacgaggcaagggaatttcaaagtgaaattccgcttctccgggtcttagcggcggcttggagcagagtaggctccatc

SEQ ID NO: 75146 - DNA, 63 bp, Homo sapiens; identical to SEQ ID NO: 11324
  chr12:71314613-71314676
  hyper

SEQ ID NO: 75147 - DNA, 171 bp, Homo sapiens
  chr12:71403294-71403465
  hyper
cggagagaaagtgaccgtgaacaataaatgattagatagataggtaggtaggtagagaacaaaacgaggaaaaagaggaacagagggggagttgcgggggagagatgttatcagaggaaacagataagactaatgttttctctagaccttccaaaacgcagtcaagaagaa

SEQ ID NO: 75148 - DNA, 137 bp, Homo sapiens; identical to SEQ ID NO: 43507
  chr12:71626492-71626629
  hypo

SEQ ID NO: 75149 - DNA, 30 bp, Homo sapiens; identical to SEQ ID NO: 34516
  chr12:71832897-71832927
  hyper

SEQ ID NO: 75150 - DNA, 617 bp, Homo sapiens
  chr12:71833313-71833930
  hyper
gggggtcccctattccggcgcgcggcgttgagcactgaatcttccaggcggaggctcagtgggagcgccgagaactcgccagtaccgcgcgctgcctgctgcctgctgcctcccagcccaggacttgggaaaggagggaggggacaagtggagggaaagtggggccgggcggggggtgcctgggaagccaggctgcgctgacgtcactgggcgcgcaattcgggctggagcgctttaaaaaacgagcgtgcaagcagagatgctgctccacaccgctcaggccgcgagcagcagcaaggcgcaccgccactgtcgccgctgcagccagggctgctccgaaggccggcgtggcggcaaccggcacctctgtccccgccgcgcttctcctcgccgcccacgccgtggggtcaggaacgcggcgtctggcgctgcagacgcccgctgagttgcagaagcccacggagcggcgcccggcgcgccacggcccgtagcagtccggtgctgctctccgcccgcgtccggctcgtggccccctacttcgggcaccatggacacctcccggctcggtgtgctcctgtccttgcctgtgctgctgcagctggcgaccgggggcagct

SEQ ID NO: 75151 - DNA, 152 bp, Homo sapiens
  chr12:71834137-71834289
  hyper
aggctggaggctcctcggcgcccgcctgctcgtgggggaggggggcgagtttgtcaagggcatcctggccaggcctgttagggcccccagagaaatgcacgtgtctcggggagtagcgtgccggcactttctggacccgcagagaaatggct

SEQ ID NO: 75152 - DNA, 301 bp, Homo sapiens
  chr12:71834789-71835090
  hyper
aaccatctcttcccccggggaggaaaggggaagtgggctgaaggctgttgggctggtaaacagcggcaccgacacccaaagggagacctgaagctctctatcatccctgggggattctcccaccccttctctccccactgcaacttccaaagccctgaggcggcggctcattgcgtaattttttctgtggaaaacccaggcccgaaggtaacaggtagttgggtgaacgcggtgacccaggaggaaccctattctcggagaccaaggcgactactctctccacccccgtgcaaagcatctg

SEQ ID NO: 75153 - DNA, 37 bp, Homo sapiens; identical to SEQ ID NO: 43508
  chr12:72054795-72054832
  hypo

SEQ ID NO: 75154 - DNA, 18 bp, Homo sapiens
  chr12:72077594-72077612
  hypo
gatatgctagataaacgg

SEQ ID NO: 75155 - DNA, 30 bp, Homo sapiens
  chr12:72165406-72165436
  hypo
gttatctccctctcgcgttttgcatgaaaa

SEQ ID NO: 75156 - DNA, 30 bp, Homo sapiens
  chr12:72232195-72232225
  hypo
actctccttttctgtcgttcagctagttgc

SEQ ID NO: 75157 - DNA, 55 bp, Homo sapiens; identical to SEQ ID NO: 34519
  chr12:72332641-72332696
  hyper

SEQ ID NO: 75158 - DNA, 90 bp, Homo sapiens
  chr12:7249312-7249402
  hypo
tgccaaacccactgacgtagcccaacaagccgctgcggtagagggtctcattatcgggcagacagaccgggaggacgttggggcccaggg

SEQ ID NO: 75159 - DNA, 87 bp, Homo sapiens
  chr12:72634614-72634701
  hypo
gtgctgggattacaggcatgagccaccgcgcctggcctctccaatcaattttaaaaaataaacaaatttatccgggcattatttttt

SEQ ID NO: 75160 - DNA, 160 bp, Homo sapiens; identical to SEQ ID NO: 34520
  chr12:72665266-72665426
  hyper

SEQ ID NO: 75161 - DNA, 103 bp, Homo sapiens
  chr12:72665668-72665771
  hyper
ggaatgagggagtctcgctgtcgggtctgcaacctcctgccgtttgccgccaccgccgcttaaagtgcccagggtggagaaggcttttccaggacggatctcc

SEQ ID NO: 75162 - DNA, 260 bp, Homo sapiens
  chr12:72665772-72666032
  hyper
tcgtagcttcgcggccctgggacttcctcctgctggttcactctagtctctcccacctcggccatccttttctctccagctgcagggtgtatggctcgggtgcctcccgtgctgtggccgccgtcactgctgctgcgagcacattccacccagaggaccgaacgccgccgctggagtggggggagaaagcgaaagccctaacttccctctctacaccctcgctcttcccaccgctcccgtccttctccctagccgagaac

SEQ ID NO: 75163 - DNA, 123 bp, Homo sapiens
  chr12:72666342-72666465
  hyper
gatgcctgctctggctgtggcccgggtggcccgcccgcggggggtgccagagggggcgggggaggaggaggaggcggtgtgatggccctggacggcgagctgggggagcaagaggaggagaag

SEQ ID NO: 75164 - DNA, 283 bp, Homo sapiens
  chr12:72666525-72666808
  hyper
gccgagaagagcagctcacccttcgcagccgcgatgggggaagacgacgccgcgcttcgggctggcagcagggggctctccgacccgtgggcagactcagtgggagtgcgaccccgcaccacggagcgccacatcgccgtacacaagcggcttgtgctggccttcgctgtgtccctcgtggcattgctcgcggtcacaatgctcgctgtgctgctcagcctgcgcttcgacgagtgcggggcgagtgccacgccaggcgccgacggtggcccctcaggctttc

SEQ ID NO: 75165 - DNA, 389 bp, Homo sapiens; identical to SEQ ID NO: 3915
  chr12:72666997-72667386
  hyper

SEQ ID NO: 75166 - DNA, 295 bp, Homo sapiens
  chr12:72667387-72667682
  hyper
aacctctgggcggcctgcgaccccggggacccagctggcttccaatacccgggaagccaggggtggggggaaggaaacgaaagcggagtagggcagtcagaactccggggtctcccagatgcctcggggtctcgctgccgccaacttcgcaaactgactcaccggtgccaaaagatgaatgctgccccctcctctagtcgggacctctcctcttcctgtcagagttccttagccatcgaaacgcagggctctttttctgaagggtagctgataatctgagcgatgccagagtgac

SEQ ID NO: 75167 - DNA, 23 bp, Homo sapiens
  chr12:73732465-73732488
  hypo
actgcgcccggccatttactggt

SEQ ID NO: 75168 - DNA, 30 bp, Homo sapiens; identical to SEQ ID NO: 43512
  chr12:74092079-74092109
  hypo

SEQ ID NO: 75169 - DNA, 16 bp, Homo sapiens
  chr12:7462672-7462688
  hypo
gcgcctggcaggagac

SEQ ID NO: 75170 - DNA, 36 bp, Homo sapiens
  chr12:74930406-74930442
  hypo
catgtaaggcactgtcgcaagatttttaaaaatata

SEQ ID NO: 75171 - DNA, 95 bp, Homo sapiens
  chr12:752339-752434
  hyper
tccagcaggggccaccgagggctccaggagcaccccaggcccgttcttctggcccacagcgcccctcctgtgaccctcagcgaccctcctgtcct

SEQ ID NO: 75172 - DNA, 30 bp, Homo sapiens
  chr12:75518961-75518991
  hypo
tgacacatgttctaccgtgactgggaataa

SEQ ID NO: 75173 - DNA, 201 bp, Homo sapiens
  chr12:7559133-7559334
  hypo
agatcacagacacatcgttttgatgaagacagtcaaaattgacggttccggaatgtctgcagtcccaaagaaaagattcattaccggagcaggagacaccatcaagccatacaacatcagaccctgactgcaaatgaggcaagccagcgaagtgaagtgcggttccacatcccaactgcttgcatacgacatcagctgcag

SEQ ID NO: 75174 - DNA, 60 bp, Homo sapiens
  chr12:75601171-75601231
  hyper
gccccgccgcgtcctcgatgcccagcctcttggccgccaggtcctcgtcgtcgccggggt

SEQ ID NO: 75175 - DNA, 122 bp, Homo sapiens; identical to SEQ ID NO: 34528
  chr12:75601378-75601500
  hyper

SEQ ID NO: 75176 - DNA, 361 bp, Homo sapiens
  chr12:75601695-75602056
  hyper
cggtaggtttcgtgccgggtgcccccgacattgaggatcaccctctcgttgttctcgatcttgcccatctctgtgactcagacatgactagggggaggcaaacacagcgccgagttaaagatcttagccgtcaaagacacaccatgacccccaccaccaacccagagcgagtccagggatgcagagttggcagacaggcacggggcaaagaccctccccgggaggggatcagcgtccagcgctgtccccgcctcttgcatcaaacctttcccaggtttccagagaactacagagatagcagtcctagtctttcttgacctttcatgacaccgttttccctgcctcccgctttcctttcttt

SEQ ID NO: 75177 - DNA, 619 bp, Homo sapiens; identical to SEQ ID NO: 34530
  chr12:75602875-75603494
  hyper

SEQ ID NO: 75178 - DNA, 426 bp, Homo sapiens
  chr12:75728077-75728503
  hyper
tatacacggaagctgcgtctaagaaacgaatatatagtgctttgcactcgactggcccattgtcagcatcccgcacttgttctttacctaacttgtgtggcttgcatattgcaatctgtattacaatccagacgcgctctgcagattacagattggatccacagaaagcagtttggatggttgaaattccctccaccagagggcgactcagagctttcccctgtagctcagagctttgtggaaggggaaccctgctgcctgttcttccccacagcgacactgacaagttgatccagccgcgctgggctcgagcctgtgcggcaggatggagccaagggagagcgtggtgcgggggcgtggggaaatcgggttgccccagccgttactggtccgcgcagtcagggcatcctccgcatcctccacatc

SEQ ID NO: 75179 - DNA, 60 bp, Homo sapiens
  chr12:76742449-76742509
  hyper
atctccctccagtggcgtccgctgcccccaaatcccttagtctcccgagaaactttcttc

SEQ ID NO: 75180 - DNA, 53 bp, Homo sapiens
  chr12:76807087-76807140
  hypo
ataattatttactagcgtgtcacagcaggtacttcattcgttttcactgctga

SEQ ID NO: 75181 - DNA, 29 bp, Homo sapiens
  chr12:76848726-76848755
  hypo
agcagaggccgggcgcggtggctcaagcc

SEQ ID NO: 75182 - DNA, 94 bp, Homo sapiens
  chr12:77085821-77085915
  hypo
aggcatgtaaataaacgaccactgggtgaggcagaaaaagtgtactgagtgtgtaacgccaaaggttcttttgtttgtttgttttttgtttttt

SEQ ID NO: 75183 - DNA, 30 bp, Homo sapiens; identical to SEQ ID NO: 15677
  chr12:77150018-77150048
  hypo

SEQ ID NO: 75184 - DNA, 36 bp, Homo sapiens
  chr12:77436981-77437017
  hypo
tgaagatataaaacacgattacggtcatgctgcctg

SEQ ID NO: 75185 - DNA, 81 bp, Homo sapiens; identical to SEQ ID NO: 43352
  chr12:7767211-7767292
  hypo

SEQ ID NO: 75186 - DNA, 36 bp, Homo sapiens
  chr12:77718450-77718486
  hyper
aggcgctcctcccgccgttcccgcaggaaacttttc

SEQ ID NO: 75187 - DNA, 342 bp, Homo sapiens
  chr12:77719271-77719613
  hyper
gggggtgcggggggacgtcggggatgggggtggccagcgcggtcctgggagtggcgggttcggatgggctggctgcggtgggccactttgggcatctcggcgtggcctgcgccggggtcacggggagggctgtcagcgccagggcggcggaacccgaggtctccagacgagtgagggagggatgcaggcttgggggtgatggagcgcttggctggtggctggtgagcgtccatacatcatagctctccttcccactcccccgcccctcttcgggattctctctttctctttccccgtcctcatttctttcttcctttactcaccactcgcttcattctcttc

SEQ ID NO: 75188 - DNA, 24 bp, Homo sapiens
  chr12:7840950-7840974
  hypo
ctaactagggctaggcgcagtggc

SEQ ID NO: 75189 - DNA, 21 bp, Homo sapiens
  chr12:7844734-7844755
  hypo
gtcaatagactgggccgggac

SEQ ID NO: 75190 - DNA, 30 bp, Homo sapiens
  chr12:7854770-7854800
  hypo
ttgaatagaatttgccgagggtacatacaa

SEQ ID NO: 75191 - DNA, 105 bp, Homo sapiens
  chr12:7864790-7864895
  hypo
ttgagccactgcgcccggccagtacttcagatttctaagaccagtttctggggataaataattggaatcacagaacgcggctcgtagcgtcgttgcatcagtatc

SEQ ID NO: 75192 - DNA, 17 bp, Homo sapiens
  chr12:7896250-7896267
  hypo
cccggccttaattcttt

SEQ ID NO: 75193 - DNA, 120 bp, Homo sapiens
  chr12:7919057-7919177
  hypo
gactccgtctcaacaaaacaaaacagcaaacaaacaaaacaaaacaaacccactatctcaccaccacgatacccttaaaagaaaatggggatgggaaattggccatttgatttcttttct

SEQ ID NO: 75194 - DNA, 34 bp, Homo sapiens
  chr12:79198065-79198099
  hypo
gggttacccatagcacgtccgggttacccataga

SEQ ID NO: 75195 - DNA, 205 bp, Homo sapiens
  chr12:7921501-7921706
  hypo
ataggcatgagccaccacgccgggccttgttactggcatttttagatgtaattaaaatccatattaatcgtcttcaagtaaaagggattataatctgagaaagcctaatccaatcagttaaggctttaagaggaaattctgcctagggagagcagctccatcgcacactgaagggttccagccatcctttcggacttgccaagac

SEQ ID NO: 75196 - DNA, 288 bp, Homo sapiens
  chr12:79257222-79257510
  hyper
tcaaaggcctttaaacgaggttgagggagggagaaagggaaatagttctctccgttttgaaatcctttcacctgtggagcagataatggacgggcccctctcccagctgggctccgctcccgcccctagcctggcgcgcggtcccttcccccacccgctgagccttcctgttcggtatttcggtattaccaagctataaattgcctgagagcttagagacaatcaggtcaccaccgccctcacaagagaaaagcttcttacttccgagcagaacggttcagctgggaa

SEQ ID NO: 75197 - DNA, 383 bp, Homo sapiens
  chr12:79257714-79258097
  hyper
gctgatgggtggagtcgcgctcccggccccacctatgggacggagctgcttctcccgcatctcggctccaccgcacccttcgcgggaagtccccaggcttccagcaaagctcagcttatcccgcccccgcttccaacccggaaccccagaagaacagcatgatgagcctccggcagccaggtgggccacctccccgcggctcagtttgaggacacttgtgcggaaccctttcacatccccaccctacccagctttcacaactccgccgggttaaatggccaaagacaaacttctacctctcctgtccccggtcccagcttttcaaaaacccacagctggcgaacccacacacatcgaaactcctaggtcgctgttgcagtctg

SEQ ID NO: 75198 - DNA, 141 bp, Homo sapiens; identical to SEQ ID NO: 34535
  chr12:79258297-79258438
  hyper

SEQ ID NO: 75199 - DNA, 440 bp, Homo sapiens
  chr12:79258439-79258879
  hyper
aggtggagccaatcaggatgctggggctcggagatgatgggcggccgcctcctcactggagggattcctggagaagctgcagtgtggggatgctctagaccgagtactgcccccagtgtctttccacctcctcctgcagcagcggcagcggcagcagcagttagcagcggcaacttgaggctgcaccccgggcaagtccccagggtggtgctcagccgagaggggggcttggcgccccgaaggggtgtgtgtagggtgggggcgaccacgtgggaccagctggtggccctggaaaacctcccacacacccacacccacacaccccttttgtgttgcaggctgcccctccaagagcggaggcagcgagagtacgcgtgtgcctcgcgccggtccacgcggggagagcactggggaccgagacccggcaccacctcccggtc

SEQ ID NO: 75200 - DNA, 134 bp, Homo sapiens
  chr12:79258965-79259099
  hyper
cgatacacttgggttttagtggtgggagtctgagacctagggagggatccccgggtggcctattgtgagaaatatgagactacatgtgcatctcctggaaaagcactttgcacagcgcccgtgatttagagcct

SEQ ID NO: 75201 - DNA, 43 bp, Homo sapiens; identical to SEQ ID NO: 43355
  chr12:7960433-7960476
  hypo

SEQ ID NO: 75202 - DNA, 94 bp, Homo sapiens
  chr12:7963239-7963333
  hypo
tcaggaggctgaagccggacagttgcttgagcccaggagaatagcccgggcaatacagtgatatcctgttcccctcctccgataaaaaacaatt

SEQ ID NO: 75203 - DNA, 80 bp, Homo sapiens
  chr12:7963796-7963876
  hypo
gggattacaggtgtgagccactgcgcccggccgaaggattttaagtaggatagtgatatacagtccgacttctgtatctg

SEQ ID NO: 75204 - DNA, 18 bp, Homo sapiens
  chr12:7973388-7973406
  hypo
aattaaacaacagtccgg

SEQ ID NO: 75205 - DNA, 30 bp, Homo sapiens; identical to SEQ ID NO: 43358
  chr12:7980007-7980037
  hypo

SEQ ID NO: 75206 - DNA, 85 bp, Homo sapiens
  chr12:7981128-7981213
  hypo
catgagattctgtctcaaaaaaagaaaaaacaaagtagagtaatcagaaccatcttcacttggattctgacgggcagggaaaggg

SEQ ID NO: 75207 - DNA, 30 bp, Homo sapiens
  chr12:7984193-7984223
  hypo
caatacctgccaaagcggttaacaaagagt

SEQ ID NO: 75208 - DNA, 30 bp, Homo sapiens; identical to SEQ ID NO: 43516
  chr12:79842607-79842637
  hypo

SEQ ID NO: 75209 - DNA, 30 bp, Homo sapiens; identical to SEQ ID NO: 43359
  chr12:7986413-7986443
  hypo

SEQ ID NO: 75210 - DNA, 30 bp, Homo sapiens
  chr12:7998024-7998054
  hypo
actcaaattgtggtccggggaccagcaaca

SEQ ID NO: 75211 - DNA, 38 bp, Homo sapiens
  chr12:8001679-8001717
  hypo
cctcagggtagtcagcccacctccgtctcccaaagtgc

SEQ ID NO: 75212 - DNA, 38 bp, Homo sapiens
  chr12:8009448-8009486
  hypo
tttgagacagagtctcgccctgtcgctcaggttggaat

SEQ ID NO: 75213 - DNA, 275 bp, Homo sapiens
  chr12:8023505-8023780
  hypo
cacatccaatgtcttcgtgatgttcgaccagttccacatccaggagtttaaggaggctttcaacatgattgaccagaaccatgatggcttcaatgacaagggggacagcacgacaagctggcttcaccgcggaagaaccccatggatgaatacctgcagggcatgatgagcgaggccccagggcccatcaacttcaccacttccctcaccatgtttggggagaagctgaatggaacagacccccaggatgtgatccaaaacgccttcacctgctt

SEQ ID NO: 75214 - DNA, 96 bp, Homo sapiens; identical to SEQ ID NO: 43517
  chr12:80488160-80488256
  hypo

SEQ ID NO: 75215 - DNA, 30 bp, Homo sapiens
  chr12:8050118-8050148
  hypo
gcccttattttgtatcgaaaatgttcattt

SEQ ID NO: 75216 - DNA, 30 bp, Homo sapiens
  chr12:8063011-8063041
  hypo
gataaacaggctgggcgcggtggctcacgc

SEQ ID NO: 75217 - DNA, 20 bp, Homo sapiens
  chr12:8074494-8074514
  hypo
tctgtgtttctgggccgagt

SEQ ID NO: 75218 - DNA, 226 bp, Homo sapiens
  chr12:8088725-8088951
  hyper
agcaagttttctccacgtcctcaggaaggatccaaagtcttaccattacagcatctctgggtctcgctgggatcatgactatttataatctccgcaaagggtggagcctgaaagggcgacaagcccccagccccaccccaccccaccccacccccctgaagcaatcttgtgatctctcggaattctgtgttatcagaactacccccgcccccgccccacagacaat

SEQ ID NO: 75219 - DNA, 297 bp, Homo sapiens
  chr12:81102159-81102456
  hyper
gtgacccaagaagaccgggtgcttgcaataggcaggaaatgcgtacccggcccgaggaagcaggaaagccgccccccaccccaccccaaccccggaaccgatgtttctttcctaatctgccgctgccttggttttccctccagcttgagggtgcggatttcctgcgcacctgcagctcccagtggccaagtgtttccgatcattccagggggctcgtgataacggctaaggaaggtaaagtaaaagggctctgggccgcaccagagaaaatccgggaggtggataggatgcttgggc

SEQ ID NO: 75220 - DNA, 29 bp, Homo sapiens
  chr12:81107996-81108025
  hyper
cgcttgtgttttctcggcttctttagttc

SEQ ID NO: 75221 - DNA, 96 bp, Homo sapiens; identical to SEQ ID NO: 43361
  chr12:8117682-8117778
  hypo

SEQ ID NO: 75222 - DNA, 18 bp, Homo sapiens
  chr12:8122686-8122704
  hypo
gcccgaactacaattctt

SEQ ID NO: 75223 - DNA, 375 bp, Homo sapiens
  chr12:8123153-8123528
  hyper
ctttcttgcactcgtctttatcttctaagccctccacatgcttttaaactgtcagtcttttcatttttatttcttcctcttggacgcatttacccaaattggcccgagggaggctgagacagcagatacgaaagaaaaatgtgtgtatgcgtgagtctttgggtggcgaagaaggaggaggaggaatgtagctcggggctcggcccccgtgctgggattccgagggcgggggacaggatgcgcgcgcggcgggtagcgtgccacacggcacgtcccggccgctgcaggaaggcggggctcaggtcccgccgactcccacatgctgggggacaccgggagcgcctcccactcccagcccgccggagagccttgcaa

SEQ ID NO: 75224 - DNA, 22 bp, Homo sapiens
  chr12:8127118-8127140
  hypo
ccgtgcccggccaaggtcataa

SEQ ID NO: 75225 - DNA, 134 bp, Homo sapiens
  chr12:81330218-81330352
  hyper
ttttgccttgcccatcgttcagtttaatcctctagaaagaaaatttttagaggtacatcggactaaatcattttcttctgagtacaccatttccaaatggccgcccagggtcctaaatccggcggctgcggaga

SEQ ID NO: 75226 - DNA, 582 bp, Homo sapiens
  chr12:81330737-81331319
  hyper
agcagacgcgaccctcgccgctttcgatctcgaagccgcggagagccgatctcggctgctggggctcggctccccgcgctctgccttgccctttcggcagagggcagctccctgcctgctgcagccccgccactgtgcgcccggcagcccaggggtgcgcccagcccgccccccgagtggccgccgggactccagcagttggaccgaccctcgccctccggcgcctggacaaacttccttcctcccgggcccctgcgccaagcaagctgacaggcggctccctcgccggtctcctctgggctctggccgggcgagcttgctctctgcccctctccaaccccgagcccctggcgcctatagccgtccccgcgcagcggctccaacaaagccagaggaccggagacgacccggcgaggggctgggagtggcagcggggaccccagagccagaaggaggcgtcccctcggcggggcgagtacagtgggaaggggcagcgggaacgtagcggggagagaaaggggaagaaagtgttctgttctcggcgcgaacgccttcctggctcgtcctcgttccccttctcct

SEQ ID NO: 75227 - DNA, 246 bp, Homo sapiens
  chr12:81331631-81331877
  hyper
gtagccagatggagacgcaactgttccgcggcggcagatcttcagttgcggtgcggagctgagcaggtatccgagagcgactgcatcgccgggctctgggagggaaggctctgccctagaactttgctattccacccccaggagcgctgggtgggtgtagctggcgggttgcttcctttcaactttccactctaataaaatggtcagaatatacgtgtgtgcatgcgggtgcgtgtgtgtataagg

SEQ ID NO: 75228 - DNA, 160 bp, Homo sapiens; identical to SEQ ID NO: 34541
  chr12:81471455-81471615
  hyper

SEQ ID NO: 75229 - DNA, 379 bp, Homo sapiens
  chr12:81471753-81472132
  hyper
cggcgactctagtgtggcttccaaacttctgggctctgggctcacttcggaatttgcccccgccccctactcccttccctcaggccccaggaagttgcaagagtaccatttgtcgcacactcggggaccgcgggtggccggaggagatgaaaccgtcttggctgcagtgtcgtaaagtcaccagcgccggggggctcggagggcccttgcctgggtcctctccggcccggggagccggtgcggccctcagggctttagtggtcccgggcccgcggggcggtctcgggggccggggatgcagggcactgtcctccggcagtggcagcgagtacaagacccacttcgcagcctcggtgaccgaccccgagaggttctgggg

SEQ ID NO: 75230 - DNA, 24 bp, Homo sapiens
  chr12:8148633-8148657
  hypo
tataataaatgggctcggctgggt

SEQ ID NO: 75231 - DNA, 90 bp, Homo sapiens
  chr12:8165031-8165121
  hypo
cagaacaaaacacacaaacaaaaaaaacaagtaacttcaggtcttaagtagtaagatctaattgttaaataagtacgggaggcacagcca

SEQ ID NO: 75232 - DNA, 145 bp, Homo sapiens
  chr12:8168130-8168275
  hypo
tacaacttctgcaaacggagacaaagaaattggcaatatcatctccaatgcaatgaaaaaggttggaagaaagggtgtcatcacagtaaaggatggaaaaacactgaatgatgaattagaaattattgaaagtggctgggcgagg

SEQ ID NO: 75233 - DNA, 205 bp, Homo sapiens
  chr12:8170311-8170516
  hypo
tccatctgaaagtttcgccagctgttcattcagtttttgcttttcatattcactagttgtgacatctaactgctcaatgacttctcaaatacgtttttcaatttgagccttattaccttttccttttaagagcatggcatcggctgggcgcggtggacttgtcagaagttttcaggagttttgctcttgttgcccaggctggagt

SEQ ID NO: 75234 - DNA, 592 bp, Homo sapiens; identical to SEQ ID NO: 34242
  chr12:8171294-8171886
  hyper

SEQ ID NO: 75235 - DNA, 37 bp, Homo sapiens
  chr12:82032738-82032775
  hypo
tacaggcgtgagccaccgcgcccggcctgttttgtca

SEQ ID NO: 75236 - DNA, 30 bp, Homo sapiens
  chr12:8214437-8214467
  hypo
tgtttaccatattcacgttgtacaaccaat

SEQ ID NO: 75237 - DNA, 93 bp, Homo sapiens
  chr12:82152505-82152598
  hyper
ggctcttaaagcagccgcggcccctttgccagaacagccgcagctccccgcgtgcagctggagccccggggcggagaccggagaccggggact

SEQ ID NO: 75238 - DNA, 263 bp, Homo sapiens
  chr12:82152992-82153255
  hyper
ccatttttctcctcccggcctttctgcaagcctctttgcttgcttcaattggccggaagaaccaacctgctggcagccggtgaggacgctacagcatcttctctcctcacttgcctcgtgcggtggctgctactcctcctcctccgtctcctcccctcctcctccttggcagccaccacctcctcttcctctggaacaagggcttcccctggaagctgctgcagtggtttccaccggcccttaaataaattctgaagtaatca

SEQ ID NO: 75239 - DNA, 195 bp, Homo sapiens; identical to SEQ ID NO: 34545
  chr12:82153283-82153478
  hyper

SEQ ID NO: 75240 - DNA, 30 bp, Homo sapiens
  chr12:8298283-8298313
  hypo
ttccaccaagaaggacgaaaatggcgaatg

SEQ ID NO: 75241 - DNA, 162 bp, Homo sapiens
  chr12:8322370-8322532
  hypo
gtgtgtctaaatagccgtgaaagggctaggaggtcacaagtcggcctcttaatttttacagttgccgttaaaacattaaggtaatattgagggtgcagaatggctccttcctcatgactttttaacagatctgggccgggcacggtggctcacgcctgtaat

SEQ ID NO: 75242 - DNA, 125 bp, Homo sapiens
  chr12:8386013-8386138
  hypo
ctgtgcgaggttgtgcgggactctgtcatggaacccagtatgccttcatgtgctggcttgtttgttgactctgtagttaacgggctgccccacgtgggcaggtactgggtcgtctgtgtctctgt

SEQ ID NO: 75243 - DNA, 30 bp, Homo sapiens
  chr12:8388556-8388586
  hypo
acattcctgagacaacggaattctggcgat

SEQ ID NO: 75244 - DNA, 30 bp, Homo sapiens
  chr12:84953382-84953412
  hypo
ttttcctctcaaaaccgactaggagtacca

SEQ ID NO: 75245 - DNA, 191 bp, Homo sapiens; identical to SEQ ID NO: 11344
  chr12:85305054-85305245
  hyper

SEQ ID NO: 75246 - DNA, 323 bp, Homo sapiens
  chr12:85305657-85305980
  hyper
cagccacgtgcctttcgtacggcgaaaggccccctttcgggccatttatcacaggatacctcaagcaaaggggaactgtggtcacgtgaaaacactctgtcctcggtagtcgccttctgcctttgctaaagcgaacggaagcgaatgaggaataaagctctctgctctccccgccccatcgcccacctgcacgaggtttagcttccaattcacctcgcgtctctctctgccccaaccctcccaactttcctcttggactttcccgtgttggaccccacccttcaaccaaccccgacttggcttggaaacgagtaggtctctgg

SEQ ID NO: 75247 - DNA, 48 bp, Homo sapiens
  chr12:85306234-85306282
  hyper
ctgggtggctaatggcgagccccacctcacccccagttgtgcccttag

SEQ ID NO: 75248 - DNA, 243 bp, Homo sapiens
  chr12:85306322-85306565
  hyper
cgcctcttgctgcttccacgtccgggcagcagcagcagcagtcgcgaaagggtagggtccaggtggctgtgacggaggccgaagaggagctgttggcagagaagcagcttcttgcctaggttgggacccggagctgggttttgggggtcgccgccctgcaggctggcaaggagagactcgtgagcgcctgtgtgtctgccagggaaacagcacgggatacaggcgcgcgggtgcgggtgcgcg

SEQ ID NO: 75249 - DNA, 8 bp, Homo sapiens
  chr12:85306789-85306797
  hyper
cgagcggc

SEQ ID NO: 75250 - DNA, 158 bp, Homo sapiens; identical to SEQ ID NO: 34550
  chr12:85306798-85306956
  hyper

SEQ ID NO: 75251 - DNA, 30 bp, Homo sapiens
  chr12:85430069-85430099
  hyper
cctgtagggaaaaaccggtgtctcttcctt

SEQ ID NO: 75252 - DNA, 718 bp, Homo sapiens
  chr12:85667044-85667762
  hyper
gtccttaccaagggacggctagatgatccatctgccaacatcaatatttggagggaaagcttaaaatatgctgtttttccaagggttaaactttaaaggggtgaaaacacaactgatgaaatgttagcatcaaatcggttaaccactaactcctttccatattcgtcgtcgaggctcttttaagtttccatgagaagcgaaacttcattctctttgctcagaatagagactcctccacctatgcgcgtttaaccacagagttgttcttgattgtaagggacttcgcccacttggttgaagtggagagccggtcctcattccagacgtcccgcacggcagtcgctcatggctccctccaggccgggagccaggaaggtggtccttcaccgaggtgcgcaccaagcggcggtccacccaggcaatggggtgcaccaatttgcctccaaaaatttgctgcgcacacaacctgttcacagttcctgatcagaaagggctaacgagatgtctgtctacagctgtctctgggcgagggcgcaggctttgggaagtggttcagcgcgatcggggacaccgcttgcagcccttggtcctgcacccctaggaggggtgtcccacaagctcggcttcccttttgcgagccacagagagctttttgttccgaaactctcattacgacagatagtatttaaaactcatcaaaattcgcttcagaaatctg

SEQ ID NO: 75253 - DNA, 42 bp, Homo sapiens
  chr12:85671757-85671799
  hyper
ggagtgagtgaataacgcaacactcaacgtttccacaaggct

SEQ ID NO: 75254 - DNA, 30 bp, Homo sapiens
  chr12:85672332-85672362
  hyper
gctaaggagcagctccggggtgcacagccc

SEQ ID NO: 75255 - DNA, 1185 bp, Homo sapiens
  chr12:85672730-85673915
  hyper
cgcatttcccccaagcgccgcgggctcctaggaagccaagagtcgtgccaaaagtcacacagaagggctttcaacctagcagtgctgtcctgcctgccctaccatcccctctggtggaaatggaggccttggacctgtccgcgcccaggacgccgcgccgcgagtgcccgcagctccgcgcgctcaccactcactcccagagcgcttttcggagtaactccacagcaactctttaaaattaaaagtaatttctgtaaaaatatgcagacattcctcttcttcataaacccctatttgtaacaatcctcactttggcattagagtaaaagcctttcaaaggcactgatcctaacgggttttcttaaaataatttgggtctaatgataaaatcgtggaccaaagggaagggtggcgaagagggtgtagggaattggttggcattagtataatggcttcattgcctcttgctcggcttctctctcccacccatcgccaccgcgtccacactccgccgcattccagagaaaaagaaaaggccacggcctcgtaaagctcccagctggcccggaccccgagctcctcccggttagaagccgaagcggcccctctactacggcggctgcgattaacagttgccaatgcatctggttccttgggcttcggattaatgtgaatcttccacgtaaacgatttacggatgaaataaaagccttttagagcaatatttcctttcaagttcttaagacgcctctaaatctttctggtagtgagtggccggcatgggggcggggtggggacgggtggctcaggaaggcgcaggcagtagggagtggaggtttaactgctttgcgatctcaccaagatcttccgaaatgccagtccactgtcacggcggcaatgaatctgggtgtcaggggctcgtctctcctggcatttgtctgaaatggagctgtctgtctgtctatcctaggcctggacgccctctgcccgggtaagtggggaaaatgggggtggggtaggggcggagggggacctggggtggagttagtcgcccgcctattttcatattcattagaactgggaggctgcccgaggaggccagctgagtttcaagatataaaagcaacttcgggtgctccttttccagccgggacgtattaaagggaccggagcggggcagttccc

SEQ ID NO: 75256 - DNA, 968 bp, Homo sapiens; identical to SEQ ID NO: 34553
  chr12:85673916-85674884
  hyper

SEQ ID NO: 75257 - DNA, 81 bp, Homo sapiens
  chr12:8599745-8599826
  hypo
tgtgtgcaacccctgcgatattgggagtgatatcatcgtcgccccctgaacataagaaacaatatcgcagtggcatgtata

SEQ ID NO: 75258 - DNA, 30 bp, Homo sapiens
  chr12:8702283-8702313
  hypo
atttttgtttaatcgcgaaccctattatat

SEQ ID NO: 75259 - DNA, 143 bp, Homo sapiens
  chr12:8746970-8747113
  hypo
aagtctggagcaaacacaatctgcaggtaattaacattattgttcccccttacctggagcagtcactcggggttggccaaagatagtttctggacaacatgggtaaacaagcctatttagataaattccgctatacttccttg

SEQ ID NO: 75260 - DNA, 30 bp, Homo sapiens; identical to SEQ ID NO: 43368
  chr12:8748716-8748746
  hypo

SEQ ID NO: 75261 - DNA, 175 bp, Homo sapiens
  chr12:8749845-8750020
  hypo
tgattaaaataacatcgataaaatcctaacattgtaaaaacacacaaaaatacatagacttggttatttctaaccttacaccactcatgacagtcgggtgatttggagggaaggtcaaataaaatgaagatttgctctggattagatgttgttagggaatcgggtcaattctgta

SEQ ID NO: 75262 - DNA, 149 bp, Homo sapiens
  chr12:8751025-8751174
  hypo
caaaagccaaagatacgtgaaatgttaatattaatggacccattttacagagaggaaagaaattaaggctttacagagattaaacatctaacccattgtcacatggaaccagaactctagtttaggtttacttgacttcgaagtcatac

SEQ ID NO: 75263 - DNA, 30 bp, Homo sapiens
  chr12:8757665-8757695
  hypo
tctaatctttaatttcggctccagaggtga

SEQ ID NO: 75264 - DNA, 40 bp, Homo sapiens
  chr12:8757926-8757966
  hypo
aggttggggttccctcgcagaaagtcggccacatgtcggg

SEQ ID NO: 75265 - DNA, 198 bp, Homo sapiens; identical to SEQ ID NO: 43370
  chr12:8790007-8790205
  hypo

SEQ ID NO: 75266 - DNA, 61 bp, Homo sapiens; identical to SEQ ID NO: 43371
  chr12:8799944-8800005
  hypo

SEQ ID NO: 75267 - DNA, 81 bp, Homo sapiens; identical to SEQ ID NO: 15635
  chr12:8808559-8808640
  hypo

SEQ ID NO: 75268 - DNA, 29 bp, Homo sapiens
  chr12:8835074-8835103
  hypo
ttactgggaaatggccgggtgcggtggct

SEQ ID NO: 75269 - DNA, 214 bp, Homo sapiens
  chr12:8850501-8850715
  hyper
cgggcgggcggcgttcggtctgagggagcggggcggtctccgccggcgtcgcgcgcgctgtgtgtgagcggggtcgcgcgcgcgcgcggcaggcgagtgagggaacgaggagcggccgggtgtgagtgtgtgggagtgagagtgtgtgggagtggggtgagggagaagctgacgggacgcgaggctgtgagaaactgggcgagtgtgcgaggac

SEQ ID NO: 75270 - DNA, 221 bp, Homo sapiens
  chr12:8851054-8851275
  hyper
cggtggtcgccgctccgcggagtcggtggggagcgaggcggggcccggccttcgcgcgtgtgccgggaggcgccggcccgtggcgtgtgcgtgcgaccgggcgagccgtgtcgagggggcggcgacttcgggcgtgtaaggagtatggtttccccgccggcgagggggtgtggtaaccccgggaacgccggctggagtcggacccgcgggctgctgacctg

SEQ ID NO: 75271 - DNA, 25 bp, Homo sapiens
  chr12:8869424-8869449
  hypo
caggctcaagcgatcttcccacctc

SEQ ID NO: 75272 - DNA, 24 bp, Homo sapiens
  chr12:8878090-8878114
  hypo
ctcacctgacgtcaggatgctcta

SEQ ID NO: 75273 - DNA, 30 bp, Homo sapiens
  chr12:88820631-88820661
  hypo
tatgtgacatctacacgaaagaatttgtat

SEQ ID NO: 75274 - DNA, 30 bp, Homo sapiens
  chr12:88861136-88861166
  hypo
tcagccatcttggctcgagccaatatttta

SEQ ID NO: 75275 - DNA, 249 bp, Homo sapiens
  chr12:88974430-88974679
  hyper
ctcgcctgggggccccggacctgcactggcgggagaccgcgaaggcgcggggacgcagagggcgaagcttggtaccctgcagctactgctcgcgaggagtcccagcttaccctcccggatccgctggggctcacctggcacccccggggacagacgaaatacctcgcgcgccagagagggctcggagctccctctgttatacaaagtcggagagggagaggagtccgggaggttcggagcaaagaattc

SEQ ID NO: 75276 - DNA, 30 bp, Homo sapiens
  chr12:8905690-8905720
  hypo
acatattttgtgtttcggcagggatggctg

SEQ ID NO: 75277 - DNA, 80 bp, Homo sapiens; identical to SEQ ID NO: 43374
  chr12:8908240-8908320
  hypo

SEQ ID NO: 75278 - DNA, 42 bp, Homo sapiens
  chr12:8926134-8926176
  hypo
cttctaccctctggccggctcacccggcgtatgtccctgctc

SEQ ID NO: 75279 - DNA, 190 bp, Homo sapiens
  chr12:8975180-8975370
  hypo
tagtatataaagctacgcggagcgatctctgcccctgaccctggaaaaatctgtctcacccacaaagatgtgggctcagctccttctaggaatgttggccctatcaccagccattgcagaagaacttccgtgagtgcttggtgtcagaattggtttattagggcagcggcttcttcgcctaactttctca

SEQ ID NO: 75280 - DNA, 30 bp, Homo sapiens; identical to SEQ ID NO: 43518
  chr12:89794228-89794258
  hypo

SEQ ID NO: 75281 - DNA, 173 bp, Homo sapiens
  chr12:8982315-8982488
  hypo
tttccagtgtatttccgcattgtcaccatggatagcaacttcgttccagtgaatgacaaggtgagttgggaggaggagaaggagtggcgcagggagaacagggaaaaggatgagagattctctagggtggaagtcctctcagcctgggcgtggcaaggcgaggccctctgggt

SEQ ID NO: 75282 - DNA, 103 bp, Homo sapiens; identical to SEQ ID NO: 43377
  chr12:8983831-8983934
  hypo

SEQ ID NO: 75283 - DNA, 18 bp, Homo sapiens
  chr12:8989364-8989382
  hypo
caccgcgcccagccaaga

SEQ ID NO: 75284 - DNA, 30 bp, Homo sapiens
  chr12:89953769-89953799
  hypo
gtccctacacctgatcgcctgatcagccca

SEQ ID NO: 75285 - DNA, 102 bp, Homo sapiens
  chr12:8995503-8995605
  hypo
attcagcccttctgtcgctctcctacataccaaaatattgctgtacacagctacgtttatggattctttatccatccttggctggaccgctaatgaaatacc

SEQ ID NO: 75286 - DNA, 30 bp, Homo sapiens
  chr12:90025918-90025948
  hypo
ttttttttttttacacgttatcattgattt

SEQ ID NO: 75287 - DNA, 198 bp, Homo sapiens
  chr12:9006823-9007021
  hypo
catcaagccagttctcgtcaaagtgagttttcttcagaggtagagacagcaaccaaccgagggatgctcagcatctcgtcttgctgtgagttagtctctcacagcaaccatactccagtccaaccaggcagcttcaactttctccttccctggccccttgaacatttgcctaatccacacccacggcctatgaaagca

SEQ ID NO: 75288 - DNA, 30 bp, Homo sapiens
  chr12:9008301-9008331
  hypo
atgaaggaaaaagagcgtattttatatagg

SEQ ID NO: 75289 - DNA, 149 bp, Homo sapiens
  chr12:9010027-9010176
  hypo
tcccatatccttgaacggcatgggggtgttttctgaagttgtcgctgtgatctaaaaccacatttggcttcccagggtaccagaaggagctgatgtacaaacacagcaatggctcatacagtgcctttggggagcgagatggaaatgga

SEQ ID NO: 75290 - DNA, 135 bp, Homo sapiens; identical to SEQ ID NO: 43379
  chr12:9016413-9016548
  hypo

SEQ ID NO: 75291 - DNA, 30 bp, Homo sapiens
  chr12:9020600-9020630
  hypo
tccctggaatgtacacgttggaggcctcag

SEQ ID NO: 75292 - DNA, 30 bp, Homo sapiens
  chr12:90219938-90219968
  hypo
gaaagtctcattctccgaagaaagaaaggt

SEQ ID NO: 75293 - DNA, 86 bp, Homo sapiens
  chr12:9026553-9026639
  hypo
ctcatagggcagtagcggtacatagagggtttcagagaatctttttttaattaaaaaaaaaatttttttttaatttgagatggagt

SEQ ID NO: 75294 - DNA, 189 bp, Homo sapiens
  chr12:90313512-90313701
  hypo
ctccatgagaggcaccgggcctcaggtggacaaggcctcctccttggccgggcgctgggcgggaggcgggagcgagcgtgctagccaagcatgtgggccgcgctgaggcttgacgaggccggcgtcccttttcctgaggcacgtgcgccgccgccgccatcatgccgtgcgcgccgccctaatgctttt

SEQ ID NO: 75295 - DNA, 20 bp, Homo sapiens
  chr12:9187316-9187336
  hypo
acaggcgtgaggcaccgtgc

SEQ ID NO: 75296 - DNA, 152 bp, Homo sapiens
  chr12:9203194-9203346
  hypo
ggatatgagcctccctgtgctcccggagggggccgggagtaggcaggatctgctcttttgggtgcagctgcagctgcccaatcctcagctgcagacctgggcctcgcgctccacggagcaggcaggagccagggacacgtgggaacctcccc

SEQ ID NO: 75297 - DNA, 30 bp, Homo sapiens
  chr12:9251150-9251180
  hypo
tctgagcccctggcacggcccttcttgatt

SEQ ID NO: 75298 - DNA, 30 bp, Homo sapiens
  chr12:926703-926733
  hypo
gctttttggacctttcgagtttctaccttt

SEQ ID NO: 75299 - DNA, 36 bp, Homo sapiens
  chr12:93436029-93436065
  hypo
atacactttgggaaacgctgccgtaaaacaaatacc

SEQ ID NO: 75300 - DNA, 33 bp, Homo sapiens; identical to SEQ ID NO: 43520
  chr12:93711081-93711114
  hypo

SEQ ID NO: 75301 - DNA, 30 bp, Homo sapiens; identical to SEQ ID NO: 43521
  chr12:93797551-93797581
  hypo

SEQ ID NO: 75302 - DNA, 16 bp, Homo sapiens
  chr12:93966301-93966317
  hyper
agagctgggccagggc

SEQ ID NO: 75303 - DNA, 898 bp, Homo sapiens; identical to SEQ ID NO: 34555
  chr12:93966318-93967216
  hyper

SEQ ID NO: 75304 - DNA, 525 bp, Homo sapiens
  chr12:93985095-93985620
  hyper
tacatatacaaggaacggaaatgaattagcccggctagatatttctaggaactagttaagggagaatgaacaagatgggagcgaggagaaagcgtgtgtgcgttcgtgtgtggctgtctgtctgtctgtctgcggcaagaggaatctcagagtttcggttatttctccttgaagaattttcaaacggagttcctgcaggggctggctctagcgtctacgatgtgcacacactgtctctcaagagggaagtgatcctggcgccacggggtgatgcagcagaagttctttttgtctgtggccagggtagagtgcggagccccacggagctgtggcgtggcggctcctcccagacgcgtccggggcgccgctcgggtctcccaggaccttatgtaacccagcgtcggcagcaaggagccggtcacaggctgaccaacgtcaaggcgtttcactttggaagcgcaccagatgagtgtggtattgagagcagacggctgggtgcaatgtttttgccgcatatctcatggg

SEQ ID NO: 75305 - DNA, 30 bp, Homo sapiens
  chr12:94019213-94019243
  hypo
gcccttcaaagcttacgaatttattgaggg

SEQ ID NO: 75306 - DNA, 30 bp, Homo sapiens
  chr12:94233462-94233492
  hypo
atctctttatgtgctcgcttttgtgtttcc

SEQ ID NO: 75307 - DNA, 201 bp, Homo sapiens
  chr12:94501597-94501798
  hypo
gaagtaagagcgatccgtggagaattgcctctcaagagcatgtggtaagaactttattattactatgggaaaatgaacttatactacataactttcttctggtgactttaaaattgatagaaattagagcaaatcaggacatggactaaggaaaagttacaaagactaatggcaagtcaaggaatccgagttaacattcgg

SEQ ID NO: 75308 - DNA, 60 bp, Homo sapiens
  chr12:94541897-94541957
  hyper
tccacacctgtcagccgctctcgcagcagccctgtggcccgagcccggggcctcagctgc

SEQ ID NO: 75309 - DNA, 859 bp, Homo sapiens
  chr12:94543088-94543947
  hyper
gggggcggccggcctcggggggctgctgctcaccggctggaccttcgaccggggcgcctgcgaggtgcggcccctgggcaacctgagccgcaactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggggcgcctcaagctgtgcgagggcgcgggcagcctgcacttcgtggacgcctttctctggaacggcagcatctacttcccctactacccctacaactacacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccaccacggcgctctgcctcttcagaatgagtgagatccaggcgcgcgccaagagggtcagctgggacttcaagacggccgagagccactgcgtaagtcctgcccccggggcgccgcggagagcgctgctgccggggagccgccgccgccgccgaggcagaacgagctgggggcgagcggcggggcgggggtacagccgggtgacatttaccaggtctcaggttcacacc

SEQ ID NO: 75310 - DNA, 44 bp, Homo sapiens
  chr12:94543948-94543992
  hyper
cgggcggccgtccgaaggctcctctcggacggtccccgagacct

SEQ ID NO: 75311 - DNA, 30 bp, Homo sapiens
  chr12:94544301-94544331
  hyper
gtggccccctgtctccgccccccaccggca

SEQ ID NO: 75312 - DNA, 90 bp, Homo sapiens
  chr12:94641622-94641712
  hypo
atcacagctgggattcgttaacaaagttactaaaacattcttttctttttgtccaggtctctgaatattgtgtggcgacttactgcgggt

SEQ ID NO: 75313 - DNA, 30 bp, Homo sapiens
  chr12:94642514-94642544
  hypo
ctcttttctcaaatgcggaggtgacatgtc

SEQ ID NO: 75314 - DNA, 100 bp, Homo sapiens
  chr12:94891920-94892020
  hypo
cagctttatcaagcacgctctcacagtgtcagtgatacatctatgcacgtcacagataacagtgactcagaaccaggtgatgagtccatccataacatgg

SEQ ID NO: 75315 - DNA, 83 bp, Homo sapiens
  chr12:95008472-95008555
  hypo
tgcatgatatgctgtcggaacaactggcctctctgacttttttctttttttaaacaacagacagatttttttttttttttttg

SEQ ID NO: 75316 - DNA, 22 bp, Homo sapiens
  chr12:95008675-95008697
  hypo
ttacagacgctgctaccactcc

SEQ ID NO: 75317 - DNA, 34 bp, Homo sapiens
  chr12:9501895-9501929
  hypo
tcacagatggggcagcgaccgcagaggcactcct

SEQ ID NO: 75318 - DNA, 377 bp, Homo sapiens
  chr12:95266817-95267194
  hyper
gagggtgggggtgagcgcgggctccctggcacctgccggtaaagcagcagccgcagcccccgagggcgccccaggccaggagctgcgcgccgtcggcgggccgtgcctggaggaggctcgcgccttccaaatgccggagtgcaggcatccttcctctccccaaccccagccccggcctcgacctgtcgcccacctggcccggacctggggctggctccgtctctggggtgtgcgccaagggagccccaccgacgcccagcagagctgcccgggctcccaaagaaggaccggggctttgggcagaattctggcagccaggcgggcgtcaggggagccggagaaggggctcgccagcaggcgtggggcggagtgccggg

SEQ ID NO: 75319 - DNA, 434 bp, Homo sapiens
  chr12:95267247-95267681
  hyper
cgaagagtgcgggcccggggtccccgcggcgccccttcccctcctcagtcccccgggggcgaccgcgctccccgccgaggtccgtccccgccgcaccctcactattcccgctgggaggaccccggcgcacgcccccgcccccgcaccccggggcgacggcgcactcaccctccgcatggtgtctgggccgtccgggcggggctcggcgacttgggcgcgagaagggctgggccggcggcgacgctcggccggccgggagctccgcgctgccccctcctgcacacgcctgcgccgcggccgccaagccggcgggggcggggcggggtagcgctggccgcggggtccccggggctctcccgggctgcggcggaggcgcggagccggccaagggcgcactgagctcgcggagctccggggccccggggcctttctgc

SEQ ID NO: 75320 - DNA, 294 bp, Homo sapiens
  chr12:95267706-95268000
  hyper
cgggccgcttcgcccctctcctcttcctcgagttctggccccaccaggagcggagcgagtctccgatgcctgccccgcggcccccagaactgagctggagaagctttggggtgaaagctgggcccaccctacagggaccccaagtttgcggagcaagagtggattggcggagagcgcagatggcaattctcacccgccttaaaagtaccaccttaaaattctccccatgggatgggaaggtggcccgctaatgtccgttcctactcttcgttttctttttaatttttcagacag

SEQ ID NO: 75321 - DNA, 34 bp, Homo sapiens
  chr12:95467953-95467987
  hypo
actagagactgggcacggtagctcacgcctgtaa

SEQ ID NO: 75322 - DNA, 40 bp, Homo sapiens
  chr12:95826267-95826307
  hypo
aaaaaagaagtgtggattttattctcggtgcaatagcaac

SEQ ID NO: 75323 - DNA, 28 bp, Homo sapiens
  chr12:95942964-95942992
  hyper
gcgtggcaaactccgttatctttaaaac

SEQ ID NO: 75324 - DNA, 84 bp, Homo sapiens
  chr12:96185037-96185121
  hyper
tctcggggagtcccacgacccggggacggaacaccccaacccagccccgcgtcacccgcactgagagcgcgccaactgctaagc

SEQ ID NO: 75325 - DNA, 30 bp, Homo sapiens
  chr12:96817042-96817072
  hypo
tatgatcaaggcaaacgaatattaacctca

SEQ ID NO: 75326 - DNA, 15 bp, Homo sapiens
  chr12:96844259-96844274
  hypo
cgtctcaaaaaaaaa

SEQ ID NO: 75327 - DNA, 20 bp, Homo sapiens
  chr12:96881018-96881038
  hypo
agccacgacacccagccaat

SEQ ID NO: 75328 - DNA, 746 bp, Homo sapiens
  chr12:96883069-96883815
  hyper
ggtcgtcatcattatcgttattaagtggccaacatggataaagagtatagtctggatttgtgaccttaaatttttggctctaatattcgccagcgctctgctcagaacattctctgttcgcatttcatacagcggtgccagcgcacaaccaggcaacgccctcaggagcatcattgttttctggacctggttctttctcgctctgccctccaggggccgctgtgtttctcggaatgcgcgcgggatgcccggttgccacgagaccgtcgccaggcaaccgcgtgtacacatactccaggcgggccggggcgcgtcaatatggcggcgcagggctccccctcgagctctccgtcagacgactctaccacctcggggtctctgccagaactgccgccgacctccaccgcgacttcgaggtcgcccccagagtcgaaggggagctcccggagctcgctgcttcagtggacctgccccgaggactcattgcccctagccgtgttttatgggccgctggacgcgaaaaacccgctcctggcctcttgtgagaaggagatccaggagttgttaggctttatgaggaaaaagaaggctttagccaccacggaggaagagaagcacgaattccgccggcgttggtaagcgctggcggggcactggggagggcgccggccagaggagggacccctggaaagggctggaggatgcaggtggtggccccagagatggttcagcgttgcggacgcagg

SEQ ID NO: 75329 - DNA, 30 bp, Homo sapiens; identical to SEQ ID NO: 43525
  chr12:97073402-97073432
  hypo

SEQ ID NO: 75330 - DNA, 51 bp, Homo sapiens
  chr12:97379992-97380043
  hyper
cgcctggcagcgcaggccgtgcactccccgcgcttccgggaacctgtttgc

SEQ ID NO: 75331 - DNA, 212 bp, Homo sapiens
  chr12:98763870-98764082
  hypo
tcaaatagctcagaccgtcaacctgcctactatgaatgaggtaccggctagattgttggcaacacagcaggtagacaagagtcagtccctgttatcaagggatcacagttcagtgagctaaatagaaacgtgccttcaactgcactgcgctacactgaaacaagtgctagtactggataagacccagttgttgttggcgccaacaagagaag

SEQ ID NO: 75332 - DNA, 87 bp, Homo sapiens
  chr12:98849530-98849617
  hypo
gcgggtagatatgggcggctctgcccaggaagacagcaacaaaagctccaatgatgaaaacagggctgaaaacgtgcttctggaagg

SEQ ID NO: 75333 - DNA, 143 bp, Homo sapiens
  chr12:98895762-98895905
  hypo
cctgattggttgggtcggagacgagacacgtaagtttaagttctataatgaaacgctttcaatcatgtcagtttatctgtgcctataaacacactcctttagagaaaatcaaaagtttatagccaggcgcggtggctcacgcc

SEQ ID NO: 75334 - DNA, 98 bp, Homo sapiens
  chr12:98896397-98896495
  hypo
gagcgaaacagaagtcggctgataaaattttgataaaatttcatttgcccgcagctggtcatttcattgggcgcttttgtgttacaaaagtgtgtgaa

SEQ ID NO: 75335 - DNA, 38 bp, Homo sapiens; identical to SEQ ID NO: 43527
  chr12:98947863-98947901
  hypo

SEQ ID NO: 75336 - DNA, 42 bp, Homo sapiens; identical to SEQ ID NO: 15681
  chr12:98948376-98948418
  hypo

SEQ ID NO: 75337 - DNA, 30 bp, Homo sapiens
  chr12:98951496-98951526
  hypo
tgtgaatctcaaaaacgctgagtaaaagaa

SEQ ID NO: 75338 - DNA, 43 bp, Homo sapiens
  chr12:98986165-98986208
  hypo
gcaaactaaaaaaagcgtggccccttgttcatacatgtattaa

SEQ ID NO: 75339 - DNA, 19 bp, Homo sapiens
  chr12:9916173-9916192
  hypo
tttttttttttttttcgag

SEQ ID NO: 75340 - DNA, 81 bp, Homo sapiens
  chr12:99287423-99287504
  hyper
caattccaaagttcccgtgtctctaatctactgatccaacgtgcccggcgcacataagcagcaccgcgactgaatttcaag

SEQ ID NO: 75341 - DNA, 258 bp, Homo sapiens; identical to SEQ ID NO: 34567
  chr12:99288150-99288408
  hyper

SEQ ID NO: 75342 - DNA, 316 bp, Homo sapiens; identical to SEQ ID NO: 34568
  chr12:99288621-99288937
  hyper

SEQ ID NO: 75343 - DNA, 1 bp, Homo sapiens
  chr12:99288961-99288962
  hyper
c

SEQ ID NO: 75344 - DNA, 188 bp, Homo sapiens
  chr12:99289161-99289349
  hyper
ggctcggcagcggcagagcagtggcagcagccgccactgccgctgttactgcggtcgccgccgctggagagaggaggacgaggagggcaaggggcagaagcaggtcctgctctgtctgccccagaggccacctcgggtttcttctcactaaccaagcgacttcgtgtttacctcgcaggagacgcctc

SEQ ID NO: 75345 - DNA, 30 bp, Homo sapiens
  chr12:9964565-9964595
  hypo
aaaggtgaactatagcgtacaaaaatagtt

SEQ ID NO: 75346 - DNA, 30 bp, Homo sapiens
  chr12:99809435-99809465
  hypo
gcaattccatcaccacgaggatccctccca

SEQ ID NO: 75347 - DNA, 30 bp, Homo sapiens; identical to SEQ ID NO: 43831
  chr13:100095884-100095914
  hypo

SEQ ID NO: 75348 - DNA, 37 bp, Homo sapiens; identical to SEQ ID NO: 43832
  chr13:100146505-100146542
  hypo

SEQ ID NO: 75349 - DNA, 81 bp, Homo sapiens; identical to SEQ ID NO: 15770
  chr13:100356871-100356952
  hypo

SEQ ID NO: 75350 - DNA, 30 bp, Homo sapiens
  chr13:100452188-100452218
  hypo
ctgagccattcagagcgtggccttcctcca

SEQ ID NO: 75351 - DNA, 30 bp, Homo sapiens
  chr13:100523137-100523167
  hypo
gtttgaacatctgttcgttgtttcgtggtt

SEQ ID NO: 75352 - DNA, 26 bp, Homo sapiens
  chr13:100547868-100547894
  hyper
cccgcgcttgggacccggcagctctg

SEQ ID NO: 75353 - DNA, 276 bp, Homo sapiens; identical to SEQ ID NO: 43834
  chr13:100575337-100575613
  hypo

SEQ ID NO: 75354 - DNA, 30 bp, Homo sapiens; identical to SEQ ID NO: 43835
  chr13:100583792-100583822
  hypo

SEQ ID NO: 75355 - DNA, 344 bp, Homo sapiens; identical to SEQ ID NO: 4040
  chr13:100608461-100608805
  hyper

SEQ ID NO: 75356 - DNA, 431 bp, Homo sapiens
  chr13:100608838-100609269
  hyper
cgagttctgggacggctgggaccaaagggctggcctccggcctgcgccctgtttgttttcctttcgccccctgaatactagattgagacgtaaagattacccgggccgaataatgccgggagtcaacactcgagcaaacaaaagtgcttgcacaactagtcaaccccgctgggacccgggccgcgggctgggggagagaacgcgctcctcgctgctaattacaaataaatgatgatgtgctcactaagtaattgatttaatgaagttcctatgaaactattaaacccgggtggaggtcaggctggaggcgccccagagcgcccattgtgggctgtttaactccaccaggctcctcggaaagacatcggggctaataggtgaagtcacagctgctcgcgctgacttctcggagcgcccggctggccgcgggc

SEQ ID NO: 75357 - DNA, 109 bp, Homo sapiens
  chr13:100609476-100609585
  hyper
tcctcactccacccccgccacttcgtgcaggaactccaaccagtgtgccacgcagggtgctcgcgagctcttggcaaggtgcctggatcccgagcgtgtgcccagtgca

SEQ ID NO: 75358 - DNA, 350 bp, Homo sapiens
  chr13:100611882-100612232
  hyper
tttaaatgtcacctccgcctttctaatgggcacagggctggaggcgacccttcaaagcgcctcggtgatgaacgacccttattaaatatggcccgagctgctgggaaagtcccgcgcccggccgcgcgccctagagcgcccctcgccggtgggccctggaggagccgggcctccgctgccaccgagcggagtccgggcccgcagagccccagcccggactggcgagggggtgcagagggaagaagagggaagcctggacgagggggggcgttgtaatacaacttcttatctgccgaccccaacacgcccgtgcgcccccagccccagagcctcggcgtgaaaggttggtg

SEQ ID NO: 75359 - DNA, 30 bp, Homo sapiens
  chr13:100620344-100620374
  hyper
ccttcggaagtggcccggggattagtccct

SEQ ID NO: 75360 - DNA, 276 bp, Homo sapiens
  chr13:100620640-100620916
  hyper
aaaaacccaaatgaccgcgggtcccctcgccgcctggggtcccccgcgccccccccgaccccacgcacgcgcgcgtgccccgggaagccaccggggacagtgcgcagggcgtggcctgtcccgccgggggcccggatcggcttctgcgcccgcagctcccggcagccgcctagggaaggccgctcccctcgcgaggcctgggcaggcgggaagggccctaggccgcgcgcggccccgcgcttgggagttccctttcggggccgggctggggagcgg

SEQ ID NO: 75361 - DNA, 231 bp, Homo sapiens
  chr13:100621135-100621366
  hyper
cgcctcgggccaccccgacgctgctgcccccgcagagccccgagcgcccccggcccgagcgtgggacccggcggctacctcctggccgcagcagcgccgataaatctgccaagtgattactgaacgtaaactccagttacttaagtgtcctccgaggggtaatcgtatctgtccctataaatcccgactgcgttcgcgctcatcagcgcttccgcccgacgcgctggtccg

SEQ ID NO: 75362 - DNA, 299 bp, Homo sapiens
  chr13:100621716-100622015
  hyper
taaagttgtgggagacgcacgcagaagaaggtgtgcgtgaagagtgtgtcacggtgggcgagtgcgagtggtctccggggttccgaaagcgcattcctgtcttcccggaggggtcccttcccctcccggaaggcctgcctcgggcggcccaaatccggcagcaaatcccacgcccggtcctcggagcgcggagactgcgcggggcctacgacccggtgggaagagaggcgcttgccggggcggcccggcctctctttccatcgccctcccagacttcccagggccgggcgggtggggac

SEQ ID NO: 75363 - DNA, 959 bp, Homo sapiens
  chr13:100622222-100623181
  hyper
aagaagtcacatgtccgggttatacgtatgcgaagagaagcagcagaaggagaaaaaaattaaggcgagcaggaggaggaggagaagcagcggcggaagcggcggcggcgcaggagctggtggcggcggcggcggcgcggccggggacagacacccacctgtatgagtacgcttgtggatcttgaggttctcggagcgcgcgaagaccttgccgcagccggggaaagggcagggaaagggcttctcgccggtgtgcacgcggatgtggttgatgagcttgtatttggccttgaagggcttgccctcgcgcggacagtcctcccagaagcagacgtggctgctctgctcggggcctcccacgtgctccaccgtgacgtgattcaccagctcgtgcatggtgccgaaagttttggagcagggcttggcgccgccggccgggggcggtggcggcggcggcggcggcggcggcggcggcggcggcagcccggccagctcgtcggggtcgatccacttgcagatgagctcctgcttgattggctgccgcatgtagcgcaggaaggccccagccgcccctgggaggtgggggtggtgctggtgcgggtgctgcgcgggcgccggcggcggcggcggcgccgggggcggcgcgtggtgctgcaggtggggcccgggcccggccgctgctgcggccgccgcagccgccaggttcaggtttaagttcacggctccgtagccgtgcagggcggccgccgctgcggccgcaaccgccccgtagtgcgcgtccccagagcgcggcgcgaagggcggttcggcgcggccgtacagctcagccgccgcggctgccgctgccgccgccagccccaggcgcatctggccgttgagcgggtgcgggtggccgcctggggcccccggcgtgtcgtgcagcgcggggaagagcgccgggccgccgctgccgtccgggc

SEQ ID NO: 75364 - DNA, 231 bp, Homo sapiens; identical to SEQ ID NO: 35039
  chr13:100623899-100624130
  hyper

SEQ ID NO: 75365 - DNA, 102 bp, Homo sapiens; identical to SEQ ID NO: 35040
  chr13:100624131-100624233
  hyper

SEQ ID NO: 75366 - DNA, 349 bp, Homo sapiens
  chr13:100624323-100624672
  hyper
cgccggcacgcgggcagagggcgcggggtggtgaggggctgaggacccccgaggggcagtcccagtttcaaaaaccttggcctcacttctctgtgtgccttctggcacccaagtactttctgcctctacctccacctctcttgtggggtggaagagccctgggctgctgtttgggagagaagggtgaatagcccgtcctacctgtagtggtgatgctagaaacttcttgtttggacacccaacctgcctagcgctcacctagggcgcatagacagtagacggagtgaagaagataaagtctattggttgcaagacaacttgagtgatttggctccgcgaaacaccaggt

SEQ ID NO: 75367 - DNA, 154 bp, Homo sapiens
  chr13:100626366-100626520
  hyper
tcttgttaaacacagcgtgatatgtatctgtcatcgatttaatatgtcttaattcaaatatagctccctgatcaatttctttttatggaagccttaaaaaagaaaagactttcttaggaaataatagagatttgggtagcgataggaaagaggg

SEQ ID NO: 75368 - DNA, 511 bp, Homo sapiens
  chr13:100630630-100631141
  hyper
agtaaaggggttttgcggtttgtagagaaataaagcacttctgagaagggacggcgacgtgactttgaacttggctcagctcttctgtgccctgcagagagaggagaactagagccgggaaagaatagccaggagcgcccaacccgtagggtctccggcgggaattaaggcgtccgccccaccgcccggccgcgcgcggcccctggaatccggcgcgagcgagcgcccagccgcgcgatccccaaacgcgggagcagcaaaggcgaaatcaaagcgaaagagagaatgggtcaaagaggagagggagggaggactggggagggggtaagacagtgggaaaggaggaaaacttcgaagtctgatggcctgaaagaaggaagggaagtgaggtctctgcatgtgcaggtctgctattctcataaccaatctccaagaaaacattttccttcggaaatatttttggagtaagcccttccaaatactctcctctcgtgctcgcctcccattccca

SEQ ID NO: 75369 - DNA, 32 bp, Homo sapiens
  chr13:100631610-100631642
  hyper
ctagaggattcttcccgcgtttttgtttattt

SEQ ID NO: 75370 - DNA, 54 bp, Homo sapiens; identical to SEQ ID NO: 35044
  chr13:100631883-100631937
  hyper

SEQ ID NO: 75371 - DNA, 85 bp, Homo sapiens
  chr13:100632429-100632514
  hyper
agcagaccagccccccgccgctccttgtggcgcgctcccggcgaggccccgggcctgaaatgtccccgcgcgcagagcctcctgc

SEQ ID NO: 75372 - DNA, 42 bp, Homo sapiens
  chr13:100633842-100633884
  hyper
gtgagtgtgtgcgtgcgcgcgcgggtgcgcgcaggggtgggg

SEQ ID NO: 75373 - DNA, 30 bp, Homo sapiens
  chr13:100634277-100634307
  hyper
cggaggcgcagggctcgcaggggcgggcgg

SEQ ID NO: 75374 - DNA, 386 bp, Homo sapiens
  chr13:100634944-100635330
  hyper
actccacaaccagtacggccccatgaatatgaacatgggtatgaacatggcagcagccgcggcccaccaccaccaccaccaccaccaccaccccggtgcctttttccgctatatgcggcagcagtgcatcaagcaggagctaatctgcaagtggatcgaccccgagcaactgagcaatcccaagaagagctgcaacaaaactttcagcaccatgcacgagctggtgacacacgtctcggtggagcacgtcggcggcccggagcagagcaaccacgtctgcttctgggaggagtgtccgcgcgagggcaagcccttcaaggccaaatacaaactggtcaaccacatccgcgtgcacacaggcgagaaacccttcccctgccccttcc

SEQ ID NO: 75375 - DNA, 120 bp, Homo sapiens
  chr13:100635398-100635518
  hyper
cgcgggctgggacagggaccaggcgcggaggggagacacgcacaggctgagactcaggctgtgggtgccgacgctgggcgcagaccgccagccggggacctgggatgggaggtgtttttg

SEQ ID NO: 75376 - DNA, 176 bp, Homo sapiens
  chr13:100635935-100636111
  hyper
cgtctcggggtgggtcgcgggggctttactgtggtttcgcagcagtttgtgaaattctctaatgggcaccacagagtttgcgattcccaacttggacccaggtcagctagagccccaggtcagctagagccccaggcagcgcggccccgcggggggatcgcgtgagaagagagagc

SEQ ID NO: 75377 - DNA, 311 bp, Homo sapiens
  chr13:100636130-100636441
  hyper
cgcctcatagattattcatctatgaccaggtctcagccaaaatcgtgccagacgatttcctaaaagaaagccaaatgttttagcaacttcccccgtcaatatttactccgaagtggggatgcgccagcggcctattgttctcttccgggaagggagggagccgaggtgcgagacaagcttttaacaaggtttaaaatttgagaaatttatttgcatgaaatgctcgctttcgagtcctgtgtctgagcggatgtctttaagaaacaatttaggtgctaatggaatttaacgttaaacggtcccctttccaa

SEQ ID NO: 75378 - DNA, 1159 bp, Homo sapiens
  chr13:100636859-100638018
  hyper
acagcttctccgtggcgagagcaacttgttagaagctgcaaatccaagaagccctctagaaaggcaggcagggctaggagcttccccacattcctgagaaatttgaggagatggacgtcagcctggaagaaagtaaaatacgaaataaatgagcaggactgtcgggcgggaaggcggttaatttgatcttagttctgccgcagaggggatcggactggtttgagggacccagccccctcaggtccttctccctcgccgcggcccagccccctcgcagcctgagtgggggctctgcaggctctgggtgtctgcagccagcgccgatgtttgccgtccacaggggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtaccaccgcggcggccgggaggagggcgaggcaggccgaggcgccggtgcagcactggcccggaccacctcagccggcctgggagggtccccaggggccagggcggcggggggaacatttctgggggtgctctcccccaggggcccggccccacagcagctgcactcacacccagtcccctctggtcccccctcccggcttttgtcttgcaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcgagggcaccttgtg

SEQ ID NO: 75379 - DNA, 194 bp, Homo sapiens
  chr13:100640276-100640470
  hyper
gctcgccttccccagcggctctgcgaactgcccaagcgccaactcctgaagcaatcagagccccattaaaatcaaatttataacccctaataatattaggcgaaattattaaaataattggcatatgttactgatccttgggagagttcattgaacacattataagctgtgaggaaaatcgtttagagttttcc

SEQ ID NO: 75380 - DNA, 254 bp, Homo sapiens
  chr13:100640905-100641159
  hyper
ggagcgggcgggagccgcttttcctcgaaagggctcccagtccctggtccctcgcttcccaaggctttgtccaaacaagtcacggacccgacaaggtggtccattctctctctttggcctttcttttctgcccttcgaatccgaaggactggatggaggggaggggatatggcaatagtgtagaagtgtcaagatgtgaaaattgctcaactgagaacgcacgcgggggctcgcggcccaacagcctgcaccac

SEQ ID NO: 75381 - DNA, 51 bp, Homo sapiens; identical to SEQ ID NO: 1121
  chr13:100642150-100642201
  hyper

SEQ ID NO: 75382 - DNA, 176 bp, Homo sapiens
  chr13:100642886-100643062
  hyper
gtgctggggccacctcgtcgccctcccacgtttctcttttgttcccaggagccgacgagcttttgaagaggtgacacctcgcttcgccttctcctgctctaggccctgccctcgtccagcatccctcctgccccacgaagcgagaggatgctcagcgcagctgccaggcagagagt

SEQ ID NO: 75383 - DNA, 380 bp, Homo sapiens
  chr13:100643790-100644170
  hyper
cggcggaggcctacagaggctcctgactggcagaactggaggtgtgggtgtggttcccttttcaccccggctcttatgttgccagtctcccccctaccaccaggcaaagcccccctaaacttagggtctggaacaaggccgagccagcgagggcctgccaggagctgcgctggagcctctcgctgcatccagagctggttcttgttcttttctctctcttggcccactgggcccacagtggttaggtggccgagtgtggtttcccgaaactctttggagtcgcctgggtctgcgtgcccctggccccgtcctcacccccgggctcgtcccccagcctccgccggcccgcctgtgaatggtggatttaatgagcgtttgtg

SEQ ID NO: 75384 - DNA, 405 bp, Homo sapiens
  chr13:100647898-100648303
  hyper
tgctaagcagatctccgcgttaaattagcctaatcatttgcctctctgttttttctaaaggtctgtggtccaagtagcagtcattcctgcaatagacgataggttctgttcggtagcgggaatgtcctgtttctttgctttaagtttcactttgtgattaaaatgcaataaaataagtctggaaaatcatttttaagagaacactttcaagaagcacttcctttcctagtgccagacaacggtgctccccaaccacttggctggaacgcttgctttcgatttgtttgtttcgcgcatttccctaaagagccgggctctttgcgctgttttaattctgctttaaaaatgcatcgcttctgccctgaatccttctctgaaacaaattcctatcgaaagtgtatcaga

SEQ ID NO: 75385 - DNA, 243 bp, Homo sapiens
  chr13:100649333-100649576
  hyper
ccctgggcgcagggctgtgtgtgcgaggacaattattttcatcagctgcttgctagcccgcgcccgactgctcctctttgcagaaccgacgggctttcaactctggaagtgaagcaggacgaattcctccatggagactccctccttgggaacgtcgaactctctctgccttggggagtggggctcgataaagggtacctaggtcgcaccctggcaggggagcactagagggccgcgaggtcc

SEQ ID NO: 75386 - DNA, 86 bp, Homo sapiens; identical to SEQ ID NO: 1123
  chr13:100649799-100649885
  hyper

SEQ ID NO: 75387 - DNA, 75 bp, Homo sapiens
  chr13:100649944-100650019
  hyper
cggccgagggagcctagagccggtgggagacgggcagcggcctctcctgatcctttcctgcggtcatacaagttc

SEQ ID NO: 75388 - DNA, 30 bp, Homo sapiens
  chr13:101298018-101298048
  hypo
attttctgtcattcccgagtcgagggtctg

SEQ ID NO: 75389 - DNA, 31 bp, Homo sapiens
  chr13:101532259-101532290
  hypo
agaaggacaaaagatcgagaccagcctggcc

SEQ ID NO: 75390 - DNA, 30 bp, Homo sapiens
  chr13:101714425-101714455
  hypo
agctgcaagctcttccggatgtccacggac

SEQ ID NO: 75391 - DNA, 30 bp, Homo sapiens
  chr13:101787561-101787591
  hypo
aaaactataaatatacgctagatagatttt

SEQ ID NO: 75392 - DNA, 200 bp, Homo sapiens
  chr13:102068158-102068358
  hyper
ccccacctccccacccgcgcgttggcccagaggtttacccaggcagcggccctggtgccgagggggcaggtgcagcgctgtagtgatgcccagtggcctcgtcctcagccacctgccccccaacacctgctagatgcccaggcggggcaggcccgaggtgtcgccggccctgggcttcccaagccagcccaggggcatcc

SEQ ID NO: 75393 - DNA, 113 bp, Homo sapiens
  chr13:102068417-102068530
  hyper
cgccccggccaggccggcaaggaccccaccgccccgctctcgggtggaggcgcccctccccacccctcccccgcgcggggcccccgcccgcagcccctctagcagcccctctc

SEQ ID NO: 75394 - DNA, 115 bp, Homo sapiens
  chr13:102068531-102068646
  hyper
cagccccagcgcccctgagccgtcctggcccggaccggccaaggaactaacgagcgcgcatcgcgggcctcgggcgcagggcacggagccggccgcgccgcagcctcccgggcac

SEQ ID NO: 75395 - DNA, 260 bp, Homo sapiens
  chr13:102068811-102069071
  hyper
cgctcggcccggctggggccgcggctcacgctcgccgtgtcactcactgagcgccgccgccgccgggcaggctgggggaggggtgggagccggagttttcgggcctttaaaaaattattattttatttaaatttttaaagttagctttgctacagggactgcagtgatgccgaagggcgggcaccgcagaggaggctgcgccgcagttggtggggagcgccagggtcggtactggcagttccttcttgccggctgccacc

SEQ ID NO: 75396 - DNA, 30 bp, Homo sapiens; identical to SEQ ID NO: 43836
  chr13:102206088-102206118
  hypo

SEQ ID NO: 75397 - DNA, 30 bp, Homo sapiens; identical to SEQ ID NO: 43837
  chr13:102385630-102385660
  hypo

SEQ ID NO: 75398 - DNA, 163 bp, Homo sapiens; identical to SEQ ID NO: 35062
  chr13:102568410-102568573
  hyper

SEQ ID NO: 75399 - DNA, 109 bp, Homo sapiens; identical to SEQ ID NO: 35063
  chr13:102568659-102568768
  hyper

SEQ ID NO: 75400 - DNA, 683 bp, Homo sapiens
  chr13:102569312-102569995
  hyper
gctcgtcgcaggaaccccggcgggggtcgccaccgccactcgcgctgccttctcgccctgcccggctcccgggcgggaggtagagccggccggcggctccccgggcgccggctggagggcgggtcccggcagggtctctgcgcgtccgtcggtccgggtcgcgctgggcaggactcagcgccgggctccagctgcccgcgggccggtgccgccgccggcgccgcccgctctcggcttctgccggtgattgtcaagtgctttggaaatcagcatctggagagaccaatcttctcccctgagatctctaatcaaacgctccgttcccaccccactacaccccctccacctatgtggtccccctcctgatgtacctcttcagaaagaaacaaaacgtataggtaataatgatttaaaaataataagaaagaaagctaagatggattgcagggatggggtgctaagaggccgagccaaagcaggtggaattgaaggaacatcggggcgctttttcttagatgcaactcgctggttcccgagccttccgcggcttggttggggcttctcggtcttaacgtggttaccggtgcactgaaactctcagcagcggttggagggcgaggtggtttccgccctccctgctaatccctccagcaccaacgcccccccgtcgccacccccaaccc

SEQ ID NO: 75401 - DNA, 46 bp, Homo sapiens
  chr13:102571921-102571967
  hyper
tcagagccctcccttcgttgttcagcagcctcggaccagcctgaca

SEQ ID NO: 75402 - DNA, 46 bp, Homo sapiens
  chr13:102572229-102572275
  hyper
gcagcgcctgaacagcggactccggagtctccgggcatctattctg

SEQ ID NO: 75403 - DNA, 388 bp, Homo sapiens; identical to SEQ ID NO: 11707
  chr13:103046665-103047053
  hyper

SEQ ID NO: 75404 - DNA, 274 bp, Homo sapiens
  chr13:103047054-103047328
  hyper
gcgggaccggggactctgggccaatgggtaaagccaggaggaagcccgtgcctggcccgttgggctccctcctcctcagagccgaagcagtccacactcggaacccagcttcacccggattaccgaggggttccacgcctggaggcagagctgcagcgtgggcccgctcgcggctttgcagaaaacaaataatgacacacttctctggaagcccggggcctgggcccagagccgtggcttctgccaaactttctggtcccggacaccaactccc

SEQ ID NO: 75405 - DNA, 374 bp, Homo sapiens
  chr13:103052094-103052468
  hyper
aggagggtaaaaggacggaggaggaggaaacagatggggtgaatagaaacggtgtaagaactagaacacagggaggaggactcagggcagagcccagagcccactgcagcaccgagtccacggagcagccagaggctactaccagagcctcaattgccaccccaaagtaccagctgggggcaatcttctccgccccagcataggagcctctgcccttttagactgtctaacaactcgcagtttctcctttgctgcaggaatggtggccgcaaacggtctcagcctccgcacccaccgcctccgtccccgcccacccgcacctcctcctcctctgcctcgcgctgcacccgcaggcggcagacccctcggagcgc

SEQ ID NO: 75406 - DNA, 359 bp, Homo sapiens; identical to SEQ ID NO: 35070
  chr13:103052469-103052828
  hyper

SEQ ID NO: 75407 - DNA, 594 bp, Homo sapiens
  chr13:103052829-103053423
  hyper
ccgccaccaccatgcagccctccagcctgcctcccctgggttgctcgcccacagctccgcggccgcccccaatcgcctcggactgagacgcggggacgggaacccctgggatccgactccccaaatcagatgcatttgcatttcttatgtaatgtactgcaagttcccttgttggagccctttggaatcggggcgcatgatcaccagtaggcttaaaagcaggaactcacggcctggctcatccccacccctggccctgtgggaccccgacgcagggctttgacaccgctttctaaagggggggacttcaattacaaatattagaggggctgggcttgtcctctcagtctggggttccctcccggcgcaagccttgctcaagtattcccggtggcaggatgtgtcagaggcagacagggggaatgagttaatgctcgggcacccggagctggacgggggagggacgcgggggctgacggaggagcggggccgcgagggagggggcctcttttactttggtaaaggtgatcgtggtggcgaatattgtgcaagctaatcagaaagtctagagcaggttctcggaacccagctacg

SEQ ID NO: 75408 - DNA, 189 bp, Homo sapiens
  chr13:103054542-103054731
  hyper
ttttttataatcaatcgccagtgctcagtgggatcggtttgaacctgcagttctcaatcaccacgaagaaaagatgcaaatttaggtgccccctccccttgtcagtcttgtagtaggtagagagcgccacaaatccccttcctccttcctctcactcttccagtttccaacaaccgtgagcatgaggaa

SEQ ID NO: 75409 - DNA, 133 bp, Homo sapiens
  chr13:103157771-103157904
  hypo
gttgtaaactctatacggataagcattacgtctgtctcgtattccactaaaatggtggataaatatttaatcaattaattaaaaacattttttatcagttctcagagatccacttgcacgtaaacctttgagt

SEQ ID NO: 75410 - DNA, 30 bp, Homo sapiens
  chr13:103451013-103451043
  hyper
caaacatttacaagacggactctcgaaatg

SEQ ID NO: 75411 - DNA, 27 bp, Homo sapiens
  chr13:103569166-103569193
  hypo
ccggccgtcccccgttaatcttactcc

SEQ ID NO: 75412 - DNA, 30 bp, Homo sapiens
  chr13:103598335-103598365
  hypo
ctgtaagtccatgcacgtactaatgataga

SEQ ID NO: 75413 - DNA, 163 bp, Homo sapiens
  chr13:103724063-103724226
  hypo
aaatccatgaccttgcggtggctgattatattattgctgtcagttaattgcttcctacttctctgtaatgggattctatagccacagctgttgaaattgacttgcagtgcttccctgttgaaggaatagccaattttttttggctttttttgcagggtggggg

SEQ ID NO: 75414 - DNA, 23 bp, Homo sapiens
  chr13:103931640-103931663
  hypo
tatagaaaacctggccgggcgcg

SEQ ID NO: 75415 - DNA, 21 bp, Homo sapiens
  chr13:104514710-104514731
  hypo
cccggccgagaattttatgta

SEQ ID NO: 75416 - DNA, 30 bp, Homo sapiens
  chr13:104659524-104659554
  hypo
aaatcgcatatgcctcggggttaaggaata

SEQ ID NO: 75417 - DNA, 19 bp, Homo sapiens
  chr13:105886013-105886032
  hypo
ttttttcttttgagacgga

SEQ ID NO: 75418 - DNA, 18 bp, Homo sapiens
  chr13:106549803-106549821
  hypo
actcggcccattatcaat

SEQ ID NO: 75419 - DNA, 39 bp, Homo sapiens
  chr13:107001648-107001687
  hyper
aaacagccatcagcgcggcgcgctcgttttttcccgcag

SEQ ID NO: 75420 - DNA, 496 bp, Homo sapiens
  chr13:107186664-107187160
  hyper
ggctccagggctctgcgggcagcgtagcgactccaggctcccctctccagaacgcgcttcgctgccagcgtcctgccaccccggtcgcccgcccgcgggccccggaccacgccgcccgcgctccccgcgaatgcagcatctccgcctctctccagagcccaccagtccccgcgtgccggccagcctagattgtggccatgtccttcgtcctcgaaaacaggagagggtcaggtatcgccatcggacaccttcccggacttgacacccgagccgatagtagcttttagcgcctgggagcgttcgggggaggaaaggcggagagaccgtccgttccagcggggctcgggttggaaagccgagcgaggagtctccacctagtgaaatggggcgggggttgggggtgggggacggggaaccgaggttccagaaacaggctccgaggccccgcggactgacccctcctcccgcccggacggcgcggcggaccccggggcgg

SEQ ID NO: 75421 - DNA, 70 bp, Homo sapiens
  chr13:107188738-107188808
  hyper
tcgccggcacaggcacgacgcggggaccgtctcactagcctctaggagacacgcgcgcttcccaaagtga

SEQ ID NO: 75422 - DNA, 30 bp, Homo sapiens
  chr13:107189087-107189117
  hyper
acagtaggaagaacacggtagaaataaggc

SEQ ID NO: 75423 - DNA, 30 bp, Homo sapiens
  chr13:107323934-107323964
  hypo
tgtgtctgcttgaagcgatgctccggaggg

SEQ ID NO: 75424 - DNA, 37 bp, Homo sapiens
  chr13:107552994-107553031
  hypo
tgtctgtgtgtttatcgagatttgttgcccaggctga

SEQ ID NO: 75425 - DNA, 245 bp, Homo sapiens
  chr13:107570101-107570346
  hyper
gaaacggggacagggcgcagggcagagcacagagcgcaggggcgcagagaaggggacgaagacggggccggaggcgcctgaggggggctccgtgcgggaatcggcggcgccacccagccccgcacatcgccgagagaggcccgcgtgcttctgagagcgccgcccctgacgtttctgctgcgcgctgggaccgaacctacaggaagcaaaaccctagaggaagaagtcggcggctttttggctcg

SEQ ID NO: 75426 - DNA, 22 bp, Homo sapiens
  chr13:108122378-108122400
  hypo
ccacgcccgaccaactatgtat

SEQ ID NO: 75427 - DNA, 143 bp, Homo sapiens; identical to SEQ ID NO: 43839
  chr13:108218849-108218992
  hypo

SEQ ID NO: 75428 - DNA, 30 bp, Homo sapiens
  chr13:108518091-108518121
  hyper
cgctttcaaactcttcgtatttctcctgag

SEQ ID NO: 75429 - DNA, 213 bp, Homo sapiens
  chr13:108518444-108518657
  hyper
cgccacacgggcttggcagagtttcctagaaaaagagccttgccccggtcgtctttgcctcggttgcccttgccgccgccgccgccgccgtctcccggggaggggggcagggtgggggacgaggaggcggagaggagtctgtgtgcctgggcggcgggcgaggactcccccatgctcgccaggagcgcgggccaggagggctcctgctgccgc

SEQ ID NO: 75430 - DNA, 216 bp, Homo sapiens
  chr13:108518717-108518933
  hyper
tgctgctgctggtgctccttgtcccgggcccgggtcagcttggcctcggcgcagaaccacaagtgatcagagagcaggactgtgaaaaacaagagagatgccagagacagtcgccatttctgagccctctcggaatcgatgaacggtttctcgttctctcggggtgctgccaaccagatttttaagccgtcgtcatactgccgacacatccaagca

SEQ ID NO: 75431 - DNA, 156 bp, Homo sapiens; identical to SEQ ID NO: 35076
  chr13:108519254-108519410
  hyper

SEQ ID NO: 75432 - DNA, 124 bp, Homo sapiens; identical to SEQ ID NO: 35077
  chr13:108519622-108519746
  hyper

SEQ ID NO: 75433 - DNA, 31 bp, Homo sapiens
  chr13:108519901-108519932
  hyper
cgcagtggcgccggctcggcccgggaggagg

SEQ ID NO: 75434 - DNA, 70 bp, Homo sapiens; identical to SEQ ID NO: 35079
  chr13:108520465-108520535
  hyper

SEQ ID NO: 75435 - DNA, 125 bp, Homo sapiens
  chr13:108520701-108520826
  hyper
cgagctgggtgcctgcgagtcgccgccgcagtctgagcctctggtgccccttagcgttggctctcggagttctgagaagggaaaggagacagacactctgggaaaatctggggtcacctcgattc

SEQ ID NO: 75436 - DNA, 286 bp, Homo sapiens
  chr13:109147577-109147863
  hyper
cactgccacagtccccgcgatggcctttgttctgttaggactccccagggggacctcggctccaggtcacagctctgggcactcccttctcctcctgctcccaggatcttgctaaagtggagacggaaggaaaagtttcaggagtgagctgcgttcttagaattgtagcagagagagaggagggagagagcagaggatcggagggcaggagtggagagaggcgcggtctcctggaacgcgcgggggaacgtggaaaggagggcgcgggagacccggagggctgccc

SEQ ID NO: 75437 - DNA, 125 bp, Homo sapiens; identical to SEQ ID NO: 35082
  chr13:109148154-109148279
  hyper

SEQ ID NO: 75438 - DNA, 656 bp, Homo sapiens
  chr13:109148376-109149032
  hyper
cgccgggctggggacgccgggagggtgccccgggtcggacttgcggcgctgggtccccacccagagttcccgcacggtgagggttggacgcgtctggggggcgtggagaggaggcttgtcggtcccttcctgggaaaggaatcgcggggacttcccaaccgctaggacgcgtaagccgaggctgggagtagaagccttctgaactctggacctaccccagaaggagggggcgaaactggccatttcgagggacgcggaagccccgttgctaggggagatgggggaagcggcgtggtcacctacacaaccgctcccaggcgcgatgggggctctgcttcctcctcctctgtttctttggggatggaaaagagagcagaacaaagatgtagagtgaaggagggctccccagctgttgcctcttgcgcggattctgctgacccctctgcgcgaccccagctgggcagtgtcagctccattgtctcagaggccggcggccaagtgagggaccagtctcacccggggggcgtcgagcctcagcgcatcgccccgtcttccctggctgcagaaaaccactaggccggtggaagtgctccgtttaattggtccctagtacgcccccgaaaggaaatggagacgatttccgtcaagttctctta

SEQ ID NO: 75439 - DNA, 30 bp, Homo sapiens
  chr13:109149238-109149268
  hyper
cagagggctgacctgcgtcttccaaaggca

SEQ ID NO: 75440 - DNA, 30 bp, Homo sapiens
  chr13:109779816-109779846
  hypo
agggaccccaacacccggctgagtgcttcc

SEQ ID NO: 75441 - DNA, 30 bp, Homo sapiens
  chr13:109917328-109917358
  hypo
gggctgccagagattcgcactctatgctga

SEQ ID NO: 75442 - DNA, 30 bp, Homo sapiens
  chr13:109944512-109944542
  hypo
ctcttatttcatgctcgctatgcatattaa

SEQ ID NO: 75443 - DNA, 23 bp, Homo sapiens
  chr13:110053866-110053889
  hypo
tacctgagattcaatcgctgagg

SEQ ID NO: 75444 - DNA, 23 bp, Homo sapiens
  chr13:110053949-110053972
  hypo
ttttggcccgataaattccattt

SEQ ID NO: 75445 - DNA, 30 bp, Homo sapiens
  chr13:110174352-110174382
  hypo
cattcttttttgagacggagtctcactctg

SEQ ID NO: 75446 - DNA, 30 bp, Homo sapiens
  chr13:110344624-110344654
  hypo
gctctgagaaaatggcgatcctctgagaac

SEQ ID NO: 75447 - DNA, 160 bp, Homo sapiens
  chr13:110424427-110424587
  hypo
ggctcacccggcatgcgctgggcccaggcagcgcagggcagtcatgggtgagggtggccactgagatgacgggatcgggggcggcttctgccgcagacccgggaattcacgtggtcagatggtccctgacttcagtccctattttcggtggttcatagca

SEQ ID NO: 75448 - DNA, 2130 bp, Homo sapiens
  chr13:110434379-110436509
  hypo
cctcctcacctttcacgatggtggcctccttcaagtggtgggacaagaagtcaatgctggcgtaggtgttggcagggggcagggcaccgggacccggccccccgcacccgccgccggtgctgccgacgcccacagcgctgatgagacccccgaggcttcgggtccggccccaggagctcttgtctcccggctgaggaagcggcggcggcggcggctgcggctggggtggcagcccgggctcctccctcacgtcgatggcgatgtagttgagaccattctggaagccggcagaggtctctctgcgcatgggcgatccaccgctcccaggacaaccgaccaagcccccgggctgacccggggtccacggccggccctgcggtgccaaagggggcgccggctgcaactgtcgtggggaggtgggcggctcgtcgccccctccagggccgacacccacgccgccctcgctgcttttcctgagagagacattttccacggaggccgagttgtggcgcttggggttgtgggcgaaggacggggacacgggggtgaccgtcgtggtggaggagaaggtctcggaactgtggcggcggcggcccccctgcgggtctgcgcggatgaccttggcgccgcggtgggggtccgggggctggctggcctgcaggaaggcctcgactcccgacacctgctccatgaggctcagcctcttcacgcccgacgtcgggctggccacgcgggcagcttctggcttcgggggggccgcgataggttgcggcggggtggcggccacaccaaaagccatctcggtgtagtcaccattgtccccggtgtccgaggacaacgatgaggcggcgcccgggccctgggcggtggcaacggccgaggcggggggcaggcggtacagctcccccggggccggcggcggtggcggcggctgcagagacgacgacggggacgcggacggacgcgggggcaacggcggatacggggaggaggcctcgggggacaggaggccgtccaaggagcccacggggtggccgctcggggcgcccggcttaggagacttgggggagctgaagtcgaggttcatgtagtcggagagcggagaccgctgccggctgtcgctgctggtgcccggggtgcctgagcccagcgacgaggccgggctgctggcggacaagagcgaggaggacgaggccgccgacgccagcaggggaggcgcgggcggcgacaggcgggccccgggctcgccaaagtcgatgttgatgtactcgccggggctcttgggctccggtggcagtgggtactcgtgcatgctgggcaggctgggcagcccctccagggacaggcgcgtgggcctcaccgcccggccgcgctggcccaagaagccctccgggcggccgccgctaggccgcacgggcgaaggcactacagggtgagggggctgcgtggggccggccccgaaggcgctggccgcctggctgggccctggcgtggcctgaggctccagacgctcctcctccaggatgcgccccacgggggagctcatgagcacgtactggtcgctgtccccgccacaggtgtagggggccttgtaggagcggggcaaggagctgtagcagcagccgggaacgcccctgagcggctccccgccggggtgcagggctgcggagaagaagtcgggcggggtgcccgtggtgaccgcgtcgctgggggacacgttgaggtagtccccgttgggcagcagcttgccatctgcatgctccatggacagcttggaaccgcaccacatgcgcatgtacccactgtcctcgggggagctctcggcgggcgagctggccttgtagccgcccccgctcgccgggaatgtcctgcccgccgcagaggtgggtgctggccccgcaggccccgcagaaggcacggcggcggcggcggcggcggcggccctgggctgcaagatctgcttgggggcggacacgctggcggggctcatgggcatgtagtcgtcgctcctgcagctgccgctcccactgcccgcgagggccgcgccgggcgtcatgggcatgtagccgtcgtctgcccccaggttgctgctggagctcctgtgggagccgatctcgatgtctccgtagt

SEQ ID NO: 75449 - DNA, 35 bp, Homo sapiens
  chr13:110438921-110438956
  hyper
gtgagtaacacatcgcgcaccgagtgactgaacta

SEQ ID NO: 75450 - DNA, 45 bp, Homo sapiens
  chr13:110439819-110439864
  hyper
caggcggagaaagtgcggtttccatagcgccggggagagggcgga

SEQ ID NO: 75451 - DNA, 30 bp, Homo sapiens
  chr13:110525952-110525982
  hypo
caacggtgtcacacacggtggcctcagtgt

SEQ ID NO: 75452 - DNA, 30 bp, Homo sapiens; identical to SEQ ID NO: 43842
  chr13:110659714-110659744
  hypo

SEQ ID NO: 75453 - DNA, 30 bp, Homo sapiens
  chr13:110767621-110767651
  hypo
attatctcttccagtcgtatcacatgaggt

SEQ ID NO: 75454 - DNA, 30 bp, Homo sapiens
  chr13:110958402-110958432
  hyper
aagtctttattctctcggaggggaaggaaa

SEQ ID NO: 75455 - DNA, 268 bp, Homo sapiens; identical to SEQ ID NO: 35085
  chr13:110958709-110958977
  hyper

SEQ ID NO: 75456 - DNA, 76 bp, Homo sapiens; identical to SEQ ID NO: 35086
  chr13:110958978-110959054
  hyper

SEQ ID NO: 75457 - DNA, 132 bp, Homo sapiens; identical to SEQ ID NO: 4051
  chr13:110959517-110959649
  hyper

SEQ ID NO: 75458 - DNA, 391 bp, Homo sapiens; identical to SEQ ID NO: 35088
  chr13:110959752-110960143
  hyper

SEQ ID NO: 75459 - DNA, 259 bp, Homo sapiens; identical to SEQ ID NO: 35089
  chr13:110960344-110960603
  hyper

SEQ ID NO: 75460 - DNA, 221 bp, Homo sapiens; identical to SEQ ID NO: 35090
  chr13:110960909-110961130
  hyper

SEQ ID NO: 75461 - DNA, 97 bp, Homo sapiens
  chr13:110998830-110998927
  hypo
agtgaccaagacattcgaagacaggcaaggaaaccttcaaatgcaggcaactcatatttcgacggggcaccctccagtgctccgagatggaaattgc

SEQ ID NO: 75462 - DNA, 126 bp, Homo sapiens
  chr13:110999273-110999399
  hypo
gagcctcatcccctgcgcttatcgtggctcactgccaagtgcgaacacctgggtccacgcctccgcatgccgggcccgtgtgcacacctgccttcctcgctggtgagagggcgcatctcagcctgc

SEQ ID NO: 75463 - DNA, 149 bp, Homo sapiens; identical to SEQ ID NO: 43844
  chr13:111144888-111145037
  hypo

SEQ ID NO: 75464 - DNA, 30 bp, Homo sapiens
  chr13:111207973-111208003
  hypo
gggcagaggacgccacggaagcgcaaacgt

SEQ ID NO: 75465 - DNA, 66 bp, Homo sapiens
  chr13:111267526-111267592
  hypo
aaagcgaaggggcctcgcagcgagctggtttggggttcagggcagaggttgcgcctggagcagaaa

SEQ ID NO: 75466 - DNA, 580 bp, Homo sapiens
  chr13:111277084-111277664
  hypo
aggcgtgagccactgcacctggcctcaattgaagcccatttttaaaacctaaagcgtgatttgtattgtactccaccaaagtgcacctgggatgcctttgtaggtcgcagctgaagccgctgatcctgcagtttcccatgagctgagcaagtgctaacggccggcctcttcctgtgacccttcctcctggagggtgaccagaccgagctgggccgtgctggtgtgtgtggctctgaccctgcctctgcagtggcggcaaaagtctttctttttaggtattgtgctctgcgccctggccctttgctaagccacctggctgggtgtaatccgagctagtacgtttctcatgcacgtcaccagggctgagtaatgagcgctggacgcctgtgtctggcgggtgggcagcgatgccggagcgatccctgagtcggcctcttgtgctccttcatcagggcgcagacttgtcccacgtgttctgtgccagtgcggccgcacctgtgattaaggcctacagcccggagctgatcgtccacccagttctgtgagtcgctctgcgccggcttctcgtaggttctctttc

SEQ ID NO: 75467 - DNA, 105 bp, Homo sapiens
  chr13:111278321-111278426
  hypo
agcacagtgtgatgacgcctgggtcgagcccggcctctccacaccagagaggagccggcgcggagctccaggtgcggtgctgtgatgtgtcgggtgaccaagagg

SEQ ID NO: 75468 - DNA, 178 bp, Homo sapiens
  chr13:111289167-111289345
  hypo
ctgcctgcttgggctcgtctgaggcggttccgagctgcaggtgtctccaccaacctgctgtgctacacagcggggtctggggcagcctcaccactgcgtgtcttggtttcctcttctgtaaaacagaggctgcctccaacccttggaacaaacagggaagagccgtagcaggcaggat

SEQ ID NO: 75469 - DNA, 30 bp, Homo sapiens
  chr13:111337750-111337780
  hypo
atcctcagggcctcacgtgctcatcttacg

SEQ ID NO: 75470 - DNA, 88 bp, Homo sapiens
  chr13:111363884-111363972
  hypo
ccaagtagtggccaataaatcttgtagaaactaaagtactcatttgcttttaactaggccaagactagaatagcgtgatctgtaagta

SEQ ID NO: 75471 - DNA, 214 bp, Homo sapiens
  chr13:111477321-111477535
  hypo
gcggaccgacgggtgcggtgagtggagatgattttgtgagagtttttaggacaatcctggaagtgggtttgtcacttctggctgcactccattggcctgaaaggaatcacacggccccaccccaatgcgggaggctgggagtgttcagcgcctgcagagaaggtcaggtgggctggaagccctgcgccaggcatggccacgccctggtgaaggt

SEQ ID NO: 75472 - DNA, 37 bp, Homo sapiens
  chr13:111682046-111682083
  hypo
acgcaggctcagggtcggactccgatggggatgcatt

SEQ ID NO: 75473 - DNA, 39 bp, Homo sapiens
  chr13:111704359-111704398
  hypo
cccagaagcaggtcacgagaccctcatgtgagagcacgt

SEQ ID NO: 75474 - DNA, 30 bp, Homo sapiens
  chr13:111745610-111745640
  hypo
gatgtgaaacccccacgactcctctctcct

SEQ ID NO: 75475 - DNA, 30 bp, Homo sapiens; identical to SEQ ID NO: 43850
  chr13:111764740-111764770
  hypo

SEQ ID NO: 75476 - DNA, 146 bp, Homo sapiens
  chr13:111766799-111766945
  hyper
gagtgagtggagactcgtgtccttttaagaagaggctccatttcttcctcgcatgtcaatgtgtgcgtgtcatcagttgttcgaggaagctcgcgcatgacgcgacacttgccgtctgggctctccaggttcggcctgctgctttc

SEQ ID NO: 75477 - DNA, 905 bp, Homo sapiens
  chr13:111767213-111768118
  hyper
tgcaaggtagcaaagcgaaacaaacgtctcgttttcagcctgtccccgccaccttgaaataaaaccggcaaaaataaaaagagcattctgggaagtacttcatcatttcaacgctcacgaattcaaaacataaacaaaggcttccgagtgccccggccaggggcgcggggcgcacggcgggcccggggcaggtaagcgcaggtgcgcgcccgcccccacccccggctccctccccatccgctccccgctccccttcccctttcccttccccgcccgctcccagccgccgccgccgccccgcgcacggcctggagcggaggctgcgcagggcgcggggcggcgcgggccgggcgcgggccgggcggacggccgcgtctttcttctcctggcggtgatgtcattgggcgacggcggccgaggccggggggcggcggcgggcgcccgcaggttcccgagccgctcctgagaaggcgcctgacagcgggccggggcgcacggagaagcgggccgggccggacctgctgggccgcgccgagccaatcgccggcgccggccgctcgatgggcgaggcggcggcggcggcggcgggggccgcgggccgggccgccgctccgaggtgaaggcgcgcgcccctccccgcctgcctcccgggccgcagcgatgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaagtaagtcccggcccgcgcccccgcccgcgccccccggtccggcccgctgcggcccgggatgcgcgcggagcacctgaggc

SEQ ID NO: 75478 - DNA, 92 bp, Homo sapiens
  chr13:111768416-111768508
  hyper
cggctcactccgctggctttgtgtggacagttcttgccggtggcgttgcgtgagtttcgcctcccaggttaattgaccggttgctctgtatt

SEQ ID NO: 75479 - DNA, 30 bp, Homo sapiens
  chr13:111768797-111768827
  hyper
tcatcgcccacaagccggccagcagggccg

SEQ ID NO: 75480 - DNA, 30 bp, Homo sapiens
  chr13:111773890-111773920
  hypo
agggtggattttagccgtttggattggagt

SEQ ID NO: 75481 - DNA, 30 bp, Homo sapiens
  chr13:111797673-111797703
  hypo
aggtggtttatgagacgatttatgaagtga

SEQ ID NO: 75482 - DNA, 30 bp, Homo sapiens
  chr13:111932841-111932871
  hypo
acctgtgtttccactcggcctattttttcc

SEQ ID NO: 75483 - DNA, 30 bp, Homo sapiens
  chr13:111972934-111972964
  hypo
tgtgtgatgtcacagcgggcggggtggtgt

SEQ ID NO: 75484 - DNA, 408 bp, Homo sapiens
  chr13:111978537-111978945
  hypo
gggtggaggagactgcgggcagtgtgagcctgtctggtggggtggagactgcgggcaacgcgagcctggcgctggtgggtgtctggtggggtggaagagactgcgggcagtgtgagcctgtctggtggggtggagactgcgggcaacgcgagcctggggctggtgggtgtctggtggggtggaggagaccgcgggcagcgtgaggctgtctggtggggtggaggagacggtgggcagcgtgagcctggcgctggtgggtgtctggtggggtggaagagactgcgggcagtgcgagcctgtctggtggggtggaggagaccacgggcagcgcgaggctgtctggtggggtggagactgcgggcaacgcgagcctggtgctggcgggtgtctggtcgggtggaagagact

SEQ ID NO: 75485 - DNA, 137 bp, Homo sapiens
  chr13:111997459-111997596
  hypo
gctctgcggctgtagcgtgaaggcagacaccgacgatgcctccaggaaggacgtggccttgctccaaaaagactttcttatggaagccagtgacgggctggacgctgcctacaagctgtagtcggtaaacccccagg

SEQ ID NO: 75486 - DNA, 30 bp, Homo sapiens
  chr13:112052769-112052799
  hypo
tgctccagacacccacggtgcacatccatc

SEQ ID NO: 75487 - DNA, 149 bp, Homo sapiens
  chr13:112060039-112060188
  hypo
tccagggcgctcctccggtctcactctttgagtcccccccacactctgggactctccagtcagctctggtccggctcatgcagacaccagttggtaaacaggaggtgctcaacgagtgttggctggtcatagagcgtgcctcatggatg

SEQ ID NO: 75488 - DNA, 30 bp, Homo sapiens; identical to SEQ ID NO: 43852
  chr13:112062748-112062778
  hypo

SEQ ID NO: 75489 - DNA, 187 bp, Homo sapiens
  chr13:112078320-112078507
  hypo
gtgggatgctctgcccgcgtggctgtggaaggagactgaagtcagagataggtggtcaggctttcccagttaaaaaaaatagctgaacttgatggcgtgtttaacatgcacctggcattttgccacacactgtctcatttaaccagcgccgctgactgggaaggaaccactgcggccacctccacct

SEQ ID NO: 75490 - DNA, 60 bp, Homo sapiens
  chr13:112090514-112090574
  hypo
aggctttggggcaatcggtgcgctgccatagacagcagacacccccgggagtcagaatcc

SEQ ID NO: 75491 - DNA, 30 bp, Homo sapiens
  chr13:112165349-112165379
  hypo
gtagcccattggacacggctgaggtgaccc

SEQ ID NO: 75492 - DNA, 30 bp, Homo sapiens
  chr13:112172192-112172222
  hypo
aaaacttttccaaagcggtttaatgaagat

SEQ ID NO: 75493 - DNA, 111 bp, Homo sapiens
  chr13:112192088-112192199
  hypo
cccggtgggtggctgcgattcctgcctctgagattcaggggccctgctggggtttgctgagcatggatgtgtccttggggctgctgctatcattcccgttccacaaacaag

SEQ ID NO: 75494 - DNA, 30 bp, Homo sapiens
  chr13:112196610-112196640
  hypo
ggagtagacaccaaacgccacattcccaat

SEQ ID NO: 75495 - DNA, 272 bp, Homo sapiens
  chr13:112200634-112200906
  hypo
tgtggacgtcaaactcgctgccggccagggggcttgccctgggaaccccactcccgctgaaggccagcagtgagagaggtgggacagcagtttctgcatctgttcgcagcaaggcagtctcttctgcctcgcagtctcgttcaggcaacactgcgggaattcggcgtgcatcgctggcgggccgctgctccctgccgccctcccgggttgtggctgagcccacgggaggcgcgtatttcccacgccatcgctggctgcgcttgctcctgtgg

SEQ ID NO: 75496 - DNA, 66 bp, Homo sapiens
  chr13:112236766-112236832
  hypo
ttgttttccctagcacgctgcctggagcgctgatgtgttgtaggagaaagacgttgttatgacaat

SEQ ID NO: 75497 - DNA, 30 bp, Homo sapiens; identical to SEQ ID NO: 43855
  chr13:112243149-112243179
  hypo

SEQ ID NO: 75498 - DNA, 79 bp, Homo sapiens
  chr13:112272942-112273021
  hypo
ggaggtggcatatcacgtgtcatggcgtctaataatgtggtgggttagaacatggtgagaccaacgtctggaatggcca

SEQ ID NO: 75499 - DNA, 30 bp, Homo sapiens
  chr13:112274381-112274411
  hypo
ccctctgaggtccggcgcctcatccatcag

SEQ ID NO: 75500 - DNA, 68 bp, Homo sapiens; identical to SEQ ID NO: 43857
  chr13:112274715-112274783
  hypo

SEQ ID NO: 75501 - DNA, 36 bp, Homo sapiens
  chr13:112276380-112276416
  hypo
cacagggtccagatccgagtgcgctgttatcctcaa

SEQ ID NO: 75502 - DNA, 30 bp, Homo sapiens
  chr13:112309025-112309055
  hypo
agggcgctccagaaacgtcaccatcaccac

SEQ ID NO: 75503 - DNA, 179 bp, Homo sapiens
  chr13:112320583-112320762
  hypo
gcagtggtggttccacgttggccgaggtccactccctgctgcaatcactcgtggcatctacagggaactcagaggctccctctgaggggctgagctttgcgggagagaacaggggctgggaagtcccttggtgtctaaaagtctgaattgcagacaatccctgtcgttaacctggaact

SEQ ID NO: 75504 - DNA, 32 bp, Homo sapiens
  chr13:112321043-112321075
  hypo
gacccccgcagggcccgcggctcccccagcct

SEQ ID NO: 75505 - DNA, 30 bp, Homo sapiens
  chr13:112323073-112323103
  hypo
ccgcaggggtcagtgcggagggggcggccg

SEQ ID NO: 75506 - DNA, 167 bp, Homo sapiens
  chr13:112341901-112342068
  hypo
cccccacactgaacacggcttctccaataatccacgacccctaggggagagtaacaatttatttttctttcttggctacaattaggcttccaaccatggtgcaccattcccgccgttgcctccatcacaacttaagacaatgagaatgcattcggatgaaagtcacc

SEQ ID NO: 75507 - DNA, 30 bp, Homo sapiens
  chr13:112347214-112347244
  hypo
ctccctctctctctccgctgtctccccaga

SEQ ID NO: 75508 - DNA, 36 bp, Homo sapiens
  chr13:112512707-112512743
  hypo
cacccctgtctcctacgtcctcggaaacgggcgggt

SEQ ID NO: 75509 - DNA, 116 bp, Homo sapiens
  chr13:112513008-112513124
  hypo
gatctggggcccctgcgtgccagctcccagtgtggctggagggcaagggcaggtccccgtcctcacgctccctgtagaaagagccgctgcacccccgtgaccgctccatgctgggg

SEQ ID NO: 75510 - DNA, 325 bp, Homo sapiens
  chr13:112553503-112553828
  hypo
acagcaaagggttggcgtatcccagtggcaacccagcccccccaactgccgccgtccttgcccgggctgatcacgacaagggttggcatatcccagtggcaacccgggcccctccactgctgccatccctgcccgggctaatcacgacaagggttggcacatcccagcggcagcccggcgcccccccaccccgccccactgctgccgtccttgcccgggctaatcacgacaagcgttgccgtatcccagtggcaacccgggcccctccactgccaccgtccctgcccaggctaatcacaacaagggctggcgtatcccagtggca

SEQ ID NO: 75511 - DNA, 64 bp, Homo sapiens
  chr13:112558994-112559058
  hypo
ggcaatgatgccacccgcatgtatctgtgtggcagcaaaatccaggccacggccttccatcatt

SEQ ID NO: 75512 - DNA, 62 bp, Homo sapiens
  chr13:112559680-112559742
  hypo
agtggactagcaaggcgggaggagcacgtgtttggagtgtggccccacgtccccgccccctt

SEQ ID NO: 75513 - DNA, 60 bp, Homo sapiens
  chr13:112573418-112573478
  hypo
ctcataaggaccacacggctgaacacctgcccatgccggggactgcgtgagagcccccat

SEQ ID NO: 75514 - DNA, 35 bp, Homo sapiens; identical to SEQ ID NO: 43861
  chr13:112573696-112573731
  hypo

SEQ ID NO: 75515 - DNA, 81 bp, Homo sapiens
  chr13:112618899-112618980
  hypo
atagcccagggcctgcggcctgagagcagcaccgtggagaggctctgcctgagcgctctggtccagcgtttccacccacag

SEQ ID NO: 75516 - DNA, 30 bp, Homo sapiens
  chr13:112679985-112680015
  hypo
caaaacgaaacttcacgcatgtacatacac

SEQ ID NO: 75517 - DNA, 58 bp, Homo sapiens
  chr13:112682842-112682900
  hypo
aaccaggaggaaggacggaccagagggaggaaaaacggcccagcgggagggaggacaa

SEQ ID NO: 75518 - DNA, 270 bp, Homo sapiens
  chr13:112690736-112691006
  hypo
ctctccagggccacccggagatgcccagactcagaggcctgcctccagccctgcctgcctggacagcaggcctgagagccggacatgcttccgtgtggccgtcacatccccagagttgcacccgcgcaggccgtgtgtgcacgtgttcttgaatcctagggtgtacatcatgtccccaaccccaccccactcagcgccaagggagggaaggggagtccagctcccctcgcagggccggactgagcactctgcactcggccctgccgtccc

SEQ ID NO: 75519 - DNA, 374 bp, Homo sapiens
  chr13:112707631-112708005
  hyper
tcctgttcccatgtgcggttggtgtcggagttagacatcatcaagaggtgaaaatttgggaagacatttcaaggatgacggaagctctgagtgagtgaacagatattcttcgtgcagaataatcccccgtggcactggtttgccggcagagcagaatgtttgagacctcaccccgcagccacgcgcgggcgtaaatcgttctcagcacgagaaacacaaaggccgcaggatcccgcgagccgcagggggttggggtcatttttttgatgccgccgcccttaagagttccagtccttcaggcgaaaggggcagatcaggccttcggggaggacccttgcctgggagagggagggcagtgccccaggggccgcctc

SEQ ID NO: 75520 - DNA, 394 bp, Homo sapiens
  chr13:112708307-112708701
  hyper
cgcaggacagcctcgctgcccggggccgagttcggtggacaagggggcagcgcccacagcaagccggaaagagggaggcgcggggccgcgcttggggcctgccgctgcacgccagcctgggcaaagagctgccaccttctgcgggcgaagcgggtcgggacgcaggacggcagcggggctggaggcagctacgtgggtccacacccccatgccctgcaaggctccttggccctgcttctcctctgtctcggcgggagaggagcagcctcggttttacagaatttcagggtcgcgtctccagcgccccgggcgaggccactacgtttaggagcgctcgccttcgctgcgctgtgtaccgtgtacacactggctccgtgcgcgagaccccgatgtg

SEQ ID NO: 75521 - DNA, 30 bp, Homo sapiens; identical to SEQ ID NO: 35097
  chr13:112709027-112709057
  hyper

SEQ ID NO: 75522 - DNA, 75 bp, Homo sapiens
  chr13:112709489-112709564
  hyper
aaaaaaattaccctgcgtttgtccgggggagatgtgtgcgtgggtccgcgcgccccgcaccgacactgagggctg

SEQ ID NO: 75523 - DNA, 438 bp, Homo sapiens
  chr13:112709815-112710253
  hyper
cagagacccagaccccgagaaacaagtgtggctccagcccaggagcctcacagaacacatttcctcctccgccttcggctctgcgtgggctagccccgcgctagggagggcaggcaactaggtcctccgaggtgaggctggggctccgcctgcagagggagtgacagcgcgccgcgagggtccgcgacccaggcaggggtggccgcaccaccccggagcgccgcacagccccgcaggcctcccctcccgcagtgcgtgcctggaacgcggggccgcctggccgagggacgtttacctggagagctttgtgtccacaacactaatccttagacactgcttcgttcagcagctgccgtcagtcgtgagggcactagtgtggggatgggggcgaattcaggagcccgtcgcagagcaatatttaaaaaggggggggggagc

SEQ ID NO: 75524 - DNA, 117 bp, Homo sapiens; identical to SEQ ID NO: 11728
  chr13:112710359-112710476
  hyper

SEQ ID NO: 75525 - DNA, 188 bp, Homo sapiens
  chr13:112710635-112710823
  hyper
cgcaggccaggccggaacgcgggggcgggggcgcgggagggggacccgcggcgggaggcgagagcgagcgaatggggagaggagcggggagcaggaggggacgcaggggagaggggactggggagcggcgagaggaggacgggagacgcggctccacctcccagctcaaaacggcgtcccagctgctc

SEQ ID NO: 75526 - DNA, 470 bp, Homo sapiens; identical to SEQ ID NO: 35102
  chr13:112710824-112711294
  hyper

SEQ ID NO: 75527 - DNA, 1654 bp, Homo sapiens; identical to SEQ ID NO: 35103
  chr13:112711375-112713029
  hyper

SEQ ID NO: 75528 - DNA, 556 bp, Homo sapiens
  chr13:112715163-112715719
  hyper
aagacttagcttaggcgacttctctaaagaactcaaccaaatctgaaaggcacaggcattttctcctcaaaatccgaggctcgagaaccatctcctctggcagggtccagtctcagctccgcctcttgcctcctcacccacttgggcataacttttgcgggtcctagaaatctgggcagcagaagagggaggggaacgctcccagccggcagccgctctgggcgtgcacccgccacgcgaagccagaggttggacgacgcagccggccaggcgcggctcccgggggaccccgaaaccgcctgtggctcaggccctacttggcaagaagagactggggagtgagaggaggggtcactcttgctctctcgcacaatagacttcccgcaggcgagtgcgaacggccttttgcttcctccttcttttccaggacccttagcgacaggagaggaagagaagcggcccggcggtttaattgccaatttcctgatgcagccacagggcccagcagcggctcagcctaggccaccgggtccaggcctctaggcaataggcccgg

SEQ ID NO: 75529 - DNA, 550 bp, Homo sapiens; identical to SEQ ID NO: 35105
  chr13:112715803-112716353
  hyper

SEQ ID NO: 75530 - DNA, 27 bp, Homo sapiens
  chr13:112716607-112716634
  hyper
ttcacccagagagctcggaggcacaca

SEQ ID NO: 75531 - DNA, 27 bp, Homo sapiens
  chr13:112716694-112716721
  hyper
attgtgaatgtgcggctctccacacga

SEQ ID NO: 75532 - DNA, 187 bp, Homo sapiens
  chr13:112717056-112717243
  hyper
atgatggactcagagcgcccagggaccctagagagaggagcactcctcaagagccccctggccatcacccgagcgccctggagcgccatcacccgaacgcgcgctccaggccctcgaacaaggcctctggctgccagagcgagtgaggggcgcagaggcggcagagagcggagagccccggtgtctc

SEQ ID NO: 75533 - DNA, 723 bp, Homo sapiens
  chr13:112717322-112718045
  hyper
cgggccggagccgtgcagccgggcccgctgcctctttgcccctcatggctccgcgcgggaggaaaccgggccttctccgcccgccctcctctcgctgcggtgtccccagcacccccgccccgcccccgcgcggtccccaccgtcgcgctcccctccctcctcgccctcgctccgcgcctcctgttggcagagatggcctcgaaggcctcttccaatttgaatggctctttcttcttctctctcccgcgctttcttttccgccttctcctcctctccttctgactactcttgtctctttcaaaagctccgcctggaaactagcggcttcctcttcatctgcctcctttaactgtggcctcggccctctggggcgacaccagagcgcggaagcctgagcccctcggagatccggggaggcacctacacatggcctcaatcctccaaccggccccagaagccgtaggagctgaacccaggagggcaaccggttgtggtgcggccacatgtccctggagagtgtcagcaagacgggtcgacttcaccaggaccacgaaagacagggcagagtttctgtcttctttcactgtcccgtagaactcctagcttgtccatcgtgctccttgcttgggactcgggactgacactgggccagaaaatccacctctagatgcctcaaagctcgctttcatgctggggggcgggcgggagcggggaagggggaca

SEQ ID NO: 75534 - DNA, 994 bp, Homo sapiens
  chr13:112720033-112721027
  hyper
tgctacttgagactgcgtttgaaaatctctttcacgttcccaaatcaaagccactttgaggtttaagaatgataaccacaggtgaatgccttactctttccacgagccaggcctttcctttgcatgacgcagaccggcggctgagacccgtcctgaggccccgcctttcattcggtttatgtggccccgcgcagttcacgcagttttctccgttcttaggcaaccagctcgtgggaaattcactccagaaaagcgtgcgccatatcattattttgcgattcaacaaactttttcaactgttgttcaggaactagattccagatagatcttgttgtgttcggccttcctagaaattccttttccagaggaagaagatccgggttgggaagagtgcgtgactatggccccgggctcattgaaagactcctccccacaaaagtttagggctgatactaaacgaagctatggagccatgcccacacaaatactccccctttacccgaattgtggggcctggactgtgaaggccttcgctgcaagagcgggcactggcgaacttcagtgcacgccgcggccgagaacggatgcagggcgggggatggctgagccgcctgatccttgcagagaacctgcaggggccctcggagggtatcccctgcgtccaagggagcgcccctccttttcagcactcgggggaactgagggcgacgtgccagccccgcactcaactttccccttccctgcaggcacagagttggccggcgggggcagaggaggagctgggtctccactgcgcccgtttaaacctggccaggggctgcgtttcctccccccaccccacgacgatcctttcttagtcttcgcttttcaacccaatcgttaatcattcggaacgcgcgggcggggagcggcgaggagggcgagctcggggttcgccgccgccgccgccgccgcgcgcgcgcgctcaggaagcggtgtggctgtcaccccctcc

SEQ ID NO: 75535 - DNA, 93 bp, Homo sapiens; identical to SEQ ID NO: 4060
  chr13:112722128-112722221
  hyper

SEQ ID NO: 75536 - DNA, 129 bp, Homo sapiens; identical to SEQ ID NO: 35111
  chr13:112722274-112722403
  hyper

SEQ ID NO: 75537 - DNA, 138 bp, Homo sapiens
  chr13:112722844-112722982
  hyper
gcaccagaactcggccgtggcggcggcggcggcggcggcggccgcgtcgtcgggcgccctgggcgcgctgggctctctggtgaagtcggagcccagcggcagcccgcccgccccagcgcactcgcgggcgccgtgccc

SEQ ID NO: 75538 - DNA, 432 bp, Homo sapiens
  chr13:112723292-112723724
  hyper
gggtgacgcgtgtcccccactcaccttccccggagaccctggcgaccgccgggcgctgacaccagacttgggttttagactgaacttcggtgttttcttgagactttttgtacagtatttatcacctacggaggaagcggaaagcgttttctttgctcgaggggacaaaaaagtcaaaacgaggcgagaggcgaagcccacttttgtataccggccggcgcgctcactttcctccgcgttgcttccggacggcgccgaccgccggagcccaagtgacgcggagctcgtcgcatttgttataaatgtagtaaggcaggtccaagcacttacaagttttttgtagttgttaccgctcttttgggttggtttgttaatttatacaaagagattaccaccaccaccccctccttcagacggcggagttatattctg

SEQ ID NO: 75539 - DNA, 423 bp, Homo sapiens
  chr13:112724172-112724595
  hyper
aagtatcttctgctccggctgtttcactgcggacggctggggctgctgcgcgttaccttgctgcaagcggggcgccttccacctggctgggggtctgcgccacagtttggtccagaggagggaggaggaagggaagaccccagtggtgggaccctggaccaggccatggatgaaggacaaagaccagggcaggtcacgggtttcccaattccccagcaattaagatttcgagcagaatttatctaaatgtgtttcaaggaaacacaatcgctgaaccaaaacgtactgcagccgagccccctccgtccatcctctgcccctccccctggcttctttctcttgggaaaacgggcaaaataattgtgctggattctcacacacacagaaatatcgaccatcaccctcccccgcgtgaactgggat

SEQ ID NO: 75540 - DNA, 190 bp, Homo sapiens
  chr13:112725278-112725468
  hyper
cactacgacttagtccgggataagggcctccccagtcctctccgggagatgatttgggaaattttataatgcttgttctgttaactcaccgggaccttgagggtccaatgggaccttgagggttttctctgaaatatacaaacttaaaggactctctctgaggttctttgactgacgtccactctcagtc

SEQ ID NO: 75541 - DNA, 45 bp, Homo sapiens; identical to SEQ ID NO: 35116
  chr13:112725825-112725870
  hyper

SEQ ID NO: 75542 - DNA, 1 bp, Homo sapiens
  chr13:112726292-112726293
  hyper
c

SEQ ID NO: 75543 - DNA, 294 bp, Homo sapiens; identical to SEQ ID NO: 35117
  chr13:112726435-112726729
  hyper

SEQ ID NO: 75544 - DNA, 380 bp, Homo sapiens
  chr13:112726796-112727176
  hyper
cggggtgcgggcccccagtatccggcggggtggggcggcgtcaggacggagcgagggccggcgggggggctcgcgtggaggcccaggccgggaggtggggacgcagggacccctcacccagtcctctgctcccgcccgagccaggcctcgggatcacctccccttgcctgagggcgagctctcctcctccctcttcctccccgcctcccccgttcttccctccctctctccctcctccctccccggcccttcctctccagctgcgcgcccgccgggaccacgctcctcccgcccccgggagccgagcggcgtctgcggctggtccggacgtgtcccctccgggcgggggtggccgggcctcctcggggcctcgggcctcc

SEQ ID NO: 75545 - DNA, 42 bp, Homo sapiens; identical to SEQ ID NO: 35119
  chr13:112727837-112727879
  hyper

SEQ ID NO: 75546 - DNA, 240 bp, Homo sapiens
  chr13:112727961-112728201
  hyper
cgcaccagcgacccgggcgcggactggggcctgcagggcgtgactggctgccccccaggactccatctccttcataaacacctgccttttccattccccggggccgcttcggctgctcctctggagggaagactggggagaaggttgcctgcgctctctgccccagaggctctgttttagaaactgtttcttaatttccataagaaacaaaaaaatcacaggaaggcctggttcctctcc

SEQ ID NO: 75547 - DNA, 15 bp, Homo sapiens
  chr13:112728335-112728350
  hyper
cgctttctccacccg

SEQ ID NO: 75548 - DNA, 370 bp, Homo sapiens; identical to SEQ ID NO: 35121
  chr13:112758003-112758373
  hyper

SEQ ID NO: 75549 - DNA, 196 bp, Homo sapiens; identical to SEQ ID NO: 1129
  chr13:112758495-112758691
  hyper

SEQ ID NO: 75550 - DNA, 670 bp, Homo sapiens; identical to SEQ ID NO: 35123
  chr13:112759111-112759781
  hyper

SEQ ID NO: 75551 - DNA, 438 bp, Homo sapiens
  chr13:112760006-112760444
  hyper
cggggcctgggggggcccaggcgccggaggagccgtcggtgccggaatgcagcgtgtttcacttgggagaaacgttgccctcggtcccttgcctccctcctgttgtctcggtttttctggcttcgtccttcgtcccacccacccgttcccacctcaggtccctcccccaggatcccctccttaaggatccaggtctctgaaaattattggcaacagttacacgccccacgattgaaatccacaagagaagagtcccagttctgcaggccgctccagggctaggggtagagatggtggcaggtggtgcgtcaactctctagggaagaggaacttgcattacaaagacttgtctttctgagctgaagtcaaaacgggggcgtcaagcgcgctccgtttggcggcggtggaggggccgcgcgcccgcgctgtcccagccgg

SEQ ID NO: 75552 - DNA, 527 bp, Homo sapiens
  chr13:112760850-112761377
  hyper
ggccaaggctctccccgcgttttcttctcgtgacctggggaatgtcccgccccatcgctcacctggctcttgtcatctcgctcatcttgaagtgacccgtggacaatgctgctccctgccgcagctccgccggtcactcaggcagaacggggtatgcaaatggcctggagaggccgaggccgaacactgcgcccattgtcccgggcgctcaaagcgccgagcagctgcgcagactttctgggctcggaccctcggccgccacgctaatgtcatcattgcaaaacatcagattttgagaactatgcagtctgaattcattagcagccttctcggcgaaggttcttttccccgtgacaagtttcaaagtccagaccccctccaacgttggtaggggtaggaagaggaggaggggcccagggaggggggtctttcgcaagtggggcctcgggggatccctgctctccttctggtgcattccgcaactttaaaagccttccttggggttctgagcgcggatgtctgacttg

SEQ ID NO: 75553 - DNA, 30 bp, Homo sapiens; identical to SEQ ID NO: 43865
  chr13:112800543-112800573
  hypo

SEQ ID NO: 75554 - DNA, 30 bp, Homo sapiens
  chr13:112805073-112805103
  hypo
cccccccacagcaagcgcacacacacaccc

SEQ ID NO: 75555 - DNA, 41 bp, Homo sapiens; identical to SEQ ID NO: 43866
  chr13:112830483-112830524
  hypo

SEQ ID NO: 75556 - DNA, 30 bp, Homo sapiens
  chr13:112846818-112846848
  hypo
gcatcctttctgtgacggcatcctttctgt

SEQ ID NO: 75557 - DNA, 212 bp, Homo sapiens
  chr13:112882188-112882400
  hypo
tcatctccacacatgcggtcacccaaggagctgagatctcgagaaactttatccttcacaaacacagatgcacaaaaaggacatctcttcatttacggaggaagtttcagtgtttctgtgtacacacacacacacagacacacacacacagacacacaatgcttacacacaaattcaaggttatgatcacgcactttcgtggagtcaaattt

SEQ ID NO: 75558 - DNA, 20 bp, Homo sapiens
  chr13:112882956-112882976
  hypo
ttttttcttttgagacgcag

SEQ ID NO: 75559 - DNA, 222 bp, Homo sapiens
  chr13:112895421-112895643
  hypo
cagaaacggcgagggcgtcctcggccgtgcacacgccatcaacacgcaagccgctgctgagagccccggtgctgtccttcatcctggaaagcctttcctaaccggagacttccaaattgaaaatcgcaacgctctgttgaagagaagacagagcccgttcttaggcattacaaaaattatccaacctacttttaacatcaaactcagcgaaccagcccagaa

SEQ ID NO: 75560 - DNA, 36 bp, Homo sapiens
  chr13:112899548-112899584
  hypo
catcagccacgacgacgacgacgactgatccatgag

SEQ ID NO: 75561 - DNA, 34 bp, Homo sapiens
  chr13:112906409-112906443
  hypo
gcgagcggtggagcacgtgcgggtgcaagcctta

SEQ ID NO: 75562 - DNA, 30 bp, Homo sapiens
  chr13:112910078-112910108
  hypo
ccccagcacaagccccgtgcccatagagga

SEQ ID NO: 75563 - DNA, 77 bp, Homo sapiens
  chr13:112998058-112998135
  hypo
gtaaatggtggctgccgcatgctggccgccccccaaacagccccagcgcggcgtgtcctcgccgtcaccctcctctc

SEQ ID NO: 75564 - DNA, 30 bp, Homo sapiens
  chr13:113013574-113013604
  hypo
gcaagaagctaatcccgcactgtagggcta

SEQ ID NO: 75565 - DNA, 30 bp, Homo sapiens
  chr13:113050319-113050349
  hypo
ggtggctcggccccccgcctctctttggcc

SEQ ID NO: 75566 - DNA, 42 bp, Homo sapiens; identical to SEQ ID NO: 43869
  chr13:113099281-113099323
  hypo

SEQ ID NO: 75567 - DNA, 95 bp, Homo sapiens
  chr13:113107030-113107125
  hypo
actcctggcagcagacggaagggcggctgccgggccctcagacccaggacgggcaccacgctggagctcagccatcccggcggtggcatcacaga

SEQ ID NO: 75568 - DNA, 294 bp, Homo sapiens
  chr13:113107711-113108005
  hypo
agccccgcctgacgccgcggtcgcttgacttcacaatcacaggagcgtgacgcctacagcctaatgttgccgtgtagggcacagacttcttaaaaagaatcttcaggggatgtcgccaggtgatggcgggaatcctcagtgagagggtgaggccaccggggctgctgtgtccgcagatgtggtgccacctccgagggcctccaagggtgcatgtgagccacagtcaccaccacagtgcgccgacgaccgccacagaaacagccacggcaccgcgaggaccgtcctgcaccacaa

SEQ ID NO: 75569 - DNA, 30 bp, Homo sapiens
  chr13:113108949-113108979
  hypo
ctctcggaagcgaggcgagcctccatcccc

SEQ ID NO: 75570 - DNA, 34 bp, Homo sapiens
  chr13:113119848-113119882
  hypo
agccgccagaacccacgagcggctggtgagaatg

SEQ ID NO: 75571 - DNA, 30 bp, Homo sapiens
  chr13:113132528-113132558
  hypo
gccttgatctaaagccggcaattgaaatta

SEQ ID NO: 75572 - DNA, 59 bp, Homo sapiens
  chr13:113160568-113160627
  hypo
gctccaaagggccctcgtccacatccatgcaccgcccagcgactcgcaagggagcacac

SEQ ID NO: 75573 - DNA, 218 bp, Homo sapiens
  chr13:113269889-113270107
  hypo
atggaccttggcagccggagggagccctcaggaaggagcccaggtacttgcagcagtggccctcagtgggtgtgcccggggcaaggcggggcagtgcgggcaggctcagcacagaacctcaccactctcatgtgattcatccatttgactctgagctccctgagggtggaggccatgctttattaatacctatatcccagcatcgatatattgccatt

SEQ ID NO: 75574 - DNA, 49 bp, Homo sapiens
  chr13:113285488-113285537
  hypo
gagacagaagaaagacgaggaaagtgcaccaactcgtttttggaaccag

SEQ ID NO: 75575 - DNA, 30 bp, Homo sapiens; identical to SEQ ID NO: 43871
  chr13:113319347-113319377
  hypo

SEQ ID NO: 75576 - DNA, 245 bp, Homo sapiens
  chr13:113350398-113350643
  hypo
tggttgccccctgtacgcttggtgccccatctgcaaggtggggactatgatggtgcccacctggtgggtctgtgcagtgacgggacaggtcacggcgctcgtgcacgctgggtgcccagtgcacggggcgtctttgttgcgcgcatggacctgcggctgcatcaccgtccatgcttctgggcttcttaaggagaccgcctctcaccttgggctttccggaaccttctccccgcactcctcttcac

SEQ ID NO: 75577 - DNA, 36 bp, Homo sapiens
  chr13:113368582-113368618
  hypo
ccgattagcacctcccgctgccgctccagctgtgtt

SEQ ID NO: 75578 - DNA, 30 bp, Homo sapiens
  chr13:113396823-113396853
  hypo
atttcaggcactggacgaccaaaagtgaga

SEQ ID NO: 75579 - DNA, 333 bp, Homo sapiens
  chr13:113400400-113400733
  hypo
tgatggactcttgggcgtctgccgtaggccgctgtgaatgctggcggcggtgatcgtgtgctgacgtctcctccacgtactgagttcgtgtcttttggatgcgcgcccagaggtggcactgctggatcctgtgctgggtcatacctatgtttaattctctgaggaacctccgtgctgtctccatagcagccgtgtcgtttcacacttgcaccaacagtgcacagggctccggttccccacgtcctcaccgggtaactggggttccggctccccacgtcctccccgggtaactggggttccggttccccacgtcctcaccgggtaactggggtt

SEQ ID NO: 75580 - DNA, 39 bp, Homo sapiens; identical to SEQ ID NO: 43873
  chr13:113401430-113401469
  hypo

SEQ ID NO: 75581 - DNA, 30 bp, Homo sapiens
  chr13:113424191-113424221
  hypo
ctgtaaatggacacacgttagccacagctg

SEQ ID NO: 75582 - DNA, 52 bp, Homo sapiens
  chr13:113424883-113424935
  hypo
accctgcttacatgccgggacgaaggtgggagagaaccgtgcatctcagcac

SEQ ID NO: 75583 - DNA, 30 bp, Homo sapiens
  chr13:113505580-113505610
  hypo
gccgacggcccagggcgtgtgagggcgagt

SEQ ID NO: 75584 - DNA, 30 bp, Homo sapiens
  chr13:113542925-113542955
  hypo
accacacaggccacccgaggcccccacagc

SEQ ID NO: 75585 - DNA, 30 bp, Homo sapiens
  chr13:113545760-113545790
  hypo
ttggggtcacaggcacgggcaccacagctt

SEQ ID NO: 75586 - DNA, 156 bp, Homo sapiens
  chr13:113546374-113546530
  hypo
ggccagctccatgcccgtccacggtgtgcaggtggaggcatctttcagggtatcaggtgggaatccgtgcttcctggcaaagtctgttccagtgtggtgcccactgtccatgcgcctgtgggtgtgagcctgcaccctgcacgaatgtgtggagcg

SEQ ID NO: 75587 - DNA, 167 bp, Homo sapiens
  chr13:113547082-113547249
  hyper
tgcagggtttctgcacgctggggagggcaggttccccagtggagccactccctgcgggtctgagtggggcccggggtctctgcacggtcaccgatgctgctgctgctccagggagcgggcttgcaggagcaaggatccagtccctgaacgcacgtgctccccccggg

SEQ ID NO: 75588 - DNA, 30 bp, Homo sapiens
  chr13:113552672-113552702
  hypo
cgtgtttgttttgttcgcttggaacctgtg

SEQ ID NO: 75589 - DNA, 30 bp, Homo sapiens
  chr13:113552957-113552987
  hypo
cctccatttgctattcggctgcctgtgtca

SEQ ID NO: 75590 - DNA, 190 bp, Homo sapiens
  chr13:113566241-113566431
  hypo
gctaggtggccaatccgccaagaataggaatgagatgaactttgaattctttttaaaaagaaaaaacaatgtcttcattgagtaagttctaccccaccctcaccaagagtcacgtggctggggaggtggccgtgcatgtggcccaagtcccttgttctgtgaagtttcccatccccgggcccagcagtca

SEQ ID NO: 75591 - DNA, 30 bp, Homo sapiens
  chr13:113568768-113568798
  hypo
atacatgcccttcagcgtgtgtactggtgt

SEQ ID NO: 75592 - DNA, 309 bp, Homo sapiens
  chr13:113598542-113598851
  hypo
gtgaggggagggtcccgggccatgaagggagggtcccgggtgaagagcaagctcatgaccctcatttactgggaatccattgctctggccccgtcatgagtggggttcgcagactgggccaatccctacagcgtatgtgtgctctggtgtctcggggcagcacagacgttgttactgctccatctggcctgggtgaacacctgggtctctctgtggagttgggggatgccgcctgctcaagggtcgcgttcctagtatgcgttccaggaatgctatgcaccaccagtgctaagccgcagaagagctgtc

SEQ ID NO: 75593 - DNA, 51 bp, Homo sapiens
  chr13:113608271-113608322
  hypo
tctctgtgtggccaacggaactgtctgctctgagaacgctgtggcatgctg

SEQ ID NO: 75594 - DNA, 64 bp, Homo sapiens
  chr13:113623284-113623348
  hyper
acacttccaggtgaccgcggcggtgacccgcggggctcccaggtgacctcgttggtgagccccg

SEQ ID NO: 75595 - DNA, 290 bp, Homo sapiens
  chr13:113648342-113648632
  hypo
ccgaccctccgccttcgtctttttcctgattaaaaaaaagcaccttcatgcggggtgcggcgcttgggaccccccaagctgacgtcactgtctgtgccggtgtctcgggcaggggcaggtgtggatgccaagctgacgtcactgtgccagtgtctcgggcaggggcgtggctgccaacggggcacggtgcgtgggatgccaagctgacatcactatgcaggtgtctcgggcaggggctggcgtggctgtcggcgtgacggggcgcggcgcgtgggacgccaagctgacgt

SEQ ID NO: 75596 - DNA, 38 bp, Homo sapiens
  chr13:113678958-113678996
  hypo
tgggcgggggcaggacggaagcccggttatcaccttcc

SEQ ID NO: 75597 - DNA, 148 bp, Homo sapiens
  chr13:113718501-113718649
  hypo
cagcatccaggcagacgtggtcctctctgtgctgctgggtgttctgctgatggggcagctcttttgggagccaacaataatcccaaacactaccacgcattccctttctcctccaggtcataatgctgagctccgtaccagacttaca

SEQ ID NO: 75598 - DNA, 104 bp, Homo sapiens
  chr13:113719085-113719189
  hypo
tcaaggagggcaggacgctatgggagggcgttcaccgtctttgcgtcagccggtctcacctgatgggtctgtgtgggaacggtttccgccggtgtctgctttca

SEQ ID NO: 75599 - DNA, 19 bp, Homo sapiens
  chr13:113763577-113763596
  hypo
ggagcgtgggtgtcgggga

SEQ ID NO: 75600 - DNA, 127 bp, Homo sapiens
  chr13:113775919-113776046
  hypo
aaacatgcctagaggcgatgtcagagggtggagaccaggagaggcaggagtcagacatctggtgccaccaggaaggcccttctcagaggaccaggctgtgcgtggtgcccgccgtgggaggccagcc

SEQ ID NO: 75601 - DNA, 30 bp, Homo sapiens
  chr13:113797930-113797960
  hypo
tccattgttcacaggcggtcacctgagggg

SEQ ID NO: 75602 - DNA, 30 bp, Homo sapiens
  chr13:113825962-113825992
  hypo
gcacatgcggtatgacgcggacgcggggga

SEQ ID NO: 75603 - DNA, 30 bp, Homo sapiens
  chr13:113848551-113848581
  hypo
ggagtgaggcagtgacggtcagagttctgt

SEQ ID NO: 75604 - DNA, 50 bp, Homo sapiens
  chr13:113984359-113984409
  hypo
atggaaacccgggtgcgtgcatggaaacccgggtgcgtgcatggaaaccc

SEQ ID NO: 75605 - DNA, 503 bp, Homo sapiens
  chr13:113985469-113985972
  hypo
tgtgtgcatggaaaccggtcgcagctctcctgtgaagaagcacctgcccagccccggcttccatccagataggaggaatccacctcttcccaacagacatggtctttgctcctcatctgagccacaggattgaccatggcagagaccaggtgcatgacctgggggttgggggctcaggggcggctgctaccaggatggccttgcctctgtgagtgaccacagctgcggggctgggataccaggaggcacgggctgcagcatgggaggcggcccaggaggagatgccaagaaggcacagcaaggacagccagtgcaggagccacccgggtgcccacccagcagctgcgcacccccactgcccgagccagcctctctgcatctcttttcctgagaagacttcggcgtggcacagcccttacagggcgtgagccttctcagacgcagctcaggttacagcaaggaagctgcaaggctggttttgctgtttggtttacttttttttt

SEQ ID NO: 75606 - DNA, 129 bp, Homo sapiens
  chr13:114017816-114017945
  hyper
gcatggatcgagttttgatccatcccgatatggctccctgctgggagggacgggtctccttcgcgtccgacccgccggcccatctcaaagcgggaaaaccggtccctgcggctgccctagctcggagcc

SEQ ID NO: 75607 - DNA, 111 bp, Homo sapiens
  chr13:114018219-114018330
  hyper
tcgatcctgcaaaaccgagagaaggaggccggcgtccccgaagtttcctctggggggtcgcgggcccgcgcggggaccgcagccgccggggacgcccgcaccccgcgccac

SEQ ID NO: 75608 - DNA, 33 bp, Homo sapiens
  chr13:114019204-114019237
  hypo
tgaattttgctctggcgacgtggcaaaggggag

SEQ ID NO: 75609 - DNA, 38 bp, Homo sapiens
  chr13:114028380-114028418
  hypo
cggcagcttcacactcgtacaggcgccttgtggtccct

SEQ ID NO: 75610 - DNA, 211 bp, Homo sapiens
  chr13:114055940-114056151
  hypo
ccccgggggccctgtcgggggagctgtggggaccggccccccagagctcagcacagcccggccctccttccagacaccagcactcgcatgtcccagcaggtgagggtgggtcaaacctgctggatctgaagttaattgttcgactggaaggaaacctgtgcgctccccggagcatgacgccacgccgcctccttggcgctgcagagccaaa

SEQ ID NO: 75611 - DNA, 36 bp, Homo sapiens
  chr13:114056508-114056544
  hypo
agccgtgtggcctcacgggtccgggtttcagaggcc

SEQ ID NO: 75612 - DNA, 30 bp, Homo sapiens; identical to SEQ ID NO: 43882
  chr13:114059583-114059613
  hypo

SEQ ID NO: 75613 - DNA, 479 bp, Homo sapiens; identical to SEQ ID NO: 43883
  chr13:114059986-114060465
  hypo

SEQ ID NO: 75614 - DNA, 146 bp, Homo sapiens
  chr13:114060775-114060921
  hypo
ctgggacactgtggtcggcgcccacagcccctcttgctgctgccagacgcggagctgcccgtggcccctgcggcgaagaggcgctgagtcccgcctgcatccctgaaagcttgctcagttccactggggctcggtgaccccttctg

SEQ ID NO: 75615 - DNA, 113 bp, Homo sapiens
  chr13:114064741-114064854
  hypo
aaccactgaggcagacggcgctccttccaaacctgccaaggatgagacatttacacgaaaactaaactcggaacctgctgcaaggccacagtgtgctgcgagctgggacgact

SEQ ID NO: 75616 - DNA, 727 bp, Homo sapiens
  chr13:114074574-114075301
  hypo
gccagcttttgtttacgatgcttgtggattttgtgtttgtgtgttttaatctataatcagtttgtaaatagactcactttctgattctcacggaggggtttgatttgcggatggagaccgagtccaccctgtttgaatgcagccgcgccctgctcatgcgagctggccttctcttccatacagcagggtggagagggaagcccactttccggtaagcgggcaaaacaggtactacgaccgtgttacttatgctagcaacagttccgacttaccttaattgggtttcttttcctgaaaggtaattctcagttaatttccccacacccacgggtgctgggaccacactccatggacgtgtgtgacgtgaggcccttcgcccccgtgtgcctgtctctctggttcttctgacttaaagcaccagtagcagcacagttagtccagttattcggaagctcagcacggagccacattgctgcagcatagaaggccacggattcctccatcagcatggactacacttcccacaaaacgaacggggcatctctatggaaaaagcaaagcgtgtccctatccctgggacacctctacccctgggacacacctagccccaggacccgcccacccccgggacccgctcaccccgggacaccactacccctgggacatgcccacccctgggacaaccctaccccccccgacacgccctgggacacgcccaccccccagg

SEQ ID NO: 75617 - DNA, 30 bp, Homo sapiens
  chr13:114080589-114080619
  hypo
ctcctgcctgccttacggtgagcacccctg

SEQ ID NO: 75618 - DNA, 75 bp, Homo sapiens
  chr13:114103353-114103428
  hypo
gcaacatgggcttgtcgtttcagggccatggatgccacctctcctatgtgtcttgtagagcgctagacacggcta

SEQ ID NO: 75619 - DNA, 59 bp, Homo sapiens
  chr13:114108109-114108168
  hypo
gcagatgtgtgcaggcgtgcctgtcactgccgcccgctgcggggcgtgccctcacccct

SEQ ID NO: 75620 - DNA, 30 bp, Homo sapiens
  chr13:114115112-114115142
  hypo
ctgagaggagcttcccgtgactgccaagaa

SEQ ID NO: 75621 - DNA, 374 bp, Homo sapiens
  chr13:114122901-114123275
  hypo
acgcgagacgtgccacgctccatcaacctctccttcagacaagcggcctatgaggacgcagcactaaagggggcgggggagggccctggacaggcggggcggaggcagcacagtgtgtaaccttccctgaatctgcgcataaaagcagatgcagcaattagaaagcaaagccaaacacccagaggcaacatttaccataaatttaggtgagaaagtatcaccacaaacccaagttgtaagctaggggatgagccactgccagcaacaggacccgtgtgttgccgtcatgccggggacgtggggggcacagggcctctgacagatgtgagaacaggagggcctcagaggtgcctacacgccgggaccaggtaagg

SEQ ID NO: 75622 - DNA, 22 bp, Homo sapiens
  chr13:114123716-114123738
  hypo
tgaaaccatggctcacgcctgt

SEQ ID NO: 75623 - DNA, 86 bp, Homo sapiens; identical to SEQ ID NO: 15788
  chr13:114188403-114188489
  hypo

SEQ ID NO: 75624 - DNA, 221 bp, Homo sapiens
  chr13:114189411-114189632
  hypo
tgtgatgataaaaagcgccataaacactaatatcaaaccatgctactctgtcttaaattttcaaatagctttgcacctgaaatacaaaattaagtttggaaaaacagtttttaactgtgttgctcacaagctaattaactgtataagttctgccatgtgaaaggttaaaaaataaagttcattttggaaagtgggcttctgcttaccgagacgacagtctt

SEQ ID NO: 75625 - DNA, 30 bp, Homo sapiens
  chr13:114190112-114190142
  hypo
ggcactcgctgtcttcgctgtgtctgtatc

SEQ ID NO: 75626 - DNA, 30 bp, Homo sapiens
  chr13:114191082-114191112
  hypo
gctgctgcccattctcgtgtttctggaagg

SEQ ID NO: 75627 - DNA, 30 bp, Homo sapiens
  chr13:114202484-114202514
  hypo
cctttccctacttgacgtgttattcaggga

SEQ ID NO: 75628 - DNA, 39 bp, Homo sapiens
  chr13:114202814-114202853
  hypo
actctgggtttgagtcgggtgtggcgaaggcggctcggc

SEQ ID NO: 75629 - DNA, 177 bp, Homo sapiens
  chr13:114203823-114204000
  hypo
cccagaccggagagacggtccagcctctgatggctcggagatgatggaccgtggaagggaagcgtctgtggggagtgagcgcttagatggccagcagctgctccttctgggaagctcgcaccttggcaacagaacagccctctagcagagcgtcagtgcagtcgtgttatcccggct

SEQ ID NO: 75630 - DNA, 30 bp, Homo sapiens
  chr13:114212474-114212504
  hypo
ctggttcccagtgggcgggggaaacataag

SEQ ID NO: 75631 - DNA, 79 bp, Homo sapiens
  chr13:114220555-114220634
  hypo
ttctaggtctggggccggggcgggcgacagcggggctcggagccaccgccacagccctgcccgacgtaggtaattcacc

SEQ ID NO: 75632 - DNA, 33 bp, Homo sapiens
  chr13:114221622-114221655
  hypo
taaaccaccagtttccgacttctgtactaaaac

SEQ ID NO: 75633 - DNA, 78 bp, Homo sapiens
  chr13:114271924-114272002
  hypo
cttcacctgcagagccgctcacctgcagagccgctcacctgcagagccgctcacctgcagagccgctcacctgcagag

SEQ ID NO: 75634 - DNA, 30 bp, Homo sapiens
  chr13:114283331-114283361
  hypo
gcaaagcctctgtctcgttcctgggagggc

SEQ ID NO: 75635 - DNA, 30 bp, Homo sapiens; identical to SEQ ID NO: 43894
  chr13:114285192-114285222
  hypo

SEQ ID NO: 75636 - DNA, 30 bp, Homo sapiens; identical to SEQ ID NO: 43895
  chr13:114285597-114285627
  hypo

SEQ ID NO: 75637 - DNA, 76 bp, Homo sapiens
  chr13:114302276-114302352
  hypo
ccctcccacaggtaccgtgtcttctgtgctggtgtcgcacccgccggccaccgccaccctgcgtcttagacgtccc

SEQ ID NO: 75638 - DNA, 374 bp, Homo sapiens
  chr13:114304719-114305093
  hypo
cctgggctttcttcccgtaataagggaagtagtgcagactgaaggtgccgttgggagggtagtacttgacctgcagcggctggccgagctcgcggggctggtcctggggaggagaggccactgcctgagtcaggcgggagctggtgtgtgccggtgtctgtgtgttgcgtttgtgtgcgtgtgtgcacacacgcgctgtgtaggtgcttgcataaacactttattgcatacttagcataaatcagatgcaatctttctaatcagtgctgagatctcagcaaggatatgatttgttagcatgcaaaatgcccagtgacccctccgtgtgcctctaacaacttgaaatgttggaaggatgacgcaggtgggtgaag

SEQ ID NO: 75639 - DNA, 30 bp, Homo sapiens
  chr13:114305730-114305760
  hypo
agcgtgctgctgacacgctactcagatgct

SEQ ID NO: 75640 - DNA, 91 bp, Homo sapiens
  chr13:114312311-114312402
  hypo
ctccatgcacccagccggcccgccccccgcacgtaccccacctggacagggtgcggcccagcatctgccccgtgtccgggttccagcagta

SEQ ID NO: 75641 - DNA, 40 bp, Homo sapiens
  chr13:114318203-114318243
  hypo
ttcttcaaaactaaacgtgcaattacgacacttttaggca

SEQ ID NO: 75642 - DNA, 30 bp, Homo sapiens
  chr13:114323035-114323065
  hypo
gggcagcggctgtgccgggtgtggacgtga

SEQ ID NO: 75643 - DNA, 30 bp, Homo sapiens; identical to SEQ ID NO: 43899
  chr13:114426896-114426926
  hypo

SEQ ID NO: 75644 - DNA, 30 bp, Homo sapiens
  chr13:114438068-114438098
  hypo
ctccaaaactgtctacgcaaaggatattca

SEQ ID NO: 75645 - DNA, 30 bp, Homo sapiens
  chr13:114438450-114438480
  hypo
cccaggtccccatcacgccatctccttgcg

SEQ ID NO: 75646 - DNA, 136 bp, Homo sapiens
  chr13:114450586-114450722
  hypo
aggctgggccctgtgcgaatcctctgggcacagaatccgccgggcacagattccgctgggcacagaatctgccagacacagaatctgccaggcacagactcggcgattctcccctggagcccggccttgccccatg

SEQ ID NO: 75647 - DNA, 38 bp, Homo sapiens
  chr13:114454880-114454918
  hypo
cagttgtgccagctccgtggctgaggaggcggtttctt

SEQ ID NO: 75648 - DNA, 97 bp, Homo sapiens
  chr13:114462710-114462807
  hyper
cttcgtttggaagagcgaggtagccttttcctgtttgaacgtgcagaggcgctcacagaactggacagtgttgcttggtttcggctcgcccctctct

SEQ ID NO: 75649 - DNA, 132 bp, Homo sapiens; identical to SEQ ID NO: 35127
  chr13:114462866-114462998
  hyper

SEQ ID NO: 75650 - DNA, 153 bp, Homo sapiens
  chr13:114466991-114467144
  hypo
cgggtgcctgggcctcggtcacttgaggggagtgtcctccccatccaaagacaagaaaggacgtgctccatgcacacaggaaggcaggtgtggcctggggtgggatgggccggggcgtgggcgtgggacacggggacacgggttggggctggg

SEQ ID NO: 75651 - DNA, 70 bp, Homo sapiens
  chr13:114478858-114478928
  hypo
accatgggacccctgcggccccacaggtggcttgagtcagacttttccaggtgcacgtggcctgtggcat

SEQ ID NO: 75652 - DNA, 68 bp, Homo sapiens
  chr13:114479383-114479451
  hypo
cgcacctctcttctgcgggcggcacctgcttcctgtcgtcctcccgacagctacgtccagcccagaca

SEQ ID NO: 75653 - DNA, 132 bp, Homo sapiens
  chr13:114492908-114493040
  hypo
taacactgaactgaccgggcatgtggacatcctagcgctggactgactgggcacgtggacatcctagcactggactgactgggcacctgaacatcctagcgctggactgactgggcacgtggacatcctagt

SEQ ID NO: 75654 - DNA, 30 bp, Homo sapiens
  chr13:114494463-114494493
  hypo
ctgtgggagcgacgtcgtgtggacagatgt

SEQ ID NO: 75655 - DNA, 30 bp, Homo sapiens
  chr13:114495640-114495670
  hypo
ccatgcgatgggctccgtcattatttagtc

SEQ ID NO: 75656 - DNA, 30 bp, Homo sapiens; identical to SEQ ID NO: 43903
  chr13:114497409-114497439
  hypo

SEQ ID NO: 75657 - DNA, 516 bp, Homo sapiens
  chr13:114497813-114498329
  hypo
ttagggttgggcacacgccctgccgtctggggttgcttctcagaggcgcgtgccgagggcccggggatggcaacgcccttccgtgcagaaggcgcctgggtgggtcttgcggaatagacgcgtgaggacgacccgcagggtggagtccggcctggccagggctggaagtcataggacgaaaggtagaggtgagaagaggcagttctgtgaaagaagccccgacctcgagctgggactttgaattggtttgcgtttgaaaaccggggttggtaaaagctgggcacccacacctctccttctgttgcagctggtggcagcgatcgtgtttatcagttttggcgtggtggccgccttctgctgcgccatcgtggacggcgtatttgcagcacagcacattgtgagtacattgtcattgtgtgcacagtcgctttccggggctgaaagagtcgacgtgaaaaaagtacaatttcattttgcagatctcagctcagacggcttcaccgtcagtctccacgc

SEQ ID NO: 75658 - DNA, 38 bp, Homo sapiens
  chr13:114499931-114499969
  hypo
acacacacactcccacggaggtgcgtcatgggagcttt

SEQ ID NO: 75659 - DNA, 30 bp, Homo sapiens
  chr13:114502300-114502330
  hypo
tgtttctctaggaaccgaggcccctcacca

SEQ ID NO: 75660 - DNA, 175 bp, Homo sapiens; identical to SEQ ID NO: 43905
  chr13:114502787-114502962
  hypo

SEQ ID NO: 75661 - DNA, 185 bp, Homo sapiens
  chr13:114506372-114506557
  hypo
acattccaagctggacgtgcccttcgtagacgagggcaaattacttgtgatgggtgcgtgggaggcacttaacgtgccggcaagggcgggcggctgagccagcctctcaggggcctcctccgcgtgtgactccgtggcccccgtgttctctgctttctgtgcactcgccccggccccatcctcag

SEQ ID NO: 75662 - DNA, 30 bp, Homo sapiens
  chr13:114507314-114507344
  hypo
cgagagccatcagcccggtgctgagagggc

SEQ ID NO: 75663 - DNA, 30 bp, Homo sapiens
  chr13:114508713-114508743
  hypo
acaacccaaactctccggacgtgtcccgtg

SEQ ID NO: 75664 - DNA, 48 bp, Homo sapiens
  chr13:114515287-114515335
  hypo
tgtgtcctggagaagcgcagggcagaagccacccgcccctcgtgctgt

SEQ ID NO: 75665 - DNA, 252 bp, Homo sapiens
  chr13:114515648-114515900
  hypo
accagcttagctccccgcgggcccagcatgcacctgccgggcacacctggggagacgggtgagcacgcctgggaagcagcaggtcccgggtgggtcacaggccccgggtgggtcacaggacaggtctcaggtgggtcacaggtcctgagtgggtcacaggtcccgggtgggtcacaggcatcccgggtgggtcacaggtcccgagtgggtcacaggccccgggtgagtcacaggccccgggtgagtcacggg

SEQ ID NO: 75666 - DNA, 30 bp, Homo sapiens
  chr13:114517682-114517712
  hypo
cccctctctgggctccgctggggccttctg

SEQ ID NO: 75667 - DNA, 30 bp, Homo sapiens
  chr13:114524666-114524696
  hypo
ctgaagatgcaggttcgtggggcctgactc

SEQ ID NO: 75668 - DNA, 142 bp, Homo sapiens
  chr13:114526487-114526629
  hypo
aggttgattcagtcccgacgtccagaggggtccgcactgcaatgaaagcggtgcattatagggtggtatgcacggtggagaggccacagtgaggtcggagcagggcctcgagagatgcagtcccagccggggtgggaagctg

SEQ ID NO: 75669 - DNA, 36 bp, Homo sapiens
  chr13:114531771-114531807
  hypo
gagccaagagggtcccgacctcggggaggccacctg

SEQ ID NO: 75670 - DNA, 30 bp, Homo sapiens
  chr13:114601611-114601641
  hypo
gtgctcccattccatcgcacctgaatgagg

SEQ ID NO: 75671 - DNA, 154 bp, Homo sapiens; identical to SEQ ID NO: 43908
  chr13:114742788-114742942
  hypo

SEQ ID NO: 75672 - DNA, 69 bp, Homo sapiens
  chr13:114744097-114744166
  hypo
ctctccccacccacacggcgccaggacgaaaccctgatgtggccggggctccggcgagggctttccggg

SEQ ID NO: 75673 - DNA, 50 bp, Homo sapiens
  chr13:114744515-114744565
  hypo
cagcctgtactgagccgaacagaaaatccccggcacgctgtctcctccag

SEQ ID NO: 75674 - DNA, 77 bp, Homo sapiens; identical to SEQ ID NO: 43909
  chr13:114746775-114746852
  hypo

SEQ ID NO: 75675 - DNA, 812 bp, Homo sapiens
  chr13:114748324-114749136
  hypo
agccacagagcccagcgtcacacgcaccgtgcacgcaagacagacgtgcacgagactgacgcacacacggccggaggtgcatgtcacagtcgactagacgggccgtggctccctgaggctggctgtggtgtggctagggcacagcccacacttcctgatccttcagctgatccccagatccccacaaacaaggagcaaaaagcacagaatcaaatgacgacacgttccacagggccaggtgggctttctgcggagggcgtggcggtggtggcagcggttctgggagagggaaaccccagcgccacttgtctatgggccgggacggcgtgcatctcactttgccggctctgcgctcttccttctcttctccctcccaaaggctgcggctttgcatgggcagcttgctggcgccactgggcgcgtcccgcagactttaaatggaatgagtggaggtctcggactgctgccggatgtagttctggaagctcttgtctccgatggggtgctccctgaaaagggggatgggagagggaatgaggcacagaccccgttgcctggtgctcacccgtggctgcgggagcttttcctgttcctaaatgtgacacactcacactgcaatccacacaaaaaatagaggagccaaaggaaccacagtgcccccggaagcacccacggtgactctgatgtgtgtgcacaggtgggtcaggcgtgcaagtacatgtgcacgtgtgctctccctgtggcacgtgtgtagcgcatatacatgtgcagatgtggaatatgtagagtgtatggcacgtgtgcagaatgtg

SEQ ID NO: 75676 - DNA, 32 bp, Homo sapiens; identical to SEQ ID NO: 43911
  chr13:114749950-114749982
  hypo

SEQ ID NO: 75677 - DNA, 30 bp, Homo sapiens
  chr13:114750396-114750426
  hypo
gcccctgaatgagcccgtgtgggggcttct

SEQ ID NO: 75678 - DNA, 78 bp, Homo sapiens
  chr13:114750975-114751053
  hypo
acacctgagcacgggcggccccacccgggagctccctgcagccccacccccactgcaatctcccgcccactacactgg

SEQ ID NO: 75679 - DNA, 30 bp, Homo sapiens; identical to SEQ ID NO: 43912
  chr13:114751360-114751390
  hypo

SEQ ID NO: 75680 - DNA, 39 bp, Homo sapiens
  chr13:114755827-114755866
  hypo
gctggagctgtgatgcggggcgcacggcctaggaggagc

SEQ ID NO: 75681 - DNA, 30 bp, Homo sapiens
  chr13:114758007-114758037
  hypo
atacgctccgtctcacggtccccatcaatg

SEQ ID NO: 75682 - DNA, 111 bp, Homo sapiens
  chr13:114760934-114761045
  hypo
tatgcgaaagcatcacgtggccacaacaacagcgaggtgcatctcacggagcataaccagggggaccgccaggcacccaggcctcctccttaggaccggcagatatgaccc

SEQ ID NO: 75683 - DNA, 197 bp, Homo sapiens
  chr13:114762623-114762820
  hypo
tcagcccaggtggcccggcctgctcagctccttccccaactgaccagcccaggattcttcctcctcctcccagctggggttagggggctgcttcctcttgaagcgtctcggggcagcaacaacctttaccatttattactcattcaacaaacatgactgagcaccagcactctcctatgtcccggagacaaagcctg

SEQ ID NO: 75684 - DNA, 193 bp, Homo sapiens
  chr13:114765044-114765237
  hypo
ggggccccacactcacgtttttcattttgaaagactcctcctccagcttctccactgccaggatgttctcgatgggaatgctgtagagaggctggtcccctgcagcagagatggactgtcagtgggtgcgggccccgctgtcccggctggggtccgggtggggctgaggggtctctgccggggggtctcccag

SEQ ID NO: 75685 - DNA, 754 bp, Homo sapiens
  chr13:114767261-114768015
  hypo
ggggcaggcagcagacgcccacaaaacccacacctgtgttgtgcgggagtcacgcaccagcgcctctgccagaccaaacctgccccctcagggccagccctgctgtggtagaaggcgccactgggccacgtcctcaggaaacgtggggagcaggagacaggatggccaccgaggatgcaaggcctcagcgaggaggacctcaagccttgccctgggcagggtcctcgaacaccctcccggcagcccagggccctctgaggctcggccttcattgccgggcaggggtccctgaccagaaccggcggccgagctggaggagaagaaagtggccagacagagtgactggaggacagaggtggaagctgaggacgagaagccaagctggagagacagagtggggaggtgggcgggggagacgcacctcgacaagcgcactcagaaatcggaaagaggggctttgagcagcaacacagccagatgtggccagagagctgtggacgcacaccggagggtgtggaagctgctgggagctgttcaagagagaaaagggcggggcgctgggagccgccaggacagcgcagttcacaaccagtggatgccgaacgccgttcattccagggattcacaggcaggaagtcagcccaggaggctgttgaggaccagcaggacccagtgggatgcgcagggcggggcctacacagacgggggttggggggggactgggagctccacgacatgccggcctccttgaggg

SEQ ID NO: 75686 - DNA, 206 bp, Homo sapiens; identical to SEQ ID NO: 43917
  chr13:114769986-114770192
  hypo

SEQ ID NO: 75687 - DNA, 143 bp, Homo sapiens
  chr13:114770922-114771065
  hypo
gctgtgggacacagacgtccccctccaaggtcaccgagaaggtggcagaggggtcccaggctgaaggcgcaggggccagacccccagggctgtcccctctgactctggttccctgagcaaagagccctcgggagcctggaggg

SEQ ID NO: 75688 - DNA, 200 bp, Homo sapiens
  chr13:114774947-114775147
  hypo
gaaacggagatcactcgaggacagcccgaagtacctcggctcacggcccaaatctgaaaaagctagaggcaagaactgtccaagcctaaatgacgataaacaggcaaagaacccggtgttaccgggcaagtgagagcccgcagggctgcccggaggacgaatcacataaatcgctcaggcgccaacgaagaccatcagac

SEQ ID NO: 75689 - DNA, 146 bp, Homo sapiens
  chr13:114776302-114776448
  hypo
aggagcctccagcaccgcaacgcccaggaggcgccaggttaggccatctgcctggcctgttcagccgcttcccacacctgacaggtcagatgctgctcctgccacggggccggcgacgagccacaggctcccgaaaaaggcaaggg

SEQ ID NO: 75690 - DNA, 40 bp, Homo sapiens; identical to SEQ ID NO: 43921
  chr13:114777010-114777050
  hypo

SEQ ID NO: 75691 - DNA, 30 bp, Homo sapiens
  chr13:114777780-114777810
  hypo
caccagcactccccacgcaccgtccacaca

SEQ ID NO: 75692 - DNA, 34 bp, Homo sapiens; identical to SEQ ID NO: 43922
  chr13:114778697-114778731
  hypo

SEQ ID NO: 75693 - DNA, 113 bp, Homo sapiens
  chr13:114779925-114780038
  hypo
ggaccatggccaccccggggtgtctgcagctgtcccgaggccacaggacacgcaaggaagagaggagccggcagcaaggccctcgctgagcctctcagcgccccatacatagc

SEQ ID NO: 75694 - DNA, 543 bp, Homo sapiens
  chr13:114780540-114781083
  hypo
ggaaaaatccagcatcggaactggggttcacgaccccgcagttctagtctagccagggctgcggggggttctgcctgggtgggagtcaccctgcacagcgctatggcagtttctcagcaacatgagggtgttcagggcactcaccctggaagcgcttggccgccgcctcccggagggagaagaagatgtcacacatgacggtcgggcagctcaccccagactcagtgatggcgtggaagacgcggtccacatactgccgtaggttctcctgcaacgggacacggcactgggacccactcccgaggctgcccacaggtgcgtgtagcaccagggcacgcccagggaggggcgcgtggggaggggctgagggcgggcgcagggcagctgcggcagtgagacacgtgtgaacagccactccctggaaatctgtgctgggagctgtggcaattcacgcgtgaaaatcactacacaggcaccacgtcggctccccggctcggccccgacctcgtttactgagtggggaatggacgttcactagaatgt

SEQ ID NO: 75695 - DNA, 35 bp, Homo sapiens
  chr13:114781299-114781334
  hypo
aagggaaggaggagccggggcggaggcagagctgg

SEQ ID NO: 75696 - DNA, 93 bp, Homo sapiens
  chr13:114782866-114782959
  hypo
acgcggaagtgcagacggagcagagcctggccccgagcacctgcctgtgggctgtgaggtcagtgcacgcccatcagtcggcttcctgacatt

SEQ ID NO: 75697 - DNA, 56 bp, Homo sapiens
  chr13:114784530-114784586
  hypo
ctggggactccccaccgaagacccccagcagggctggtcaccggggatccccagga

SEQ ID NO: 75698 - DNA, 66 bp, Homo sapiens; identical to SEQ ID NO: 43926
  chr13:114785766-114785832
  hypo

SEQ ID NO: 75699 - DNA, 165 bp, Homo sapiens
  chr13:114786866-114787031
  hypo
aacatcatcttaccacgcctcgtaggagctggactgccgcaggactttcaacgggatccttagttctcccaggaattcatctccaaacttcaggttactggcattccagaggtcaactctgaaaaacagcatcaggacagctctagctgacggcgggcagcccgt

SEQ ID NO: 75700 - DNA, 116 bp, Homo sapiens
  chr13:114789389-114789505
  hypo
ggcgtcgtgctgacccgccaggccctgcgacctctgagtgaggcctgaacccatggaaggcggagggcttagaacaagaccttaagaacggctgcagcccccgtcactccaggtgg

SEQ ID NO: 75701 - DNA, 20 bp, Homo sapiens
  chr13:114802298-114802318
  hypo
caccgcgcccagcctggagt

SEQ ID NO: 75702 - DNA, 115 bp, Homo sapiens
  chr13:114802580-114802695
  hypo
gcttggccacgggtacgcagcctcgggcgttaattatgagattccaccagctgtgagatcaacctgcggcattcttatttacagctttgtggagatgcaacgtctgagtcctgat

SEQ ID NO: 75703 - DNA, 42 bp, Homo sapiens
  chr13:114803361-114803403
  hypo
caggagaagggagcacggccgtccgttcgggggagccgggag

SEQ ID NO: 75704 - DNA, 30 bp, Homo sapiens
  chr13:114803808-114803838
  hypo
tccgtgggagcagcacgctggggcccttgt

SEQ ID NO: 75705 - DNA, 346 bp, Homo sapiens
  chr13:114807501-114807847
  hypo
cttccagtgaaaatacgtatcagaatatatttgtacaatatacgtttacctagtatggatttatatgtgtaaattcgcatctgcaaccattattatctgcttatacgttcacctcattccagaaacattcccgaggcgcggcaaacgtgtgcccatcccatccccggcaggacagggcttgtcaggcgctgggcaccgagccatctcccatcctgcgtcccttcatggcaccaccatgtcaaccctgccagtggcctccgcacactgcggaccacgccacccaccacggtgagcacccacggcagcacatgcacctctgttgaccgatgcacgtgaactcctaggg

SEQ ID NO: 75706 - DNA, 46 bp, Homo sapiens
  chr13:114808091-114808137
  hypo
cctgggcctcctacccggccaccctgcctcacgccaggacagcgca

SEQ ID NO: 75707 - DNA, 18 bp, Homo sapiens
  chr13:114812180-114812198
  hypo
gtccgagccctgccttca

SEQ ID NO: 75708 - DNA, 30 bp, Homo sapiens
  chr13:114816511-114816541
  hypo
agtgtgagcagcgagcgtcagatggaccgg

SEQ ID NO: 75709 - DNA, 72 bp, Homo sapiens
  chr13:114820299-114820371
  hypo
ctttaaacacattctcgcgttggtcgttgacgcagcgagccatcctctgatctcctgcgtctgcgtgggcac

SEQ ID NO: 75710 - DNA, 30 bp, Homo sapiens
  chr13:114838479-114838509
  hypo
cgcgggaaaatgggacggtgatgtccacgc

SEQ ID NO: 75711 - DNA, 30 bp, Homo sapiens
  chr13:114840646-114840676
  hypo
aaacaaaatcaaaaacgggagcagagtaga

SEQ ID NO: 75712 - DNA, 316 bp, Homo sapiens
  chr13:114842818-114843134
  hypo
tccatccctgcctgacgatgcccagtcctaccgcactggcaccaacgcacccaattcatccctccgtccctgcctgacgatgcccagtccccccacactggcaccaacacaccggattcatcccttcctccctccccactcaatgatgcccagtccccccacactggcaccaacgcaccggattcatccctccctccctgcccgacgatgcccagtcccaccgcactggcaccaatgcaccggattcatccttcctccctgcccgacaatgcccagtccccccacactggcaccaacgcaccggattcatccctcc

SEQ ID NO: 75713 - DNA, 30 bp, Homo sapiens
  chr13:114844847-114844877
  hypo
gggaaggagaccctgcgggagaattggagg

SEQ ID NO: 75714 - DNA, 37 bp, Homo sapiens
  chr13:114845313-114845350
  hypo
ccacccggcaccctccgtgggacgaggctgcacatct

SEQ ID NO: 75715 - DNA, 460 bp, Homo sapiens
  chr13:114847212-114847672
  hypo
acacccagggaataacgaggaaagagaaggcaaaggtgggctgaaatgaagccgcccttctgagttcacaaaggagcagagacacaccggtgctgcacaggaacccccagggcccccgtgttcctagcgcagcagagcctgccccgcatccaggctgcatctcctggggctgtgactcctctcctgagtccacacacaggacctcacacctgcactcaccggctgcagctgcacacacaggagagcttctcacaggacaaatgcctggaccccacccagagattgccattctttgactaggacgggctccaggcagtaagaacagacattcgtcttgattagaaagcctgcaggtggttctgggtgcagccaggactgagaggcattacttactgctgagaactgagaaggtgtgaagatgcccctacctcctcgccccactcaccggggagctgcgggt

SEQ ID NO: 75716 - DNA, 227 bp, Homo sapiens
  chr13:114855474-114855701
  hypo
tgatatttcatgtcacggatggaacgcattctgtgtatttgttaatcactgatggatgtttgggctgttcccagctttcagttgttgtgaatggtgccgctgtgaagtgtgcacaagttcccatgtgaacacggacagctttgggattctcttgattatttaccaacgggtggggccgcacggcaacaggtttaattaccctaggagccacccggctgcctgcccag

SEQ ID NO: 75717 - DNA, 30 bp, Homo sapiens
  chr13:114862455-114862485
  hypo
gagtctgctcctccacgaggctcccagatc

SEQ ID NO: 75718 - DNA, 37 bp, Homo sapiens
  chr13:114886881-114886918
  hypo
ccgtgtcttctgccacggatctcggctaaaggaaaag

SEQ ID NO: 75719 - DNA, 53 bp, Homo sapiens
  chr13:114889099-114889152
  hypo
tcccagagaatcctccgtcctaccctgggcacgccatgcgcaccaggcaggga

SEQ ID NO: 75720 - DNA, 30 bp, Homo sapiens
  chr13:114889446-114889476
  hypo
gcaggagtcgttcctcgatcaattccaggt

SEQ ID NO: 75721 - DNA, 38 bp, Homo sapiens
  chr13:114892617-114892655
  hypo
cgctcatccactctgcgcctgcgcggttcacacgctcc

SEQ ID NO: 75722 - DNA, 30 bp, Homo sapiens
  chr13:114911257-114911287
  hypo
gtgcacacaggagcccgggggctcaggcgt

SEQ ID NO: 75723 - DNA, 69 bp, Homo sapiens
  chr13:114917035-114917104
  hypo
cactcaccagtgccacgtgcacacggatcatctaattctaggggggcaactgcacggtttgcccccgac

SEQ ID NO: 75724 - DNA, 30 bp, Homo sapiens
  chr13:114917570-114917600
  hypo
cagccctagcaaacacggccacgctgccct

SEQ ID NO: 75725 - DNA, 37 bp, Homo sapiens
  chr13:114922755-114922792
  hypo
ggattacaggcatgagccaccacgcccagccagctgt

SEQ ID NO: 75726 - DNA, 351 bp, Homo sapiens
  chr13:114961720-114962071
  hypo
ttccaaatctaagcacgagcctctttcagaacttcaggccgtgtgctgacatggaatccctggtgccacgaaagaccccagagcagcacaatctgagctcactctgtttccaatactgcgcccaggtaacgctgcctcctcatgccacaggtccagagcgcccagccgctggtagacacccgcgccccgctgacgttccgccatctccacctgaaactcaagaggctgaaggtacactttcatttctaccttacttaatgtaatagctaactagaaaatgccagcttaaaagcccaggaaaatagaaaaggcagggttagtaaggaataaactcaccgaagacaaaatgca

SEQ ID NO: 75727 - DNA, 107 bp, Homo sapiens
  chr13:114989891-114989998
  hypo
ctgagatgccggcatcgggccgggaggagctgggcctctgcccactgcagccatgacctctccaggcagccccgcccccctgtgtcgtgaagcgcaactgggcacag

SEQ ID NO: 75728 - DNA, 207 bp, Homo sapiens
  chr13:115024113-115024320
  hypo
atgtatcaaataagacgtctttaaatagaaacacacataaaacaaggttacgcattgatcaattagagaaaatgtgaccagagaattgcaggaatctaactgtatttcccctggcagccgcggttcaatatttgctaactcagtgtacacagtgactttatagaacataaatactgtggttgggtgcggtggctcccgtctgtaatc

SEQ ID NO: 75729 - DNA, 259 bp, Homo sapiens
  chr13:19517655-19517914
  hypo
gcctcaacatacccccgcaagcctggcatcccgtccccgtgacccgggggacttcttgccgctttggagggcccccggtggggggagacacagggtgaagccggggactccacgaccccctgggccccacgcaggggctgcagggaaggcactggcctctgagggatgatcccagcctcctcggcctcaccgctttttcccccggctacctcaacctccccctgcaagcctggcgtcctgtacccgtgacccaggggac

SEQ ID NO: 75730 - DNA, 44 bp, Homo sapiens
  chr13:19537201-19537245
  hypo
ggcaggagacaaggccggggcagctgcatcgcccccagagctgg

SEQ ID NO: 75731 - DNA, 106 bp, Homo sapiens
  chr13:19756080-19756186
  hypo
accacgtagtggggacgccctctgattggatgcaggattggcgggaaggcagcaggctcagagagggccctctgactggatgcaggactggcgggaaggcagtggg

SEQ ID NO: 75732 - DNA, 30 bp, Homo sapiens
  chr13:19964867-19964897
  hypo
tggtccttcccgactcgctgaagcttgggg

SEQ ID NO: 75733 - DNA, 101 bp, Homo sapiens; identical to SEQ ID NO: 43749
  chr13:20078200-20078301
  hypo

SEQ ID NO: 75734 - DNA, 30 bp, Homo sapiens
  chr13:20138821-20138851
  hypo
caacagcaagaggtccgaattgcccttttc

SEQ ID NO: 75735 - DNA, 78 bp, Homo sapiens
  chr13:20312627-20312705
  hypo
actgtttacagagaacgacaagtaacaaaaagtcctcctacacacttaaaagcatctctagattacttataataccta

SEQ ID NO: 75736 - DNA, 87 bp, Homo sapiens; identical to SEQ ID NO: 43750
  chr13:20392358-20392445
  hypo

SEQ ID NO: 75737 - DNA, 63 bp, Homo sapiens
  chr13:20500420-20500483
  hypo
agggcttctccaattcgcttcaaacaataaaggatgtattgttttttgcgggggtgagtgggt

SEQ ID NO: 75738 - DNA, 30 bp, Homo sapiens
  chr13:20531916-20531946
  hyper
ctcagcccctccaaccggtgggagcccagc

SEQ ID NO: 75739 - DNA, 27 bp, Homo sapiens
  chr13:20692250-20692277
  hypo
cgtgagccactgcgcctggccacattt

SEQ ID NO: 75740 - DNA, 166 bp, Homo sapiens
  chr13:20692809-20692975
  hyper
ccttcttccaggaggcgtttctcagccacaccaacgcggcacttcttttcccttttggcacagaagtgaggaagagcagctgagctggtctcggtctcccagctcctgcagtctgaggaccccgggatgctccagccagggcagacccgcgcggggggtgcccttc

SEQ ID NO: 75741 - DNA, 151 bp, Homo sapiens
  chr13:20701930-20702081
  hyper
gtgaggtctggtggccgaggggaggtgcccagcgtgcgcgtccgcatccggcgggcgacagagcagccccggaacaggagcttcccggcaccggccgtggcgtggcgccctccgctgggccgttctcccccgcagccgctaagtcagcatc

SEQ ID NO: 75742 - DNA, 129 bp, Homo sapiens
  chr13:20702784-20702913
  hyper
ttgtcctggatgatccgggcggaccctaaatgtcatcaaagtgtcctcgtaggagagggagaggaggcgaccgtgggggcagaggctggaggaccgcggcgcccgggacctgcccgcacctgactgcag

SEQ ID NO: 75743 - DNA, 128 bp, Homo sapiens
  chr13:20734542-20734670
  hyper
gcgatgctgaatgcccgtggacggctgggtgcgcgccgttagctggcgcggtgacatctgcttagagttttcaagcatttcagcatcgctaggagccctacagcctgacggtccgggacagcccggct

SEQ ID NO: 75744 - DNA, 100 bp, Homo sapiens
  chr13:20735432-20735532
  hyper
ggggctcttccctgccgcctacgcactccggggcatgcccgcgcgggacgtgagaggagagccgagggctgttggggcgggcccgacccgcttgcggggc

SEQ ID NO: 75745 - DNA, 577 bp, Homo sapiens
  chr13:20735533-20736110
  hyper
cccaccgcacgcagatgcgccagcccgcgccccgctcgcgcctgtcctgggcttcgcaggcccggcgaggtagctgctctccgggcgctcccacggtcggaggcgcgtgggcgtcgggcacctaggtctcgcccgcctgcagccgcctggggacgcgggttccggacggctggcgcggggcggggcggggaccaccgagcaggaagtccccgcggaagcgccgccgggcacagcgtgggtgctgtcgaggagtggcgcccgggcggggcgggaggttataaatagcggccgccatcctgcttctcttcagacacacttaatttagccggcaggcacacggatgcttatttttaaaaaaagaacttgttttattgcgctcgaggtgaccgggaaggtgtccccgcgggtcactcgctccatctggtcctggagacgagatgccagggcgaggcctaacctgcctgctggcgcccaacgaagattttaacgttttctgttcccttcggggtggttttaccacgcttgagagggacgcctaccgcggaaggccgcggaccgagggcggcatcgcgtcctt

SEQ ID NO: 75746 - DNA, 90 bp, Homo sapiens
  chr13:20766251-20766341
  hyper
cacaccacctcttcgcgaacaagggtcctaaaaattttccttctaggcggggagcacagcccggaaacagaccctcgtgaagtgtttagg

SEQ ID NO: 75747 - DNA, 714 bp, Homo sapiens
  chr13:20805970-20806684
  hyper
agtcaaaggggaccacgctggggtaaaagtcaaaccagtccatcctcgttcctctgcgtacagagagagggtccagcgcgggcggcgcccactgccatcgggccggggccggggcgcgtggacaggagggtgcggatagaggcagatcgggggcccggtcgccccacgtgcggccagacacccatcccggccgcgctctgccggctctgatccggtgccagacaggagcgacaggggcgaggtggggaccagccgccgacctcacctgttttgttttcttggaggaaattcctccgctggggggccgaggtggcaccgcccgctcgccccccgcaagacccagccggtccgcgcccgcttacctgctctgcggccggcggccctggcgcgggctctgcgcggggcggcgcccttcgctccggctgggcaggcaggtcgggctcgggcgccgccggctgtcgggctctcgtcgggtttcgggtgaaggccccggctcccacctgctgcgccttttaaccgcgccccaccccgcctctgccctgacgcggctcgggcgggctgcgggaggcgagcgctgtcactcgacgagccccccgcccccacctacccggggcgcactagccgctgggcgcggaccgtccccctgaggagcaaggagtgcaggaccggggctgtccctccggggccggatgcgcagagcggggacctttttcc

SEQ ID NO: 75748 - DNA, 18 bp, Homo sapiens
  chr13:20875611-20875629
  hyper
gggctggtccgattgcgc

SEQ ID NO: 75749 - DNA, 154 bp, Homo sapiens
  chr13:21057336-21057490
  hypo
acaataaaagataaacgtgtgaggttctggatatcctaatacaccgggattttaccatgacacactgaacacacaaatcaatcacacatgaatcccaaatatgtacaattaagatacagcaagtaattttttatttattattatttttttaaga

SEQ ID NO: 75750 - DNA, 33 bp, Homo sapiens
  chr13:21057550-21057583
  hypo
ctccgcctcctgggttcacgccatctggactga

SEQ ID NO: 75751 - DNA, 30 bp, Homo sapiens
  chr13:21475790-21475820
  hypo
tagaactacaaactacgctagaattagttc

SEQ ID NO: 75752 - DNA, 45 bp, Homo sapiens; identical to SEQ ID NO: 34793
  chr13:21520313-21520358
  hyper

SEQ ID NO: 75753 - DNA, 30 bp, Homo sapiens
  chr13:21549397-21549427
  hypo
ccaggcggtggtctgcggagcagcacagct

SEQ ID NO: 75754 - DNA, 181 bp, Homo sapiens
  chr13:21634356-21634537
  hyper
gccgcactccatccccgagggaaagctccccagaagttctggagttgggctgaaggatgtgatggcaagatgtgaatgatgtcagaatccccatctccagagtccggctggggagctaagcgcaggtgagcttacatcagaagagaaagccaaaccccccacacgtcgctaaactagggca

SEQ ID NO: 75755 - DNA, 218 bp, Homo sapiens
  chr13:21634747-21634965
  hyper
agccggcggcgcggccgcggggaacggggtgggaaccgcgcggcagtgggtgaggcggcgcagccaccgggggctgaggggcggcgcggcctcgactgcggcaccgccgtgggtccgtcggctcgcgggacgacggggcggccggcgggggccaacagggcgggctctgaaggactgattggcccgtgggacgatggcgcggccgggaggatggcccc

SEQ ID NO: 75756 - DNA, 419 bp, Homo sapiens; identical to SEQ ID NO: 11520
  chr13:21649623-21650042
  hyper

SEQ ID NO: 75757 - DNA, 30 bp, Homo sapiens; identical to SEQ ID NO: 43753
  chr13:21711382-21711412
  hypo

SEQ ID NO: 75758 - DNA, 34 bp, Homo sapiens
  chr13:21713712-21713746
  hypo
cgtgagccaccaccacgcccggccagagttctta

SEQ ID NO: 75759 - DNA, 23 bp, Homo sapiens
  chr13:22049000-22049023
  hypo
tttttttttttgagacggagtct

SEQ ID NO: 75760 - DNA, 23 bp, Homo sapiens
  chr13:22049278-22049301
  hypo
accgcgcccggctgtttctgcat

SEQ ID NO: 75761 - DNA, 33 bp, Homo sapiens
  chr13:22122977-22123010
  hypo
atacaaggattctatcgccgtatctcagacctt

SEQ ID NO: 75762 - DNA, 620 bp, Homo sapiens
  chr13:22243244-22243864
  hyper
actaagtaaccatcccggcgcactgtacccaactggtcgaggaacgcccctgctgtacccatcactgctggctgcctcggagattaatgcgagcgactcgggtggtttatgagaagtgacacttaatacccagcttcttgtatctgccgccgagcagttaacgttaaagcccgctctgtaccaccgcggatgtgactgctgtaaataccacggggcagggctctcatgcttcagaaacacgtaagcaagacgcaccgagccagccccggacacccaatgaccctggactgcggcaaagggggggtgggaaaggaagaggggaggaccactcgctcttctctccttcctcctcgcccgggccggagcacgccttcctccccggagggcaggggaaggtcgctccaggtcgctggcacctccagcgcccccgaaatctgcaaattcatcgctccctttcgtcttcaggcgaagccctcccgtccggagtagggccagccccagttatgcatctccagcctttagctgactactaaggcggatccgacttctcccccataaccaggttttgattcgcttccccaccgcaggggttcagtctctgctttcgactttgcttctca

SEQ ID NO: 75763 - DNA, 176 bp, Homo sapiens
  chr13:22247052-22247228
  hyper
tggtgtgagtgtgtgcgcgcgtgcaaacgctgcgagcgaattttaaagggcattccgaggatttcatttttcagcggagggtatttgtgactcagcactgagggctgcagactcgagggctggtggctctgcccactttatgcttgcacacacgtgcttgccggggcaccctgagc

SEQ ID NO: 75764 - DNA, 42 bp, Homo sapiens
  chr13:22336937-22336979
  hypo
cagtcgctgccgaaacgatcacccagtcgcagtcactttgct

SEQ ID NO: 75765 - DNA, 30 bp, Homo sapiens; identical to SEQ ID NO: 43756
  chr13:22391874-22391904
  hypo

SEQ ID NO: 75766 - DNA, 16 bp, Homo sapiens
  chr13:22707389-22707405
  hypo
gcgcctggccaggtta

SEQ ID NO: 75767 - DNA, 42 bp, Homo sapiens
  chr13:22766880-22766922
  hypo
ctgacttccctgctccgagggagtacttggtcagtggatttt

SEQ ID NO: 75768 - DNA, 31 bp, Homo sapiens
  chr13:23174977-23175008
  hypo
ggccacaggctggtaccggcccacagcctgg

SEQ ID NO: 75769 - DNA, 352 bp, Homo sapiens
  chr13:23489676-23490028
  hyper
tagggggcggggggacgcggagcgatgcccgcgccggcgcaggggcggataaaaagccgtagcgccacgggagtgggcgggagggagagggggtacccgagggccacaagagtatgacggggctgtaagagctggtgtggcgggtgctgcccccctgctctgtctgcaccgcaagctcacctcctggctccgcgttcggttcggcacttggaactggatctggcgactgtgccggcgcgccgcctctgccgcggtcctagcgccgctcggcttcacgctccgcaagtcccaggcgtctgcaggaaccgccatcaccacccgcacccgcgccgggggtcgtgcctgcccgcag

SEQ ID NO: 75770 - DNA, 108 bp, Homo sapiens
  chr13:23507321-23507429
  hypo
ccctggagcctggctcggaggatgcgaggaggattctccagcaggcaagcatggtcagaggggccactgggtcgccagatggagtccctgtgccgatcccacagtaca

SEQ ID NO: 75771 - DNA, 30 bp, Homo sapiens; identical to SEQ ID NO: 43757
  chr13:23717527-23717557
  hypo

SEQ ID NO: 75772 - DNA, 851 bp, Homo sapiens; identical to SEQ ID NO: 34800
  chr13:23733447-23734298
  hyper

SEQ ID NO: 75773 - DNA, 7 bp, Homo sapiens
  chr13:23734814-23734821
  hyper
cgccttc

SEQ ID NO: 75774 - DNA, 115 bp, Homo sapiens
  chr13:23896852-23896967
  hypo
cccaggccctatcatcgcacctgcggcgatgcacagaccgccccccacccatccacctccccccccccccccccccgccaacaggtgtaacgtggtgccgcgggcagaggattca

SEQ ID NO: 75775 - DNA, 20 bp, Homo sapiens
  chr13:23920566-23920586
  hypo
gccaccgagcctggccccct

SEQ ID NO: 75776 - DNA, 288 bp, Homo sapiens
  chr13:23949125-23949413
  hyper
aagcacaggcggccacgctgccggagtcattcgcgccgcccgcggaaacctgcgtcgcccaccccgggccctcgacgcccgccgttcctccgcgtggcggagcccagcccagcgcccccggccaccgcctacctcgcggccgccgcgccacagccgctgctccgacaccgggaagccagtctccgcgaagatacgttccttcacatcgcgcacggtccaggacgccagcgccgcgacggtcctgcagcccacgcagccggggagcacggtcaccgggacccacctgtg

SEQ ID NO: 75777 - DNA, 29 bp, Homo sapiens
  chr13:23961293-23961322
  hypo
tcgatttgttaaaaacgaatgtcggccgg

SEQ ID NO: 75778 - DNA, 30 bp, Homo sapiens; identical to SEQ ID NO: 34801
  chr13:24007814-24007844
  hyper

SEQ ID NO: 75779 - DNA, 641 bp, Homo sapiens
  chr13:24040375-24041016
  hyper
cgggaacaccctgcacgtgagaggggccctgaaattcacgaggggctggggctttgcgtttattcctccagttccgcctgcagcaaccctgacgatcgagcagggcccgcgggggagcgagcggaagcgggcagcgtgcgctgctgtcccgctacccagcccgctaggctgcgcagctgcgtctgcgggcggggagccggggcggccgtgggcttcctccgggcgcgggctgacggctgccgcctgtgggcgccccagccctgcagccgagcgggaggggcggaccagcgggtgtcgggagcaggctgcagcggccaggcctctgcggcttctcggagtactgggtccactggagagcgaagagccgcggccgccaggattcccagcagcggccgcgtgttgagagcctagaagtggccccgaagccgtgcctttcccgatagccaagcagaagtaggacttgaagcaccgaggctgggatgcccatgctggtgacgccttggggctcgcagttatacttggtgaccggtctacacggcgattcggtgctttccggagtagcagattcatctatctttagacccaccttcgtccttcggcggtttagcacggcctgcgctttcctgcgagccctgctgtca

SEQ ID NO: 75780 - DNA, 154 bp, Homo sapiens
  chr13:24153182-24153336
  hyper
tggggaacaccccggcggaaaggaaccctccctctctgctctgaaggaaagtttcccaacacagccatgttcttggtggtctccggtcccccatccccaagcccccagtcagcctcacactcatccgcttcagtagccgcggagtgggggcctc

SEQ ID NO: 75781 - DNA, 213 bp, Homo sapiens
  chr13:24153538-24153751
  hyper
ggtgcacggtgtgcacgctggactggacccccatgcaaccccgcgccctgcgccttaaccaggactgctccgcgcgcccctgagcctcgggctccggcccggacctgcagcctcccaggtggctgggaaggtaggtgcgtcgctgtccccggcgcgcggcgtcccgcgaggtcttcagccctcgccctggtggatccccgctgggtgggagcc

SEQ ID NO: 75782 - DNA, 70 bp, Homo sapiens; identical to SEQ ID NO: 34805
  chr13:24154053-24154123
  hyper

SEQ ID NO: 75783 - DNA, 30 bp, Homo sapiens
  chr13:24155137-24155167
  hypo
atttgtttctttggccggagtgtgtcttgc

SEQ ID NO: 75784 - DNA, 70 bp, Homo sapiens
  chr13:24289608-24289678
  hypo
gtttggggtgctatccgggtttgcattgcaggcggtggggccagctgcggtatggcggtggcggggggtg

SEQ ID NO: 75785 - DNA, 590 bp, Homo sapiens
  chr13:24477427-24478017
  hyper
ggtttccccagatgccgcggtgcaccgagcaggagcagaggccacgcgggagccgggtgtgcgggtgggtaccggccgcgcccctgctcggaggcggcgactccctcccccgccttactcacaccgtgcctcagtttccccgtcagtgcagcggacaagacaatgccgaggtcccaggcgggcggcaggatccaattagtccgtgtaaaatgagaggcatctggcttctcccgggcaccccgcagcctgccccgcctcttagtggctaaaggcagggagcccctgagtcccagcgcggctgggggctctcagcagttctggccgagctccctcccgcccgcgtcgcctggcctcgaaccgctgcaccgcgggcggccccgacgggttcccgacctcccgctggggacacctgtcccgccgcccggcccttccccgcctcccgcgcctccgccccaggggagctccgggacaggcccacctaggcagcctgccggcgcagacccagcgagggaaggccagtctcgggcctccaaccggacacgcgctccccattccgggctctcccacgtctgcacactccagcccagcca

SEQ ID NO: 75786 - DNA, 35 bp, Homo sapiens
  chr13:24553829-24553864
  hyper
ctgagttctgctgggcggggagccagagactgatt

SEQ ID NO: 75787 - DNA, 189 bp, Homo sapiens
  chr13:24553924-24554113
  hyper
cgcagggcatgggggcggcgcgcacccgggacagtttccagtcggcttctccgtgaccttcctcccccttccagctcggagcgggatgctgggatccctccaaggaccctctgaggacgtaggagggatgctgagacaggcaagtgggatttctctacatattgtcacctcgcccgcacttttggagaa

SEQ ID NO: 75788 - DNA, 53 bp, Homo sapiens
  chr13:24554519-24554572
  hyper
tgctcagcgtcactgcgtgagcccccactctgatgcttcgttggtgtgtgtgt

SEQ ID NO: 75789 - DNA, 68 bp, Homo sapiens
  chr13:24931992-24932060
  hypo
gccaggcaggtcctccgacagtgccacagccccaggcttgtgcagctaaatcacggaggccttccagg

SEQ ID NO: 75790 - DNA, 15 bp, Homo sapiens
  chr13:25115633-25115648
  hyper
gtccagtctgtttcc

SEQ ID NO: 75791 - DNA, 78 bp, Homo sapiens
  chr13:25115693-25115771
  hyper
cgggctgtgtggggaccgctttcccccaggcccgtcgtcagtgtcctgagctccgccgactcccgcccattggcgtcg

SEQ ID NO: 75792 - DNA, 250 bp, Homo sapiens
  chr13:25254947-25255197
  hyper
accggagcaggctgacgggaagcgaggaaaaggcgaagaggagaaacgccccgtcccggggcaaggggaggccgcctttcctctgagcgccccccggcctgggcaccgcttctctgactccccgccacggctccgtgcggccgccggggctggctggggaaagaagccagtccagaggagcgagaaggggccaaggggtcctaggccagctccatggcacctgcgggctccgactcggaggatggggtga

SEQ ID NO: 75793 - DNA, 81 bp, Homo sapiens
  chr13:25319824-25319905
  hyper
tggcgaccagaacaacgagggcgacgaagacaggactgaggaacatgcgcccctgccgccctcacccggaaccagggctcc

SEQ ID NO: 75794 - DNA, 1 bp, Homo sapiens
  chr13:25320108-25320109
  hyper
c

SEQ ID NO: 75795 - DNA, 153 bp, Homo sapiens; identical to SEQ ID NO: 34810
  chr13:25320387-25320540
  hyper

SEQ ID NO: 75796 - DNA, 416 bp, Homo sapiens; identical to SEQ ID NO: 34811
  chr13:25320613-25321029
  hyper

SEQ ID NO: 75797 - DNA, 1082 bp, Homo sapiens; identical to SEQ ID NO: 34812
  chr13:25321112-25322194
  hyper

SEQ ID NO: 75798 - DNA, 43 bp, Homo sapiens
  chr13:25561078-25561121
  hypo
tgtgggaaccatgcccgtgaccggtcctcggggatgctgctgc

SEQ ID NO: 75799 - DNA, 323 bp, Homo sapiens
  chr13:25592243-25592566
  hyper
cccgcccaacaggcccgaggcagagaaaccgccttagcagctctcgcggcgcccagtacaggcggcggttgctgcgcaggtgccgcgggctggcagggctccctggagccgcaaggcgcgccctgccccagggcctgtttgactgtggcccgcgccctcttctcctcttccaacggctcccgatgctcagagacccccgcgctgggccctctgcagcccagggatggggttgagtggtgcttctccacctggtgccgccgctgggcccacagcccgacttcgccactgcgtcgcccccggggtccgcgctgatgggcgcgagg

SEQ ID NO: 75800 - DNA, 32 bp, Homo sapiens
  chr13:25592593-25592625
  hyper
cgctgcagtcagcccaccgcttgcaggtggca

SEQ ID NO: 75801 - DNA, 180 bp, Homo sapiens
  chr13:25592860-25593040
  hyper
tccatgtgctggtggcggctgcagctgcagcgcccatgggctgatgtggcttaccggagctgcggccggccacgcccaagggcctcacaggctgcgctgcccttgccagctgctcctgacccgcgcccagagagcaggacctggcgcttggcactgtgcagccacggggatgaggctgag

SEQ ID NO: 75802 - DNA, 60 bp, Homo sapiens
  chr13:25593061-25593121
  hyper
cgccactggggccacagcctgacttcacctccccgtcgcccaagtcgtgtgatgggcaca

SEQ ID NO: 75803 - DNA, 30 bp, Homo sapiens
  chr13:25607882-25607912
  hypo
gtctgtccccactaccgcctaacttcctag

SEQ ID NO: 75804 - DNA, 55 bp, Homo sapiens; identical to SEQ ID NO: 34815
  chr13:25620899-25620954
  hyper

SEQ ID NO: 75805 - DNA, 251 bp, Homo sapiens
  chr13:25620955-25621206
  hyper
aggagccctggagactcagggcccgtctggtgcggcccgggctttgctccgcgctcgccccctgcagctgccggggccgccgcaacttttcaaacctcaccgcaccgacagctctgtcccttcttttatctggagacgctgagcctcatcaactctcacctgcgtttcaggaaaaataataataataataaatgttccacggacacaggatttcggccaaatgctgcttagctctaccttccccaaaaggg

SEQ ID NO: 75806 - DNA, 387 bp, Homo sapiens
  chr13:25621263-25621650
  hyper
cgtccgcaggaggccttgcggggatccgagcatcccgctccgagatggaagtggtaggacagtccgggagaagccgacgggaaactgtcctgggcgcgcaccgcccccgtgccctgcgccctcctcatttgctcggccagcgcgggacctcccagccgctgggcccgcgaccgcggcgaatcagtctccgcttccccgcccagcagagctcagatctgctctggagggctctcgggatgtcgcctttccctggagatgagcagttctgcgtcaccctccgtggccagcgcggcttccagggctgggctggtctattgtttgctgttcttgaaaggacgtggggagggtgggagggtgggagggtgggagggccggggctgagccggg

SEQ ID NO: 75807 - DNA, 24 bp, Homo sapiens
  chr13:25642802-25642826
  hypo
acatgcatgcatgcacgtggacac

SEQ ID NO: 75808 - DNA, 27 bp, Homo sapiens
  chr13:25668696-25668723
  hypo
ctactctaggctaggcgcggcggctca

SEQ ID NO: 75809 - DNA, 38 bp, Homo sapiens
  chr13:25669254-25669292
  hypo
tacatatttattggtcgggcacggtggcttacgcctgt

SEQ ID NO: 75810 - DNA, 71 bp, Homo sapiens; identical to SEQ ID NO: 15753
  chr13:25670585-25670656
  hypo

SEQ ID NO: 75811 - DNA, 98 bp, Homo sapiens; identical to SEQ ID NO: 34818
  chr13:25744637-25744735
  hyper

SEQ ID NO: 75812 - DNA, 295 bp, Homo sapiens; identical to SEQ ID NO: 1089
  chr13:25745300-25745595
  hyper

SEQ ID NO: 75813 - DNA, 244 bp, Homo sapiens
  chr13:25745726-25745970
  hyper
cgccgccgccgcggctccggctcgtctccatggaaaccgcgcgggataagccgctttcgtcagcagtgggctcgcgccaggccactgtcacccgtattctaaatcaacctgagccgcgctcgccgccgccgctgcaaaagaaacacacataaaagaccatcttccctcccgcaagggcttatataataccctaacccacttccatccgacttggctcggcgctgcatggcgtttttgtggcagg

SEQ ID NO: 75814 - DNA, 67 bp, Homo sapiens
  chr13:25862385-25862452
  hypo
gtgggggggtggcggcggggggcaactggtgggtggaggccaagtcacaagtcggctgctgaacacc

SEQ ID NO: 75815 - DNA, 122 bp, Homo sapiens
  chr13:25945896-25946018
  hyper
gacaggcagagactccgagtcccccaggtgcacccctctcctggaagagcccccgaaagtacaggcccaatctcccaccccaccaagccctccccatcgccttccccgacacctaaaagccc

SEQ ID NO: 75816 - DNA, 374 bp, Homo sapiens
  chr13:25946300-25946674
  hyper
cgtagcctccgtctctcgcccggggccgccgagcccccgacacgggcgagatgctgaacggcgcaggcctggacaaagctcttaagatgtccctgccgcggaggtcgaggatccgctcgtccgtgggtgagctgggaggggcgcggcgagggagggtgggcccggggcgggggcggcgcggggcgcgcctgcggttatgcgacactgccccgcccgcgccccgctcccctccctgggctccctgggctctctgggctgcaggatccgccgacgcggcgcgctggccgcacgggggctgggcgtcgctgcacctgcggggccaaaaggctccaggccggggcgaggtgagcggcgggcgtcagagacccccggct

SEQ ID NO: 75817 - DNA, 57 bp, Homo sapiens
  chr13:25946801-25946858
  hyper
cggcgcagagaagatgcagccttccctgccggcggccggcaccgctgtgctgcagag

SEQ ID NO: 75818 - DNA, 78 bp, Homo sapiens
  chr13:26041957-26042035
  hypo
ggattacaggcttgagccaccatgcccggccaagatgtcagttttttaatggtgtgcaacgtccgtttctttgatagt

SEQ ID NO: 75819 - DNA, 108 bp, Homo sapiens
  chr13:26042600-26042708
  hyper
tggctgcttgcagggcgcattcccattgctgctgtctctgttcctaaggaagatcaaaggatcccagaaaacccagttccagagctcagttcccgggactagagggta

SEQ ID NO: 75820 - DNA, 403 bp, Homo sapiens; identical to SEQ ID NO: 3985
  chr13:26042768-26043171
  hyper

SEQ ID NO: 75821 - DNA, 159 bp, Homo sapiens; identical to SEQ ID NO: 3986
  chr13:26043340-26043499
  hyper

SEQ ID NO: 75822 - DNA, 30 bp, Homo sapiens
  chr13:26157703-26157733
  hypo
ctcatccacaccgcccggcccctgggagca

SEQ ID NO: 75823 - DNA, 30 bp, Homo sapiens
  chr13:26317471-26317501
  hypo
cttgatctacacctccggctttcagagctg

SEQ ID NO: 75824 - DNA, 30 bp, Homo sapiens
  chr13:26323546-26323576
  hypo
agagctgaagttagccgaggggagtccaga

SEQ ID NO: 75825 - DNA, 89 bp, Homo sapiens
  chr13:26355034-26355123
  hypo
agcaccagtccagtccgtggcccaggggttggggatccctgtactacaggatatgagaaaaggccttactggcagtttgttttctgtgt

SEQ ID NO: 75826 - DNA, 322 bp, Homo sapiens
  chr13:26624595-26624917
  hyper
ggagaaactgaggcccgtgagggtgaattagggacccacaccgaccaaataataagccagaaggcagactccgcctcctggtcctaggccctttcctgaatttccccccttcaaactcccaggtccctgacgtccaggcaacgccaaccgtcctccctttcgcgctgggcgcaggccgccctacctgccgagccgtcggggccgtctttgtccgcccggccaggctcgccagcgccctgctggcggtcattgtcgcagccgccctggtccaggcgcgcctcggcgctggagcagcagtagcgcaacgcgcagctgccgcagc

SEQ ID NO: 75827 - DNA, 391 bp, Homo sapiens; identical to SEQ ID NO: 34828
  chr13:26625266-26625657
  hyper

SEQ ID NO: 75828 - DNA, 150 bp, Homo sapiens
  chr13:26626239-26626389
  hyper
gacctcagggacgcccgcgggcgccgggcagcccctcactttcctaccccgggcaaggagaaaggtgtggccaagggcggggtctgcctgctggaataggcgcgggaggaaacccaacctaagcaatccaggcctcgctaacacaaataa

SEQ ID NO: 75829 - DNA, 30 bp, Homo sapiens
  chr13:26693061-26693091
  hypo
ttgtgcagggtagctcgacaggcctgcagg

SEQ ID NO: 75830 - DNA, 86 bp, Homo sapiens; identical to SEQ ID NO: 34830
  chr13:27050496-27050582
  hyper

SEQ ID NO: 75831 - DNA, 276 bp, Homo sapiens; identical to SEQ ID NO: 34831
  chr13:27131553-27131829
  hyper

SEQ ID NO: 75832 - DNA, 451 bp, Homo sapiens; identical to SEQ ID NO: 34832
  chr13:27131859-27132310
  hyper

SEQ ID NO: 75833 - DNA, 158 bp, Homo sapiens; identical to SEQ ID NO: 34833
  chr13:27132629-27132787
  hyper

SEQ ID NO: 75834 - DNA, 18 bp, Homo sapiens
  chr13:27144128-27144146
  hypo
tataccttgatcagccgg

SEQ ID NO: 75835 - DNA, 30 bp, Homo sapiens; identical to SEQ ID NO: 43763
  chr13:27278150-27278180
  hypo

SEQ ID NO: 75836 - DNA, 32 bp, Homo sapiens
  chr13:27319461-27319493
  hypo
caagcagtgcacagacgcggaatcccagccta

SEQ ID NO: 75837 - DNA, 512 bp, Homo sapiens
  chr13:27334211-27334723
  hyper
acttcaaaacaccagcgtgagcgaggcaggcacacacggactcgcggcggtctgtttgcaacagcgctgggaatgcacattggaaaatcacatcttgcatgctgaaaacgaacaactgtttgacatctgggctgctgccgagaaaaccacgcggcagcggcaggtctcgagccaggggccgccatcctcgatggaatatttaaatcgcctatttccatcgaactcccaccctccaaacgcatcccccgcgcgcgtgcacatcctcaaacgcacccccgaccggaacaaagaggggctccagactccccccgtgcgcacggggcagtcgggagggccacgagagggaggtgtgtgcaatggaagtaccgagacagacagacagacagatgcccatgcactgctgccgattccctggcggcggggacgggagtcggacgcgagggggacagacagggtgcggggacaggcggcccgcgggggcgggggggtcatcgagggggtcaccttggctc

SEQ ID NO: 75838 - DNA, 256 bp, Homo sapiens; identical to SEQ ID NO: 34835
  chr13:27334724-27334980
  hyper

SEQ ID NO: 75839 - DNA, 30 bp, Homo sapiens
  chr13:27390853-27390883
  hypo
actaattacatataacgaccctactttcaa

SEQ ID NO: 75840 - DNA, 38 bp, Homo sapiens
  chr13:27553623-27553661
  hypo
ctgttggctatgggccgggtcaacgtccacactgatca

SEQ ID NO: 75841 - DNA, 208 bp, Homo sapiens
  chr13:27610050-27610258
  hypo
agaaggtgggacattcgttggctaagtagaaagctgagcagatctcagctctctctctgttgagtgcccaagcacacatagaactacacacgtggtatctcagcagtaaggcctgacagcaaggcaaggggggacaggcgggaggtgagtcatgatcctgcgtgtgcgttggtgctcattctgacccgcgcaccgagatggaagctgt

SEQ ID NO: 75842 - DNA, 30 bp, Homo sapiens
  chr13:27811290-27811320
  hypo
tctattgccatatgccgtttggctgaagta

SEQ ID NO: 75843 - DNA, 67 bp, Homo sapiens
  chr13:27845541-27845608
  hyper
tccccccagtttgtccgaggtgcctgggtttgacaggcttgttctactccttcggttgattttccta

SEQ ID NO: 75844 - DNA, 108 bp, Homo sapiens; identical to SEQ ID NO: 43764
  chr13:28239991-28240099
  hypo

SEQ ID NO: 75845 - DNA, 422 bp, Homo sapiens
  chr13:28363673-28364095
  hyper
gaaagaaggaaagcccgggacaacagaaattctttcaatgttgaactgtccctgatggacacttgaaaaccggctccggcagcagagccgacccgccaggcccaggggctcccgggcccctcctggggctgtcaggctaatccggcagccgcctcccaccccgccccgctctgggggacttttgctcgggtgactaaagttcaaactcggctaaagcaagccctgggaggcgctttaaacaggaaagtggcgcggccgcccgagagagcccgggtagcggcccccggaaaccaggcggcgggcagaggccgcggggtggggaggccgggttggctgggtggggaggccgggttggcggggcggcccggacctcccggctgcccgcgctagcacctgcccaaggctcgggtctctcagaggca

SEQ ID NO: 75846 - DNA, 132 bp, Homo sapiens
  chr13:28364150-28364282
  hyper
cgccaagcagggagccccctctccggccgcggcccgccgggctgagagaccacagattaagtgcgccttggttctctcagggatgctattttgctccggcccgggtctctcccgcgccgagttgcacaacaa

SEQ ID NO: 75847 - DNA, 52 bp, Homo sapiens
  chr13:28364644-28364696
  hyper
agctttggccttgctcgcattcaggggctcttaaccccttcctccccgggca

SEQ ID NO: 75848 - DNA, 272 bp, Homo sapiens
  chr13:28364723-28364995
  hyper
cgctggccactcgcgggctcccagctccgggtgcagtgcccgccccttgcacccctgggccccgcccgcccttgcgcccctccagcctgcctctgcccagcggaaagcccctctccccgcccgggtctcgctcttcgcttcctctcagcgacccagcccagctcaaatttcccagagagcaattagaacgggaattaggctgcattgatgcgttccggctggtttgcaggcaccaccctagagtgggggagccttggcgctgagactctgtc

SEQ ID NO: 75849 - DNA, 609 bp, Homo sapiens
  chr13:28365486-28366095
  hyper
gtacacagctctgagcgtttgaagttgtttaaccattgtgtgaccagaaagaagagtgacgcggcaggaagaagaagccgggtcttggggagagcggaggcgggtcagggtgggcaaaggcagccgatgccaggaatacaaccgcccttcgcgccgttccaaactaagagatggcagcggtttcccagcgcactgctggaagtgtgctccagtagacagggtgtgggcaagatgcgcgggcagacagtccgcactcgccacatgtgctggggtgcgagatctagatctgcgccatctcggctttcattccccattccctgtctctgttcgtaacgctcagagactgtttttcctcttttacatccacggccctgtcatttgaaggaaagggctggttggccagcatctaccgaacaaagactgggcgtcgtaggcagcaccaaaattaagactatttgagaaacttagagaaaaccgagggacagcgatgggtctagggctggataaggaataatgagcccttctcctccctccccacagacgcctccttcacgcgggaacccggtcctccttcttccgacgcagagagagaagcgattccacaggtgg

SEQ ID NO: 75850 - DNA, 209 bp, Homo sapiens
  chr13:28366393-28366602
  hyper
agggagaggagggggcgagggcgcctgttacggcgtgggtggggttgacaagaatagagtacattatgcagttcatttagttaacaagtgaaataatgaggaagcgtgcagagtgaatgccaagagaaaaggcacaaaaaccctattgagaggccccggccgctcctggcgtagtccatcacatggcaatagtcctatttaagccgcgc

SEQ ID NO: 75851 - DNA, 375 bp, Homo sapiens; identical to SEQ ID NO: 34841
  chr13:28366664-28367039
  hyper

SEQ ID NO: 75852 - DNA, 693 bp, Homo sapiens
  chr13:28367253-28367946
  hyper
cgcgcagagggaccgggcagaggtgatccgaagcaggatggagagccagagatggaggaagagggaccctgggctttctgggggcggtgagggtcatgtcggggactaaggggggcgcttggggtggagtgaggatagagggccgggacacaacgccaggaggcggatgagggcagacgtccaggtcctggagtgtgggccggggtaagtgagggctgggatccaaggctctccatgaaggggaaggggttccagggctgcatgactccgggagaatcaggatctcggagctggacaaggagcgctcactgtagctctgctgtggattgtgttggggcgaagagatgggtaagaggtcaaagtcgtaggattctggcgaccgcctaccaagggattgggtccacagcacagaggtctgatcgcttccttctctgctctgccacctccagacagcagctctaaccagctgcccagcagcaagaggatgcgcacggctttcaccagcacgcagctgctagagctggagcgcgagttcgcttctaatatgtacctgtcccgcctacgtcgcatcgagatcgcgacctacctgaatctgtccgagaagcaggtgaagatctggtttcagaaccgccgagtgaagcacaagaaggagggcaagggcagcaaccatcgtggcggcggcggcgggggtgc

SEQ ID NO: 75853 - DNA, 918 bp, Homo sapiens
  chr13:28368153-28369071
  hyper
cgctgattcccaggcacccgcagccaaaccactgcctggcatggatttggcactgctttgcagaggtcccgggcctgggcagggctgagagcttggcagagactggaccatggcgtccccgccccagggctcgctcgtgtccaaagccaactccaagctgtgaacactgtaagcgctcgagtcctcctgggcagtgcagcaccgcggcccccgcccgcaagcctgcttggcgcagcgccttgctggcagccggcgcctcctagcccgccctctctgggctggcttgggcttcctcgcttactctactctcctccgctctcggtcaaggtcggcggccttggatgctcgttcgcttctctttttaaaatgtctttttgtccctccccacctctttcctgtgatcatttattcactcggcccccgcccgccaacacacacatttatgaacccccactttttttttccttctccttttcccttcccctcctcagggagcctcctccttcagtcagtccatttgtcccttgatctggccttgctgtcctcagtccccacggctcctctcacagatgataaatttcgcccgtagtatccatattggggaaacagatttgctctgtttccaacacgctcttccttcctctaaacataggaccccgctctgcgccgctggcgaccccactcttccccctccagactctggcccgccccagcctagctgtgtaattgtacggcctctgcaatgccagaagatatttatttatttatttatgtacaaaattttaaataaacttttttttttcttagaaatgcccgtggctctgagcccagaggccttcgctctggagtagacaggcgccaacccggattgggcctcccttctgggaagggttggggatccagttgcagggtccgagc

SEQ ID NO: 75854 - DNA, 906 bp, Homo sapiens; identical to SEQ ID NO: 34846
  chr13:28369161-28370067
  hyper

SEQ ID NO: 75855 - DNA, 15 bp, Homo sapiens
  chr13:28370409-28370424
  hyper
tagtcccagtctaac

SEQ ID NO: 75856 - DNA, 959 bp, Homo sapiens
  chr13:28370502-28371461
  hyper
cgaagacccagactacaaggccccggaaccaggagcttgtggggcttagttctaaaatcttccatcttttccttcaaatcaagctgaggatgggggtgggagggtctctctccagttcccctggaacaagggcaggcacgatctagctccccatggagaaactcttgccggttcttcctggagctaggcatctgagttgtgctctagactgatgaggatctccatcagtctgaacctcactttagacggggaccaattctccaccatcccaggaggcgacattgtgccaatctacggccaatctgaacgaagccaaggtgctttagtgcataccagtgaatagaatcacaactgttttactatcagtgatgaggctgatgcttgctgagttttgctcgtttgcatgttgctctagggccccagggtgagtgcagttgtgcactcttagctccagcaggaccggcccagcctccgtttggctgggatttgggggcgggcggcagcacgattttctggcaacgagttcgttgtgggtctgaaggaccggcttagaactagcacctctcctggattacaggagggggtggtcttgtgcacctgggaaaggccttcgccagcactcagtgtcaggcatcttgatcagaaatgcactttcgagcctgccagggaaccaagtttggaggggatggaaacggcggtgggagacatagaaaggatgaacacacacacccggctctccccgcactcgcctcttctccagctccccctcctctcccgcctaggagtccctcctgttcccagcttctccccagagtccgcagatccacagctgtgagccaggtccgcgtggggccagttttcccaggagtgcacgtttcctcctctcggcttcccagggattcatttccggaagaccaagctttcagctttctagtctgccttagcgagcagcgggagga

SEQ ID NO: 75857 - DNA, 305 bp, Homo sapiens
  chr13:28394662-28394967
  hyper
agttgtgttggaacccgtggagagaaggaactgtccgtttccaaactctgcttcggcccctctcccctcccacccacggccccaggcagagagggccggaaaggcagcccattcctgcccgcgcattcgggcgcacaagcgcattgcgcatgtactgtggagggggcaccctggtctccacctggaatgcgcttctagccaagtaattgcgtcgcctttgcgcgcagctggcctggggaacctgggcccatcagagccagttactcttggtccccgctttactggagggtcgcaggagactttcg

SEQ ID NO: 75858 - DNA, 481 bp, Homo sapiens
  chr13:28395176-28395657
  hyper
cgcctccctctcccacgagagaactggctgagagaaaacaaacctcagaacaaaaacccagtcaccccatgggccttttgttttcagtcaaatgcgcaaagccaggtggctcctttaacacccccagagattgtccccatgatctcctctgcgccatggggcgctgggtgctgggggcgccgtctgtatcctctgcctggtaactgcccccatcgcgccccactgcgccccagcccaggctggaaaactgggccaacagggaggcttggatggggggaaacccagcctgaggctggaaacggctagaagtgaacgggacgagtggctttgcaaaagcagccgctgcgattctctagcgccagcgcccctgcttccaggaactttacgcaagataggcgagaggggtggccgcactaaaagaaaaagaaaaattaaaaaaaaagacattccaactactttatccttgcgcagggaccccttc

SEQ ID NO: 75859 - DNA, 75 bp, Homo sapiens; identical to SEQ ID NO: 34851
  chr13:28395998-28396073
  hyper

SEQ ID NO: 75860 - DNA, 182 bp, Homo sapiens
  chr13:28396536-28396718
  hyper
ggctacctccaagcccggagctcaaaatgctcaatttatttattcttaattttgtggcgatcattcatggaagcaaaaaaggctacagtgtcctttttaagaaaagaaaagctaattcttgaagtgaccttggcagtctggtgcgtgccccatccgaacagagagggcggcttgtgtcaaca

SEQ ID NO: 75861 - DNA, 292 bp, Homo sapiens; identical to SEQ ID NO: 34853
  chr13:28397177-28397469
  hyper

SEQ ID NO: 75862 - DNA, 632 bp, Homo sapiens; identical to SEQ ID NO: 34854
  chr13:28491793-28492425
  hyper

SEQ ID NO: 75863 - DNA, 127 bp, Homo sapiens; identical to SEQ ID NO: 3999
  chr13:28492426-28492553
  hyper

SEQ ID NO: 75864 - DNA, 58 bp, Homo sapiens
  chr13:28494207-28494265
  hyper
cccggctccagctcccgactcccggctcccggctcccggctcccggtgcccaatcccg

SEQ ID NO: 75865 - DNA, 825 bp, Homo sapiens
  chr13:28494773-28495598
  hyper
cgccttggattatcccgggtcggactaaactacatcagggagctaccgagcccatccctcacagcagtgcttctctagtccagtttgaagcatctttcccacccagctctcctgggagtgtacactccttccttccctgttcgctgagcccatcttcgccccaggagcccgcgctcccagcgccatccttagagagccgaggctgagtcctgctcagggcttcggacactacagatcctcctccagcaggggatccgggaacccaggactccttggtagtgcacatcgaggaagccgagtagggacatgggtgcctcggacccaggccccagatcgccttcggagccccggagcccctcacttcccgcgcttcgttaaggaagggcaggcatctaggggcgccaggtaggtgcagaaaggcagggagggaaaggaaactgcacccaacccagcagtgtccggctgccctggttgtggaaacaggataggagtaaagaggaaggggctggggcaaggcgggggctcaccgcgaggctgaaagccggcctctcaacgtcagagcctggcagctaggagagcaatctgagaagcgaattcgtttttcaccaaccgaaagcaattgaagctgtctccccgcaccgcttcccaggaagtaatttttcaggagatgggcgctccctgcctagctggtggggaggcgagaggcctggttcctgcggccctccgcgccggcagagaacagaaggtctttcccggagccgggagccggaggcacggggtagcccccgggtcctttgcggccccgcgcgagcggcaagttccggc

SEQ ID NO: 75866 - DNA, 155 bp, Homo sapiens
  chr13:28495599-28495754
  hyper
cggcctgtgtcgtcgccgctactcactgtcatcgctgccgtgcctcagccacttctggtcacacctgcaccgcaaatagttgccttttcctttcaactggcagccgggagtagggggaagcagctcgagccggcgtcccccggcccaccccgaaa

SEQ ID NO: 75867 - DNA, 30 bp, Homo sapiens; identical to SEQ ID NO: 34857
  chr13:28503435-28503465
  hyper

SEQ ID NO: 75868 - DNA, 145 bp, Homo sapiens; identical to SEQ ID NO: 34858
  chr13:28527239-28527384
  hyper

SEQ ID NO: 75869 - DNA, 1150 bp, Homo sapiens
  chr13:28527845-28528995
  hyper
tgtgaagagaaggagcgggggttttaagagccacagcgccaccgagagagtggaaaggagtagattagctcgcgcctgctatgcgaggcgactccccccgagacccacccgcagcccagcgcccttggccaggaggcccggaaagccaccgaggcggccgaaaggggccgcggggcacccctcagcccctcctgcggcggctccggctgcccctgctcagcctcccgctccccgcccggagtcccagctctcagatcggccgcagagctgggaacagaggccgcggggtccaggccgttccgcccgctcagccggagcagcagcgccgcctgccgggggcctcgcgcaggcgagacaggccagacgccggaggccgcgggcggctgcagctttgacgggccgaacacaccagcgctcccgttccgccttttgaaaatcaaatcccttgggcctggtgccaccatcgctcagcccaggtcttcgacgacgggtcgaaggccagtgctccaggccttcttcaccgagtggcttcggcgcttgcggcccaggttccccgcacctccgcgccgtagttgcgcgcaccttttgaaaagcttggcgtcttcaggtataaggacaaaaacaaccgcggacatcacaccattccaaagaagaaaaagaaagtgcccggaatctcagggcgcgacttccggggcgacgggcggcggcggagaggcgctccccgggcttcctacccggcaggaggccgcggcgccgggacctcgcctgccctcaccgcgcgccacctctcgggagacgccgcgaatctctccagggaatcccgggcagcggcgcagacccagcaaggaccggcagcaggccgagaccggccgtcttgggcgagagcagcgggacacgagcccccgggcgcccgctgggagcgcggggaggctctgggctcagggaagctgcgctccgagtggccttggaggacggtcaaggagcccgggccccgcggcggccgggagtggacgcgactggtccgcgccggccgcaggggaaggggcgggtcggcgctgcctgagctctatctgctctaatggctggggtagatccgcggagatacttgaataccaggccgaacgcttccccaaggcgtgttgtagacaac

SEQ ID NO: 75870 - DNA, 108 bp, Homo sapiens
  chr13:28534446-28534554
  hyper
aaatcttgcagcgcccgggtttgggctcagccggagtcggcagaggcgcttgcacctcccaactgggtgaaaactggaacctttccgggttcacgagcccaagcccca

SEQ ID NO: 75871 - DNA, 10 bp, Homo sapiens
  chr13:28535260-28535270
  hyper
cccgacccca

SEQ ID NO: 75872 - DNA, 268 bp, Homo sapiens
  chr13:28535305-28535573
  hyper
cgcccgcgggccgggccaccggagcccctttcccaatcctggagctgtatacgccacccggaagggccgcggaattggagaggtgctgcagagggtctatacctcttgctgtttcccggctctgctcatcttccccaactgcccttaaggcgcctccgtgggcgcgctgattaggctctcggatgttggtgggaagatcgaaacgaagggctaagcccccctcgcccgggtcctgccggaaagttcagctcggcggcctccaggatca

SEQ ID NO: 75873 - DNA, 627 bp, Homo sapiens
  chr13:28540473-28541100
  hyper
taacgcgactttctccgcggtggacgctcggacacgcgtgaccgcctcaaacccactccaggctgccattggtactcgcccctttttacagatgaggaaatggagaatcagaccgggtcacgcagatagtatcaggcggggttggcaccggagcctggctggagccacagaggacacctccggagctgaggcgcagggcagttccctcagccgaacaccccgggagggagactcgcctggaagtgtctcggagcgacccttgctcgggtgctgccccttcagtgtcccggacgtgccgggcaacgcgatgaccagaccctgagcgctcttcgacccatgccccaagggccttggaggcgccccacaccccctgggaacctaggagcggggctatggaggggagggatgagagggacttgtcagaattcattattgactgcgaaagtcaccaccctctttccgggccctaaaagagacaatggcagggctgggaaggtgtatatcaaagcaagccaggccgcgtccccccctccacccccacaccttgacagatgacgctccgcagaggagcccggctccggcccgcgggctgcggccaccccacattaacatcacaagggcacccgg

SEQ ID NO: 75874 - DNA, 104 bp, Homo sapiens
  chr13:28541179-28541283
  hyper
cggcttccctcccgcccccttcccggccctcaccccgcggccgctctcccgggacacgcaaaggtcttccttagggcgtgcgccacccccgccaaccgcgcccc

SEQ ID NO: 75875 - DNA, 172 bp, Homo sapiens
  chr13:28541956-28542128
  hyper
tcagaggttcagagacggggcgcgcccccgtcgccttagcagctggggctagcaccttcttcccagcgacagcagctctccctggtctgcctgctcgctgtaccttgaattggcccgagtggccaaacccggtcccacacacagcctagccatcctccgacccccccaggtc

SEQ ID NO: 75876 - DNA, 40 bp, Homo sapiens
  chr13:28542355-28542395
  hyper
ctcttggaaagaggacgcctgaacacggtgttgagactca

SEQ ID NO: 75877 - DNA, 74 bp, Homo sapiens; identical to SEQ ID NO: 34865
  chr13:28542653-28542727
  hyper

SEQ ID NO: 75878 - DNA, 708 bp, Homo sapiens; identical to SEQ ID NO: 34866
  chr13:28542728-28543436
  hyper

SEQ ID NO: 75879 - DNA, 416 bp, Homo sapiens
  chr13:28544169-28544585
  hyper
gctagtggttattggcgtgcataactggaggcgagctaggggatcgttggtaaagcagtttcttaggctgctggttacacagaatgtcagtttgtgaaaattcattgagctacacttgtatgtttattatacttaaatataaggaaaagagaatttctgctaatgcttacctaggtatttatgtgtcttacatcatacctgtatctttaaaactctctgtcctttacaaagggaaacgttctccgaagaaatttatttctcatttccaggagatgataaggcaactcagggccattattaacgactgctaatgaaaagctctgagttgagaaaggatctctcttggtttgggaagcgctgcggccaaggggcctagggctggaagtggccgtcttggggaccgaagccgcgcagcc

SEQ ID NO: 75880 - DNA, 238 bp, Homo sapiens; identical to SEQ ID NO: 34868
  chr13:28544665-28544903
  hyper

SEQ ID NO: 75881 - DNA, 30 bp, Homo sapiens; identical to SEQ ID NO: 34869
  chr13:28545247-28545277
  hyper

SEQ ID NO: 75882 - DNA, 395 bp, Homo sapiens; identical to SEQ ID NO: 4002
  chr13:28549497-28549892
  hyper

SEQ ID NO: 75883 - DNA, 313 bp, Homo sapiens
  chr13:28550239-28550552
  hyper
cgccgcgcagccagctctctgtcccttcagctccagctccttctaaagggacagactcagcgtctgcccccatctgcaccccttcccgcaggaataaaatcattttccggacaagcttggaactgttgaaatgtaactatgtaattggagacaccggggtcgtgtctgggagattctgagctcatctacactcttgctaaactgcggggaacccagccctggtgggatctgtgcatctcacatgagcttttttacataaagagcacagacgctgcatttggggcctggtttatctaagcgtggggtttacccc

SEQ ID NO: 75884 - DNA, 420 bp, Homo sapiens; identical to SEQ ID NO: 34873
  chr13:28551129-28551549
  hyper

SEQ ID NO: 75885 - DNA, 727 bp, Homo sapiens; identical to SEQ ID NO: 34874
  chr13:28551658-28552385
  hyper

SEQ ID NO: 75886 - DNA, 514 bp, Homo sapiens; identical to SEQ ID NO: 34875
  chr13:28552659-28553173
  hyper

SEQ ID NO: 75887 - DNA, 30 bp, Homo sapiens
  chr13:28576403-28576433
  hypo
taagtctgcagccaccgctagtctggtggc

SEQ ID NO: 75888 - DNA, 30 bp, Homo sapiens
  chr13:28599972-28600002
  hypo
gtgcatggggatctccgtggggcctggtgg

SEQ ID NO: 75889 - DNA, 133 bp, Homo sapiens
  chr13:28613123-28613256
  hypo
tcggtgggaaaggttcggggccttcatagaggaggtagagctcgagctggagcctcacggatgagttggttttgatgagaggacaaaagaaaaggcatccaaggaggagacaaagcagcgactgaaggcgcca

SEQ ID NO: 75890 - DNA, 327 bp, Homo sapiens
  chr13:28673900-28674227
  hyper
tttggggacagtcctcggagtccttgaaaacccctttggggtttatgccaggataagaagagactagaagaaagggacagctagtattttaatatgtaaatctgtttgcataatatttcctaggtaaactattcgttgatccaaccaaaattcggcggggctggggggtatcgttattgaggatgactcgctctaggggagaacgcggacgcattttcccatcagagttccctccataaatcaaaacctcaaaagaagagttaaagacgacacccaggtgtctacagtatccaagggccgggccaggagaggtccttggccacctgg

SEQ ID NO: 75891 - DNA, 463 bp, Homo sapiens; identical to SEQ ID NO: 34877
  chr13:28674720-28675183
  hyper

SEQ ID NO: 75892 - DNA, 1213 bp, Homo sapiens; identical to SEQ ID NO: 1100
  chr13:29067773-29068986
  hyper

SEQ ID NO: 75893 - DNA, 858 bp, Homo sapiens
  chr13:29068993-29069851
  hyper
cggcctgctcgcccggtgcccgcgctccccgcggccaacgacccggccgccagagtccgtcctctcgttcgccgccgccggccccgcgccctgagcgcccgtctcgcggctccagccaggagacaaccacttccccgggtaatcctcgccgccaggcgcccgctggccgctgcacccgagccccggagcccgctccgagccgccgccgctgccggggaggagccgagaggagtgtccgcctggcgcgctccgagcctcccgcggacctcgatgaagagcagccgagggcgggggcgatttataacctttccccagcccacttcctaccccggcacctccttctggtgacgtcaaggggtcccccacccctcatccgcctccccacctaccctcttcttcctcccaggctcgcttccctgcggctacggagaggggcgggggccgacgagggcgggtggcccggggccgagcgcgcgtggggaggtgctggcgacgcgggcccgggagcgcggccccggcaggttcagggtctttgctccgcgccctcttgcccttgcccctcctcctgcccatcgcgctcaggaaatccttgcagactccctccacccggcttactcagctctgggggccgcccgaaactggggaagggacaaggctgaagctccgccgcctggccctaggggcggaaagtccgatccaagggaagctggccgcgcctccgcgacggtgttcttggcacggaggactgaggcgcagtccggctgtctccccttgcctgctcttcccgcgctgtcccgccgctcctgaccccttcagactgtcccgagaagtctaggaaggcaccggagaccctcggca

SEQ ID NO: 75894 - DNA, 440 bp, Homo sapiens
  chr13:29105249-29105689
  hyper
cccttcccaacagatcgagagctcggaggcttggcacggtcggtcccgatggccccagcgggagggtcacggttgagacagcagccccatctcattgtttaaggccggggcttcctcttttggcggagcgggagcgggagcgggagctgagcgggaaggggacggacgccgcgggagccttcgggatgtctattgctgccgctccctcccctcgccgggagcttgggtttcccggggtgtgtgcggattctcaataaaaagggaaaagcacgatccaagttaattttccagcgccgacaggaaatgctgtttcctgcatcgtacaacgctggtgccaacaagactgacacaggagcccattgtcccgcgaacaatgtggcgatggggaaggacgcctgagaaaacagaccccggccccgtgagcgcgtttgtttgatcct

SEQ ID NO: 75895 - DNA, 114 bp, Homo sapiens; identical to SEQ ID NO: 1102
  chr13:29106308-29106422
  hyper

SEQ ID NO: 75896 - DNA, 392 bp, Homo sapiens; identical to SEQ ID NO: 1103
  chr13:29106423-29106815
  hyper

SEQ ID NO: 75897 - DNA, 166 bp, Homo sapiens
  chr13:29106898-29107064
  hyper
cgccctgaggtcagggccggggcctgaggacacggcgctgggctccgggggacgcgggttcacgccggcgcccgagcgccacctccccgccctccgccggctcacgtagtcccggggttcggtacgtgaagtgccggcgcgaggctgctcaggccaccgcatgggc

SEQ ID NO: 75898 - DNA, 72 bp, Homo sapiens
  chr13:29107252-29107324
  hyper
cggagaaaatcagatgcagtctccttccctttggtgactatccgtgggggtttctcccggtggaaatgagcg

SEQ ID NO: 75899 - DNA, 588 bp, Homo sapiens
  chr13:29292691-29293279
  hyper
gcctcggatgccctgcgctcgtgcgcgcccgggttcaagggcagcctctggactggggcaacagaggacgcgccggggacagtaacctcggactacgcggccggcgctggggtggggagagtactttcccgtcgaactcgaccaaattacgcttgtcggggagtctcaagcgtattgtaaagcaaacctcggcaagcgcacttccgcgtcccgagtgacacctgcagggttctccggcagccctcggcttccccgcggccctgcggacctcggcctcagcgcggcgcggcggggcgcggagcagctgctccttctgcgcagtggacaatcggccaatcggcgcctccgtcggtcggtcagcggccctgccagcgctaggcgatgactcggccgcagccagctgagcatcgctgtccgccgaggaggcggggtcggctgccgcggcgctgtcactgttctacccggctctcctgcgattgggcccagcggtcggtgccccagcggcgattggtccacccggacgtcactctcccctggagagtggctagtggatcgtgcacccaccctcggaggcccggagtggatccc

SEQ ID NO: 75900 - DNA, 62 bp, Homo sapiens
  chr13:29293280-29293342
  hyper
cgcgaccgagcagccactcagcaccgctgttgagtggtgggccgcgccgcaggctcaacagc

SEQ ID NO: 75901 - DNA, 70 bp, Homo sapiens
  chr13:29352560-29352630
  hypo
agggagctggggcctcggggggaggtgacgcttgtataggctcccctctgtgctccggcggggcgatttt

SEQ ID NO: 75902 - DNA, 208 bp, Homo sapiens; identical to SEQ ID NO: 34886
  chr13:29393656-29393864
  hyper

SEQ ID NO: 75903 - DNA, 119 bp, Homo sapiens
  chr13:29394329-29394448
  hyper
gggagcgcctgggcgtcgtgcgggcggctccggtccccggctgcgccccggccctcgagcgggggcggcggcctgggcggtgcctgcgccgaggtgagtgcgggggcgcggagcggagc

SEQ ID NO: 75904 - DNA, 428 bp, Homo sapiens
  chr13:29394546-29394974
  hyper
cggctctcagggcaagtttatctccccccttctgcggaaacccttgaccgcttagcggagtacagacctgtcggtaaatagaaaactcgagctggagaggaggaggaagcagcgtggcggaacccggcccgagatgagcgtctccgtgagggcagtggtggcctcttggacattacatctttcttggctctttttgacccaggtgagcgaatcctctgctgcgcggtccggtggggtcggctggctctgctgccgccctctggacccgccggagacaggtgagcggagttggggagcgcgcagccgggctcggggcagcgccgggctggttcggcttctcgtctccagagcgctgatgcttcctgcccacatcacctgctctggcttagggactgcagctcttttggcaccttcgcttgctgccaggt

SEQ ID NO: 75905 - DNA, 182 bp, Homo sapiens
  chr13:29738377-29738559
  hypo
ggagggctcccttctcgctctgcctttccaggctccagtcagcatcatttgctttcctggcacgatttttgcggtctgctcatgttgtttacatcattatttctgtcctgaagtcagcagcactgtgcattgggcttagatttttgacagcgattttggcagatgtgcgctacagtgggaag

SEQ ID NO: 75906 - DNA, 208 bp, Homo sapiens
  chr13:29914008-29914216
  hypo
ggcggcaccctggcccggggcggcactatggtccggggccagcccaggtaccagctcaagtagttgcccatgacagcaatgcagtagtcgggacgttctcttagaaattcagcttccagaagtttccgaagtctgcggccggggccaagtgtgctgagcttggtgaccgttggaatcaggacgccagaaagcgcgcaaagcatcgcaa

SEQ ID NO: 75907 - DNA, 214 bp, Homo sapiens
  chr13:29933425-29933639
  hypo
ctcgaaatgggtttccgcccaagccggacccgcaggcccgtgaggctgagcggcagctggtgctgcggctgaaggagcggtgtgagcagcagaccagacagctgggcgttgcgcaaggggagctgaagagggccatctgcggctttgatgccctcgccgtggccacgcagcatttctttagaaaggtgaggccccatttcgtgaaggtccaagg

SEQ ID NO: 75908 - DNA, 40 bp, Homo sapiens
  chr13:29954759-29954799
  hypo
aagacatcagctggccgggcgcggtggctcacgcctgtaa

SEQ ID NO: 75909 - DNA, 19 bp, Homo sapiens
  chr13:30031261-30031280
  hypo
acagcgagactccattcaa

SEQ ID NO: 75910 - DNA, 30 bp, Homo sapiens
  chr13:30057559-30057589
  hypo
ccacggcatgtgctccggctacacaggtgg

SEQ ID NO: 75911 - DNA, 81 bp, Homo sapiens
  chr13:30098898-30098979
  hypo
tggagtccaggagggcgcagcttttgccaggtgtgtggggcccgggcacagctgggcactggcccacgggaggggctcagc

SEQ ID NO: 75912 - DNA, 123 bp, Homo sapiens
  chr13:30106999-30107122
  hypo
ggttttcagccagcacgccgggggcgttcagagtcatgtgtgtccgtgagaactccccgatgggtctgcctatcagctcgtcgaaggtggcgctccaggccctcgctacgcttgaagtacctg

SEQ ID NO: 75913 - DNA, 144 bp, Homo sapiens
  chr13:30123237-30123381
  hypo
gaggcctcctctttacgtggagcggacgtgctagtgggcactaagagaatagcctctatcagagaggagaatgcaattcaatttacctgaaattcctttcaggtatctggaaacaaatggccaattgcccgcatgctcacctga

SEQ ID NO: 75914 - DNA, 21 bp, Homo sapiens
  chr13:30149067-30149088
  hypo
accgtgcgtggccagagcagc

SEQ ID NO: 75915 - DNA, 64 bp, Homo sapiens; identical to SEQ ID NO: 43771
  chr13:30574503-30574567
  hypo

SEQ ID NO: 75916 - DNA, 26 bp, Homo sapiens
  chr13:30707178-30707204
  hypo
aggtccaggccatagcgacggggacc

SEQ ID NO: 75917 - DNA, 526 bp, Homo sapiens
  chr13:30707244-30707770
  hypo
cgtccctgcactgggtgggccgtgctgggagaaggtcccggggatcactcctcctaggccgccggggcagtctctccagccaccctctttccccagagccagcgggctggggttcttggtttagactctcttctctcctgtcctggaggaccagccatttgacgcccttgtccactgggaggatgttttccatgattccacttcttcccttcctcggccacctaaggcaggccggcttatgcgtgactgtcaaccgaggcaggccacagcgctgtgggcaggcggttttgcacgtatccttagtgaccctgaaggcccagcctctgctggctgcctgagccgagggttttacttcttttcatttaatcactttattggtccttgccgggagggagcccatgggtcctggtaaaagtgcatctccctgtggttctggggctgatcctccttctggagcagaagacagagctcagtgaggaccgcctgtgctgcctgcctgggacgccccagccgcagggccgcgcag

SEQ ID NO: 75918 - DNA, 186 bp, Homo sapiens; identical to SEQ ID NO: 43775
  chr13:30761001-30761187
  hypo

SEQ ID NO: 75919 - DNA, 30 bp, Homo sapiens
  chr13:31003108-31003138
  hypo
agattgaaatacctgcgagccgggtttggt

SEQ ID NO: 75920 - DNA, 175 bp, Homo sapiens
  chr13:31385108-31385283
  hypo
ctagtgggttatctgcgtggcttgcctgacctcagcagaaatccacagcgcagggcccagagctgtgtgagcacctgcaattgaagaattcacaattacaagtcatgtgtctaaattggcaggctttcaagaaagtcccaccaatcttcaagcatacagccgccaagggccacgt

SEQ ID NO: 75921 - DNA, 41 bp, Homo sapiens
  chr13:31415119-31415160
  hypo
gactggatttaggaacgtgtccgtcgcggtgtgtatctgca

SEQ ID NO: 75922 - DNA, 230 bp, Homo sapiens
  chr13:31742917-31743147
  hypo
cccaggcagataacccgccggctggtgcctcccaactcccaaagctcctttcgcctgggttctggtgtgccatccatgcttacgcatctctctgtgcccagtgccctgcactaagccaggtgtgtagccggccctcacgctgttagctgctgttaaatgccagcactccgccccacccaactctgttgtggctcctccgactgccagcacggctacgtcatcaaacaggt

SEQ ID NO: 75923 - DNA, 89 bp, Homo sapiens; identical to SEQ ID NO: 43777
  chr13:31821217-31821306
  hypo

SEQ ID NO: 75924 - DNA, 27 bp, Homo sapiens
  chr13:32159215-32159242
  hypo
ggcatgagccaccgcgcacggcccatg

SEQ ID NO: 75925 - DNA, 25 bp, Homo sapiens
  chr13:32244681-32244706
  hypo
acaggctaggctgggcgcggtggct

SEQ ID NO: 75926 - DNA, 30 bp, Homo sapiens
  chr13:32605107-32605137
  hyper
gcagataccaccatgcgtgtggaaggcagg

SEQ ID NO: 75927 - DNA, 34 bp, Homo sapiens
  chr13:32605459-32605493
  hyper
cccttagccccgcggcggccgtgtgggccggagg

SEQ ID NO: 75928 - DNA, 191 bp, Homo sapiens
  chr13:32605725-32605916
  hyper
ccggaggaggaggagcggccgagcatctctctctgctccgccgtgtcctttagatgagcactcccggccggagccggaggtggatccgcagagctgcctctgggcgcctgaccccgcgctgacatcacaacctgtgacaggcgcatcacgcccggtacctgctcccggccgctgcccgtcctcccagcctc

SEQ ID NO: 75929 - DNA, 91 bp, Homo sapiens
  chr13:32670558-32670649
  hypo
tgctagggaaaactgcgggggggggcttcatctgggaaatgacatttaagctgagtcttcaaagaatatgattaagacagtatatttgtgt

SEQ ID NO: 75930 - DNA, 171 bp, Homo sapiens
  chr13:32752857-32753028
  hypo
aataacattcttaatcgacagttgttcaactctatttgagtacttcctatgatctttatttaataagtgatatttaaaatccagaacttagtttcactcttgttttcgactccatatttctagtagcccaattaatgccaagaaaaccagcactgccggcagcggagacaa

SEQ ID NO: 75931 - DNA, 76 bp, Homo sapiens
  chr13:32755306-32755382
  hypo
gtgagccaccacgcccagcccagattttattcttaaaagaagtaattgtgggttctgactgcgtaggttaccagtt

SEQ ID NO: 75932 - DNA, 30 bp, Homo sapiens
  chr13:32798473-32798503
  hypo
tggttgactatctcccggagaccatcactc

SEQ ID NO: 75933 - DNA, 160 bp, Homo sapiens; identical to SEQ ID NO: 34889
  chr13:33001068-33001228
  hyper

SEQ ID NO: 75934 - DNA, 121 bp, Homo sapiens
  chr13:33113918-33114039
  hypo
tacagatttctactacgacctttgtctcctcataattaaactcatgcatcctactttgaaacaaccacatttacgtgaggttgtggcgttctcagtgtgttacatccgcaggcacactata

SEQ ID NO: 75935 - DNA, 17 bp, Homo sapiens
  chr13:33410944-33410961
  hypo
ctcggcctcccaaagtg

SEQ ID NO: 75936 - DNA, 86 bp, Homo sapiens
  chr13:33590122-33590208
  hyper
caggtgcttccccagcggcgcgctccgctagggcccggcaggatcccgcccccaagtcggggaaagttggtcggcgccttttctcc

SEQ ID NO: 75937 - DNA, 191 bp, Homo sapiens
  chr13:33590467-33590658
  hyper
gagcccgccggggagcgggggtgggcgcgccggcggtgggcgggcgggcgcggcggggcgcgggcataaaggggcgcggcgcggggccccggagcctggctcccgcgcagcatgcccgccagcgccccgccgcgccgcccgcggccgccgccgccgtcgctgtcgctgctgctggtgctgctgggcctggg

SEQ ID NO: 75938 - DNA, 375 bp, Homo sapiens; identical to SEQ ID NO: 34891
  chr13:33591066-33591441
  hyper

SEQ ID NO: 75939 - DNA, 105 bp, Homo sapiens
  chr13:33924609-33924714
  hyper
gactcagactcccggcgactggaaaggacggacgcggcactcccgccggggtcccgggacccaatgcgggcgcgacatgggtcggtccggcgctgggaggctgcg

SEQ ID NO: 75940 - DNA, 30 bp, Homo sapiens
  chr13:34345129-34345159
  hypo
ttatttggtctttggcgtggaattttgtca

SEQ ID NO: 75941 - DNA, 42 bp, Homo sapiens
  chr13:35516493-35516535
  hyper
cagcggcggcagcagcgtcaatagcatcggccacagcctgag

SEQ ID NO: 75942 - DNA, 41 bp, Homo sapiens; identical to SEQ ID NO: 34893
  chr13:35517132-35517173
  hyper

SEQ ID NO: 75943 - DNA, 646 bp, Homo sapiens; identical to SEQ ID NO: 34894
  chr13:36704800-36705446
  hyper

SEQ ID NO: 75944 - DNA, 119 bp, Homo sapiens; identical to SEQ ID NO: 34895
  chr13:36705447-36705566
  hyper

SEQ ID NO: 75945 - DNA, 15 bp, Homo sapiens
  chr13:36705621-36705636
  hyper
cgcccttcttggcag

SEQ ID NO: 75946 - DNA, 91 bp, Homo sapiens; identical to SEQ ID NO: 34897
  chr13:36729246-36729337
  hyper

SEQ ID NO: 75947 - DNA, 30 bp, Homo sapiens
  chr13:36788716-36788746
  hypo
acagccgctgcgtcccgggcccgccccctg

SEQ ID NO: 75948 - DNA, 30 bp, Homo sapiens
  chr13:36878705-36878735
  hypo
tacgccaacattgaccgcagaatccaccgc

SEQ ID NO: 75949 - DNA, 29 bp, Homo sapiens
  chr13:36883103-36883132
  hypo
aggtgtggtggctcacgcctgtaatccca

SEQ ID NO: 75950 - DNA, 44 bp, Homo sapiens
  chr13:36885927-36885971
  hypo
acaagagatttagtccgccaggcatggtggcttacgcctgtaat

SEQ ID NO: 75951 - DNA, 368 bp, Homo sapiens
  chr13:36919856-36920224
  hyper
taaagagtaaaatcacgcgcaatccatcccaatataaccgcagttgttcgtgggccttcttgcagagaaaggctgcccaaccttgacggggccatgggcgctgcgggagggcaaaagaccacagagatctgcgaagccaaagtaaacaacggggttggggcggcgagaatgatcaatagcgatgctccgaaaggactccgcgataggaatcgagcgggaaggattccctccatcctaacagtccatgggttaagaggccgaagcttccctaaataccacactcccgcgagagaagggactgagaacaacttctcaaactattctctctcgaaatcgctcccttcctcgaaaattccatctctgagact

SEQ ID NO: 75952 - DNA, 66 bp, Homo sapiens; identical to SEQ ID NO: 34899
  chr13:36920266-36920332
  hyper

SEQ ID NO: 75953 - DNA, 54 bp, Homo sapiens; identical to SEQ ID NO: 34900
  chr13:36920333-36920387
  hyper

SEQ ID NO: 75954 - DNA, 724 bp, Homo sapiens
  chr13:36920464-36921188
  hyper
cgctcgccgggggccggtcccgaggttcccaaggcctcgcgcgcgcgcttgccgtggcaaccaagacgttccacgacgcgcgctctcgaacgcttcgcgtcacgcggccgcgcggccccgcccgtcggcctcgctcccgccacagagcccgcagcacgccgccgccgcagcctaggtcacgtgagtacccacgcgcgcgtcttgccagcggattcatcaccggcctgctcagactaggttctgcccactctgaccttctaaatggtacgtgggaggacgtccgtccccttcggacccaagagtcaccgtaacactctagaaggggagaaaaggagcgagggcggcaggcgacagagaacctcgcgagtcagcggccccgcgcagacccccccaggcacggtcccctgcggccacgtcggctgctcggcgcctgcgcaatctctttctctccagcgaaaccgaggcctccggagagcctagtagagagtgtgggcagtgagcgcttgtagccgctagagggagcgctgggcacagtgcacgagagacaataaaggctgattatcccctcaatgtctctgcagcctgagctttgtgacttctgtatccagagcacagttaatttccaaaagcccgcctgcaccacgtgttttaagtcttggtgtgtgtgtaaagtctatatcactatcataaaactgttagttcctgattccgggatacaaagagt

SEQ ID NO: 75955 - DNA, 161 bp, Homo sapiens
  chr13:37004731-37004892
  hyper
ttgtccgctcccaagcgactcaggctcttggcaggacttgctgtagagtcccagacggagttagccactgagtccttcagcgacccaggaaataacaacactgttggcaggtgggggagggcgcccgggaagatatccaatagtggcgtcaggcaagagga

SEQ ID NO: 75956 - DNA, 108 bp, Homo sapiens; identical to SEQ ID NO: 4013
  chr13:37005473-37005581
  hyper

SEQ ID NO: 75957 - DNA, 164 bp, Homo sapiens; identical to SEQ ID NO: 4014
  chr13:37005899-37006063
  hyper

SEQ ID NO: 75958 - DNA, 225 bp, Homo sapiens; identical to SEQ ID NO: 34905
  chr13:37006433-37006658
  hyper

SEQ ID NO: 75959 - DNA, 138 bp, Homo sapiens; identical to SEQ ID NO: 34906
  chr13:37006733-37006871
  hyper

SEQ ID NO: 75960 - DNA, 176 bp, Homo sapiens
  chr13:37247973-37248149
  hyper
attttccaatggtggcgcaagctcctccctcgcccgagctgggcgccgtcctagagccaagcgcccgctagagccgagactagggggcggtgaggagtgggacccgctcgcggccattggttgtgcggccaggaggggcggagggacgacgcgcgggctgtgcggggccggcagcc

SEQ ID NO: 75961 - DNA, 482 bp, Homo sapiens
  chr13:37248512-37248994
  hyper
gtgtccttactgtcccgagaagcaatcgcagcccggctctccgagtcttggggtgactccacgggctgcaggaggagccgcgaggggccctgagtgcaatgtccttggccccgtgttgacctgcctcggtcccagacactgggaaccgggaaggtctaccctcgctctgcaaggtggattcctccatgcaagtgtagacagttctacactttgcagagtgtgtctaggtgccttctgtttgcttttgcctttgtggtgtgtggagggtcattcttgggtttgttttgctcctgtctgattttctagggtcatttgcgtcccttctcgggaacggggactcgccatgcgcacactgacagctggctttgcacctgctaaggcgctggagagtcttttcgcccgtcttagggtggccctaaatccggggaagttttatgtggcgctgaacacttgcgtttcccaggggcgttttccctagctcc

SEQ ID NO: 75962 - DNA, 15 bp, Homo sapiens
  chr13:37249039-37249054
  hyper
cgggtctgatgagac

SEQ ID NO: 75963 - DNA, 67 bp, Homo sapiens
  chr13:37493463-37493530
  hyper
atctgcttcccacctcgccccctcccctctgcggagagctggcaccgaggggcgggccaaggaaaag

SEQ ID NO: 75964 - DNA, 103 bp, Homo sapiens
  chr13:37494004-37494107
  hyper
cccgggaacaacgaccgccaaaagccaagcctcacgccgaggagcctcccaggctgccccgaggacgaacaacttcgccctccactcaatgcgctcacacgca

SEQ ID NO: 75965 - DNA, 461 bp, Homo sapiens
  chr13:37643689-37644150
  hypo
tcccggaagcaacctcctgtgctgcccccaaactcatgcagccaggtgggacccgaccctaggcccggagctttcatcactcgggactctggccccacactgctgctctcacccacgcactgctgctgtggggagggcgtggggaggaggcggagctgggcccggggctgtgccacgcttcacgcttcacggaaccagcgggagccaaggacaagcaggagccgccccgcagccccttgggggccgccgctatgaggccaggccaagtcgcccagcccagagggggagtgatggagccacgcgattgggcacagaggagtgggcagagaggcacccagcaaggacctggagcccccgccccaggctgtgaggaggcatggcccgggctgcctgcacattccacagagcaggcaggagccccaccttcccaggtgcaggacccaggccgtctgtgggatctg

SEQ ID NO: 75966 - DNA, 210 bp, Homo sapiens
  chr13:38443222-38443432
  hyper
gacgcagaatgtaatcgatcggtagaacattgatcactctccttccttcgttaccctactttaagtgccggagagctaaggcctcacttatatgcacccagatgcccccgagatctccattttccccaaatgcataaaaggctaaaaacggccacattccccagcaccacggcgtggctgcagctcctttgtttaccatataagtcacac

SEQ ID NO: 75967 - DNA, 155 bp, Homo sapiens
  chr13:38443479-38443634
  hyper
cggaagactgaggagcacccccaaactcctgctcagcccgagtcaagcaccgaaagcttcacaggtttttttcctgagccttgaagagaaaccacatagccagaaccttttgaactcctaaccccgcagggatgtccgcctcccagaagagagcc

SEQ ID NO: 75968 - DNA, 75 bp, Homo sapiens
  chr13:38443635-38443710
  hyper
gcttcccaggcagcttaggaaacttaaccgagatcccagaaagaaggcgaggtgtagctccggtcgaacggagcc

SEQ ID NO: 75969 - DNA, 291 bp, Homo sapiens
  chr13:39260356-39260647
  hyper
ttggtctaattactgcgaagagaacaggaacgtctctaatgacagctaccctaacagagtcggatttgggagcgcctggggccacattccctagaatttattctttggtgcaagactagcaattctgatcagactgcatttctcacgcattccaaatgccctttttcccttttactctgtgaacctcggttgcaaaggaggggcttgttaaaaactcaccaatcggaggactgtgcccattgtaattcacgaggagaaggcagcgtctgggcgcgccgaagggggctgggc

SEQ ID NO: 75970 - DNA, 389 bp, Homo sapiens
  chr13:39261007-39261396
  hyper
caggacaacctgttgcgcctctatctcctcccctccccgcagtttccccgccttggcctctaagagctgattggcagaaattactacccaaccctcagctccgcacctcctcccccgaccaacgattggccacctgggaggactggagtaaggggtgcgagcggagggatttccctcaaagcccagggtccggggacctggaaagtagaagtggagggattcaattctccgcgcgattgaggcgctagcggcggagctggacggcctgggaaggcttcggctcctcggctgcggctccagcccggacggcgccgcgcaactttgccatccttctggcccagccccggctacaggaggaccccgcgggcaacgcgcggagttcctggcac

SEQ ID NO: 75971 - DNA, 94 bp, Homo sapiens; identical to SEQ ID NO: 34912
  chr13:39261689-39261783
  hyper

SEQ ID NO: 75972 - DNA, 102 bp, Homo sapiens; identical to SEQ ID NO: 34913
  chr13:39261928-39262030
  hyper

SEQ ID NO: 75973 - DNA, 183 bp, Homo sapiens
  chr13:39262129-39262312
  hyper
cgcgtgggcatcctgtccggcttgggcgcgctgcctcgctatggagaactcctccactacccgcaggtccctggaggagccagagagggaggcgccccggagactctcctgatggactgcaaagctttccaggaactaggcgtgcgctatcgccacacagccgccagtcgctcaccaaacagg

SEQ ID NO: 75974 - DNA, 231 bp, Homo sapiens
  chr13:40020679-40020910
  hypo
agggtaaacaaagatcgtgtcccaactgtgtaccacaatcaacgtcgtatctgaggatctcggtgatcctcatagcttccctatgaggctgataccatcttcattctgtagctagagaaactaagatttaggaaagtaaaccatattgcccaaagtactctagttaagtggcaaagccggtattttcatttaggtcccgtccaatagcaaacttcacgatactaagtggca

SEQ ID NO: 75975 - DNA, 30 bp, Homo sapiens
  chr13:40211522-40211552
  hypo
tttttttttttgattcgttgttaggcacgt

SEQ ID NO: 75976 - DNA, 86 bp, Homo sapiens
  chr13:41103265-41103351
  hypo
ttttacaaccttactcgtactcttcaaagctgtcaacgtcttaaaaacaaagaaagtctgagaaactgtcgcggtcaagaggaggc

SEQ ID NO: 75977 - DNA, 48 bp, Homo sapiens
  chr13:41238485-41238533
  hyper
tcagcttggggaggccgcgccacgactggaccccgcccccgggaagcc

SEQ ID NO: 75978 - DNA, 35 bp, Homo sapiens
  chr13:41241688-41241723
  hyper
tgggcgggaatctcccgctccgtccactaagtcca

SEQ ID NO: 75979 - DNA, 30 bp, Homo sapiens
  chr13:41496219-41496249
  hypo
acacaagctacaggccgagcgtggtggctc

SEQ ID NO: 75980 - DNA, 53 bp, Homo sapiens; identical to SEQ ID NO: 15760
  chr13:41681520-41681573
  hypo

SEQ ID NO: 75981 - DNA, 30 bp, Homo sapiens; identical to SEQ ID NO: 43786
  chr13:41705935-41705965
  hypo

SEQ ID NO: 75982 - DNA, 53 bp, Homo sapiens
  chr13:41859167-41859220
  hypo
ttattgtgagttcctcgaattgttgacttactgattaacgtatgatctactga

SEQ ID NO: 75983 - DNA, 30 bp, Homo sapiens
  chr13:42021853-42021883
  hypo
cgaatattttcagagcgtgaacaccttctg

SEQ ID NO: 75984 - DNA, 30 bp, Homo sapiens
  chr13:42022516-42022546
  hypo
taggataatcatccccgtggataactacaa

SEQ ID NO: 75985 - DNA, 231 bp, Homo sapiens
  chr13:42031162-42031393
  hyper
aactcctgcccctctcgccccgaccctctccactccgcccgcccaccatctcggaagtccccttgggacaatgcgtaggggacctccgcgtccccgacacccgactgggacacggccgcgggctccttcgtccctcaccgccagccagggaggctctgcatgcccacgtccacttcacagccgaggaagctgcggctcgcggaggtgcctggcacgcggcgggaagcagca

SEQ ID NO: 75986 - DNA, 153 bp, Homo sapiens
  chr13:42032496-42032649
  hyper
cgcgtcgcccttccacgagcgccacttccactacgaggagcacctggagcgcatgaagcggcgcagcagcgccagtgtcagcgacagcagcggcttcagcgactcggagagtaagtgcggcccccgctaggatggcgccgggatctcccagct

SEQ ID NO: 75987 - DNA, 29 bp, Homo sapiens
  chr13:42063589-42063618
  hypo
ggcgtgagccaccgcgcctggccactcct

SEQ ID NO: 75988 - DNA, 181 bp, Homo sapiens; identical to SEQ ID NO: 43787
  chr13:42540722-42540903
  hypo

SEQ ID NO: 75989 - DNA, 19 bp, Homo sapiens
  chr13:43149215-43149234
  hyper
gtgggcagaatgacacggc

SEQ ID NO: 75990 - DNA, 98 bp, Homo sapiens
  chr13:43149235-43149333
  hyper
cgaccagagaggcgcgggctcgggatgggggctctgcggctgtggcgctgtcctgtgggggtgaaggaagagggacagccccacgtgcctgctaggga

SEQ ID NO: 75991 - DNA, 51 bp, Homo sapiens
  chr13:43543176-43543227
  hypo
atccataggtggccccgccctccctcattccggcagcggctgtgcttgctt

SEQ ID NO: 75992 - DNA, 637 bp, Homo sapiens
  chr13:43565939-43566576
  hyper
tcaatttataaggtgcggcatggatactttcatttaagcaaatgagctttcattcagtcaaaatccctgttgttgggcccctgtggttttaaactccaaggaccaaggtgcttgtgagtgagtatgtttggggcccgggctcccgccccgaagccaggttgttaaaatactcaccgcctctggcccgcgtgcacgacgctctcccgcgaagggcccttaggggctgcctccaaaccctctctctggtcttccacggggctcagctccccttgccgcccagaagggtcctggggatcccgggtcgggcgggaggcaggggaggcgccgagcccggagttcaccactctattgcgggtgttcatggttcacagcccgcgggtcccgggccgccgtcgctgcgggagggatgcggctgggacgcttagcgagtctcaagatgggattccaaagtgcagaggcagcggttttaacagctgagtttcggtttctcagaatcagcagcagactgcgcccgccccagagaacttccccacgtattctccactgaggccccgtccgaccttatcgcgggttaacagcccaggatgttgacttgagctggcttggtcggctacaggtgagacggtttaaagtctca

SEQ ID NO: 75993 - DNA, 30 bp, Homo sapiens
  chr13:43728041-43728071
  hypo
gcgtgattctggttgcgttgtttttctgac

SEQ ID NO: 75994 - DNA, 199 bp, Homo sapiens
  chr13:43985951-43986150
  hypo
actgtgtccaacactcgcggtacagagagattaccaggcacctgtcacctacacccttcggcactgctgcaagcatctctgaaaccaggagaaagcttaccagacacgagctgctgtccaggcaaccctacgggaaccatgcccaggttattcatggctgtagcccaggctgtgggatctgtcacggacatgttgagct

SEQ ID NO: 75995 - DNA, 160 bp, Homo sapiens
  chr13:44359820-44359980
  hyper
ggcttgcccacctgtcgaccccactttccccatgtgctcgccgcgggatgacaaccacaacactccagaaccaccccccttccgaaagagggcggggttacgccttcagccaatcaggacccgcgagccccgggtgtccaacctatggggtggctgtggc

SEQ ID NO: 75996 - DNA, 236 bp, Homo sapiens; identical to SEQ ID NO: 34919
  chr13:44360043-44360279
  hyper

SEQ ID NO: 75997 - DNA, 327 bp, Homo sapiens; identical to SEQ ID NO: 34920
  chr13:44360467-44360794
  hyper

SEQ ID NO: 75998 - DNA, 231 bp, Homo sapiens
  chr13:44360995-44361226
  hyper
cggctggaagcctgtgtgagtagcggcgcccgggagagcggggatctgctgaggggcgctggagactccgcggctggaggcgcgcgggcgtgcgcacgcgcgcctgcgagtgtgagtgtatgggtgcgcgcgcgcccacggggtgggggagtcgcgaggggagggggagagaggccgagagatgctcgtagggaccgaggcaaaattctacgaccccggaaatccgtaaac

SEQ ID NO: 75999 - DNA, 34 bp, Homo sapiens
  chr13:44361544-44361578
  hyper
gccaagagaagaacccgggcgcacgtggccgact

SEQ ID NO: 76000 - DNA, 817 bp, Homo sapiens
  chr13:44947725-44948542
  hyper
cgtccccgtccccgacgcgctcacaaacgccgtggtcgcccgaaccttcggccccgcagcattcggctacaggaccgcgacactgcagggccccggctctgcgcgctgcgctccggccgctcggcgcgggaggacgtgcggtcgcgcctgcctcggtggccgcgcggggtaggtggctgcggggaccggaaggatggcgaggaagtcggaaagggtttcctgagatgagagattacttccgtccgggctgcggcctctctctggagtcggctagccggggctcggggagcggggtgcgcagggctcggggccacgccttgccacctgcagcgcccgggtgggccgcgggggcctcggcgggacgcgctcggccctgtcgcaggagctaacgcagggggaatccttgcaggtgggagcatttcagagcgcacaagccatggtggccaaacagcggatccggatggctaacgagaagcacagcaaaaacatcacccagagggggaacgtagccaaaaccctggtaaggcggggtcggcgccggccaggcagagccctgcagcccggcggggtggggcggaaggtgggggcggggccgggcgggtagcggcgcagggtccggcctcccggctcccggcccgccccttctgcggggtcctgcagagtgggggctgagagctgggttcagggcggcgcggtctgcttggcgtcctcgtgggcggagagggccctggttggtcgtggcccctctgggagtggctacctgggctaccagggaggcgcagaggagccctcctccccgacccgcaccccctgtccc

SEQ ID NO: 76001 - DNA, 56 bp, Homo sapiens
  chr13:45165560-45165616
  hypo
ccctgccccaggcttcgagggggcgctgccggttgccggtgcgaggcgctgggagc

SEQ ID NO: 76002 - DNA, 38 bp, Homo sapiens
  chr13:45491139-45491177
  hypo
gcccgtgcgacataactagactccgtctcaaaaaacaa

SEQ ID NO: 76003 - DNA, 26 bp, Homo sapiens
  chr13:45562261-45562287
  hypo
ctgcactacctggcccggcgtggtgg

SEQ ID NO: 76004 - DNA, 26 bp, Homo sapiens
  chr13:45562467-45562493
  hypo
ttgcttgaactcgggaggcagaggtt

SEQ ID NO: 76005 - DNA, 260 bp, Homo sapiens
  chr13:45564543-45564803
  hypo
cctttccagattccccgaagcattgtcatgcctttctttttgccctcgggttttttcctaattacattgcatatttagtacactgtatttgaataatttgtcgacataatctgtctccaccattgcactatggtcttctacctgaacacgcaacaggcacttggtatatacgaaacgaatgcttctcggattccggcatgcatacctatctgctttaatgtttattcacatttgtagactagcaccgacacccagttgga

SEQ ID NO: 76006 - DNA, 281 bp, Homo sapiens
  chr13:45885713-45885994
  hyper
ttctggtctgaatggcggtggaggggaaggtagaaaggaggcgtctgccgagcagcatccgcgcggagcgagctgcggtcctcgggaccccgcagcaggagccacgagcccgccccggcgtccgagccctgcaggcgaggccaggcttggcgcggagggacctcagcgtccggggagcgctcgctgtctttgagttcctgctgccagagccgggcctcctctgctctccgcagcctcgcagggagggcgcaggggcgagtcctgggcgggcagggcagccg

SEQ ID NO: 76007 - DNA, 22 bp, Homo sapiens
  chr13:45905242-45905264
  hypo
cttttgtcgatttgtcttttgt

SEQ ID NO: 76008 - DNA, 34 bp, Homo sapiens
  chr13:45926312-45926346
  hypo
ttactcagagaatagcgaacgcttccttgtgcca

SEQ ID NO: 76009 - DNA, 30 bp, Homo sapiens; identical to SEQ ID NO: 43794
  chr13:45939250-45939280
  hypo

SEQ ID NO: 76010 - DNA, 34 bp, Homo sapiens; identical to SEQ ID NO: 43795
  chr13:45950905-45950939
  hypo

SEQ ID NO: 76011 - DNA, 30 bp, Homo sapiens
  chr13:45992804-45992834
  hyper
tggaaaagcaaccttcgcagggggcaacct

SEQ ID NO: 76012 - DNA, 146 bp, Homo sapiens; identical to SEQ ID NO: 34924
  chr13:46189788-46189934
  hyper

SEQ ID NO: 76013 - DNA, 30 bp, Homo sapiens
  chr13:46424993-46425023
  hyper
ctccagtacacagagcgcatctaaccagca

SEQ ID NO: 76014 - DNA, 195 bp, Homo sapiens
  chr13:46425360-46425555
  hyper
ctctcaggttgacagcgtcggggaaagacatcagaccatcaatccagcttttcctgccagctggggaaacaacactcggtcactaacagcacccaatcacctagagagcgagagtgagccgaggcaaacacgccgggttccagacaccgtcccagcccccgagacccgggtttgcaaagggctgcacacgttcgc

SEQ ID NO: 76015 - DNA, 79 bp, Homo sapiens
  chr13:46425575-46425654
  hyper
cgagaaaggacttgaacctgagcccggtgaaggtaaaatgacacagagactcacctttaggttgtgtgtggggttgacg

SEQ ID NO: 76016 - DNA, 90 bp, Homo sapiens
  chr13:46659250-46659340
  hypo
ctgggattacaggcacgagccactacacgtactttttcaaagcactttcacactcatttcctttgatatttataacgctttgatatagac

SEQ ID NO: 76017 - DNA, 20 bp, Homo sapiens
  chr13:46660849-46660869
  hypo
tcctacggctatttatggca

SEQ ID NO: 76018 - DNA, 147 bp, Homo sapiens
  chr13:46661276-46661423
  hypo
ggtctgtagctgcagcgggcagctgcagctgcgcctggggagcatgaggctgccgccctgccatcacagaagggggcgggacttttacctcctcctggcttctgctggctccgtggagcacacagccccagccgtgcctcccgcatg

SEQ ID NO: 76019 - DNA, 406 bp, Homo sapiens
  chr13:46785697-46786103
  hyper
attagccccgggacccggctgcacaaaagtgcagccttaaagaatgccagcccatattctagacacccaagtaaagcatcctgtaatcgagagaaaataataaataatagtggtcattgccattaagcataaaaatagtaataacaattgtcaccacggcgttccgtacagcagctgcgcgtggagccggcttctcctccggcccccacggcccgcagcttcccctgcagccccacagtgcgtcggaggaaggcgagggctccgcgcgcgctgcaccgtgggctgggcctgcccctcccggcgcccgcctcgcctcgcctgtcccgcgcccgcctcgcctgtcccgcccccgcgcctgcgcgtcaagtggctgggctggcttagcggaccccggttgctagggtgt

SEQ ID NO: 76020 - DNA, 30 bp, Homo sapiens
  chr13:46896454-46896484
  hypo
ggtgtgggtaactgtcggggcaactgtgtg

SEQ ID NO: 76021 - DNA, 172 bp, Homo sapiens; identical to SEQ ID NO: 15765
  chr13:46920144-46920316
  hypo

SEQ ID NO: 76022 - DNA, 21 bp, Homo sapiens
  chr13:46926247-46926268
  hypo
ccaccacgcccactgcacttt

SEQ ID NO: 76023 - DNA, 599 bp, Homo sapiens
  chr13:46961084-46961683
  hyper
tctccaaggggtccccgacactgctctgagcgaccctaagatacctgggtgtctctgctgggcacaaacctctctggcgccacttccaccatccaacctctcccgcggccctcccttccctttctccaaccaccctctccaccccgcgccgctcccatctcgcccccggccccgccagcctcacccagccaaacccgagcggtggaacgctgcgctgggtaaacgccgcgcgtcgggtcctccctcgcgcggctccgggcagcgttccgtggccaccgcgctcccggtaacagcagaaaggggagggaggagagctaccgaggaggggacagcgacgccccgacgccgccacgccccccgcctcccacacgggggccaccgtagctctctagaagctcctcagggaagcaaagcgccgttcccgccgcaggcaccgagacgtcgcccagatggaagaaactctggagatgcgcgctcctacaccggtgccgcggcgcccgggcccagcaccacgcacctatgcgcgcctctgccggtcctcctagaaatcccgccctgcctacccgcggcgcgagacgcaacgacgctttcaggggtca

SEQ ID NO: 76024 - DNA, 158 bp, Homo sapiens
  chr13:47043913-47044071
  hypo
agagacaccatctcaaaaaaaagaaaagaaaaggaaaaataaaaccatgtatttacccatggagtcaccatttccagtgctgtcattcataggtgaggatgatgcaattgacccattaaaagacaagggcttggggccgggcgcggtgggtgactcac

SEQ ID NO: 76025 - DNA, 16 bp, Homo sapiens
  chr13:47526166-47526182
  hypo
tcgctatcttttaacc

SEQ ID NO: 76026 - DNA, 142 bp, Homo sapiens; identical to SEQ ID NO: 43800
  chr13:47528522-47528664
  hypo

SEQ ID NO: 76027 - DNA, 30 bp, Homo sapiens
  chr13:47685252-47685282
  hypo
atcagagtccccttccgtccttatgggacg

SEQ ID NO: 76028 - DNA, 29 bp, Homo sapiens
  chr13:48318948-48318977
  hypo
ggagttggccgggcgcggtggctcacgcc

SEQ ID NO: 76029 - DNA, 30 bp, Homo sapiens; identical to SEQ ID NO: 15766
  chr13:48667877-48667907
  hypo

SEQ ID NO: 76030 - DNA, 30 bp, Homo sapiens
  chr13:49254587-49254617
  hypo
tcacgcagcatgtttcgttttcttcctaac

SEQ ID NO: 76031 - DNA, 809 bp, Homo sapiens
  chr13:49794117-49794926
  hyper
gcagacatcgctcaccggaccgggtagggctcgtgcgctaagggcgccgggtattccagttagtggagagggaagcgccctggaactgcatgggcccgggagagggcgcgggagcggagcagggccgggccggggcgggccgcggccgtgggcggagactgcgcgcagctagctcgggagcgcctcggagcccaccccgcagagccgcttctcgcgccccgcagcgcagcgcagcgctccgccgtctgacctgccgcgcccgcagcgtgcgggctgggaaaggaggcgctcaccgagagggaccacgcgccaggctcccagcccgacccgggacgcggcggccgcgcggagcacccatgggcagcccctggaacggcagcgacggccccgagggggcgcgggagccgccgtggcccgcgctgccgccttgcgacgagcgccgctgctcgccctttcccctgggggcgctggtgccggtgaccgctgtgtgcctgtgcctgttcgtcgtcggggtgagcggcaacgtggtgaccgtgatgctgatcgggcgctaccgggacatgcggaccaccaccaacttgtacctgggcagcatggccgtgtccgacctactcatcctgctcgggctgccgttcgacctgtaccgcctctggcgctcgcggccctgggtgttcgggccgctgctctgccgcctgtccctctacgtgggcgagggctgcacctacgccacgctgctgcacatgaccgcgctcagcgtcgagcgctacctggccatctgccgcccgctccgcgcccgcgtcttggtcacc

SEQ ID NO: 76032 - DNA, 30 bp, Homo sapiens
  chr13:49877160-49877190
  hypo
cagaggtgggagccacggtggggcacgcac

SEQ ID NO: 76033 - DNA, 63 bp, Homo sapiens; identical to SEQ ID NO: 43802
  chr13:49922188-49922251
  hypo

SEQ ID NO: 76034 - DNA, 138 bp, Homo sapiens
  chr13:49922941-49923079
  hypo
ccaggacttgcctcccgcttaaccacccaccactctttggtcttctccatcacaacaaatctctctgacggcccagcctgcaggctccgcctccagggagaccacgccccgtccctcaccctccgccaggcattcttc

SEQ ID NO: 76035 - DNA, 238 bp, Homo sapiens
  chr13:50070420-50070658
  hyper
ggccagaggacagggcgcggcccaggccagttccacaggtggctctgactgcccatggtttcgcgcgagtggtgggcacgcttcggtttacctcccccgcgggtgacagcccagtgcttccaccacaaccgatgtcaactctcctagcgcccctccgctcaccggtaaaccaggacagtggaggggcgccctgatgcggtgaggcagggggcggccctgagggaagagctgggtctca

SEQ ID NO: 76036 - DNA, 33 bp, Homo sapiens
  chr13:50070684-50070717
  hyper
cgtctccccttctccagtcgttccagtcctccc

SEQ ID NO: 76037 - DNA, 21 bp, Homo sapiens
  chr13:50367842-50367863
  hypo
ataaagagctgctttcggccg

SEQ ID NO: 76038 - DNA, 311 bp, Homo sapiens
  chr13:50704489-50704800
  hyper
gataagatactccctcgccggctccctccgtgagcggggctgggcgggtgcggaggggcgggcggtgcgcctcgccgagcccggggcgctgaggtcggcaagtcgtcttcggaactggcggcggcgcttctccagtcgacgtggaaaaaaaaatcgtctcaaatagcacccctcggtctgcagccctttaacactggtaaagtagataacaaggaactctgctgaacgagggaaactcagtttagaacgtcccagagtttccaagtttgtcaagcgactgggaatcttggtcgccgcgtggagagctgcgc

SEQ ID NO: 76039 - DNA, 52 bp, Homo sapiens
  chr13:50705047-50705099
  hyper
caattggctgaatctcgaaataacttttttgatagtccggaaaagaaacatg

SEQ ID NO: 76040 - DNA, 92 bp, Homo sapiens
  chr13:51086819-51086911
  hyper
tctctgcaatttggccgctcctggacttgttgcagccaggcttcaaagagaaaccaccgcttcctccccgagccccacgccagcctcagagg

SEQ ID NO: 76041 - DNA, 104 bp, Homo sapiens
  chr13:51796701-51796805
  hyper
gagggtgagccgcgccgggccgggccgcgggcggggggcgctctccgagttgcgcggcggctcctccccggacggggaccctcctgatccgtgcgacgggaccg

SEQ ID NO: 76042 - DNA, 231 bp, Homo sapiens
  chr13:51797015-51797246
  hyper
tgtttcctccttcctcggggactttcctcctgtagctccggagccccctggagtccggccctggagatcgggagaggaagaaaagcagggtgggacacccgcacctaaaagtctttccgaagtcggctaggaggatggcatttctcgttatatggcttcatcgtgggactttaatctgtgctgccgagtccccctccccgactcctccagtcccgccgaacttcctcacct

SEQ ID NO: 76043 - DNA, 30 bp, Homo sapiens
  chr13:52389910-52389940
  hypo
ttagtggtcactgttcggtgtcatcctgga

SEQ ID NO: 76044 - DNA, 30 bp, Homo sapiens
  chr13:52390252-52390282
  hypo
aagctactgctttgacgttgttagatttta

SEQ ID NO: 76045 - DNA, 84 bp, Homo sapiens
  chr13:52532586-52532670
  hypo
tgcttgtggccaggacgatgagcacgtccatgttggctgacctgtgtctcagagatttgtaggcctgaacgtagaagtaccacc

SEQ ID NO: 76046 - DNA, 35 bp, Homo sapiens
  chr13:52928634-52928669
  hypo
aagccaaaagactgagcaggcgcaagtcagactgg

SEQ ID NO: 76047 - DNA, 706 bp, Homo sapiens
  chr13:52979745-52980451
  hyper
tggaagtctacccctcgcgtcgtcagcttaaagccctccttaatgaggaccgtctttaatttaatttaatccttgtatttcatactttttgtatatcagaaaggatttctttttggaaagaaacagtagctcaagacgcgatttttcaaggttctgtggccagtctcagtcactcggcaacatctgagccaaggcagagccaggttcacttaaattcgggactccgaagtgtggagaccaataccccttaaaagcgtcccctggggccgaggcgggtgtggggaggggccgccaccgtccacctgcgccttcaggctgcggtgaggtggcagagtccggaggcatttcccgaccccagaggagcctccaagagtctcgcggcacgggcgcgaacaccaggatgcggagggcgcttcttacctttcgagactgacgggcagcaaccccaggccgtccgggcgcgtggcgaggcggacgggaaggctcaggggcggcgaggtagagcgccaagcatcccgcgtcccagactgcacgccctgaccccgcggcgttcggctcccacagccccgcggggcccgcccccgacggcgtggggagggcgggcgccgggagggcggggggcacacgggaccgggcgtggtcggttcccgccccttctgggcagcgcatcctttcctgccggtccccagctcgccagctgctggac

SEQ ID NO: 76048 - DNA, 36 bp, Homo sapiens; identical to SEQ ID NO: 43806
  chr13:53025686-53025722
  hypo

SEQ ID NO: 76049 - DNA, 32 bp, Homo sapiens
  chr13:53055615-53055647
  hypo
attgttggccgggcacggtggctcacgcttgt

SEQ ID NO: 76050 - DNA, 349 bp, Homo sapiens
  chr13:53174056-53174405
  hyper
ctagtccccagagcccgggctttagggcgcccggatgcaaaccagttttgccgccaaggaacccggacaggcgcgcctcctccccggcctcgcaaggaacaggttaaggagacatttcccactttctctgcccggccctgaacgctcgccgcccctgcccagccgcccactgtctggcagcctgcaagtctccattcagaagcggctccgtgctgcccagcgatggcgccctggcggcgcggaagcccgcggccaaatgacacgacttgggggcaaaggaggacaacagttcccaccaggtaggcactgggggaaggaggccgatgaccctgagattctccagcgaccc

SEQ ID NO: 76051 - DNA, 41 bp, Homo sapiens
  chr13:53174673-53174714
  hyper
gggtgctttcctacctctgggctccccgagaccctttctga

SEQ ID NO: 76052 - DNA, 458 bp, Homo sapiens
  chr13:53312856-53313314
  hyper
gacgtgccttccccacggtcgcgccactgcttagtgggagatgagccgagaacggcctttctcggaccgtccactacattctcccctactctacgcttcaatcttctcccgtgaaaccttcacttgcttttctacaacgttgacctaaggcggaaagccgcgtgccagagtgggatgggagaggggagctcacgctgggcccgaggggcccgccggcagccgcgcgcccctcgccggcccgcgctcgggctccccctaggggcaccatgggcgacacgggggtccccgcgcgccgccctctggacttacgtgactgtcgctccccttccagaagtagaaggccccgatggccccaaagagcagcagcacagctcccgaaatgaggaccacggctcccaccttgagcagccgcgcggggctggagggcttcaccgtcagcgtagcgtacgcctgcgggc

SEQ ID NO: 76053 - DNA, 17 bp, Homo sapiens
  chr13:53313512-53313529
  hyper
cgcagcacagggccttc

SEQ ID NO: 76054 - DNA, 83 bp, Homo sapiens; identical to SEQ ID NO: 1109
  chr13:53313530-53313613
  hyper

SEQ ID NO: 76055 - DNA, 273 bp, Homo sapiens; identical to SEQ ID NO: 34941
  chr13:53313677-53313950
  hyper

SEQ ID NO: 76056 - DNA, 30 bp, Homo sapiens
  chr13:53353373-53353403
  hypo
aactgtaggctgctgcgggagacccacgag

SEQ ID NO: 76057 - DNA, 16 bp, Homo sapiens
  chr13:53419713-53419729
  hyper
caccgccacagggggc

SEQ ID NO: 76058 - DNA, 291 bp, Homo sapiens
  chr13:53419730-53420021
  hyper
ccggctcctttccaaaacccggggaggcaccgtagggctgcagcagggaataggggaatgggagtggggggagggttggataagaaacaaacaaaaaacaagtgcgacaggttgtctacctgaatgcacccaccctacccctccagtctcccttcccccagcctgtccgcggagctcggaggggggcgcccagccgaaggaaggcctcacctcggcgtgcgcgccgcggagccgctgctgcccctcgaagtgacaggcgctttccccagtggcgctgccgccctctgagcc

SEQ ID NO: 76059 - DNA, 31 bp, Homo sapiens
  chr13:53421826-53421857
  hyper
cgccctgcgggaaggccgggctgtggtcatt

SEQ ID NO: 76060 - DNA, 15 bp, Homo sapiens
  chr13:53422237-53422252
  hyper
agaagctgaccacat

SEQ ID NO: 76061 - DNA, 146 bp, Homo sapiens
  chr13:53422634-53422780
  hyper
tcagtctcaggctctcggaatcacgctctttgcgagccctgtgcgggagaagtctgcgggtagcagctccgagcctccagcgggctctgaggacgcgcggacccgccctcactctgcgcctctccgtctcttacagaagctgcgcc

SEQ ID NO: 76062 - DNA, 27 bp, Homo sapiens
  chr13:53422781-53422808
  hyper
cctcgcgccgcctttgcctttatagcc

SEQ ID NO: 76063 - DNA, 76 bp, Homo sapiens; identical to SEQ ID NO: 34946
  chr13:53422809-53422885
  hyper

SEQ ID NO: 76064 - DNA, 82 bp, Homo sapiens
  chr13:53423116-53423198
  hyper
agtggctcctgattccgccttcccccagcccctgccaacacacacactctgcattttgcacctctgacgcttccaaaccctt

SEQ ID NO: 76065 - DNA, 360 bp, Homo sapiens
  chr13:53423765-53424125
  hyper
ctaaacggtgatgggcgctgaattccacacaatacccggctcgtattaaagtgcatttagagaactttttcctcctgatgccttgttccgcctatttagaggattttctttctgttctaatagggccactctgggaagcaacactcgtccggttccagaagaacaaaatcacagcgtgacgttgaaacctggcaggaacgtggggggaacttaaccatctgcttaggaaagtgtggagcttcggcactgccaaaatctgggctgggcggatcctggggctggccgggcgctgcgctgccccacagatagccccctcccatccctgacggccagggagatggagctcggatctgcaacaag

SEQ ID NO: 76066 - DNA, 1249 bp, Homo sapiens
  chr13:53424759-53426008
  hyper
tccttggggggtacacgcagtcgaaggaactttctattttccttccgagccccgcaacactcccaccccaacctggggctggctggtgacctttagcgcccctaggctaacgtcatctctcctcacccctcttcccccggagacccagacgggaacaggttcagaacttggctggtggacagcggcctcagcgcttccgctggcgtacccagggcaaggtcaggcccgcctggcgctgctgctgccgggcggaggacccggaaggtggggaaagtgggtggaaatggggccggagtcccaaaggaagggatttcagcggtttccgcgagcacagcccggccgcgaatggctgggacccggacctcgcgccagcgccccctgcgcatctgcaccccgcagttctgggctggactcgggagccccgccacgcgctaagtttgggtttttcgcttggccagagattcggaactacttgcaatttctactcaaagtgcttccgcgtcagcatgctcattctcaaggctgaaataaaccaaggcgtgcttgaaagtgggaaaaggaaaggggagtaggggcaggcaaaagccaggaggcgggaggaggggtgtagggtggctggtagcaggtctaaagtgttttttccgcggccaggccctcgtcgatcggaagtagccacgacggcggcggcgccgggaggctgagagctgggagccggggagcccgggaagggagccgcgagcctccagccgccaccggcgcgcacaggtctttccgtgccggcggtggaggtgtgaaggcacgcgaacaccgtgagctccgggccggcagcggacagccactcgattatggaaatacgatttaaaatagcacatcaacgtccgcagcaactccccgggaaggaaaatatgtccggggaggtggcgctggagaggagtaggggaaagggaggggagctcgcccgcccgggtgctgatcaggcctcacaaaagccgctcgaatcgccttgttatcataccaaaaggtctgggcaggcccaaaggagcccctttctctcggttttagcaacttcgccggcaactgtctcgcaatcttgagaacaaacacagctccacaatggccggcgttttctcggaatgcaaatgttgcgggctccgcaaagctgggtttctgttaccgagcctaatgccggcattgtgaaactcgcgtgcaaacaccaagattgacatgggcgtcacgtgatggattaggg

SEQ ID NO: 76067 - DNA, 18 bp, Homo sapiens
  chr13:53427247-53427265
  hypo
gcccggcctgtctgtatc

SEQ ID NO: 76068 - DNA, 76 bp, Homo sapiens
  chr13:53580906-53580982
  hypo
cgctgggattacgggcgtgagccaccgcgcccggccggtgctaagcattatttctaaagttcgtttctttaaccca

SEQ ID NO: 76069 - DNA, 40 bp, Homo sapiens
  chr13:53775398-53775438
  hyper
cgggcgccaaccggcagatgcgctgcgccctctactggca

SEQ ID NO: 76070 - DNA, 30 bp, Homo sapiens; identical to SEQ ID NO: 43808
  chr13:56180149-56180179
  hypo

SEQ ID NO: 76071 - DNA, 39 bp, Homo sapiens
  chr13:57484515-57484554
  hypo
agcgcctggagctgccggctccgccggaggcagccggtg

SEQ ID NO: 76072 - DNA, 30 bp, Homo sapiens
  chr13:57861015-57861045
  hypo
tgtcagctgcctgctcggaatgcggggcca

SEQ ID NO: 76073 - DNA, 881 bp, Homo sapiens
  chr13:58203571-58204452
  hyper
ttgattgctgttgctcgcggcatgttcgtaccagcgcgggcagaaacgggctcacgagcgccctcgaattcacacacactcaccgaaatacacatctcagcccgtggaagcgcattcacacacacccacgtacactcctccgcacctcattcagatgggtccacgcggagtcagggctgcgcttcccttggcatgggcgtgtgtgcggcgagggcgtgtgtgcgtgcgtgtgtgagagtgtgtgtagagaaaccctttaggcagaccgcagctacgttattctgcaagcatactgcgattcccgattccgtgtatgtaggaccacaaaaaaattaaatcgctgttaaacttttttttgtaaattctcttttccgaaggaaggcgctggaagagctactcccggtggttaaaggcccgggagacctggtggcgaatcctggggcgcgtccgctttggcggagcgctgggctccgctagccggactggttccccatctaactgatctaatcaatgactccgaagagccggggctcctggccccgcccccgccatcctcttctccgcctcccattggacgcgggccgagaaggcagggccttgctcctcgctcggattggctgacagggaatcagtatcaatgtttaagcggcggcgtgaggtgaatagagtcagtcagcaagagacgctggggagagagcagggatcgcgagcccggcggatgcggcagcggcggaaggcggctggggagacgctactccaactgttgaattgaattttcacctttcctttcatccgctgctttgcttgcggagatggatttatttgctttgaaatccgcatatctttctcagactgtggggtgatcccggcagacaccagac

SEQ ID NO: 76074 - DNA, 63 bp, Homo sapiens; identical to SEQ ID NO: 34953
  chr13:58204937-58205000
  hyper

SEQ ID NO: 76075 - DNA, 437 bp, Homo sapiens
  chr13:58205795-58206232
  hyper
ggggagagccttttccgaggaagagagggaggagcctggtggggagaggaaactacaaatcgggacactagttctttacgctgcatttcctcccctccctttggctgctcggaaaggagagagaggaaaaaaaaaatacgcttggctggtagatgcagtccgccgccgccgctgcctcagccagcaatgcaagattagatctctaaatgcagcaaaacactgcctgaaaacagaccggcccgcgcagcaagcagacatttcacggtgcgctggggaagcttcaaaatatatctgtgactctgtcttcgttgctcttcatccccatcaatttcatcacgggaggcgagcagcaagtaagaatttcactttcggatctgcctagagacacacctccctgctccctcccccactcgatgtgaagagtattccggagtctc

SEQ ID NO: 76076 - DNA, 320 bp, Homo sapiens
  chr13:58206452-58206772
  hyper
cgcagcttctcacccagtgcggatgctgtagatcaacaggttcagggaacttgagcagaataaggagagaccaccgggtgccgcagctcgggtgcagagggaaaaaaggacccatagacttgtggctcgcgtcgcgcgcgcacgctgcgccagggccccaggctggcgcgcactccctctctggctcctccagtccgattgctcctgcccccaccttacaggtctgggatgtacctttccatctgttgctgctttcttctatgggcccctgccctcactctcaagaacctcaactactccgtgccggaggagcaaggggc

SEQ ID NO: 76077 - DNA, 151 bp, Homo sapiens
  chr13:58206861-58207012
  hyper
cgggtagctaccgggtgctggagaactccgcaccgcacctgctggacgtggacgcagacagcgggctcctctacaccaagcagcgcatcgaccgcgagtccctgtgccgccacaatgccaagtgccagctgtccctcgaggtgttcgccaa

SEQ ID NO: 76078 - DNA, 86 bp, Homo sapiens
  chr13:58207315-58207401
  hyper
gctgactgccctggacggtggcgagcctccacgttccgccaccgtacagatcaacgtgaaggtgattgactccaacgacaacagcc

SEQ ID NO: 76079 - DNA, 247 bp, Homo sapiens; identical to SEQ ID NO: 11627
  chr13:58207567-58207814
  hyper

SEQ ID NO: 76080 - DNA, 1155 bp, Homo sapiens
  chr13:58207891-58209046
  hyper
cgggcccgggggttccgtccccttcaagcttgaggagaactacgacaacttctacacggtggtgactgaccgcccgctggaccgcgagacacaagacgagtacaacgtgaccatcgtggcgcgggacgggggctctcctcccctcaactccaccaagtcgttcgcgatcaagattctagacgagaacgacaacccgcctcggttcaccaaagggctctacgtgcttcaggtgcacgagaacaacatcccgggagagtacctgggctctgtgctcgcccaggatcccgacctgggccagaacggcaccgtatcctactctatcctgccctcgcacatcggcgacgtgtctatctacacctatgtgtctgtgaatcccacgaacggggccatctacgccctgcgctcctttaacttcgagcagaccaaggcttttgagttcaaggtgcttgctaaggactcgggggcgcccgcgcacttggagagcaacgccacggtgagggtgacagtgctagacgtgaatgacaacgcgccagtgatcgtgctccccacgctgcagaacgacaccgcggagctgcaggtgccgcgcaacgctggcctgggctatctggtgagcactgtgcgcgccctagacagcgacttcggcgagagcgggcgtctcacctacgagatcgtggacggcaacgacgaccacctgtttgagatcgacccgtccagcggcgagatccgcacgctgcaccctttctgggaggacgtgacgcccgtggtggagctggtggtgaaggtgaccgaccacggcaagcctaccctgtccgcagtggccaagctcatcatccgctcggtgagcggatcccttcccgagggggtaccacgggtgaatggcgagcagcaccactgggacatgtcgctgccgctcatcgtgactctgagcactatctccatcatcctcctagcggccatgatcaccatcgccgtcaagtgcaagcgcgagaacaaggagatccgcacttacaactgccgcatcgccgagtacagccacccgcagctgggtgggggcaagggcaagaagaagaagatcaacaaaaatgatatcatgctggtgcagagcgaagtggaggagaggaacgccatgaacgtcatgaacgtggtgagcagccc

SEQ ID NO: 76081 - DNA, 30 bp, Homo sapiens
  chr13:59118670-59118700
  hypo
tttctactgcacaagcggggtgcaattccc

SEQ ID NO: 76082 - DNA, 30 bp, Homo sapiens; identical to SEQ ID NO: 43809
  chr13:60614880-60614910
  hypo

SEQ ID NO: 76083 - DNA, 23 bp, Homo sapiens
  chr13:60710775-60710798
  hypo
tataaacaattctgccgggcgcg

SEQ ID NO: 76084 - DNA, 21 bp, Homo sapiens
  chr13:60860933-60860954
  hypo
tatgcaaatgccagccgttgg

SEQ ID NO: 76085 - DNA, 38 bp, Homo sapiens
  chr13:61791028-61791066
  hypo
gaggattatattacttccaacatcgcagggggtgtaca

SEQ ID NO: 76086 - DNA, 30 bp, Homo sapiens
  chr13:61988304-61988334
  hyper
actttctatcccctccgcccccgccttccc

SEQ ID NO: 76087 - DNA, 110 bp, Homo sapiens
  chr13:61989219-61989329
  hyper
cgggtgccaggtcgccgggcaccagctcactcccagggcctgtgagctgcgcgcattccctcggccgcgcattccctgggaggctgcagtcagagcgctcttgaagggag

SEQ ID NO: 76088 - DNA, 30 bp, Homo sapiens
  chr13:61989554-61989584
  hyper
ggttgggcacagtagcgcttacctaccagc

SEQ ID NO: 76089 - DNA, 94 bp, Homo sapiens
  chr13:64311539-64311633
  hypo
actttggaatgttcacggcacataatacaatcggtatatttactgattgtgtattggtgaattggtgctggctctcagttcccgcctcgcggcg

SEQ ID NO: 76090 - DNA, 30 bp, Homo sapiens
  chr13:65360861-65360891
  hypo
ggaaaagccagcctgcggcagactgcacca

SEQ ID NO: 76091 - DNA, 30 bp, Homo sapiens
  chr13:65499779-65499809
  hypo
cctgggctgtgacagcgccaatcccgcttc

SEQ ID NO: 76092 - DNA, 48 bp, Homo sapiens
  chr13:65904937-65904985
  hypo
gggttctcctccgatcgccctggccaaactctgcgctgttcctccagc

SEQ ID NO: 76093 - DNA, 20 bp, Homo sapiens
  chr13:65937832-65937852
  hypo
gttgctttatttgtccggtg

SEQ ID NO: 76094 - DNA, 303 bp, Homo sapiens
  chr13:67804228-67804531
  hyper
cataccatttccatccgatgccaatactgcttaagtctctaacttcttgtaggaaacgtcagagttgcggtgatgatgattctctgacagctatccgggtgacagttgcccgaaaaattcctaatcggttatctcttgcgtgcttcagagactctgaggcgctcctttccgtctcgcgtgctctccctctctcccttcccctctgcccctctctccttctccctctcctctctctgaactgaatttcttgatataactctcaataagcccagagggagggcgtgactgcccaggccccgcccc

SEQ ID NO: 76095 - DNA, 100 bp, Homo sapiens; identical to SEQ ID NO: 34961
  chr13:67804644-67804744
  hyper

SEQ ID NO: 76096 - DNA, 23 bp, Homo sapiens
  chr13:67804745-67804768
  hyper
cgctggcgctccccaggcccggg

SEQ ID NO: 76097 - DNA, 423 bp, Homo sapiens
  chr13:67804863-67805286
  hyper
cgcggatccggggaaccagggccaccgctgcgggcggatgggggtcaccgaggcggctcgtctccaggcgcacacttcgcacatctctttgctaagtgaaggggccaaaatgcacagatgggggagtctacccaggaacagaggcgcgagacgtatagccacccctgggttgggagcacgagccagcagatccccggagcgcgttaaacggacaacatgcccggtgctgcaaatagaggcttttgctggcagggacattggaaagaagggcggagagggagtacagcgaaaggtggggaccgcagaatttggaatctctgcggagaccggaaagaaaattaatcggagcacttcctacatgcagagccacggaaactgccttggaaagagaaagtggcagcgtctgggtcccctcggtcagcc

SEQ ID NO: 76098 - DNA, 59 bp, Homo sapiens
  chr13:67805379-67805438
  hyper
cgcgcctggaaacctgagcccggactcgcggctgctgcaaaacccgcttccagcccacc

SEQ ID NO: 76099 - DNA, 51 bp, Homo sapiens; identical to SEQ ID NO: 43812
  chr13:68343951-68344002
  hypo

SEQ ID NO: 76100 - DNA, 73 bp, Homo sapiens
  chr13:68488541-68488614
  hypo
tcccctacaaaattgcgaataatattgaagggtgtacaacccctgctactttagcagccgcatcttgctagaa

SEQ ID NO: 76101 - DNA, 83 bp, Homo sapiens
  chr13:69619398-69619481
  hypo
cactacagcatcatacaggtagtttcattgccctaaaaatcctgcgttctgtctcttcatccctctgtcgcttaacttctcac

SEQ ID NO: 76102 - DNA, 208 bp, Homo sapiens
  chr13:70681570-70681778
  hyper
agaggaggaagaggacggggaggacgatgaagaggaagaggaggaaggcttcttccagaaagtgctcacaccgcttctctcttggcttttgagcaggcgactctggctgggtccccagtgctcaaagctgccactgccgtcctgttgcaggcagcctccccccgccgggccgccggtggaaggagacgggtggctgaagagtttccag

SEQ ID NO: 76103 - DNA, 432 bp, Homo sapiens
  chr13:70681866-70682298
  hyper
cgcaggagtaggctggtcagcaggtgggggaggacagcggggcccgggggcggaggaagaggcgggatgcgccctctgcacccctagagccagaagacgctaggtgggctgcgcgctctgccaggcgaaggctggagcgcagacggcaaagccgcgcgtttcagccgtggtcgggtccgcaggacctgggcgtggggacaccaccaggcaggagcagaggcaggactgggacgccaaaagctgagaatcctcgatgcccgcgcgagagccccgtgttatggcgaggtgggacaacccttaggctggagatgcgcgagggagggaggtctgagcgctccgaagctccggaggcggctgcagctggatacacctcactgggatgcgcttgtggcagagccttagtagggaaggtggtggcgttcttgtccttgc

SEQ ID NO: 76104 - DNA, 30 bp, Homo sapiens
  chr13:71068811-71068841
  hypo
cattttacttaacaacgggaaccttgagaa

SEQ ID NO: 76105 - DNA, 30 bp, Homo sapiens
  chr13:71158391-71158421
  hypo
ttcagtttgtattttcgattgagaatggtt

SEQ ID NO: 76106 - DNA, 30 bp, Homo sapiens
  chr13:72408836-72408866
  hypo
tacttaaattggtttcgttttcccatttca

SEQ ID NO: 76107 - DNA, 93 bp, Homo sapiens
  chr13:72438470-72438563
  hyper
aattcgaatctttttcgtttcacagccttcccgggcactaacagagaagaagtctttctccatggaaaaaagagctagcgctttttcaaccca

SEQ ID NO: 76108 - DNA, 259 bp, Homo sapiens
  chr13:72438769-72439028
  hyper
gaacttttgcctctgcgcttccttgcagagaaccgtggggacaaagcggcgctgtgaaagggggtggaatgatcatctctaccccgaaactgacaagttgccccactcccgccccctcttggtagatcctcccccactgagcgttcattagcataaaactggtctggctggggaccggtcccgccgcctcctccgtgcgcgcgctttgctgggctggggaagccaaggcacagagtatcagggccgctgagcatcccag

SEQ ID NO: 76109 - DNA, 30 bp, Homo sapiens
  chr13:72439538-72439568
  hyper
gctccccgagccctgcggagcaggtcacga

SEQ ID NO: 76110 - DNA, 113 bp, Homo sapiens
  chr13:72439959-72440072
  hyper
gcgcagagcgagcggcgccgggaaaggagcgagggcaggcgagcaggctggtgggaaggggcgcgggcggcgggggctatcccccccgactcaccttgcgttggtgcagtcat

SEQ ID NO: 76111 - DNA, 37 bp, Homo sapiens
  chr13:72440704-72440741
  hyper
gccgccgccgccgccgccgaagcgatgggctccgggc

SEQ ID NO: 76112 - DNA, 191 bp, Homo sapiens
  chr13:72441499-72441690
  hyper
tcggagcagagactccgagagcgcgagacactggagagggagcgtgcgaggaaaggaggaggggagggggaggatacggaaagaaactgtgggagggacggagaggaaaagccggggacacagaagtggcgatcggaaaaggagagggagatcatctacttctcttctactactaccgttagattgcatgt

SEQ ID NO: 76113 - DNA, 29 bp, Homo sapiens
  chr13:72469378-72469407
  hypo
acataatacatttcacgcattttttaaaa

SEQ ID NO: 76114 - DNA, 21 bp, Homo sapiens
  chr13:73253695-73253716
  hypo
aggcgcagtggctcacgcctg

SEQ ID NO: 76115 - DNA, 30 bp, Homo sapiens
  chr13:73545132-73545162
  hypo
tattccatgtatatacggttgttttgctat

SEQ ID NO: 76116 - DNA, 30 bp, Homo sapiens
  chr13:73619593-73619623
  hypo
tccctcatacatacacgctgtgggcaattt

SEQ ID NO: 76117 - DNA, 30 bp, Homo sapiens
  chr13:73636816-73636846
  hypo
tagaaggagtaaccccgatttggagaaacg

SEQ ID NO: 76118 - DNA, 30 bp, Homo sapiens
  chr13:73653014-73653044
  hypo
ggaaacatgcaagtccggagcatcctgtag

SEQ ID NO: 76119 - DNA, 207 bp, Homo sapiens
  chr13:73664304-73664511
  hypo
aagcccatcagaatccgggaattaaggaaacaagacatgaagggaactctcagctcatctagagggctccccaggctccctttagggcgggagtctgttccaaggtgcagccagcctgagcctgccaagagtagcaggtgagccctgttaagaccatggtaagtggattcacctgcccagagagagatgcgccgatcttgactgtct

SEQ ID NO: 76120 - DNA, 153 bp, Homo sapiens
  chr13:74707261-74707414
  hyper
agttacacatcattacgaccagagacaataatgaatgtagcaccaggagcactattcatgccagcagtgtcatctccgccttaaccccttcccctccactctctccagcgcgcacacacagcccacacggtcccggtgcggagctattcatcc

SEQ ID NO: 76121 - DNA, 43 bp, Homo sapiens; identical to SEQ ID NO: 34971
  chr13:74707625-74707668
  hyper

SEQ ID NO: 76122 - DNA, 30 bp, Homo sapiens; identical to SEQ ID NO: 43813
  chr13:74987640-74987670
  hypo

SEQ ID NO: 76123 - DNA, 211 bp, Homo sapiens
  chr13:75149904-75150115
  hyper
acaattagatgctggcgcggcccggagaggctcgcggatgcctggccgcgcgcctccgcgggacgtcagcgcccgcggcacgatctgctgctgtcactatcagtatccggcaggagcccgcccgccccggcccggccccaggccgtggaggaggggggagggtgcggcgcaggaagctgaagataagtctccaaatcgggctaagctggga

SEQ ID NO: 76124 - DNA, 261 bp, Homo sapiens
  chr13:77459367-77459628
  hyper
tgctgctggcaaaggcgcaggtgcccgtggagctgcacgccaccatgtggaagcccgactcggacagcttgtcgaaggcctgctccaggaagttgaacttgaggtaatagcgcgaggtgtagcgctccgggggacggtcggggtcccggctttcgttcagggtgtccccaaacacctccttggccagcgacgtctttccgcaaacggtgatgcgcgccactcgccggaacttggcgtccgcctgcgcgtcccgcccgatgg

SEQ ID NO: 76125 - DNA, 105 bp, Homo sapiens
  chr13:77553641-77553746
  hypo
tcgctggagatccagcggagtgtgcggagggaggcgtgttggataccttttaaaaatgagaagccccaggccgggcgcggtgactcacgactgtaagtcgcggcc

SEQ ID NO: 76126 - DNA, 120 bp, Homo sapiens
  chr13:77935896-77936016
  hypo
gatgggactacaggcccacgccaccatgcgtggctaatttaaaaacatgttttttttatttgtttgtttgttttttgatagagatgggggtctatgttgtccaggctgatctcgaactcc

SEQ ID NO: 76127 - DNA, 23 bp, Homo sapiens
  chr13:78081911-78081934
  hypo
attacaggcgtaactcatagtaa

SEQ ID NO: 76128 - DNA, 161 bp, Homo sapiens
  chr13:78271464-78271625
  hyper
aagggagcaaaccagcgggccggtggtgcactactcgagggccagcacctgcagctgcttctttgggaaccccctggtccccgcaaccgcctcagagacccgcgcagttcactgtcccaccaagcggcaggaggaggtgcttgtggcgggaaagttcaggc

SEQ ID NO: 76129 - DNA, 338 bp, Homo sapiens
  chr13:78271894-78272232
  hyper
ggtgctgatgcgaaccgccggctcggcctcagcccgcgcgtggtcggccccccaggccggggcgacagggaaggagccgtagcctccccgtggcccgaggagccggcgcggcggcgcgcactccccggcggccgcggcgccctcggggcccacgatgatggcggagcaggtgaaatgcgcctcggcaggggtcagctctggagcgggctccgggccggtggtgaacgcggagctggaggtgaagaagctgcaggagctggtgcgcaagctggagaagcagaacgagcagctgcggagtcgagcggccagcgcggccgccgccccgcacctgctgctgc

SEQ ID NO: 76130 - DNA, 44 bp, Homo sapiens
  chr13:78273206-78273250
  hyper
tttgaattttgcagtcgtgtgcccttttgcgttgcattttcatt

SEQ ID NO: 76131 - DNA, 30 bp, Homo sapiens
  chr13:78335732-78335762
  hypo
gaaaaatgtgtcaggcgtatgtgcacacgc

SEQ ID NO: 76132 - DNA, 1223 bp, Homo sapiens
  chr13:78492801-78494024
  hyper
ctgcccgagccaagtcgctgcaaacgctaataccgcccgcagcctcttcgccagtatccacgctcaaaagtaactcaagtttgcgcgccagtgggaaacttggcgctcatgactcgccagcgcgggtcgaaactccttcctgatgccctctcagctgtttttcttcccccgcgtggccaggaggggtaaataatatgcagtggggcggggcgttctggaaggggtgtgccagggagggaatgatgggggtcccaggcaaagctccgaactctttcacgtaacgggaggaatacagacacgtcttagttaagcgtgcgtgggaaccgcggaattaaggcacctagaggccaagggcttgtgtcaagctctgcattttgccccgcaggggaacctctataccccgcgattgaactcgaaagactcctcccggcggatgaaagccgctactccctggctggctgagctacagctcccgcagcgcgcccaggagtgcgccggagattcggaaacccgcagagacttctcaagtcagcaggaacttggaaaccgctgttccctccaaacggcttcaaacactcgcgctccttcctttacccaacctaattttaatttgccctctctataggcttaatttttatttttttaaaatcccaaactagtaagccaaaccgaagccccagaataaggttcaatcaatgattttaattcaacaccaagcccgaatgtttacctctcggatctgacaaaccagatgcagagcgacgaatggagaccaccttcccgggaggcggaacccagctgggttccagcctgctctgggagaggagcacgcctcccttgagctgcaggcgggtccggctctgacgaaacgctgcgagaatgccagacagtgtagcctccaccgtttgctcggggtctctgctgccatcagacaagtacttttattcattcatcccttcccatcaatcaccgccagactcctcccgcgccttccgaccccgctgcaacctttccccttgggcgatgcctggacagcatcagtagtagttgcccgagggaggggggcagtcctcgtccggggacaggtcccaaaaggctgtttatttgttagagttctacgctcttcaaatgaacccaaatcaagggcaagttatcacgcaccatgtgacacccggcagctccagactagaacaaggctctgcactgaacgtgataattgaact

SEQ ID NO: 76133 - DNA, 16 bp, Homo sapiens
  chr13:78567988-78568004
  hypo
gcgcctggcatgtagt

SEQ ID NO: 76134 - DNA, 149 bp, Homo sapiens
  chr13:79160947-79161096
  hyper
tgtgctgctcactagcgacccctctaggtcttagagagaagagagctcatgcagaagagtactcgggaccattgccgggacgagaagcccatcaggctgactgctccattagggagcatcgcaagctcggggtgcgaaagcttccccgc

SEQ ID NO: 76135 - DNA, 43 bp, Homo sapiens
  chr13:79169673-79169716
  hyper
ggactgggacacgggcgcttcttctctccagcccttggttcgc

SEQ ID NO: 76136 - DNA, 265 bp, Homo sapiens; identical to SEQ ID NO: 34975
  chr13:79169849-79170114
  hyper

SEQ ID NO: 76137 - DNA, 37 bp, Homo sapiens; identical to SEQ ID NO: 1112
  chr13:79170347-79170384
  hyper

SEQ ID NO: 76138 - DNA, 777 bp, Homo sapiens
  chr13:79170467-79171244
  hyper
cgccacccggagaaccgcggctggtgcccttgaaggccctgggatgcctgggttgggtgggtgagtgaacgagaaccctgagtgagtgaggggagggcgggtcccctcctggcttcaaattcaacccaatcagctctgccgatggtttgaaactgcacacgccgacccacccgccccgaagtctgaaagttatgccctggagacctgcgagctgcggagtgcagctggagagggagctgccccacgaggaggcctccagaataactcccggagtcggaacagcgctgggctgctgaagtttgcagcctccggatccgcgccccgccctgcagatccaccggatttcggggagggaatcggggggctgcccgtcctcccgtaaagctgacttgacaacaattacgaaagtttttaattagctccttgttataattcattttatttccagaactctccgaccataaattattcaaagagtaagccaacccgagcggggcggccgcgcgccttccccacgcgcgccgggctggctctggccgctcagctcacccgatgccccgtgagccagccccgcgccagaagccgcggtggcaggaaggtttgatcaaacattaaataacgtaatgtttgcgacaaggcttatctcacaagtggaaaagaggacctcgcgagaattagaattcggctgctattttaaaaaatcaattaagcttgcggtcttttttgaaacagctcgaaaggactgcgtggctatcatcgtggcgctaagactgagat

SEQ ID NO: 76139 - DNA, 220 bp, Homo sapiens
  chr13:79171448-79171668
  hyper
gctatcaggagaggccggggcggcggggcagaggcagagggcagggatcgctgagtgagtcctgcgggcttggggcgccctgttctctcacgtgcgctgccacgtgtaggaggaactggaccgaagtagtctcagtatcacaagaaaacaaaaatcgatacaatcacggcagtgggtgcctacagtttatttatgaaactgtaatcgaagttgagagcaa

SEQ ID NO: 76140 - DNA, 349 bp, Homo sapiens; identical to SEQ ID NO: 34978
  chr13:79175595-79175944
  hyper

SEQ ID NO: 76141 - DNA, 49 bp, Homo sapiens; identical to SEQ ID NO: 1115
  chr13:79176077-79176126
  hyper

SEQ ID NO: 76142 - DNA, 145 bp, Homo sapiens; identical to SEQ ID NO: 1116
  chr13:79176276-79176421
  hyper

SEQ ID NO: 76143 - DNA, 577 bp, Homo sapiens; identical to SEQ ID NO: 34981
  chr13:79176608-79177185
  hyper

SEQ ID NO: 76144 - DNA, 318 bp, Homo sapiens; identical to SEQ ID NO: 1119
  chr13:79177305-79177623
  hyper

SEQ ID NO: 76145 - DNA, 378 bp, Homo sapiens
  chr13:79177885-79178263
  hyper
cgtgggagccgctcttatagtgaccaccagcaaggacagcgcaggtgatgcacctgtagctacccgggcatgcgcactgcccgcctcacctttcccaccgtggtctggaaagatcagaaggtccagctattgtctaagggtgggcaccttttagaataaaaaagacgagatgcgcgcacgcccctctatgtgtgtgtgtgtgtgtgtgtgtgcgtgcgtgtgtgtgtatgtgtgtatgtttcttctccctgatagcaagccttgaatatatgagcattacttaggcattcctcctcttcgggatgcctaacaagctgttgtataatgtatacagctggacatttctacgttaaattatgcccgcgcattcctctgtat

SEQ ID NO: 76146 - DNA, 216 bp, Homo sapiens
  chr13:79179534-79179750
  hyper
tcaacggggagtggacgatgagcaggacgtcgctagagggaaagagtgagtcctacggtagtcatcacaccgggagtccgggcttaacctagtccttcctgacacccctggtggccgttccctgcgctctctcttgacgggaaagaaaaggcccccacagagggtgagggcctggaacctgcccctcccctctcaaggaagcgctggtctttaggg

SEQ ID NO: 76147 - DNA, 740 bp, Homo sapiens
  chr13:79182684-79183424
  hyper
caggaggagcagagacgtccccgccccgcctgggccctgccgcattcaaagctggaagaaggcgctgatcagagaaggggcttccaggtcctgggttagaacaacaacaaacaaacgaaactccacaacagacacgcctgcccatgaccccacgcaaggacataggaagttctgtcgccttcctgctccgcggatagccgcctgccgtctgctgccaccagaacgcacggacgctcggggtggaggtagtcaatgggcagcaggggacccccagcccccacaagcgcggctccgaggacctggaagcgggtgcctgtcgctctccgcaggctccgctctgcctccaggagcaagatccccaaaagggtctggaagctgtggagaaaaccgcaaggacgcgagtccaaacccgagagtgcggagctgggtcctgtcacccggctccaacgctcgccggcgccgccgccagccgcccctccttcccgccgcccgcacaaatcaaagccccttgcgagggactgggaaatagttgccttgtcatgtaacacattgccctgatttattataaaattttaacgaaatcatgcatattttaacagcctttaatcactgcatgaaaatttaattcatgaactgtagcgcgtttaaataaatgaagtgttaattcattaggattaattaatttgttaaaggattgtgtgcaaggttaaggtggaaagaaaactctttgttggtttcgc

SEQ ID NO: 76148 - DNA, 150 bp, Homo sapiens
  chr13:80015563-80015713
  hypo
agtttcccattggaccggcctgaaagcagtgtcctaatgagactacatccttgctaagctttttcctcctgcactctcttacctcccaccccaacttctccgagagcattttctcaactaatcatttaaataagaatccccattttgggc

SEQ ID NO: 76149 - DNA, 65 bp, Homo sapiens
  chr13:80914079-80914144
  hyper
gacccaggctgaccacgaagaacggaagagagagagctgcacttccgaaccgcagagacccggcg

SEQ ID NO: 76150 - DNA, 32 bp, Homo sapiens
  chr13:80914581-80914613
  hyper
cgggcgaggcaggtccgcggggagcgccccgg

SEQ ID NO: 76151 - DNA, 41 bp, Homo sapiens
  chr13:80915541-80915582
  hyper
tcacactccagcgcccgccagcgctccgagccgcaggaggc

SEQ ID NO: 76152 - DNA, 30 bp, Homo sapiens
  chr13:81279635-81279665
  hypo
cgacccccatcacagcgtgggggaggcaac

SEQ ID NO: 76153 - DNA, 19 bp, Homo sapiens
  chr13:82399492-82399511
  hypo
actccgtctaaaaaaaaag

SEQ ID NO: 76154 - DNA, 30 bp, Homo sapiens
  chr13:82646591-82646621
  hypo
agagttgggcgagtgcgctccagcattcac

SEQ ID NO: 76155 - DNA, 30 bp, Homo sapiens
  chr13:82797186-82797216
  hypo
gggcatggtggctcacgcctgtaatcccag

SEQ ID NO: 76156 - DNA, 17 bp, Homo sapiens
  chr13:84382511-84382528
  hypo
gggtgcggtggcttacg

SEQ ID NO: 76157 - DNA, 196 bp, Homo sapiens; identical to SEQ ID NO: 34986
  chr13:84455560-84455756
  hyper

SEQ ID NO: 76158 - DNA, 369 bp, Homo sapiens
  chr13:84456111-84456480
  hyper
ctgtgcatggctgtgcgtcggactgaccttgcctctctgatacaaagcagggttttccgcggcttctgttgttgaggctgctggtggagttcttgctgtggttgcgggttgcccagaagtccccccgaggtgctgtccagttcccccggtgctgaaatcacgcccgaccgaaggactcacgctgcccagccaatggcgctggaaaatttccgcaatcgctgcgttttgtggttgtccatccttttcctttcctccccttcggtcctcttaaggcttttttttttcttttctgtgctctcgctctcgcttactagctcttcttttcctgttctccttctctttcttctgctctttcggaattacgtggag

SEQ ID NO: 76159 - DNA, 77 bp, Homo sapiens
  chr13:84456706-84456783
  hyper
ggcataaaaggctgacgatctacatagatgcttattttaaatggattatttgattatttttgcgtgctggaaacttt

SEQ ID NO: 76160 - DNA, 30 bp, Homo sapiens
  chr13:85406594-85406624
  hypo
ctagtagccagaccccgcactccctcaccc

SEQ ID NO: 76161 - DNA, 24 bp, Homo sapiens
  chr13:87738892-87738916
  hypo
tttatttttttgagacggagtctc

SEQ ID NO: 76162 - DNA, 489 bp, Homo sapiens
  chr13:88323342-88323831
  hyper
ttaacagtaagtacacgagacagcagcattctgaatggcaggaggaaggcaggcgatcagcacagggctggaatcatctgttcctgaccaccagcaagcctggcactgccggggttatttccactcctccctttcccaatccgagaattgcacagtcccacgctcgaattacacacatggtccaagacttctctctcttcctacgaatgtgacatccaagggggccccggttgcgccgccctagcccagggacgccttcgccctcggctgccatctatcggccaccgagcgcccgcttcgccccgggcccatcatgtctgctgcagcttggctcgcaccagaggcgcgacaataaacaagtgcactggactgggccctgcacccgctccggagcagctgtctcagagacccggtgttgcttaccgcgttgccacctcctcggcgcccgggaggaagacgcaactttctcggagttttttttagagccac

SEQ ID NO: 76163 - DNA, 302 bp, Homo sapiens
  chr13:88323867-88324169
  hyper
cggttgctgcccgccccccccttcccccagaaaccccaaaggatgtcggtgatagagagttccaactaatgacgattgtgcgccgcatctggggaagggatacagaaaaaaaccctgcaaacaccgtgaggatgaaactgccaaagggatgcaagagcctctcaaatactaattaggggccgcggcggcggcgggctcggcgcggagacagcgtcggcgggatcccagcgcggtggtcgccgctgcgctggggggcggaggacagcgcaggagctgcagccgccgccttcgctggagcagcc

SEQ ID NO: 76164 - DNA, 349 bp, Homo sapiens
  chr13:88324170-88324519
  hyper
aggggccggtgccacctttgctcgccccctcactaccatgtacagtgtgcgctgcaagaagaaggcgggagatgcatgcacacccccgcgacccgctccctctggctcgtcccccggcgtgcgccactgaccaggggggaatgtggtgaagacggcgaggaggagagccgaggggggaggggagggccggccggcgcgaacccaggccggagggtgcgaggagccagaggaggctggagggggcggcggccacagctgggtcggagaaagttgccccctatgcagatggcaactgtgagtacccctgtgggggggagggtgcagcgaaggctgccagggaccccgcgat

SEQ ID NO: 76165 - DNA, 53 bp, Homo sapiens
  chr13:88324920-88324973
  hyper
gggcgcctctttcctccagcctctgggactgcgctgctcgcagtctcctcgcc

SEQ ID NO: 76166 - DNA, 863 bp, Homo sapiens
  chr13:88325198-88326061
  hyper
ctccccttcttcctccgttttcccttccttctctttggggcggggtgggggagggggagcctcgcgtcctggaactccgggtgcttctgcctgggctgctgcttgagcagctgtgcccggagcctccggtgcggcctgggtgctgggctccagtccgagaggctccatgctgcttactgcagggacgtacagggcggtgatccagtatctaaattctttgggagaaaatgaatagttcccccgcccccgccctccaggaaaaaaaaaaatctgagaatctgagaatgttcagcgcacccgcgaatttgcatcggaggtgcgtttccccgtcagaatgtcagcctccccaggctcattcaactttattttctcaaatttttggtctcctttgctagcaaggaggagggggaagggagtgggttgagaggaagctcttcgacccttgctaactagaactgaattaaagttgtaaacgctggagtttaatactggctggactgaatttgcaatgggctttcagatggggtgggaggtgaatgggggcggggaagcacagggagggagggggaggggacccaacctcgctgaatggatgtgcggatttgatccagcggagaactgaaatttcaaggtaaacgttttgctttcactggggtggggatgtttttgccgcttttaagccgggagacgtttaccgttgcgttgggaggtcggggatacttgcgaggtttatgcactgtggttccaattcatctcgacacgtctgggtggccacacgtgaatgattcgcaggcacactgatacatgtgcgtttgaatgcaggggcgtttaataacgcgggctggagtcgacttggggatcag

SEQ ID NO: 76167 - DNA, 396 bp, Homo sapiens
  chr13:88326312-88326708
  hyper
tccttcctttaagagtgctgctgttgatcagaagtaggaagtggaaggaagccttcaaggggacaaaaagagagcaagaaaaaaaagggggagggggtcatattgattcctgtgggagatgaaattcggatattaaacaactgacctaagtcgcttacagttcttcctcccacctttctattttgcctcttaatcagcccaggcgtcctttccctgagattaaaaaaaagagagaggggagcgttaacaattaaatgtaataagcaactccaaagatggggatgctgtcgaggtggtagttccgtgcaaaccttgctattaccgttgcaaatagacgcggagcccaaggtaagggaggctttcgtgctgatccttggtgtactgattcccggtaag

SEQ ID NO: 76168 - DNA, 188 bp, Homo sapiens; identical to SEQ ID NO: 34994
  chr13:88326936-88327124
  hyper

SEQ ID NO: 76169 - DNA, 32 bp, Homo sapiens
  chr13:89253759-89253791
  hypo
gcgtgagccaccgcgcccggcctatttattaa

SEQ ID NO: 76170 - DNA, 27 bp, Homo sapiens
  chr13:90047527-90047554
  hypo
ccacaacaggccaggcgcggtggctca

SEQ ID NO: 76171 - DNA, 101 bp, Homo sapiens
  chr13:90685501-90685602
  hypo
gctgtgtgcagtggctggacccttgactctctcactcacactcccctcaccgctctgcaccaagttttcaggagccacttggctcccggctcacccttggt

SEQ ID NO: 76172 - DNA, 30 bp, Homo sapiens; identical to SEQ ID NO: 43817
  chr13:91948489-91948519
  hypo

SEQ ID NO: 76173 - DNA, 87 bp, Homo sapiens
  chr13:92050679-92050766
  hyper
tgggagagcgaggtccgggtttccttctatttatttgcatcgatgtcgctccgagtcttcagcactgggccgcgtatgacagcatct

SEQ ID NO: 76174 - DNA, 425 bp, Homo sapiens
  chr13:92050975-92051400
  hyper
cagtggtggccagagcggatgcttgcgggctccctgcggctccactagttttcttcgccccgcccagccgcccactcttctcggctagggaagaagaccagagggtgctcagctggaaaactctggtgtctcagcttagggcctcctccgggaagagctaactgctcccaggtgaagccggtgcccgcgggcggtccgtacaccccgcagccggctcgcaccgctcgagagcctcggccgctgtgtcttccacgtctgcagctcagccagggcgcgcagggcgagtggggtccactggcgggtaaaggggaccaggacggcgaggatggacgcacagacctggcccgtgggctttcgctgcctcctccttctggccctggttgggtccgcccgcagcgagggcgtgcagacctgcgaagaagttc

SEQ ID NO: 76175 - DNA, 113 bp, Homo sapiens; identical to SEQ ID NO: 11658
  chr13:92051401-92051514
  hyper

SEQ ID NO: 76176 - DNA, 30 bp, Homo sapiens
  chr13:92345893-92345923
  hypo
actgccaaggcctggcgctcactaagcctt

SEQ ID NO: 76177 - DNA, 30 bp, Homo sapiens
  chr13:92857981-92858011
  hypo
tttggaacagtgatacgtttataaaacaac

SEQ ID NO: 76178 - DNA, 95 bp, Homo sapiens
  chr13:93879208-93879303
  hyper
catccccaagaacctcgagctcacaccaacagacacacgcgcgcatacacactcgctctcgcttgtccatctccctcccgggggagccggcgcgc

SEQ ID NO: 76179 - DNA, 472 bp, Homo sapiens
  chr13:93879304-93879776
  hyper
ctcccacctttgccgcacactccggcgagccgagcccgcagcgctccaggattctgcggctcggaactcggattgcagctctgaacccccatggtggttttttaaacacttcttttccttctcttcctcgttttgattgcaccgtttccatctgggggctagaggagcaaggcagcagccttcccagccagcccttgttggcttgccatcgtccatctggcttataaaagtttgctgagcgcagtccagagggctgcgctgctcgtcccctcggctggcagaagggggtgacgctgggcagcggcgaggagcgcgccgctgcctctggcgggctttcggcttgaggggcaaggtgaagagcgcaccggccgtggggtttaccgagctggatttgtatgttgcaccatgccttcttggatcggggctgtgattcttcccctcttggggctgctgctctccctccccgccgggg

SEQ ID NO: 76180 - DNA, 299 bp, Homo sapiens
  chr13:93879918-93880217
  hyper
cgtcccactggccgcccggcgtccccttccttccccctgttgctgagttggtgctcactttctgccaccgctatgggactccgcgtctccgtgttgggcggcggatgctcctgcggcttcttcggcgggggaaggtgtgcgtctccgccgcctcattgtgtgcacacgcgggagcaccctggctcccgcctcccgctgctctcgcgcccttctaccccttagttgatggctcaggcccggctggccagggagcccgggtcactccggggcggctgcaaggcgcagacggagagccgagc

SEQ ID NO: 76181 - DNA, 205 bp, Homo sapiens; identical to SEQ ID NO: 35001
  chr13:93880533-93880738
  hyper

SEQ ID NO: 76182 - DNA, 49 bp, Homo sapiens; identical to SEQ ID NO: 35002
  chr13:93880793-93880842
  hyper

SEQ ID NO: 76183 - DNA, 183 bp, Homo sapiens; identical to SEQ ID NO: 35003
  chr13:93880843-93881026
  hyper

SEQ ID NO: 76184 - DNA, 79 bp, Homo sapiens
  chr13:95201260-95201339
  hyper
gcagaccctggccaacgttctttagtctgatgcgtcggggagctgtaaagctgccatccttcaccggtgggcaagtaac

SEQ ID NO: 76185 - DNA, 36 bp, Homo sapiens
  chr13:95201626-95201662
  hyper
gtcgttcgcgtcttccggcgccgagggtgcctctgg

SEQ ID NO: 76186 - DNA, 21 bp, Homo sapiens
  chr13:95201891-95201912
  hyper
tttaaaagtagctgccgaaac

SEQ ID NO: 76187 - DNA, 30 bp, Homo sapiens
  chr13:95202314-95202344
  hyper
gtagccccttcccttcgatctgcccctgcc

SEQ ID NO: 76188 - DNA, 81 bp, Homo sapiens
  chr13:95354293-95354374
  hyper
gtgtgcatatgagagcggagagacagcgacctggaggccatgggtgggggcgggtggtgaagctgccgaagcctacacata

SEQ ID NO: 76189 - DNA, 56 bp, Homo sapiens
  chr13:95355963-95356019
  hyper
ctgtctcaggctctccgtgcgtcctttcactcgtcttcacccggccagtctatgca

SEQ ID NO: 76190 - DNA, 1528 bp, Homo sapiens
  chr13:95357026-95358554
  hyper
tttcctccagtcaagcgtgagtgatggggcggccgcgcaagggcaacggagtccagcggacaaagcttgcagagaggggcagtggcccggaggcaagggtggcggtggggggggtggggggatgggtcacaaaagtagagcaactgagcttgctgcctagcggtgccacttccctgctctgcgctaaggctatcgtcgaaggcccagagacaccttgaccctggaaacccaatccagcacgtcctgcctccccacaaatatccctcaccccaaatcgctgtgcgttttgtctcctcaaagcgactcccaatggatttggatttattcagatagaactcttcggaagtttttcagatttttcaatttcaagaatttgcatgttttaagtgaagctgaaaccgcgaaggctcaggttacactttaaaatatgcaaggcttccgtgcggccccgacatttggtaaggctcaattgcttaagaaaaaagaaaaaaaaaagaacattgctttgagaatttggggtgccccccccccacttttgtcacaattcagagcttcattccctccggccgtccaggacgtcgagagagcggctggccagagctcagccccggcgcattcgcagggacgtgtcagctgggcaggctataatttgcattattccattaagttaggagcagcgctgataacgactggaaagttcgacggctgggtgggcccgcgacccgcaggcctggcgagcaaccatcgaaaataaaacaattgctgtccttggcggcaaaggcctctatggacgcctccagggcagcgcagggaaccaaagggcaccccagatctctgcgggttcgcgccttgcctcgtgggggacaggaggttctctgtcccatgaggttcagtcaaggacaaggagccgggaggggaaaggggcaggagccaaggagagaaacctgaaagaggcaaactttaaatatatcgtaattctttaagggggtgggctctgtgtttctttgcaacttcacagtctcaccatcctcggctttggagtggatttggcagtgaggacaaggacggaacgccggtaggggagtagttgcttgtctcttgtttattcttctcctcttttccagcggcccagataggctgaaggcaaaactctcagcaagggggaagcgaccatcctgcgtggacctttctcccaggggtgggatgatgaaaaaagaaatcctcctggggaagcccctaggtatcccccagcccctacctttattaggaggcccgggtttcccccattaaacttatattcattcattcattcattcattcattcgttcattcattcataccacgactattcagtgagcacctaccatgtgccagacacagtattagactctcaaaaacgcggcataaatggaaactaggccctgaagccagagcctcaggactggctcccgggaatgtttgaagatcatcgcgtatcttggaattgccaggcttcctgctccacagattccagcgctgggcaaatgga

SEQ ID NO: 76191 - DNA, 787 bp, Homo sapiens
  chr13:95359626-95360413
  hyper
ttaataaagtttggacggctccctcggcctccgctgggccgcgggcgcaagaaagacgcggaccctcgaggcggacgagttgcgggaacttcgcttgcctggaggacacggcggcccaggcggccgggagcgccggcgccgagccgcgctctgattggctggcgcgaccgtccctatctgctccggggagagtggaatcttctctccatcttctgcgccccgagcctggggtgagagggagatccgcggtgctttctcctatcttcttgggggagggggaggaggaaattgtcaagggaagtaacaatcgcggccagcaaccctgctctcccaaagccaccccctcgcgcgacagcgtccccagcaccagttcttactgcttacacagcgcaattccacctgtttgcacaaagcccgaagcaacatgcctggccccttggatacgaggcttgcttcaagttttgggacaacggtgaataccaaagaaattgcatcatggctttaaaaaaaaccttgaaaagaaacgaaaatagaagaataaaaggaagggaaagaagaaagatggaaggaaggaaggagagagaaggaaagaaagaaaaatggagaaacagggagagagacggagatagataaagagatggagatagagatcgcgagccagcagcagctctctgcccaatcacagcgctgcatttgtgggccactttcagacgcttacaccacccacccccgggcctttctctacgccctcttgccccggagccgctccccccgctccaacccctta

SEQ ID NO: 76192 - DNA, 30 bp, Homo sapiens
  chr13:95360897-95360927
  hyper
ttagttttgcataatcgctcagaaccatat

SEQ ID NO: 76193 - DNA, 644 bp, Homo sapiens
  chr13:95362808-95363452
  hyper
acaaaaggccagattcgagccggtcactggtcaagaatggatctggttgggagttctgcttgagagaacagagatctgcaaagttcaaatagtacaaacagggaggcgaggctgctcagagccatcccactcccagaaacgaatgacacaagcagcttttcccgtgtgccagccatttcagacctcacatttgaacagcgtgcatgcaacacggaccgggagggggttgggggttggggggctgaggggcgaggaagaagaatgagaaacaaaaacaaaaccgaccatgaaacttccaacaaaactggaaaggccaacatgtcaaaaagttactcctccacctccgtgggtcaaaacgcaacaggttccgaagtgcaaagcaaacgccaactgctgccgcacacaaccgcctgctttcgagttggctgccgaagtgcgggtctgaaatgatcctgcgaattcacaggcctgctcgcccgcgcccttgcgcgcttggccactcctgccccgcctggcctctctgcctctacctggcacctatacattctatgtacatacaaaccgggcccccggtcgcgggagggcgcacggggaggccgcagcgctcgtacctatacatatgtacacgtgtgcacaccggtcct

SEQ ID NO: 76194 - DNA, 467 bp, Homo sapiens; identical to SEQ ID NO: 35010
  chr13:95363493-95363960
  hyper

SEQ ID NO: 76195 - DNA, 227 bp, Homo sapiens
  chr13:95364064-95364291
  hyper
cgcggccggtacttgtagtcggggtgctccttcatgtgcatggcgcgtagacgcttggcctcgtcgatgaacggccgcttctccgactctgtgagcagtttccactcggcgcccaagcgcttgctgatctccgagttgtgcatcttggggttctcctgggccatcttgcgccgctgagcccgcgaccacaccatgaaggcgttcatgggccgcttgacgtggtccac

SEQ ID NO: 76196 - DNA, 346 bp, Homo sapiens
  chr13:95364329-95364675
  hyper
cgccgcctcccgggccctcgccctcggcccggaggaaatcaatgttggctgcccgcggagacccgctcggccggccggggctcgtcgcgccccggcgtcgctcccgccccggaggagggggctgggggaccagcccagggccacgccgcgccccgggccgccttagtgtctccggccgagcgctcgagcaggttgtctctgggacactctaacttctcggcggtgccccctccccgcggcggcagtttgccctttacgttctttgggtccttcgtctgcagtggcgtttgctggtgagctccccgcaggtagcggcggccgggcagagcgctcctcctcctcggtc

SEQ ID NO: 76197 - DNA, 781 bp, Homo sapiens
  chr13:95364676-95365457
  hyper
ttctctcttaaatgcaaagcgtccccaaaagttgcgtcgcggagactcctcgaagttgagccgaggagcccgccgccgcgtgctgccaagtgccaaagggggctctcagcggctggagtgtttgggttctcctcggtgactttctcatttgacagaagcagatgggggtggggaaggcggggaggtggccctggaggaggaagaggagggggaggcggaggagtgtccaggcgtgccacgagaacgcagagcgcagcaatggatataaatacaaatacagcagcaccagcctgtcttcttggctccgggcagggtgcgccgatgggaaacccccaatcggctgggtgattttttttttttggaggggggagctgtcccccgcagcacctgcctctcgagtcttcctctcccgctgctggactgacgggtggggcgaggaaggagggtggatgaggcttgagcaagcgttggtcgcccggcctcagaggaagttctcccggctcgccgaggagccgcgtccggccgtcccctgggccatgccggctctgttcgctccgagccccttcaggcgcgcctgccgacttagggctcccggagctcgccggccgcggagggcagcgcagcctccacgcggcgccgcaggcctggcaccggccgcgtccccgcctcgctcttctcggcagccgcctggcacttgcaactaacttcgcccaagtttcctgcgccgcggcgcccctctcggcgcgctcctgggagcgtgcgcccgcgagtccgccgcgcc

SEQ ID NO: 76198 - DNA, 279 bp, Homo sapiens
  chr13:95365497-95365776
  hyper
cggcgcaggggcggaggtgctgcaggagagttaaggaaaacgggccatcacctcagttcgcaggtccgcgctgtggcacctcccgctctccccactcccgcggcgcagggggccccttcccagcccaggccgccctctgcaccggctcaggtgagtgtggctacctgcatgtgtgcgcgcccggagccggcactgggtgtgcatgtccagccgcggctgtgtgtgtatatctgggggcctgcggaggaggtggagcccaggactcggggagggaggagg

SEQ ID NO: 76199 - DNA, 30 bp, Homo sapiens
  chr13:95451825-95451855
  hypo
gcatataacccagtacggttttgaatgtgg

SEQ ID NO: 76200 - DNA, 23 bp, Homo sapiens
  chr13:95476305-95476328
  hypo
ttaaaaattcttggccgggcacg

SEQ ID NO: 76201 - DNA, 545 bp, Homo sapiens
  chr13:95619761-95620306
  hyper
cttactgcagtgcagcgtttatgacacttgaaaacagattggagagtgggttttgctcgggcgacttgattgtctttcaagttggcgttaagagttttcaacaggtctccttccctgccagccgggaccccgggggtccctcggagcagggcgggtgggaccgctcggcctccttctctcgcccgcacgggcgccgccgcagacccggagcaggcacccggcggccgccgcgtgggctgcagcttagcctcctctgcgggcgcccggcagggctgcgcggccgagactcggggcgccggcgccggggcggccgggagctctgtcatttggcaactccctgcagactgatgacacggcgctttccatggtcgagccccacaaagtgtagggctgcggggcgcacctggctgggctcctaattacccggcctgggacgcacggggcagccgcggagggtggcgcctggggtcgggccggggtccccttcgccgcagtcccgcccacccgcagcctccgaggggtcccggccagggcgttctccacac

SEQ ID NO: 76202 - DNA, 475 bp, Homo sapiens; identical to SEQ ID NO: 11674
  chr13:95620307-95620782
  hyper

SEQ ID NO: 76203 - DNA, 221 bp, Homo sapiens; identical to SEQ ID NO: 35017
  chr13:95620853-95621074
  hyper

SEQ ID NO: 76204 - DNA, 355 bp, Homo sapiens
  chr13:95655055-95655410
  hyper
tcaggactttagacccggtggctaccacgtggccatggctagctgtgtccacacggcccctccgaagcgccttggccccagctgcactctcctcgcccccttcctcccagtgggaacgagccagccagcgagccctctccccacgggtggcgcccgcacccctccttgcccccgggccccggcctgtgatcgctttccagggggcaggcgagctcccgggccggcggcagagggcgggcgcctgtgatccgtggccagggagcgcgtgcgcgccgagcatctgggggcgccctcctgtgatcccccgccaggcccagctctgtggcagaggccgtacactcggcctcccgcccgg

SEQ ID NO: 76205 - DNA, 135 bp, Homo sapiens
  chr13:95711256-95711391
  hypo
tagaaaatatcagggcgcagaagcatggagtaatatcgtgttgtgagacttttgtttctgtgcgtgtgtgcgcacctgcacaagcccacactaaatcatgttgcaaagcagagttctgatcggggactgcgccag

SEQ ID NO: 76206 - DNA, 70 bp, Homo sapiens
  chr13:95718405-95718475
  hypo
atcaaatcacggcatcgagccttggcatatgccatcgtgcctttcacatgcatttcgacctgctgaaatc

SEQ ID NO: 76207 - DNA, 30 bp, Homo sapiens
  chr13:95725531-95725561
  hypo
ccaaaccaacctgcccggcatccagagcta

SEQ ID NO: 76208 - DNA, 85 bp, Homo sapiens
  chr13:95775589-95775674
  hypo
atgcttgtttgatgtcgctctggagtgttttttgtttttttgcgggggacgaagtctcactctgttgcccaggctgaagcacact

SEQ ID NO: 76209 - DNA, 30 bp, Homo sapiens
  chr13:95780731-95780761
  hypo
ctcctatgcacagggcgtctgcaagtcctt

SEQ ID NO: 76210 - DNA, 50 bp, Homo sapiens
  chr13:95843472-95843522
  hypo
aaatttacctggaaacgacttaatggtcacatatccgaataatcacaaat

SEQ ID NO: 76211 - DNA, 73 bp, Homo sapiens
  chr13:95858839-95858912
  hypo
gaagaagagggtaaccgtcagccgcacagccccatacagcgtcactgccacgaacacgcggctggctgtgatc

SEQ ID NO: 76212 - DNA, 30 bp, Homo sapiens
  chr13:95870024-95870054
  hypo
agttcatcaccttcacgatgcaaattcctc

SEQ ID NO: 76213 - DNA, 105 bp, Homo sapiens
  chr13:95888741-95888846
  hypo
cccaaacaactagcacgggatcaggatatttacagaagacattcccatccctcagatgggtcatgatattaaatcccaacaagcctgtctcggcatgtgaacgcg

SEQ ID NO: 76214 - DNA, 91 bp, Homo sapiens
  chr13:96031634-96031725
  hypo
ttttgaaatacatatcgtcaggtttttctggactggatactaactgatacagtgtttggtaccagaatggtataaaaagaaatgaccggcc

SEQ ID NO: 76215 - DNA, 30 bp, Homo sapiens; identical to SEQ ID NO: 35019
  chr13:96056313-96056343
  hyper

SEQ ID NO: 76216 - DNA, 30 bp, Homo sapiens
  chr13:96135326-96135356
  hypo
cttgggagaaagtgacgctgcccgtcctca

SEQ ID NO: 76217 - DNA, 441 bp, Homo sapiens; identical to SEQ ID NO: 35020
  chr13:96204922-96205363
  hyper

SEQ ID NO: 76218 - DNA, 183 bp, Homo sapiens
  chr13:96296373-96296556
  hyper
gcctcaagtcccaggcgcatggcaccgccgggcagccgaaccagcagacaaaagccgagagacgcgggttccaggggaacctcggcgcccttccttggaaggcaaacaggcagtgggggcagcggcggctactccagctggatctgcagaggctcggctcgcagcctggagaggcaggagggc

SEQ ID NO: 76219 - DNA, 110 bp, Homo sapiens; identical to SEQ ID NO: 4038
  chr13:96296840-96296950
  hyper

SEQ ID NO: 76220 - DNA, 247 bp, Homo sapiens; identical to SEQ ID NO: 35023
  chr13:96296991-96297238
  hyper

SEQ ID NO: 76221 - DNA, 66 bp, Homo sapiens; identical to SEQ ID NO: 43823
  chr13:96409578-96409644
  hypo

SEQ ID NO: 76222 - DNA, 919 bp, Homo sapiens
  chr13:96742194-96743113
  hyper
atctctccttgctcccggccgaagggattcccacccccagctgcctcctccgagccccgcggagcagcggactcctcccctggaaactcctccggggctgggggaggctttggcgcatgctccgtacctagggcaggtttttgctgcgggtagcagggctcctgtcacaccggctggcgggttgtggcggtgccagcctgtgtgtgcgagtgtgtctgcgtgcctgcgcctgggcggacagcccggagcggcagtgcgactcgccgggagaggcgtctccgcagaggcgcctcgcccgctgccgctgcgctgcgggggccgctctgcaaacttgcggcgagcgccgtcagccctcgcggctccacagccccgcgacctgccggcaaaggcgccgggcgcgcgtgccgggcgcggtgcccgcggccggccggggcggcgggagcgggccgcgccttcgcccttggccggcgccctggcgagcctcatgcagccccggcgctcgcggccgcagctacccggctgcccggctgcgcgcggcaggtccaggacccgaaccccgctccccagcgcctgagcgcctgcaagccgccggcgggatgccgcgcgtcgcctgagagagccgcgccggggcgggagcagggagcgggccggcccgggcgcacccgggagcgcagggcgccccacgccgcagccgcagccgagcgcgccggcgcccgcctcccccgcccggctcgcaggccccggctcctcaagccccgagggccgcggggccgccagccagccacacgcctcggcgtcaggggcatggaggaacggcgggctccgagccgcgccccggagtccgcgaaacttccgagcgggcgcccgtccgccctgccgccgccgccgccgccgcttcgcctgccggcctgagagcggg

SEQ ID NO: 76223 - DNA, 548 bp, Homo sapiens
  chr13:96743347-96743895
  hyper
ccccccgagggacctcggggggccgcggcgccggaggaggaggacgaggagcccggagacccccgggagggggaggaagaggaggaggaagacgagccggaccccgaggccccggaaaacggctccctgccccgattcgtgccgcgcttcaacttcagcctgaaggacctgacccgcttcgtggatttcaacatcaaagggcgcgacgtgatcgtgttcctccacatccagaagacggggggcaccactttcggccggcacctggtgaagaacatccggctggagcagccttgtagctgcaaagcgggtcagaagaagtgcacctgccaccggcctggcaagaaggagacgtggctcttctcccgcttctccaccggctggagctgcgggctgcacgccgactggacggagctcaccaactgcgtgccggccatcatggagaagaaggactgtccccgcaaccacagccacaccaggtactgtcgcccgctgggtctctgttcttcccccccaccccccatccctcttcctcagtcctgacccagagc

SEQ ID NO: 76224 - DNA, 220 bp, Homo sapiens
  chr13:96743896-96744116
  hyper
accccgcgctccctgcccctgccgatggtttcctggcgtcttcagcggttggcgccgtggctttggggagggatgagaaacctccggatagtgcctaggtcctgaactcgttcttcccccagcccccaccgcttcccgccacccctctgccttcaccctctaagatgtgcggagccaccgtgtggatcctgcctgttgcctagcacggcctggcctccct

SEQ ID NO: 76225 - DNA, 30 bp, Homo sapiens
  chr13:96958800-96958830
  hypo
gcctgtatgaaggtgcgttagattctgtcc

SEQ ID NO: 76226 - DNA, 18 bp, Homo sapiens
  chr13:97599727-97599745
  hypo
tctcgcctcactgcaacc

SEQ ID NO: 76227 - DNA, 16 bp, Homo sapiens
  chr13:98426774-98426790
  hypo
tgcctgatctcagctc

SEQ ID NO: 76228 - DNA, 30 bp, Homo sapiens
  chr13:98702848-98702878
  hypo
aaaatggagctttcacgtaaattaggctcg

SEQ ID NO: 76229 - DNA, 30 bp, Homo sapiens
  chr13:98795810-98795840
  hyper
gggcggcaacttgtgcgagtccaggctccc

SEQ ID NO: 76230 - DNA, 39 bp, Homo sapiens
  chr13:98866341-98866380
  hypo
ctcagcagctggagccgttggagccgctggaacctctgg

SEQ ID NO: 76231 - DNA, 48 bp, Homo sapiens
  chr13:98870050-98870098
  hypo
cctcttgttcttgttcgtcatcatatcctacgccgcagcggtgcctgt

SEQ ID NO: 76232 - DNA, 325 bp, Homo sapiens
  chr13:99083172-99083497
  hypo
ggaaattaaacaaatcgtgaaatagagagtgcaggagcgcttcatttccccaagtgaaactgggcagaacacaggtgcatcccattcagctgaacaggaccctcctcctctgttgcctcccaagcacctggcggctcacctgtggaagcacagcgaggccttggaggccctggagaatggaatcaagagctcccggcggctggagaacttctgcagagactttgagctgcagaaggtgtgttacctaccgctcaacaccttcctcctgcggccactgcaccggctcatgcactacaagcaggtcctggagcggctgtgcaaacac

SEQ ID NO: 76233 - DNA, 30 bp, Homo sapiens
  chr13:99136257-99136287
  hypo
caagtgcggaaacctcgaatgatgtgtctg

SEQ ID NO: 76234 - DNA, 30 bp, Homo sapiens
  chr13:99176587-99176617
  hypo
agcctcaagggaccccgcagtgttcgctct

SEQ ID NO: 76235 - DNA, 187 bp, Homo sapiens
  chr13:99189615-99189802
  hypo
tgctttgaacagcagcgggctcattcacaacagcacagtgcccggcacacgggagacctcaaccccatcagctgaataaacaagtgaggcgagtgcagctgaggagctgaggccccagccgccagctgtggcacgagaggcagacagaccttccagactaaggaccgggccacgcactggccagggt

SEQ ID NO: 76236 - DNA, 46 bp, Homo sapiens
  chr13:99328589-99328635
  hypo
ccacgcacgcacgcacgcacgcacactctctcgctcctgctgtagg

SEQ ID NO: 76237 - DNA, 384 bp, Homo sapiens
  chr13:99404616-99405000
  hyper
cctcggcggagtcggcgcctctgggcacctctggcttccgcgccccggccgcacggtgaccacccgggaggggatcccgggcgccccgcaacctcccggcccccgtgggccttcgggtcgccccgcttcccgccgccgcgtacccttcgcgcctcccggccctcggtgccggcccccgccccgcgtagctccgagtctttagcccggccggccccccacccgccgagcgtacccatggcggcggctcccagggctcctgcgacctgccggcgggacgtgctcctggcaggtgctactcctccgacctgacgtccaggcccggccccgttgccccaggtacagccccagctctgcgaggcggggccgccggctccacccgggggg

SEQ ID NO: 76238 - DNA, 213 bp, Homo sapiens
  chr13:99428504-99428717
  hypo
tgtggaggttttacacgatgactcagtgcacatcagagtcagagacaggacggccgaacactgattccagagataggcatgtgggccccgcccgggaaggagagctgcctgggagatggggagctgcaagagagcacccagaggggtaaatttgcacaaggccactgcgtacactggtacgtgcttccttgaaaatgtgacattttcaggcag

SEQ ID NO: 76239 - DNA, 24 bp, Homo sapiens
  chr13:99851628-99851652
  hypo
tggggagagcgagactccgtctca

SEQ ID NO: 76240 - DNA, 85 bp, Homo sapiens
  chr14:100111198-100111283
  hyper
aggcctctggccctgcgcctccctggctaaagagcgccctgtggggaggaagcagggccccaggcggaaccgggaaaacacaccg

SEQ ID NO: 76241 - DNA, 54 bp, Homo sapiens; identical to SEQ ID NO: 35524
  chr14:100111503-100111557
  hyper

SEQ ID NO: 76242 - DNA, 265 bp, Homo sapiens
  chr14:100111764-100112029
  hyper
cgtgcgccggctacgcgagggacctgctgtgccaggtgagcgggcgcgcggccaccgggcggggcggggcgcgggaggccgagtcctggagcagagatcggaaccccgcgggggcgagggccaagagtgggcggcggactcgggaactctaagccccaacagggagtcatttggcacggggcggggagaccgcgcatcccaggacgactcttggctttgccattcattagttttgtgacttgggccttctcggggcctcagtttc

SEQ ID NO: 76243 - DNA, 483 bp, Homo sapiens
  chr14:100125656-100126139
  hyper
ctgcacctggctcagcggtcagccggcgccccagcacctgccccgcggagcccgtgagccctggctcagggcgaccccgagccgcgccctctcccaccccgcccgcaggtcggcgctgctgggcaaggtgctgcgcatcgacgtggaccgtaaggagcgcggcctgccctacggcatcccgcccgacaacccgttcgtgggcgaccccgcggcgcagcccgaggtctacgccctgggcgtgcgcaacatgtggcgctgctccttcgaccgtggcgacccctcctcgggcactggccgcgggcgcctcttctgcggcgacgtgggccagaacaagttcgaggaggtggacgtggtggagcgcggcggcaactatggctggcgcgcgcgcgaagggttcgagtgctacgaccgcagcctgtgcgccaacacctctctcagtgagtgcccgcgccccggggaccccggccccgaatccgcccccac

SEQ ID NO: 76244 - DNA, 120 bp, Homo sapiens
  chr14:100148288-100148408
  hypo
cagcccgccccaagggaagaatcaggggcgaagagagatgcaaccccccgggagcatgccaacctacaaaaccccgagtcaaaggtcaagccacacacttgcctctctcaagtcacctgc

SEQ ID NO: 76245 - DNA, 36 bp, Homo sapiens; identical to SEQ ID NO: 44101
  chr14:100209839-100209875
  hypo

SEQ ID NO: 76246 - DNA, 30 bp, Homo sapiens
  chr14:100223391-100223421
  hypo
taaggctgggcatggcggctcacgcctgtc

SEQ ID NO: 76247 - DNA, 32 bp, Homo sapiens
  chr14:100259369-100259401
  hyper
cttggtctttgtccccgcgcccccgcaagggc

SEQ ID NO: 76248 - DNA, 582 bp, Homo sapiens
  chr14:100259680-100260262
  hyper
accggcagcagcagccgccacagcagggccggccccagcgccagcgccggtcgcggtcgggctcagctcagtgtgtggtgagcggcggcggcgcggccgggccggggagcgggcgcggcccggcggcctcagcatggaggacggcttctccagctacagcagcctgtacgacacgtcctcgctgctccagttctgcaacggtgaggggcggccgcgcggggccggggcggcgagcggctggtggcgggcggcggcgacggcgacggcggggaccaagccgaggggccgaggcccggcggccgcgggcgaggccgcgcaaagttgttgcggaggggcgcgcggtccccgttcccgccgccggcgcattgtgttggagccgcggggccgcgcctcgctccgggccgccccgggctccccgccgccaccccggctcccggcactggcgcgcggaccccgccggctccagcacccgcggagcgcgcccgggcggaggcgcgtggggcacagggcggcggggaggcccgggcagcctccgcgttccggggaacgtgttgcttttttgcttcccgacccacatctgtt

SEQ ID NO: 76249 - DNA, 30 bp, Homo sapiens
  chr14:100406078-100406108
  hypo
actgagcatatctctcggctgagggcggtc

SEQ ID NO: 76250 - DNA, 507 bp, Homo sapiens
  chr14:100437443-100437950
  hyper
agagagggaatcagtcgccggtgacctcgacggccctcggatcagggatgccccgagtccgagcgggcagggtgctcagcagggccaggtgatgggaatcatggggccatcgagcacggaccctggctcccccggtggcctctgtgagctctggggtcaggcggggactggaggagcgtccgcgccgggagggagcgcaccgcgccacgtgcccgcccggcgccccgcccccaccccggccacgcccctcgcgcttccctcaaagccccgcccctcagccccgccactctcgtccgccccgcccctcgcagcctcaagctcagcgctcccggaggcgcggacggtggggccccgcgccttttgtgtcgggctttgaccgccgcgcgcgctcattcacctcagcggccgcgggcggaggggcgcacgcgcgcgcagtcccctcggagggcggtggggcgaacagcaacgcgcgtaccctagctcttggctgctgtgctgagactagcc

SEQ ID NO: 76251 - DNA, 204 bp, Homo sapiens; identical to SEQ ID NO: 35529
  chr14:100438017-100438221
  hyper

SEQ ID NO: 76252 - DNA, 749 bp, Homo sapiens; identical to SEQ ID NO: 35530
  chr14:100438222-100438971
  hyper

SEQ ID NO: 76253 - DNA, 290 bp, Homo sapiens
  chr14:100591008-100591298
  hypo
ccacccacaaaagggcgtgaaggagtgagccaccagacgccaggtgtaagcgtacaggcgtggatggctaaatgggtacttcatttctctcgaaactgcttcatcacccgcagtgctgaattctgtaccccagggcccaatccaagctgtgtggggtcactggccgtccgggaatgggcataccgcctggcggtcggggtgtgaacagcaggggacacacacacaagcacatacacttgtcccaaggcaggaccacacacatagctgcccccagacgagaccacgtacgg

SEQ ID NO: 76254 - DNA, 30 bp, Homo sapiens
  chr14:100597146-100597176
  hypo
gatccgcagcacgggcgtctccggagcctc

SEQ ID NO: 76255 - DNA, 30 bp, Homo sapiens; identical to SEQ ID NO: 15860
  chr14:100611919-100611949
  hypo

SEQ ID NO: 76256 - DNA, 115 bp, Homo sapiens
  chr14:100613268-100613383
  hypo
ggggctggttctcctcggggccgcacccgcgagcacacacgcagacacctgagcacacgcggtgggcatgcacatgcatattcatgtacgaacatgtttgcgcgcgcgcacaccc

SEQ ID NO: 76257 - DNA, 458 bp, Homo sapiens
  chr14:100625468-100625926
  hyper
ctccgcgccagggagcgcgtgcgcctcgtagcgcgtcccggggccgcccctgcgccctcgcgtcccagcatcccagagccccggccctggccccgggagtggctcgcgaggaacagctgggacgcgctccctggcgctcggacccgtactggggtcctcggaatcctcaggtcccagggagtttcagacccggccagggtgggggaccctcggggagccggccggggaccccagggaggggagcggcaatggcggaacgcccactggaatttgggccagagctggagcggcccgtctgggctcgaccccacgacgcgactccagacgggccaacggggcggtccccaccggggtgggccccgcgcggcgctcacccagtatctccttgcgccgctgcgtgtgcggctggtcggtgtagacccactcgaagtcgctgcggctcgcgctgttgcccatgg

SEQ ID NO: 76258 - DNA, 92 bp, Homo sapiens
  chr14:100637026-100637118
  hypo
acaggcgtgagccaccgcgcccggcccaaaggcattaaaattaactccaccccagtcaacaaccatgaagtattttgcgctgacagctttgg

SEQ ID NO: 76259 - DNA, 368 bp, Homo sapiens
  chr14:100643113-100643481
  hypo
cagttcagcggctcacgtctgacttctctccttggcctcatgcccagggcaccttcctgaatcccagaggtgagcaaaactccacctccacaaccccagggcaccccattgccaccacccctcagccttggaaatggagtcaccaggcatgaagtttagatgtgcacaacctggcaccgagtccctacggtgggaccatgcccgcagcggcagtgtggaagatgggacagacacagcgaaatgcctccagggcgtggtgggaggggccggaacagggagatggcgcgtgagtagcatctgttcttacagcaaaacctgtaaaagtaaaatatacgtaggtttgtcactaaagacgtgtctgcataaat

SEQ ID NO: 76260 - DNA, 30 bp, Homo sapiens
  chr14:100644084-100644114
  hypo
tgtgagccaccgggccggtataaaaagata

SEQ ID NO: 76261 - DNA, 297 bp, Homo sapiens
  chr14:100644399-100644696
  hypo
agcccagcccagtgccgcgcctgtcctcgaacctggcccaacgctcgccgggagcagggacctgcgtgcagctatggaaccgaggcgcgggctgcgggatcccgccctacctcccataaaccagggcccgagataagggagtcccagagggccaggggagtcgcgggcccagcgtctcagtgggcacgaatttcttactttaacctcttttctgtcgaccccatctgtccccacctgggaggagggggagcaacaggccccttcccggtcgagttcagggctcggtacaaaggctgc

SEQ ID NO: 76262 - DNA, 36 bp, Homo sapiens
  chr14:100747273-100747309
  hypo
gaagcctgataatttcgggaggctgaggcaggagaa

SEQ ID NO: 76263 - DNA, 30 bp, Homo sapiens
  chr14:100749445-100749475
  hypo
cagccctggaagctccggagctaactggga

SEQ ID NO: 76264 - DNA, 35 bp, Homo sapiens; identical to SEQ ID NO: 44108
  chr14:100780162-100780197
  hypo

SEQ ID NO: 76265 - DNA, 30 bp, Homo sapiens
  chr14:100801423-100801453
  hypo
ggctccttcctgcctcgggcaccagctcag

SEQ ID NO: 76266 - DNA, 104 bp, Homo sapiens
  chr14:100843537-100843641
  hypo
attatttgcagtgcacggttccattagtttataattagtctttcatattatattagttccattggagatgagctggctggctggctttagaagttgttgttgtt

SEQ ID NO: 76267 - DNA, 163 bp, Homo sapiens
  chr14:100843941-100844104
  hypo
cggtcgttttatttaaactctggctttgcgtgtggaagttgttacctgcctggaatgggctgcgaacgggggcggcattactagaggaggctgactacagacatttatggaatgatgacctgacttgtagaccagtggaaccctcaggcgaatgatgccactt

SEQ ID NO: 76268 - DNA, 204 bp, Homo sapiens
  chr14:100938536-100938740
  hypo
ggagccctggagccccggctgggcagggaaccctgtcctccttcctgtgcatgggccggctctcctgatgtgcgctggctcctctgagccatctgtgcagtgccacctgggtctacctcccagatcctggaggcagcacgcgtgagagggcacatagacagggtacaggtgttggctcttctgcctccccgaaccaggcctctt

SEQ ID NO: 76269 - DNA, 690 bp, Homo sapiens
  chr14:101033483-101034173
  hyper
cgcctcggctcaggctccggaaggaaaacacgggaggggtgttcccaaagtaggggtcagggtgccaggggaagtcgtggaggaagtggcaaatattcaaactggctgatcccaggcctgccgcgcaggtggtcccgtgaagtctaccaaggcttaaagtttggcaccgggagggaggccgcgggggacactccccagaagctgtcgcgggattcccccaaaatggctccaagacgcggctgcctggtccagccgcgaggactccatcccccacccccgccccccagaggcggacacttaaaagctcagagccaggcaactggcagcccgggggctggggcgggtggtggttgggggtggggtggggtcgggggagagagcgccggggcagtgcggaacggcacgaacggaacccggagggtccccggggaccagcgagagtccagggcagggagccagaggggcgctgaggaccgcacaggaccaggcggccccgggtagggggcagcccggccctcagtggcgctagccccagcccccgccgcagcggcccgggccggcggaggagccccgcgcgaggctccccagcgcctcgcggcgcgcacacacgcaccacacacacgcacctggcccgcagccccgccgaggccgcccgcgggccctgggggatgcgctcgggtggagccccct

SEQ ID NO: 76270 - DNA, 59 bp, Homo sapiens
  chr14:101034412-101034471
  hyper
cccagcttccagtcccggccgcggcccccgtgactcagtgggcgcgccgggccgcggcc

SEQ ID NO: 76271 - DNA, 676 bp, Homo sapiens
  chr14:101034860-101035536
  hyper
ctggcttgcccctcccgggccccagggattaacccgtgagcgcccggctcgccggcggggctccctgccttgcttgcgcagacccgcccgcgcgcggcttggagaccctccctgcccagccccgctcagccgggcagcccctccgcgcgccgggcagggggacccacccgccgccgttaaccttgtgggcgcgggcgagcgacggggaccgcgagcggcccgggcgggatcgcacttcctgcgtggagctgggggcgccgggcgggctctctatcacccgggagaggccgctccccggggctttgcccgtctttctgtgccgtgactggcactcaagggggacaggggtccgagctcagggaccacgcgacagacctgggaagactgatgactgcccatcccggcccctcgcgccgggcgccgccgccgcgtccgccgggagcgcgctccgctcgggtccgggccccacgccgcctcccccaccgccccgccgggcgagggcgcagcccggccgcagcgccaagctagaaggcccggccccggggcctcggccaggctcggccaccaacttcccgggtgctcgggccggccttccggcgctctcccggcctcagtttcctcacctgaaagctggggggaagggggaggcagctggacgaggcgctccactgccctt

SEQ ID NO: 76272 - DNA, 30 bp, Homo sapiens
  chr14:101038620-101038650
  hypo
tctgaccccattgcacggctgcccactgcc

SEQ ID NO: 76273 - DNA, 30 bp, Homo sapiens
  chr14:101052393-101052423
  hypo
cagagccacccccaacggccagttgcccct

SEQ ID NO: 76274 - DNA, 42 bp, Homo sapiens
  chr14:101052723-101052765
  hyper
tgctccctatccatccggccccgctcccgggtgcccactctg

SEQ ID NO: 76275 - DNA, 56 bp, Homo sapiens
  chr14:101121187-101121243
  hyper
ccggggtctcctctgcggcgaagagcgtgggtgcaggaccccggcgcgcagcgcag

SEQ ID NO: 76276 - DNA, 30 bp, Homo sapiens
  chr14:101155496-101155526
  hypo
aaggtggctctgcctcggtttacgcctttg

SEQ ID NO: 76277 - DNA, 40 bp, Homo sapiens
  chr14:101192480-101192520
  hypo
gtccgtctgtttatacgtgtgtttgcgtgtttgggtgtgc

SEQ ID NO: 76278 - DNA, 39 bp, Homo sapiens
  chr14:101192920-101192959
  hyper
tctgcggcccaggttcgattcctgcgacttgtcctaggc

SEQ ID NO: 76279 - DNA, 201 bp, Homo sapiens
  chr14:101193397-101193598
  hyper
gcccagagatgaccgcgaccgaagccctcctgcgcgtcctcttgctcctgctggctttcggccacagcacctatggtgagttccccggcggcccggctcgcgccccctctggggaagcctgcgactccccgccggccgcccggtgccccgcacgccccgtctcgtgagccccaactccgcccgtcccgcctagccctaagc

SEQ ID NO: 76280 - DNA, 32 bp, Homo sapiens; identical to SEQ ID NO: 44110
  chr14:101198835-101198867
  hypo

SEQ ID NO: 76281 - DNA, 60 bp, Homo sapiens
  chr14:101199827-101199887
  hypo
accgtagacagacctcgtattgctttctctttgagagtccccaagcgcttcctgcacaat

SEQ ID NO: 76282 - DNA, 186 bp, Homo sapiens
  chr14:101200566-101200752
  hypo
ctcaggcaatttctgcgagatcgtggccaacagctgcacccccaacccatgcgagaacgacggcgtctgcactgacattgggggcgacttccgctgccggtgcccagccggcttcatcgacaagacctgcagccgcccggtgaccaactgcgccagcagcccgtgccagaacgggggcacctgcct

SEQ ID NO: 76283 - DNA, 44 bp, Homo sapiens; identical to SEQ ID NO: 44112
  chr14:101201633-101201677
  hypo

SEQ ID NO: 76284 - DNA, 30 bp, Homo sapiens
  chr14:101244707-101244737
  hypo
agattcatgctaacccgtaaccaaggctgc

SEQ ID NO: 76285 - DNA, 248 bp, Homo sapiens
  chr14:101250082-101250330
  hypo
ggggagctggggtggcgacccatgaattagggtccattgacccggaggtcgaggcttccagagcgggccagccggcagccccaacgtgtgaggctgtgcacctgctggggagggtttttttgatggcgacggcgtgaggtgagcgggtttgctctgggcggtcgaggattagcgccgactgagagggtcaggtgcaccggggctttgttcagacctgtttgccttttgtcccccgcctgcagaaagcc

SEQ ID NO: 76286 - DNA, 30 bp, Homo sapiens
  chr14:101280064-101280094
  hypo
atttctgcattgagccgtgtacaccagaga

SEQ ID NO: 76287 - DNA, 30 bp, Homo sapiens
  chr14:101301191-101301221
  hypo
tgtgtgagcagcttccgacccctgccccat

SEQ ID NO: 76288 - DNA, 70 bp, Homo sapiens
  chr14:101347653-101347723
  hypo
tggtgtttgcacctacgagagcgggcatctgggtgagcagctgggtgatggctgtcgtgatgctgctgcc

SEQ ID NO: 76289 - DNA, 48 bp, Homo sapiens
  chr14:101349702-101349750
  hypo
agagccagacaggctcgttgccaatcagcgagccgtccacggattgga

SEQ ID NO: 76290 - DNA, 30 bp, Homo sapiens
  chr14:101531739-101531769
  hypo
gaggctggggcacctcggggaaggacgccg

SEQ ID NO: 76291 - DNA, 45 bp, Homo sapiens
  chr14:101532265-101532310
  hypo
tgtctgtgatgagttcgcttttattaatgacgaatataacacaga

SEQ ID NO: 76292 - DNA, 34 bp, Homo sapiens
  chr14:101532812-101532846
  hypo
atgacacacaagacacgagcggcctctcttcagt

SEQ ID NO: 76293 - DNA, 344 bp, Homo sapiens
  chr14:101543828-101544172
  hyper
gggatgcaatttccccggtgtttttcaggcccagagctattgaataaatgaagtgcgcgccggcggagtcagtaactcactgcgcggctcccggcaggcgggggcggagtgggggccgcagaaccggacgtgcctggcgaggttcagaggcgctagcggtgtggtgggtgggcagcgccgggatggctggagggaggggctacggggggaggcgctgccgatcccacactgatctggcggggaggagggaggggcggatggggtttgctggagaacttgaccttgcttcgctcccctcaaggggcagctgctgggagaccaagtgtcaccggctggcaatcagg

SEQ ID NO: 76294 - DNA, 34 bp, Homo sapiens
  chr14:101576586-101576620
  hypo
caagggtctccagtgcggccgtgaccagtaagag

SEQ ID NO: 76295 - DNA, 105 bp, Homo sapiens
  chr14:101591942-101592047
  hypo
tccagccgtgcagaacgacatgcaattgaaaacttagggattgtttctttctgggatttctgtttaatatttttggacctcagtggaccacgggtaagggactca

SEQ ID NO: 76296 - DNA, 30 bp, Homo sapiens
  chr14:101665450-101665480
  hypo
tgtctctggatgggccgtgttgtttgtgcc

SEQ ID NO: 76297 - DNA, 62 bp, Homo sapiens
  chr14:101694557-101694619
  hypo
ggggtctgtgcgaaccgcggggtctgtgagaaccgcggggtctgtgccgcctggtggggagc

SEQ ID NO: 76298 - DNA, 173 bp, Homo sapiens
  chr14:101713576-101713749
  hypo
ctttcctctccacttcgtcctgtggatccaatcatccctgtggaaggacgatgggaaaatctgcctcttggggcctcagatttccagatctaagttccagctgccaagaggacacaacacagggttctcagagccgccgcaccctaatttcatctccccgcactgcccccacc

SEQ ID NO: 76299 - DNA, 30 bp, Homo sapiens
  chr14:101797233-101797263
  hypo
ttcaggtgatccagacggttctggatccaa

SEQ ID NO: 76300 - DNA, 30 bp, Homo sapiens
  chr14:101864688-101864718
  hypo
gcctagtagaataaacgtctccttgcaaag

SEQ ID NO: 76301 - DNA, 30 bp, Homo sapiens
  chr14:101908354-101908384
  hypo
acctgcgtctcctgtcgtcagcaaaatgca

SEQ ID NO: 76302 - DNA, 103 bp, Homo sapiens
  chr14:101915704-101915807
  hypo
ggaatcccaagaggccgctcaggcaagccagatagagccacccatgtgatcaagcattcagggcatgagggcccccactaccatggcccggaaaatacatgca

SEQ ID NO: 76303 - DNA, 190 bp, Homo sapiens
  chr14:101923096-101923286
  hyper
gttactatattaaagcgcttcaagttttcatagcgctcgtcaaacagagacctcggaacgctctgcagacattaattaatgttcgctccggccctggaagccatttcaccaatggaaattccgatgagaaaggaagaaacgaggggttcaaggccgcgccgttgtgagtccgctgcggaactaggaactg

SEQ ID NO: 76304 - DNA, 166 bp, Homo sapiens; identical to SEQ ID NO: 35537
  chr14:101923521-101923687
  hyper

SEQ ID NO: 76305 - DNA, 214 bp, Homo sapiens
  chr14:101924030-101924244
  hyper
gacgccctggcccggtgtccccgacgcgcctggagcccgggagggaggcgcgggcctggcctgggcccaggaggatggagcccgactcagggccgtctctccccgcttgggggtgctcaggagggcccagggtacctgcgcgggcaccttggcggcgggtcaccctccctccgagccactccgtccgtgggcagcggccttaccaggtccgagc

SEQ ID NO: 76306 - DNA, 143 bp, Homo sapiens
  chr14:101924295-101924438
  hyper
cgggagccccaggtgcacacacgcaggcctgggccgggcctccaggcctctgtccttcgggcgggctgggaggtggcctggcgatgcccgccgaggggtggagagggcgaagccagggcggcgtcggcgaggccatcaaaggc

SEQ ID NO: 76307 - DNA, 122 bp, Homo sapiens
  chr14:101924457-101924579
  hyper
cgttgcccatgaccaggccgagggcatgaaaggatctttatcctccagtgacattgccaggccggcgcttttctgcggcctccccctcccgcggccctaattggggccggctgctaatgtga

SEQ ID NO: 76308 - DNA, 214 bp, Homo sapiens; identical to SEQ ID NO: 12051
  chr14:101924858-101925072
  hyper

SEQ ID NO: 76309 - DNA, 50 bp, Homo sapiens
  chr14:101925655-101925705
  hyper
cggcagagtctctggggcactcggggcgggcggcagcaggtgggacccgc

SEQ ID NO: 76310 - DNA, 302 bp, Homo sapiens
  chr14:101925706-101926008
  hyper
gcccgacccgcgctagggccgcccaccccctcggaccccggccgggtctctccacagcctccgtgcgcgtcccagaaggaaaatgctagcaaaccggaaggccgcacggggccgagccggcctcagcccggccaggagaggccgtcggtgccccgaggaggaaggggacccggcccgggacggccgccccgcggtacccaggaaggacgcccgccgttcccagcaccccagcgtctgaaaaatgaatgtgaactccgcaagcgtgctcccgcggacattttacatgtcggttgttcacattt

SEQ ID NO: 76311 - DNA, 863 bp, Homo sapiens
  chr14:102026178-102027041
  hyper
tttcgcggctggtcccggggcggcaggcgcacgggacgctggcggcggcggcggcttccgacttgggctcagaccccgccgctccagacaagtccccgcgactgcgacagtgtctcgggcagttcagctccccagacgggagacagaccctcgcgacctggttcaggccttgccctgggggacactgcagtccaaggcgaaaggagacttgctcccggcctctgggtccctaggtcaaggcacctccccgccccgccgcccctgagcccaagtcgccaaccccgcgccgcgcgcagcgagggatcagaaggtctcggacgccgcggcagggccggccagggccccacgagttagggagttgccccgcacccctaaacgctcagcacccatttacggttgaaagtacgcacttgacgcgtccgggcgcctccgcggtgagtcgcgccgccgctctcggggtccgcgaaggtggctcagttcgggcgctccagtctcgacgttcccggggtagagagcaacgtccggggacgaacgggacgggtgcgcccagcggccggggctgcgctgggcgaggcaagcggcgagaggggagcgctccggcgttcaggcaacagctacccctagtgggagagccgcccggggccggcgccgccccgcgcccgctgccccgcgccccacgcccgtggcgccccgcgcccgggtcggctgggggcgcagggccggcgccgctttccccagctctccggtctccggcgcccggcggtaacccgcccgcgggctctgccctccgcacctctcagcccggccccggcggccgctgacccaggaaccgcggcgccccgctggaacgagatgggacgggg

SEQ ID NO: 76312 - DNA, 30 bp, Homo sapiens
  chr14:102029131-102029161
  hyper
cccgcgcgccctgagcgcagctgggttcca

SEQ ID NO: 76313 - DNA, 507 bp, Homo sapiens
  chr14:102029818-102030325
  hyper
tttccctctgaatagcggcaggaattaaacacaaatccctccctcgcgtccccatagtgaccttgggaagcgggacgggaaggagcctaggctggcaggggcgctggaggaggatggaggaggaagagggtctgcggcggtgcccggggcgctcctacaaccgcacgcacccacctggacggggaacttagctgcgggagaagagcgaggtagcggagcgccgcgggatcctggaaagcggcgggagaggcaagggggccctctcttgctcccgcgcgcgcacacacagaccgaacagatgcagctgcccctgcagccgccgatccaacttaactgagtatccggcggtgtgtggagggggttgggtgaggtggagggcgagaggggctttggacccggtacagcctggctcccgaccgctgcaggcaccactgcgcacctgactcctccctggcccccttccggcacctgcaaccttgcctcttgcccacccgctccaggcagctg

SEQ ID NO: 76314 - DNA, 354 bp, Homo sapiens
  chr14:102030555-102030909
  hyper
attccagggctggggcggggattcggggccttaggcacaggtcccctcttgcagtcacggccaggggctcgctctcgcgcaatccccgccctcactgtctcgcctgttgcgcccggagtgagggcgacccgggggacgcgggattagcttagcccgcagcccctgtgccagcgaaaccttgaacattaagtgaaaggtgggggacacagtgaaagccgctgaggcgggagtgtacggatccaggtgaggggactgggcacggcaacttccctggcgcgccaggacaatgcctgggaacccaggattgtcagggtcgccgggggtgggggtgagtagtgtcggtttgcgcgcttg

SEQ ID NO: 76315 - DNA, 21 bp, Homo sapiens
  chr14:102031173-102031194
  hyper
acccctacctacctccgcgaa

SEQ ID NO: 76316 - DNA, 36 bp, Homo sapiens
  chr14:102031235-102031271
  hyper
cgcggcagggacgcggcccggcgcctgggagagtcc

SEQ ID NO: 76317 - DNA, 54 bp, Homo sapiens
  chr14:102031526-102031580
  hyper
gcgccagccactccccgcacgggccgcactcgctctggtcgcagctccagggaa

SEQ ID NO: 76318 - DNA, 76 bp, Homo sapiens
  chr14:102094052-102094128
  hypo
agagctagccaggggcgttggccggctgtggatctgtccagacccaggccgccctcctacgcgggcctgctgcaac

SEQ ID NO: 76319 - DNA, 542 bp, Homo sapiens
  chr14:102247672-102248214
  hyper
ccgccctgcgcctcccggtggcacagcgaccttggcggctttggcccctgagccgctaggctgccaaggcgcgctgtgcgcgtggggccaggctcgacctcactcctgttgtcgctgcagacccgcgtgggctcccgccgggccctcctgccgccccccagcctccccgcccctgcccttgccagcctgcgccttcctgggcgcctgacgcacccctctgccccaaccacgttttctcaagagtgttgtctgtcccggccttccaaggagacccttagctcccgccggccgcctccggagcctccggcatgggccccaggccggggtcccgcctttgccccggcctccgctgcctcgccccggagcccggaggaggggagccggccacccggggaagaagcggaggacgccgatctggcctcctgcgttgcgcgctccaaccctctgcttggccgcccgcgaaccgcgctctcccgtttcctttccgtcccgtctcgggggcttcatcctccagccgtggccgtggccgtggccaggtgtac

SEQ ID NO: 76320 - DNA, 30 bp, Homo sapiens; identical to SEQ ID NO: 44120
  chr14:102325042-102325072
  hypo

SEQ ID NO: 76321 - DNA, 51 bp, Homo sapiens; identical to SEQ ID NO: 15865
  chr14:102335848-102335899
  hypo

SEQ ID NO: 76322 - DNA, 30 bp, Homo sapiens
  chr14:102356167-102356197
  hypo
gaaatacagcaaaaacgtaagatggattaa

SEQ ID NO: 76323 - DNA, 78 bp, Homo sapiens
  chr14:102397345-102397423
  hypo
cctgaggcttttgtttttaggtaagtttagattttataaaacgtcagcatttttttaaacaaacgtgctaaatttcag

SEQ ID NO: 76324 - DNA, 54 bp, Homo sapiens
  chr14:102399668-102399722
  hypo
ccccgtggagccctgcggcgcgctggcttctcctggtgacggtgtgcaccagct

SEQ ID NO: 76325 - DNA, 141 bp, Homo sapiens
  chr14:102418526-102418667
  hypo
ggcccaggagttgctcgcatgagccaccacgcccagtgtattcagattttcttcgtgtttcttttctcttccgggatcccatgcaggacaccacgtcgcatttagttgtccaccacggtttttttgtttgtttgttttttt

SEQ ID NO: 76326 - DNA, 46 bp, Homo sapiens
  chr14:102422726-102422772
  hypo
caggctcccattccacgactccgcaattccacggccagcacatccc

SEQ ID NO: 76327 - DNA, 93 bp, Homo sapiens
  chr14:102467269-102467362
  hypo
atcttatgtttctctcgacagcttcgacaaaatttggatgccctcctgaaccagctgaaaagcttccctgcccggttgcgacagtatgcgtcc

SEQ ID NO: 76328 - DNA, 30 bp, Homo sapiens; identical to SEQ ID NO: 44123
  chr14:102474565-102474595
  hypo

SEQ ID NO: 76329 - DNA, 38 bp, Homo sapiens; identical to SEQ ID NO: 44124
  chr14:102493613-102493651
  hypo

SEQ ID NO: 76330 - DNA, 117 bp, Homo sapiens
  chr14:102500433-102500550
  hypo
cgttcattgcctacgcgggttactttgaccagcagatgcgtcagaacttgttcactacctggtcccatcacctacagcaagccaacatccaggtgagaatcacggggagttcaaaaa

SEQ ID NO: 76331 - DNA, 156 bp, Homo sapiens
  chr14:102521602-102521758
  hypo
ctcctcctgcatcagcgccccacccaacagagccgaccaggctgggaacaccgagaccgagagcgcgtggctgtgtctacaaaggcctcctctttgagggagacacgcgaggcacgggtggggcgatgagacaggatcggccggtccttgacagtc

SEQ ID NO: 76332 - DNA, 97 bp, Homo sapiens
  chr14:102529446-102529543
  hypo
aaaataaataaagaaagaaagaaaagaaaatagaatggaaacgttagggagtagcaaagcaactctgaccagccctcggttccgccccttgttagtg

SEQ ID NO: 76333 - DNA, 94 bp, Homo sapiens
  chr14:102529981-102530075
  hypo
ccagccctgtcaccccgcccctgcagccacgcctgggggagcggcggccggtagggccgggcggctgcgaggccagaaacgcctccaagagctc

SEQ ID NO: 76334 - DNA, 81 bp, Homo sapiens
  chr14:102530479-102530560
  hypo
gctccttctccccagcgtggttcctaagagccttagcgtgagctgagactcagaccccttcattcccgggcaatactgaaa

SEQ ID NO: 76335 - DNA, 136 bp, Homo sapiens
  chr14:102564366-102564502
  hypo
caacattatcccttccggatgccttccctccctgccacctccagggagagggagtgttggcttctttattcctccttgactgacctgggggcaagtctcttctctttaagcctcgggtttgtttttctttttcttt

SEQ ID NO: 76336 - DNA, 34 bp, Homo sapiens
  chr14:102593144-102593178
  hypo
gtgagccactgcgcccggccgactagattctttt

SEQ ID NO: 76337 - DNA, 30 bp, Homo sapiens
  chr14:102654008-102654038
  hypo
tggcagagtgtagggcgaattgcatgtgat

SEQ ID NO: 76338 - DNA, 35 bp, Homo sapiens
  chr14:102659542-102659577
  hypo
tctttccctgccatccgagccgctcagaagctgcc

SEQ ID NO: 76339 - DNA, 61 bp, Homo sapiens; identical to SEQ ID NO: 44129
  chr14:102673269-102673330
  hypo

SEQ ID NO: 76340 - DNA, 180 bp, Homo sapiens
  chr14:102682077-102682257
  hypo
tgtagacaccaggcccgtcgtcggtgcagagcgcttcctacacagggcagtgggggacgttccatttgggatgagaagaactcatgatttacattgtcttactatgaaataccatccctcactcttgacagacgacgtagctgatctgagcagcgccctggcacccgcaggcctaccccc

SEQ ID NO: 76341 - DNA, 30 bp, Homo sapiens; identical to SEQ ID NO: 44131
  chr14:102909162-102909192
  hypo

SEQ ID NO: 76342 - DNA, 30 bp, Homo sapiens
  chr14:102948168-102948198
  hypo
agctcttgcatcccccgtcccccattcccc

SEQ ID NO: 76343 - DNA, 30 bp, Homo sapiens
  chr14:102959193-102959223
  hypo
aaggctgttaatgggcggaggctcacatta

SEQ ID NO: 76344 - DNA, 30 bp, Homo sapiens
  chr14:102977854-102977884
  hypo
ggatgcctctgagtacgatggtggggagag

SEQ ID NO: 76345 - DNA, 30 bp, Homo sapiens
  chr14:102983823-102983853
  hyper
gcggcccgcggactgcgggtgacagggtcc

SEQ ID NO: 76346 - DNA, 161 bp, Homo sapiens
  chr14:103007079-103007240
  hypo
gcggacacctgcctccgggatgagcgcattgggcaacactgcatgctttgcattgggaacatgtttgtgtgtgtgcgttgggggtgtgtgtgcggtggggggctatgggctgggatgtcccttgaggtgatcagctctctacgttccgcacacacaaacac

SEQ ID NO: 76347 - DNA, 32 bp, Homo sapiens
  chr14:103018826-103018858
  hypo
tgttttgttttgagacgaagtctcactgtcac

SEQ ID NO: 76348 - DNA, 803 bp, Homo sapiens
  chr14:103021316-103022119
  hyper
gccacttggctggggcgaggccacctcgctttgggtcttgtcgcgcccaggccagcgccagcccaggcttgccatggactggctcctgggcgttagatgaatgaatcgactcaacccgggccgccacgttgtgttcagaacaccgacagtcgctcccaggcaaccagcacctgctgcgccccgtttccagcgacctccccaaccgcgtggactcgcatccacgtgcccggcggggccgcagcagaaaggctcggaccccccaggacgatcggccggtgggggccggtggggccgcagactcggggggcggggggcgccaggcttccgggtcctgcccccgccccgtggggaacagcaggacggcgccgaggccgtttcgctttcctccgcgcccatttgccgggaggggaccccgtgctccgacctgaaggtgacggcagagcctgcgggaggcctaggccggtcccgccctacgggtcccgggggcgaccctcgcgctgacattggcgtccaggccgcggcccctgcctccgcgcccacccacgccgggcctggccctcgctcccccgggaaaagccccgccggcggccgcgagagcgcggaagcgcagccgtagtgaccgcgagacaaagacccggcggcgggggaggcggcggagagaccccgccagcgcggagaccccagggaagcttctctggaagacctggtgctggtccgctctcccgggacctcattttccttatgtggacaacgggggcggggtcacagcagcccctcgggcttatagccgggttgttctttcc

SEQ ID NO: 76349 - DNA, 133 bp, Homo sapiens
  chr14:103216392-103216525
  hypo
ctgcagccgcagtggcgcctgcatggagggggccccctaatcatggtgcctcggctgtggaatgttctgggagctagtcagaacggacatggctgccgcagctgaccctcccgcctggcgaactctttctggc

SEQ ID NO: 76350 - DNA, 30 bp, Homo sapiens
  chr14:103229680-103229710
  hypo
agtggacggagtgaacgaacgaattttttt

SEQ ID NO: 76351 - DNA, 177 bp, Homo sapiens; identical to SEQ ID NO: 44136
  chr14:103277520-103277697
  hypo

SEQ ID NO: 76352 - DNA, 171 bp, Homo sapiens
  chr14:103389118-103389289
  hyper
acccagggccgaggtcgctctaggcctggagggtgaagatcttccgaggagtgggcagggagggctttggagggttgggggcgtgaaactcggccctgcctccctcgtctggcgagtgcgcagcccggaagtgcgcggccagtgcatcgggcggtgcgggagaggagagga

SEQ ID NO: 76353 - DNA, 401 bp, Homo sapiens
  chr14:103389502-103389903
  hyper
cttccctaaacccctcgcggctccctcaggacaaccccacccaccacattcagggccggcctgacctggtcctgccgcccccagccccttcttacttctcataccgggttgcgctctgtcgcagctcttcccggcccaggtaggactcctccgggaagccttcctgattccaaggccgagaagaggtctgtgctgccccatcctcctccatgccccagttgtcactgtccttaacaacgctgtcctctgctccagcgccaggcaaactgggggcagtgccgggaggctatctaggcaggcgtcctgcagggcgcgtttgagcgggctctgcaggtatcagtagaagtccgttggagagcgcccgggcagggcgcccacagtctggccgggagggaccaggg

SEQ ID NO: 76354 - DNA, 85 bp, Homo sapiens
  chr14:103390113-103390198
  hyper
gccagaaccggaccccgtgcgccggcggcgccgttgagttcccggcggacaaggtgcctgggagcgccggcggggtcggtgatgg

SEQ ID NO: 76355 - DNA, 775 bp, Homo sapiens
  chr14:103394683-103395458
  hyper
ccaggggactgggggcggggtgggcgcggagcaggcccggacccccgcgtggcgccgcctcagcccgtgtctcttgcagctcctgccgctggatggggaactcgtcctggcttcaggagccggattcggcgtctcagacgtgggctcgcacctggactgtggcgcgggtgaggcggtcgggcaggggcggggctctggaaaggcatgttcaggggcggggactggagggaaggcgcgtcgaggggggcgaggaccggagggagggcgcctccgggggcgtggtttagggagtggcggaagtgtcccgaagcggggcttgggaggtcgtgctcagacgcgtggcgtggcgtggcgtggcgtggtgtggcgcggcgcttgttccgtggagctcagggatgtgctccggctcaggcgaacctgccgtcttccgcgactctgaccgcttctcctggcatgacccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtccgcagcatctcggctctgggccgggtgagcactgaggggagggaggctcgggtcccctctccccacctcggcccgaccccgcccctcctggtctgcacacgttgggtctgagcactcaggtgaagtctcttcctcgggctggctccggtggggacccggctgcccgcaga

SEQ ID NO: 76356 - DNA, 56 bp, Homo sapiens
  chr14:103406559-103406615
  hypo
ttaccctccgcaggccgatggtctgcacccactccatggtgcgcacatcaaagacg

SEQ ID NO: 76357 - DNA, 30 bp, Homo sapiens
  chr14:103416858-103416888
  hypo
gcctcttggactgctcgggaggtattgggc

SEQ ID NO: 76358 - DNA, 42 bp, Homo sapiens
  chr14:103456666-103456708
  hypo
gagatgggggagaaccgcaaacaaacccggaatgcctgcggg

SEQ ID NO: 76359 - DNA, 216 bp, Homo sapiens
  chr14:103459583-103459799
  hypo
acgttatatatactacgttcacttcccaacagactccaccagtgttgggaagaaaggcaggtatctgcaactctgaaggctgtgtgcacagggcatgccgcaggtgggttctcaatgagccgctccacatgggatgcgaggcttctggccaagagcacgtctattaacagcacttttggggacatctaacagactctcccacgtccaccagttttt

SEQ ID NO: 76360 - DNA, 49 bp, Homo sapiens
  chr14:103477626-103477675
  hypo
ctaggcaaagccaaccggacccagagccacaccgcgtgtgtcaacagca

SEQ ID NO: 76361 - DNA, 22 bp, Homo sapiens
  chr14:103533487-103533509
  hypo
gccaccgcgcccagccaatatt

SEQ ID NO: 76362 - DNA, 212 bp, Homo sapiens
  chr14:103550430-103550642
  hyper
ctggagctgggagggcgcgggcgctgaggaccggcggccagccccgcggtgggcgtgagtgcgagggaggccgggagagcgcgtgtgggcggggagcgcgagaaggagagcgagccgggagagcgcggagccagcggagcgcggaggccccagcgccagcacccgcgcgggcggtgagcgtgagtgtggcgcagggtcgcccctccccagcc

SEQ ID NO: 76363 - DNA, 131 bp, Homo sapiens
  chr14:103584461-103584592
  hyper
ctcccctctcctccccgacttccttctccaaacagccccatgaagcagcactgggcttcccaagagaggtcctgccacgtgactggcctctgtcattggcagaaccctgcataggccgtagctctgcagct

SEQ ID NO: 76364 - DNA, 93 bp, Homo sapiens
  chr14:103589787-103589880
  hyper
gggccaggacagtggcggccaggccgggacacggtaagtgacctccgcttccacacgtccattccccgccgctccgcgcggcttctcgcccgc

SEQ ID NO: 76365 - DNA, 30 bp, Homo sapiens
  chr14:103593974-103594004
  hypo
accaggggctgggcccgggccggcagggag

SEQ ID NO: 76366 - DNA, 328 bp, Homo sapiens; identical to SEQ ID NO: 35556
  chr14:103655240-103655568
  hyper

SEQ ID NO: 76367 - DNA, 96 bp, Homo sapiens
  chr14:103655569-103655665
  hyper
ccgcggggctgcggggtcgaggggaggggactagtgtgcaggggccaccctctccccagccccgccccccgagtccagctccgcccctgatgcgta

SEQ ID NO: 76368 - DNA, 43 bp, Homo sapiens
  chr14:103673852-103673895
  hyper
ggaccacgctggacacgcagttcgcgtgcggccgctccccgag

SEQ ID NO: 76369 - DNA, 65 bp, Homo sapiens
  chr14:103674215-103674280
  hyper
gttcccgggggtcacggccaagatccagcggaggatggaccaggtgttcacgctggcggtgcgcg

SEQ ID NO: 76370 - DNA, 717 bp, Homo sapiens
  chr14:103686706-103687423
  hyper
tccgtcctcttctcccgacctggcgtgcgtctcctgttccccggccccccatcccatgggaccgtccttcctaacggcacttcaccccgcccggcccacgaggtggtcccgggccggtgacaagatctggacgtggcgactccgggaaggggcgaccgggcgcggagagcccctgggacccaggcctcagggacgcatcggggtcggagctgggcccgggggcggggctggggtggggaggctgaggttccttcgccccttccctcccctcgccccccgcagcctcgcggcgcgtttcctgccccgcccgccaggagggagtggcccccgccaagtcccgcgcgtctctgccaagaccccgtgcgggtccgtgccggtcgcgctatccaggcgcccgcccaggcttggggagctctgcgcgcgggagccggcgactcctcggggcaccagggcgtggcgagggcgtcggcctcggcggggaggccttggctgggccgtcggggtggcgccgtgccctggaggtcgtggctggaagcgaggccgcgggggtccaggagcgctcatcggggcgccagatgcagcctgcgggacgtccagtgcccgcgcaggggccgggcgaggccgtggcctccaggcaacgcgcagccgcgttggcgcgagttttaaatcggtgccttcccagctttgcaagttcttatcaatcgttacatgcaagag

SEQ ID NO: 76371 - DNA, 47 bp, Homo sapiens
  chr14:103698810-103698857
  hypo
ctgagtgagtccagccgagagggctgggaggccggagggcagggctg

SEQ ID NO: 76372 - DNA, 71 bp, Homo sapiens
  chr14:103699549-103699620
  hypo
cagccaatgccccagcgcccccagcagcccggcccactctctccagactccctgcccggtagaagagcaca

SEQ ID NO: 76373 - DNA, 519 bp, Homo sapiens
  chr14:103739918-103740437
  hyper
ccagcctgggttgagcggggcggatctgggactccgaggcttcctacgtggggcgggttcccagcggacgcctctgccgcacccctggcggggacccagctgcgccccttcccgcggccctcctagggcctgggtgcttggaggctcgaggccccaagatccatgtcgcccggaatcccggtgcctaggccttgtcgcgggccctgggaccaactcgcgggggtcaggagctgggggttgagagaaagatgatcaggtgggttggagaaaggagacgcttcccgctgggcgagtgagcccaggacgcggcagaagagggcagaccctaggggaccgccgcgtccccaggcgcgcacgcgacccctccccgcgccgaaaatcctctccccgcctcagtctccccgcctccgcctccccacccatagtgtcactccgaccctagccctgggtccaaacgggcaggagaggtcgctggtgcctccgcggtccccgccgcgcgcagaactcggccgagtgcac

SEQ ID NO: 76374 - DNA, 72 bp, Homo sapiens; identical to SEQ ID NO: 35562
  chr14:103740539-103740611
  hyper

SEQ ID NO: 76375 - DNA, 520 bp, Homo sapiens
  chr14:103745299-103745819
  hyper
ccgggccaaggctggcgggggtcgccgcggcgcgaccgcctcctccgccccggctccgtgggatgcgcgtccgccctcccaggccccttcctcccgccctcccccgccccccgttttcctcccctcccctcccgacccgccccaggccagacccccgcgcgggtcctcgccctcccaggacccttcctccctcccctcccctccccgccgcgtcccggaccctgcgggctggtcccgcgccccgccagggctgccggggtgtgctgctggggagcgtggagtgggcaggaccacgctggacacgcagttcgcgtgcggccgctccccgagcagtgcgcggcgtgggcggaggagcggctccgcgaggagatcgaggcgaacgcggcgcccgcgttgctggaggtcgtggacgcggcgggcgccgagcacctggtcacgctccaggacctggacatccgccacggcgacggctccgcggtgctcccgggcgtgtgcagcgaggcctcgttccgggccgtga

SEQ ID NO: 76376 - DNA, 30 bp, Homo sapiens
  chr14:103778195-103778225
  hypo
actttaattaacctacgttcttccctacgc

SEQ ID NO: 76377 - DNA, 30 bp, Homo sapiens
  chr14:103793396-103793426
  hypo
gggggacagagcacacgtacacctggaggg

SEQ ID NO: 76378 - DNA, 30 bp, Homo sapiens
  chr14:103814512-103814542
  hypo
tatcactgaatgcaccgatgaaatactctc

SEQ ID NO: 76379 - DNA, 89 bp, Homo sapiens; identical to SEQ ID NO: 15869
  chr14:103820833-103820922
  hypo

SEQ ID NO: 76380 - DNA, 30 bp, Homo sapiens
  chr14:103977805-103977835
  hypo
ggagttcagctgcttcggctgcttctgctg

SEQ ID NO: 76381 - DNA, 41 bp, Homo sapiens
  chr14:103988695-103988736
  hyper
cttggcgcgcagctccgcgtacagctcgggggtcagcacct

SEQ ID NO: 76382 - DNA, 375 bp, Homo sapiens
  chr14:103989154-103989529
  hyper
gacgcaggcgaacagcggccgctccgcgctcccgcggctcttaaggggcacaacgcgggccgcccattggcggctatttatagcccattcattccattggcccgcgccgcggggtggtgccgccgctttgtccgccgcccgcagcccccaacaccctggccgcccacccgagctgtcccctcgctgggaccccgcgcagcctgcccagtcccccgcccaagacctcgaggccgaaacctcaggtccttggatatctggatcccctcgcacgcccttgcctctgggcgggaaactgaggcggagagcctccgggcactcgaggacgcttgggttcatccgcatcctcgagcctgcccgcctagtccagccagcccc

SEQ ID NO: 76383 - DNA, 60 bp, Homo sapiens
  chr14:103989537-103989597
  hyper
cggcgaggggccgggcgaaagctttcggggcttccgcagcaggtacggcccccgccccac

SEQ ID NO: 76384 - DNA, 80 bp, Homo sapiens
  chr14:103996379-103996459
  hypo
atggtgcaatggtggcggtgcgtgtgcagcgtggggcacagacccagacccggcatggtgtcctgcggcactcagttgac

SEQ ID NO: 76385 - DNA, 17 bp, Homo sapiens
  chr14:104006077-104006094
  hypo
cttttttttggagaccg

SEQ ID NO: 76386 - DNA, 89 bp, Homo sapiens
  chr14:104014163-104014252
  hypo
cgcctcgctgccccacgcctgcaccctgacatccccagcacgttttttaattttttttttccattttttattttttgcgtgtgatagtc

SEQ ID NO: 76387 - DNA, 70 bp, Homo sapiens
  chr14:104048912-104048982
  hypo
ggctcccagttcctccgcagaacctgcaggagtgtgcgtgatgaaacccgtcactcgttgtgtatggtag

SEQ ID NO: 76388 - DNA, 57 bp, Homo sapiens
  chr14:104061854-104061911
  hypo
ctggtggatgtgggccgcacccctccagctggtcccacctgccgaccagctgttctg

SEQ ID NO: 76389 - DNA, 27 bp, Homo sapiens
  chr14:104062202-104062229
  hypo
ttttttttttgagaccgagtctcgctc

SEQ ID NO: 76390 - DNA, 26 bp, Homo sapiens
  chr14:104062469-104062495
  hypo
gcttgagccaccgtgcccagcctatt

SEQ ID NO: 76391 - DNA, 30 bp, Homo sapiens
  chr14:104083385-104083415
  hypo
tctgcaccttgtgggcggggctgtggccga

SEQ ID NO: 76392 - DNA, 30 bp, Homo sapiens; identical to SEQ ID NO: 44144
  chr14:104121128-104121158
  hypo

SEQ ID NO: 76393 - DNA, 120 bp, Homo sapiens
  chr14:104159317-104159437
  hypo
agttttcatccactccgccctttggtgtggctgtcagtgggtggccgggtgcctgtggctgctctagaacctgtttctcaggtgcctggggcccacccggcagctcgagctgttgggact

SEQ ID NO: 76394 - DNA, 37 bp, Homo sapiens
  chr14:104160021-104160058
  hypo
cgccctgcccggaggcgccagccgcactccttggctt

SEQ ID NO: 76395 - DNA, 39 bp, Homo sapiens
  chr14:104194452-104194491
  hypo
tgttggtgctgactccgctgggcacgtccatcaggtggg

SEQ ID NO: 76396 - DNA, 55 bp, Homo sapiens; identical to SEQ ID NO: 44145
  chr14:104194695-104194750
  hypo

SEQ ID NO: 76397 - DNA, 68 bp, Homo sapiens
  chr14:104195247-104195315
  hypo
ccaccttcctcgtcacgtttggaaactcagagaaacctgaaactatgacttgtcgtctttccaataac

SEQ ID NO: 76398 - DNA, 42 bp, Homo sapiens
  chr14:104199986-104200028
  hypo
actattttgaacatacggacaaggcctcgccttcctgtgtcc

SEQ ID NO: 76399 - DNA, 136 bp, Homo sapiens; identical to SEQ ID NO: 44147
  chr14:104202705-104202841
  hypo

SEQ ID NO: 76400 - DNA, 36 bp, Homo sapiens
  chr14:104335400-104335436
  hypo
gcgaagtcggccgggcgcggtggctcacgcctgtaa

SEQ ID NO: 76401 - DNA, 30 bp, Homo sapiens
  chr14:104346851-104346881
  hyper
cctctgtggcaaccccgtgtgtggttttgg

SEQ ID NO: 76402 - DNA, 26 bp, Homo sapiens
  chr14:104355130-104355156
  hypo
gtgtttgatttgacacgccctccccg

SEQ ID NO: 76403 - DNA, 30 bp, Homo sapiens
  chr14:104367439-104367469
  hyper
catctcagcatgttccgacagaaggggcct

SEQ ID NO: 76404 - DNA, 98 bp, Homo sapiens
  chr14:104386144-104386242
  hypo
caatacataataaaacgagggccccccctttttttttttagacagagtttcagttggtcatcaggctggagtgcaatggtgcgatcgcggctcactgc

SEQ ID NO: 76405 - DNA, 38 bp, Homo sapiens
  chr14:104387082-104387120
  hypo
aggcgtgaaccaccgcgcccggccggcccctttcttga

SEQ ID NO: 76406 - DNA, 30 bp, Homo sapiens
  chr14:104486789-104486819
  hypo
gggaggatgcagcttcgaggagaagacgct

SEQ ID NO: 76407 - DNA, 30 bp, Homo sapiens
  chr14:104503586-104503616
  hypo
acagctcctgcgagccgctgccccgccatg

SEQ ID NO: 76408 - DNA, 30 bp, Homo sapiens
  chr14:104547888-104547918
  hypo
ctggagcggaggccacgctctgagcaccct

SEQ ID NO: 76409 - DNA, 36 bp, Homo sapiens
  chr14:104560644-104560680
  hypo
tcactgccctctgtccgtccccgcccagttggagtc

SEQ ID NO: 76410 - DNA, 30 bp, Homo sapiens
  chr14:104561546-104561576
  hypo
gctgccatggagaggcgctctcccgccctt

SEQ ID NO: 76411 - DNA, 34 bp, Homo sapiens
  chr14:104567474-104567508
  hypo
cctgagtgtttcccacgtgcgtgtgggtgtggga

SEQ ID NO: 76412 - DNA, 44 bp, Homo sapiens
  chr14:104568268-104568312
  hypo
gctcctctctgcccccgggtgtggggtcacgattcccctggcct

SEQ ID NO: 76413 - DNA, 131 bp, Homo sapiens
  chr14:104571985-104572116
  hypo
gcaggaagggccaggcggtgggcacacagcagggaggccttctgactggcggcgctgccttagtgcggggctgcctcgggagctgcctgtccagaagaagggcgggtgagtgggggcggtgcttgctctgg

SEQ ID NO: 76414 - DNA, 33 bp, Homo sapiens
  chr14:104572793-104572826
  hypo
gtgaccattccgtcccgacggcggtgggagcag

SEQ ID NO: 76415 - DNA, 161 bp, Homo sapiens
  chr14:104573825-104573986
  hypo
ggcccagtaagaccccggcccagagttcctagaaaacaaaaatgttgtggacaaagctgggaggacacggtgcatctctgtgcacctgtgggtatggggggctggggtggaggtggggcagaaggtcctggcccagcagccagacgcggtcaataaaaagc

SEQ ID NO: 76416 - DNA, 30 bp, Homo sapiens
  chr14:104576414-104576444
  hypo
ccagcctgggctgcccgaggccaggacgac

SEQ ID NO: 76417 - DNA, 4 bp, Homo sapiens
  chr14:104583032-104583036
  hyper
ccac

SEQ ID NO: 76418 - DNA, 30 bp, Homo sapiens; identical to SEQ ID NO: 44151
  chr14:104600477-104600507
  hypo

SEQ ID NO: 76419 - DNA, 136 bp, Homo sapiens; identical to SEQ ID NO: 35566
  chr14:104601737-104601873
  hyper

SEQ ID NO: 76420 - DNA, 1412 bp, Homo sapiens
  chr14:104601963-104603375
  hyper
cgaggctggggcagcccacaggaggagcgcgggacccgggcttgagtttgcacccaggcagagcgcccacccccgcccctagcttcggaccctgaaagtaaagtcgtcgtgcccggcagccagcccgaatcttccagccctcagggagtcggggtcggggcagggaaggccacgggtggcggcacaatcgggatcctggagtggaggcgcagactgcgggtcccgctgcgcacgctccgtggtccggttggggtgggccttggaggtccataggccaaggttgaacgggggctctggagcgtgggcggggtggagtgcacaggtcactgggctctgagcgtttccatgggccaggaccccaacgcgccgtgtcctcaggacagattggagggggaaggggctgcgattatgccccagtcggaagggttttacagcagccgcgctgccctctccctgccggatacccggcagtagacaccgacgtctgggggctagcgaggcaggtgggcgcggaccgcgacccgattctggcttccaacctccgcccagtggcgcgcggggccgtcgccccacacctccagtccgcgtggctggtgtctggctcgccgccggggcggaaggggcgctgtcggcgcaggcgggcggggccggagcgcgggggcgcgcggcgcggagcgagcgcagggctcgggggcgcggggcgcggaggaccgggggcttgacgggcggccctgcgcggtgcggggcgcggcggcggcgggcgcgcggccagtgaacgcgcgggcggggcggcggtggcgggaggcactaggggccgctccccgcgcttccctcttccatggcgctgccccagccgcccgagccgccccgcggcgcgccccgcaaggctcccagcctgctggagatgggggcgctctgcctggactcggagatcatcctgggcttcaccagccacctcctgcggcgacgaggcaaggtgagggctgtcgggaggggggcgggcggcgtaggcgccgtcccgttactttgccgcgcggctcgcgcggccgggggtgctgcgccgggaaggagacggcaggtccggagccgcgtcccgcagcccgggctgggactcgctgccgcactttcccccattagcgttgtccaagtctccctctgccttcaaggctgtgtcccaaccggacccacccggaggctgtggctagggcggagagcgcagcgcagggattctcgggctcaccttgcgccttgctaggatgggcgaagtagggggtcggggcccctgactgatcgtgagcccccgaggtgactccagccttgtgcaccccgtgttctgcggatatgggatgtgagcttgtgcttcccgaagcgccgcggcggtagaagcgctgaagttgcgggtgtggctggcc

SEQ ID NO: 76421 - DNA, 38 bp, Homo sapiens
  chr14:104603715-104603753
  hyper
aggtcatcaacgacccggaaagccgggaggggatcacc

SEQ ID NO: 76422 - DNA, 1513 bp, Homo sapiens
  chr14:104604105-104605618
  hyper
gcgacatttggggcccggctaggcacagagcaactggtcgccagggaagggcgggggggcggcctcccagccggagacaaacaagcaattaattccggagctgagttcccatctgccaggcctgctgacaacaggtccggcgcacgcccgcaggacctcccgcttcccgggcggcacggcgcgcacacccacttgcgggcacacgcgcggctgtaaagacacgtgccgttcgcagacgcgccgaggcacagatacgccggcgcggtcgctgcccggctcgaggcgcacaccgcggcgacactaacccacgcgcgacagttagacctaaagtggcccgcgacacgcagagtacgctgggcttgctggaaaggcgcctgggagtctcggggccggggtcccgccccttcctcggcccacctcgccgtgggccttgggcaagagcgtcccctccgcagcctcagttttcccgcctgtagagggaggggcgtcggcgcctcctgggagacgcgcagccctggtgtcccgggagaggggcgggaggcgcatgcgcgcgcgcaactagatcctcgccgccgcccccagcgcccctccccggggcagggactcacctaacaggttggggtccttggagtgcgcggggccgcgtggggaagcggggaccctaccccccccacgcgccgcccagcactgggcaagggcggggcactctctgggctcccgcccctcgccgcccgccccgggagcccgagccccgcccttccccggccccgccctcgcctcccgagcgcgcccaccggagccaccgcgctcctcgcgacactcgcaggctctgcgaacttccgagcggctgggccgggccatgggggcgcctcggggccggatcacgtagccgcggcgcccccggagagccagcgtggccgggagcgcctgccgggctcttcccgcgccccggccatggtcggccgcggcgtccctctgtgcgctgcgcagcccgcggtacgcgcggcccggcctggagagggaggcgggcggcgggggcccgggacggcgaagatactcgcggtgtgcgctggatccctgggggccgggcctcctgctgagggtagcggacccgcaggcgggacctccggggatggagggagtgggtgagcgccagggtcgtgcccagggctcctaactttggcaagagcgtcacgctggggcagggcgcgcaggggtctggatccgacggacgtcccaggctcactgtccgcttccgcccccacaccctgcaggtggccgagggcggcccggcccgcgagccgccgccgctgctggaggtgtccccccgaaagaggctacccgccgggcccgaccaggacccatgcggcagccgccctgctcccgaaggcgccggggccggcccagagcagggccactcggccggcggaggcggctggtgccgccactgccacacgaagctggtggagctcaagcgacaggcgtggaagctggtcagcgggcccgggaccac

SEQ ID NO: 76423 - DNA, 30 bp, Homo sapiens
  chr14:104608088-104608118
  hypo
ctctttagcaacacccgatgcctgcatggt

SEQ ID NO: 76424 - DNA, 30 bp, Homo sapiens; identical to SEQ ID NO: 44152
  chr14:104609469-104609499
  hypo

SEQ ID NO: 76425 - DNA, 858 bp, Homo sapiens
  chr14:104617582-104618440
  hypo
gctcttgtttttagccgtttctagaacccagtctcagggttctagagaaacctgtgtgtccccccagttcagggaagggggcagtcaccaaacagggtgcatcccagcgtacagctcagacctgggtgggggagctggtggagtgtgcggcggggggtggggccctgggctgtacccgatcctgcggctcttgcgccccttcggtgagctcatgtgccctctaggagcgtctccgagggaggccttcgcttctgttgacacctttacagcagcactgatttgattttccacctgccccaccggggctggagacctgaagaggaagggagagggtctcctgcccctggctctgccttgagtgagtgtgggtgagggaggccctcgtggctctgaagagacgttgcttttaaggggccctgcttcttgccagtctcctgcgtgtccccggccaggcggccttagctgacagtggtccggttgtccgggagccgcaaacctgccttgttagccgcaggccggggcgcttaatgacggctggggaaggtggacagttaacaaggacattgtgagcctcacgatgaagcccgatcattattttcctgctgggcttgtgtgggtgaaagtgtttgggcttattaatctgttacggatggtgcggtggccaggcgggagctcgcagcgtcatggacggtgagagtgctggtgggctctgggtgccggccctccctccccaggcactgaccctgcctttgtcccttgctgtcctcaggatccttgcctctctgccctgcttctcgacaagctaccagcacctggggccctgccagcctgtcgcccagaggccgagcgccgctgtga

SEQ ID NO: 76426 - DNA, 154 bp, Homo sapiens
  chr14:104618676-104618830
  hypo
tgtctgtagcacctgcgggtcttggaggggcgctgagcacggtcaccatccaggcccagcagtgcctggagggcatgtggagtgtctcgcgggtcaacagcttcctcccgccggcgtgcctggtgagtgtcttgctcagcggatgggagctgct

SEQ ID NO: 76427 - DNA, 295 bp, Homo sapiens
  chr14:104619085-104619380
  hypo
cagcacagggcttggcgatgcacagggcaccgtgtgtagatcggggctcacgaggcagatggagtaggagggcccttgtggcagagcgagggcctgtgtggaggcctgggggtgtgaggcgtccatggacgtcgggcgggggaccggcagttgcaattgctggagatgcgttgcctgcccctgtggcaccctgggggcagagggacatgtgggtggctgtgaagagccgtgtttctgcctggtacactgtctagtcaccacacagcgaccagcacaagctcgcccttctcccttg

SEQ ID NO: 76428 - DNA, 193 bp, Homo sapiens; identical to SEQ ID NO: 44156
  chr14:104620411-104620604
  hypo

SEQ ID NO: 76429 - DNA, 847 bp, Homo sapiens
  chr14:104622914-104623761
  hypo
cctggaagctggtaccggccatgggttgggcagggtgagccggccatgggttgggcagggtgagccctccatggtggtgaggagggatactgtctgggatggcagggcctctgtctggagtgtccctcctgggtcccggggcggcttgttctgctgacgtgccgtgcctggcctctggcctgtgccacttgggacaccctgaggacgctgggccttccagaccagcccacgtcccctcagcacggggaccccagtcctctgctagcctgggtacaaaggacgcctcgggcagtggttatcgactggacacttggggccgaatgacgcttggcacctgggtgaccgtgacctgaccaggccacggtgcccaagggggtccttggagagcttggggcactgggcccttggggaaggggccggggcgaggggtggccaggctgaagcaggctgccttccctgccttgcctggggttgcatccccccacgccgcccaggaccaggtttggcctgagggttcggggtcccacgtgtctgggaatggaacgtgcggaggtggagctcacgtttgctgggctgtcccgggcgtttaattacgtttgtgcttcattatgaggaggcctccctttctgggatttatttgagctaatgagttggaaatgccagggtagtatttcagatgagggagcgccacacatcaccgtacgtggggcaattagtgttcctgccaaatagttatcgtggtttcttctctaattacgccgctgggtgctcccaggaggctcaggggtgagagggtggggggtctgtgtccatcggtcttgaccagtgtggtcgctgcgattctgga

SEQ ID NO: 76430 - DNA, 291 bp, Homo sapiens
  chr14:104626758-104627049
  hypo
gatcccatgggtgcccgggtacccgagtttcgttaatgctaacaggggcatagatagagcaggggctgagccccatgccctcaccccctgggtggggcctggggaagctgcagggattgaggcagcgcagctgtgacagagcttggcatgctggcccagcaagtgttcgggagggtggggcgcgtgggccgggtggccccggggttaggagttctccgaaggctctggtgacccccagggttaggagttccctgaaggttctggcaactctgatgacgctgtctgaggccc

SEQ ID NO: 76431 - DNA, 184 bp, Homo sapiens
  chr14:104627651-104627835
  hypo
gggagggtggggctccgtccaccagcctcgcacggcccagtgtggaagctctgggttggccataagtgattcctgcacgcgacagaacaggctcgtgtgtctccttggggtaattaagggcctcaccatcaaggccaactgcctgtgaaattaccctcttgtttggaagcggtgatttttctct

SEQ ID NO: 76432 - DNA, 159 bp, Homo sapiens
  chr14:104628609-104628768
  hypo
ggtggagatgtggggcgaacaaccttccagacttccagggctgatggaaccacagaggacgcccggtcccagcctctgtctaggcggcctgggccctgggtgtgcccgctgtggcccaggcatacctgagatctgtgctgcggacgctgctcctgggag

SEQ ID NO: 76433 - DNA, 150 bp, Homo sapiens
  chr14:104630025-104630175
  hypo
aaccccgagcatgcgcggcacggggcggccatgggccccgacccctgctctgactcacacctgcatcctggggcccaggcccgtgtgcctgagacccctggacctcacccggcatcgccagcatttacccaataccgtgccagctgtggg

SEQ ID NO: 76434 - DNA, 64 bp, Homo sapiens
  chr14:104630660-104630724
  hypo
caccacacccttcgccgggtggcatcctggcctctggcccgcgtgggagcgcctcctgttggga

SEQ ID NO: 76435 - DNA, 45 bp, Homo sapiens; identical to SEQ ID NO: 44163
  chr14:104630962-104631007
  hypo

SEQ ID NO: 76436 - DNA, 282 bp, Homo sapiens
  chr14:104636842-104637124
  hypo
acttacaattaaatccgtgaaaaatattggctctgaaatgagtctcgggtaatttgatttacgctgtagtggagaaatcagagatttcagcgcagagtggactgtggtgtcctccagcaggaaatggggcctgtctctggctctgcgttggagccctggttcagggtggccctcgtgtgcgcagcctctgccgggtcagagccgccgcctcctggcatcgacgcaccagacccacctgtgtggggtgtccctgctgtggatgggtttcggagtgtttgcagt

SEQ ID NO: 76437 - DNA, 33 bp, Homo sapiens; identical to SEQ ID NO: 44165
  chr14:104638185-104638218
  hypo

SEQ ID NO: 76438 - DNA, 837 bp, Homo sapiens
  chr14:104639050-104639887
  hypo
ctcccatcctcatcacggtggttgctggcagcttctgatgggaaaggaggctggtcctacacatgggccgtggtgggcatatggggtgaggggcttgtggagaggaagctgaacccctgccgaactgaaaggcagagggcttaggatggatccaaagaggcccctgagatctcggtgcccctggttggcccccggggacgccagtagccataaaggctccttgcgtggtgtgtggtggggcctgacgcctgcgtggcccccaggcaagtcgtacaccatgatcgggaaggacagctcaccccagagcctgggcatcgtgccctgcgccatctcctggctcttcaggctcatcgaggagcgcagggagaggacgggcacccgcttctccgtccgggtctcagccgtggaggtgtgcgggcgcgaccagagcctgcgggacctgctggccgaggtggcccctggcagcctccaggacacccagtctccgggagtgtacctgcgggaggaccccgtgtgtggggcgcaggtgcgcctgcctactgtcccaccttgggggaggggggctgcacttggccctgagccactgaagacgccgctgcctctgcctttcctgcagctccagaaccaaagcgagctgcgggcacccacggccgagaaggcggctttctacctggatgcggccctggcggcccgcagcaccagccgagcgggctgtggcgaggacgcccgacgcagctcccacatgttgttcacgctgcacgtctaccagtaccgcatggagaagtgcggccggggaggaagtaggtgccacacccgcactcccgggcccctgtggga

SEQ ID NO: 76439 - DNA, 399 bp, Homo sapiens
  chr14:104640183-104640582
  hypo
gagccaagcatgtgccgtatcggtgagtgtagggcctgggcaggtgccgaccagggtggccccttggtgacctggtaaatccgtgtctggtgtgcccggtgctgctgtggcccccagctcctcagggctttgctcctccaccacctgacaggcctcgctgcccgtgggctgcctggggccccacgctgggctggtgccggagctgggtgggaaccagactgatcccagggctgcccttggccagcctgtccccgaagctcccttcccaaggccttggcatctgaaccgcctcgacccgcagggaccacaggctcaccatgctgctgcgtgaatccctggccaccgctggctgccgcaccaccatgatcgcccacgtgtcggatgcgccagcccagcacg

SEQ ID NO: 76440 - DNA, 532 bp, Homo sapiens
  chr14:104641305-104641837
  hypo
tttcttcccccagtacgcctccagctcctctggcggggagagctcctgtgaggaaggccgggcccgtcggcccccgcacctgcggcccttccacccacgcactgtggccctggaccccgaccgcacgcctccctgcctgcccggtgaccccgattactcctccagcagcgagcagtcctgtgacacggtcatctacgtggggcccggtggggcggcgctgtcagaccgggagctcaccgacaacgaaggtccgcctgacttcgtgcccatcatccctgccctgagccgccaccggccctccaagggtccccgagacgcagaccacttccgctgcagcaccttcgcggagctgcaggagcggctggaatgcatggacggcaacgagggtccctcaggaggtccaggtggcaccgacggagctcaggccagccccgcccgagggggccggaagccctcgccaccagaggctgcatcccccaggaaggccgtgggcaccccgatggctgccagcacccctcgaggcagttctggt

SEQ ID NO: 76441 - DNA, 202 bp, Homo sapiens
  chr14:104642041-104642243
  hypo
actgatggagtggcacggacccctcccgtgggcatgagtgggcaggtggctgggtccccgatgcttcctggggccacctgcccccgcctggctgctggcagtcgctgtccggagcggggcctgctcaccaccacagtgaccctgcagcggccagtggagctcaacggcgaggacgagctggtgttcacggtggtggaggagc

SEQ ID NO: 76442 - DNA, 288 bp, Homo sapiens
  chr14:104642454-104642742
  hypo
cagctcctggctcagcgaggtcagcgtctgcactgccgacagccgtgaccccacgccgcagccccgcttcagccccgactcgctggcagggcttgaccctgggggcccccctgccctggatggttccctgggggatggaagctctgggttcctggggccagacagacctgacagtcctgggccaacctggggtccgtgccctggggaagtggctgcagtggccccatcccgacccggcagggagccccaggccgggccctcgcggtgggcatccgcagcccagaccat

SEQ ID NO: 76443 - DNA, 1271 bp, Homo sapiens
  chr14:104643013-104644284
  hypo
ccagaggctgtggctcggatcccaccgctgcggaggggtgccaccacgctgggtgtgacaacgccagctgtgtcctggggagatgctcccacggaggtggtggcctgctcggggagcctgaaggcctcccccaccagcaagaagggtctggctcccaaggcgggcttcctcccgaggcccagtggggcggcccccccggccccacccacgcggaagtccagcctggagcagaggagcagcccggcctcggcccctccgcatgctgtgaacccggcgcgggtcggggctgctgctgtccttcgaggggaggaggagcccagacccagcagccgggctgaccactctgtccccagggccacgtccagcctgaaggcccgggccagcaaggtagaagcagcacaccgtcttgccggacacgcgtctctggagcggtacgaaggcctggcgcacagcagcagcaagggccgggaagcccctgggcggcctccccgggctgtacccaagctgggtgtgccaccctccagccccacacacggtccagctcccgcctgtaggagcggcgcagccaaggctgtgggggcccccaagccccctgttggtggaggcaagggccgtggcctagtggctggtgggtcgcgggctctggggccttcggtgaagctgtctacggcctctgtgacgggcaggagccctggcggccctgtggccggtcccagagcagccccacgggccgggcccagtgtcggggcgaaggctggccggggtaccgtcatgggcacaaagcaggcgctccgggctgctcacagccgcgtccatgagctgtcagccagtggagccccgggccgaggtggctcctcgtggggctcggcggactcagacagcggccatgacagcggcgtgaacgtgggggaggagcggccacccacgggcccggccctgccctccccctacagcaaggtgaccgccccacggcggccccagcgctacagcagcggccatggcagcgacaacagcagcgtgctgagtggagagctgccgcccgccatgggccgcaccgcccttttccaccacagcggtggcagcagtggctatgagagcctgcggcgcgacagcgaggccaccggcagcgcctcctccgcccctgactccatgagcgagagtggggctgcctccccaggcgcccgcacccgcagcctcaagtcccccaagaagagggccacaggtgggtgcagaggtgcacagccctctacagtttacgggctttctgtgtg

SEQ ID NO: 76444 - DNA, 382 bp, Homo sapiens; identical to SEQ ID NO: 44172
  chr14:104645126-104645508
  hypo

SEQ ID NO: 76445 - DNA, 990 bp, Homo sapiens
  chr14:104645716-104646706
  hypo
gagcagtgtgagtcccgcccgcccacggacccagcccggcccaccgtgtgccctgacagctgccctcccctcccagagccctgttgctctcctgtacctcgtggtgggaaggctggaaggcagggtcggccgggccaagatgcctttcctggggcctctggggggccaggtggctgcccccagcctcgggcctgacgcaggtgcccctcccctctcctcccctccccagttgaggtggacccggagctggagcccgagtcggccgagtacctggcggccctggagcgagccacggcggccctggagcagtgcgtgaacctgtgcaaggcgcacgtcatgatggtcacctgcttcgacatcagcgttgcagccagtgctgccatcccggggccgcaggaggtggacgtctgaggctgggcgccggacaagaggagggggcgtgcagcgggctggaggacgggacgtgggacggagcgaggatgtggtgggggctgcggggggaggatgcggaggggtttctgtgcaggacgggagtctcagagaggagacggagtgtgggggagggagggccggccacgcggtggacagagcgagggtgccagggtgaccagaagaccgtcaccacccgacagcaacgcaagtgcctttgaccttgatttggacttttctcccttttgcatttggtgctacagacttgagacaccagcagaagttgtgttcagcccggccccgctgcgcctgtccgggccggggctggcgccggttgtgtttgtgtccaccttgccttctttgcagccaagcagtttttgtggagtggagtgggacttacctgcacgccccaggggtctttcaggattcaggatgacttttcttttacaatggtttcctctcggcagagcccgggttgtgggggatctgtgtggggttctcaacgcagatccatcctggggtctcccgggcagggatggctgacctcgagtcccctccctt

SEQ ID NO: 76446 - DNA, 207 bp, Homo sapiens; identical to SEQ ID NO: 44175
  chr14:104647208-104647415
  hypo

SEQ ID NO: 76447 - DNA, 30 bp, Homo sapiens; identical to SEQ ID NO: 44176
  chr14:104647924-104647954
  hypo

SEQ ID NO: 76448 - DNA, 283 bp, Homo sapiens
  chr14:104648592-104648875
  hypo
ggccacagggtcacccgcacccaggcccctagtgtccatcgcaggtggcccttgggactccagcctctgggattggggttgcaggccagcctgggaggctgctggggcccctgatcctccagccccagccctgcttttgttggaggccagcgctgcgtcccagcagaaactcagactaatgtggagggcagggttgttcccgagaagccgagggccacgcatgccggctctgtgctgggtttggagaacttggcgagggggtcgggtccgggtggggtgtgat

SEQ ID NO: 76449 - DNA, 30 bp, Homo sapiens
  chr14:104674208-104674238
  hypo
ccctttccgtggcaacgacccaatgactat

SEQ ID NO: 76450 - DNA, 172 bp, Homo sapiens
  chr14:104676826-104676998
  hypo
aggtttcagttgctgcgtgtgtgaaccgaattggcgccttctccttttccagccatcagtatgccttttgtgcgattttgtgttagcacccagcaggatggggtgtcagagcctcagagtccccagggagtgtccccgtcccagcccagaggggaagcggcactggggccca

SEQ ID NO: 76451 - DNA, 30 bp, Homo sapiens
  chr14:104679828-104679858
  hypo
ccggtgagaactcaccgcagctgacacccg

SEQ ID NO: 76452 - DNA, 189 bp, Homo sapiens
  chr14:104682484-104682673
  hypo
actggagcctcaggtcggggtggacacgaagggcttccgtggactcaagtcgctgccccttggggtgcctggggctcggagccctgccgtgagcacgcacactatgccccagtgaatttctgattgcaaaagacatcgggcatcgggcgggggcactcggctcccatctgcagccgccccttttgtcag

SEQ ID NO: 76453 - DNA, 30 bp, Homo sapiens
  chr14:104682881-104682911
  hypo
ctttagagcctccctcgtgtggggcagtcg

SEQ ID NO: 76454 - DNA, 87 bp, Homo sapiens
  chr14:104696332-104696419
  hypo
agtgatggctgaggacgaacaagggtgcgaactgtcactgacatttccgtggggcgtggacgtgacacatcccgaatgccatacctg

SEQ ID NO: 76455 - DNA, 186 bp, Homo sapiens
  chr14:104705204-104705390
  hypo
agaaagactgccagacgtgcggctgaggaggagccaggctacgcctgccctcaggcccccgagagtgtggaggcccctggccatgcaccggaggagcctctgatggatgcttcataagagtggtgcccacactgcagccacctccgctgccagggacccctccggtgaacacgttggctcctcctc

SEQ ID NO: 76456 - DNA, 58 bp, Homo sapiens
  chr14:104719866-104719924
  hypo
cgcgttctccagcaccggtggagagaaagccccgctgtccagccgagttctgatggag

SEQ ID NO: 76457 - DNA, 32 bp, Homo sapiens
  chr14:104735865-104735897
  hypo
tccctttggttttaacgcgtccttattttctg

SEQ ID NO: 76458 - DNA, 32 bp, Homo sapiens
  chr14:104759084-104759116
  hypo
cagcgttttggctcccgcgtgttggggcgggg

SEQ ID NO: 76459 - DNA, 30 bp, Homo sapiens
  chr14:104760897-104760927
  hypo
acatttggtggactccgatttggggtgtgt

SEQ ID NO: 76460 - DNA, 310 bp, Homo sapiens
  chr14:104768148-104768458
  hypo
ggatccgccccaggccgcatgggcggggaaggggagctgagccggagccactccacctggtgccgggcctgtgccctttccagggcaaccgatgtctcagagtcctggccccagagcagagagcctctgcaccctggaaggtcctgcttgctggagtgaggggcctgcgaggaccggccctgttctcaagcccagccgtggacctgcgtgggctgcctggcgggcctcattctctctgcagtgggagaaatgtgcagtcaaccctgagcgaacgtctaaacctccaaacacaccacgactttcaaagcct

SEQ ID NO: 76461 - DNA, 103 bp, Homo sapiens
  chr14:104770277-104770380
  hypo
cccgggtctggccagcgggcactagtgtgggagttcagctggcaacccccgacagccttctgagcacggcccccttaccaggtgccgccgcttcccagcctcc

SEQ ID NO: 76462 - DNA, 30 bp, Homo sapiens
  chr14:104773160-104773190
  hypo
gcttcacctgggagccggctggtcagaggt

SEQ ID NO: 76463 - DNA, 30 bp, Homo sapiens; identical to SEQ ID NO: 44181
  chr14:104798505-104798535
  hypo

SEQ ID NO: 76464 - DNA, 38 bp, Homo sapiens; identical to SEQ ID NO: 44182
  chr14:104800605-104800643
  hypo

SEQ ID NO: 76465 - DNA, 37 bp, Homo sapiens; identical to SEQ ID NO: 44183
  chr14:104801369-104801406
  hypo

SEQ ID NO: 76466 - DNA, 30 bp, Homo sapiens
  chr14:104812509-104812539
  hypo
gggggcacccggcaccgtgggaggcgtgca

SEQ ID NO: 76467 - DNA, 62 bp, Homo sapiens
  chr14:104820337-104820399
  hypo
ggaagcgtgcagaggcgcagcagagcctggtgtgctggaggaacagacgtgtggtcgggggg

SEQ ID NO: 76468 - DNA, 121 bp, Homo sapiens
  chr14:104821569-104821690
  hypo
gaccagtgcagcacccgcaagctgcactccagcttggggctcccttccctgtcctcccgtccactgtcaccttgcacagccttcgactcgctctcctgactgggaccggcctctcccagcc

SEQ ID NO: 76469 - DNA, 30 bp, Homo sapiens
  chr14:104841778-104841808
  hypo
cggggagacagggtgcgggaggagcccctt

SEQ ID NO: 76470 - DNA, 201 bp, Homo sapiens
  chr14:104842214-104842415
  hypo
agcagatgcacagcccgtatagatgcccaggacttgcttcatttgtgttaattaccttcttttgattttcctgatcaataaattatcccgacgtaattggattatttgcatggctggcaagaggtcgctgtgatttagcgcctggcatcctggcagctgcgtggggtcccattctctctgagctgtcggcctggtcctgtc

SEQ ID NO: 76471 - DNA, 36 bp, Homo sapiens
  chr14:104854637-104854673
  hypo
agatggatgaaaaatcgctggcgaaggtcactacag

SEQ ID NO: 76472 - DNA, 30 bp, Homo sapiens
  chr14:104858976-104859006
  hypo
gagctggtccttccacgtggaacaccctgg

SEQ ID NO: 76473 - DNA, 166 bp, Homo sapiens
  chr14:104862860-104863026
  hypo
attccccagtgagcacggagcagcagcccgcccggctcagcagtgccttgccctggccctttctctcctcgctggttcatctgcattaaagaaacagaaagcttccttcgctggcccgctcattgcctgtcttctctccctgcctcagctgcggtcaggctccagg

SEQ ID NO: 76474 - DNA, 30 bp, Homo sapiens
  chr14:104889841-104889871
  hypo
ggtggggcctgagcacgggctggtgtgggg

SEQ ID NO: 76475 - DNA, 263 bp, Homo sapiens
  chr14:104897587-104897850
  hypo
ttcatccgtcccactgcgggcgcagcaccatatctgttcattcatctcactgcggaggcagcaccatatccattcactaattccactgcggtggcagcaccctatccattcatcgtcccactgcgggctcatctgggtcttcgtggagccacggtcctgcttcagtagatccaattttccaaagctgctctgtggattttcagcccctcccaccgtgtgtgggggccactgccttctctgtcctaaagcggccctgccatcgc

SEQ ID NO: 76476 - DNA, 257 bp, Homo sapiens
  chr14:104899274-104899531
  hypo
ctaatctgcaagctgcggcccgaggcgcacctggctgtcccagccctcccagcagcacctggcggctccctgagcttgtccacagcagcagtcgtcttcagggtggctctgcactggcaggccccgggtgcccttcccacgggggtggcagggagccggctactccagacgggccccgcactgtggacaggcgctgatgcttcggtttccgtggttgccccggccccgttgtttgagggccccgagcctggcccacc

SEQ ID NO: 76477 - DNA, 37 bp, Homo sapiens
  chr14:104917379-104917416
  hypo
aggccaaggtacccccggcagccgatgggaaatcccc

SEQ ID NO: 76478 - DNA, 30 bp, Homo sapiens
  chr14:104937788-104937818
  hypo
gggggtactcagtggcgaagggagagacaa

SEQ ID NO: 76479 - DNA, 38 bp, Homo sapiens; identical to SEQ ID NO: 44188
  chr14:105026775-105026813
  hypo

SEQ ID NO: 76480 - DNA, 30 bp, Homo sapiens
  chr14:105052447-105052477
  hypo
ggtgactttcagtgacgggacctcggccca

SEQ ID NO: 76481 - DNA, 68 bp, Homo sapiens
  chr14:105055027-105055095
  hypo
gcactggaggacctgcgggcccggctcctcggccttgtcctgcacctgcggcacgtggccctcacctg

SEQ ID NO: 76482 - DNA, 30 bp, Homo sapiens
  chr14:105059531-105059561
  hypo
ccaaggggccctgtgcgaggcctggaggtg

SEQ ID NO: 76483 - DNA, 114 bp, Homo sapiens
  chr14:105063222-105063336
  hypo
actcaggatgggcttcgtgagggaagatcacccacagcagggcagggtgtcaagggatcttccggggaggtgggcggaggccgaggcgggtggggcgggcgcacctgtggggta

SEQ ID NO: 76484 - DNA, 332 bp, Homo sapiens
  chr14:105070904-105071236
  hyper
ctcgcgctcctgcaccgtgaggttggcgctcagccacatgccctcggtgaagagcaggcagcggccgcggaagtcgtggccgttctcggacagcgggaccaccaccacgaagctgaacaggaaggccaagaagtagcaggcgcactgagcgaaaaggaaattgttgagcgccatggccggcccgggcgagagcggcggcgggaaggccgcgggaggctgcgccgggcggggaggccgcgggaggctgcgcagtggcggcgccggcaggtcccgcgcgcccctcccgggacgcgtgcgcatcggccgagcgcgggaagcgcctgcggtcagca

SEQ ID NO: 76485 - DNA, 30 bp, Homo sapiens
  chr14:105084500-105084530
  hypo
ggtatgggctttcctcggaagttgagcaag

SEQ ID NO: 76486 - DNA, 48 bp, Homo sapiens
  chr14:105101539-105101587
  hypo
ccaagctgcctgaatcggggaggggctgggggtcggcacacacaggag

SEQ ID NO: 76487 - DNA, 30 bp, Homo sapiens
  chr14:105103478-105103508
  hypo
tcacccactgaggaacgggcaccacccgtc

SEQ ID NO: 76488 - DNA, 33 bp, Homo sapiens
  chr14:105103792-105103825
  hypo
acagagaaacaagggcgtcggggatgctaagtc

SEQ ID NO: 76489 - DNA, 159 bp, Homo sapiens
  chr14:105132631-105132790
  hypo
caaccagcccccacccgccgaggtgacactggagctgggagagtggcagcctccatggcggccacagtggctcccagctcccctgcagcagggcctccctcctcccccagggccgggcagagggcacctgcagggcatcttccccggcaccccctggct

SEQ ID NO: 76490 - DNA, 99 bp, Homo sapiens
  chr14:105157485-105157584
  hypo
ttgtggaggagctgacggctgtcaagcgaatgacacacaccgcacatgtggggacgtggaagctcctacctgaaatagactctgcgccttccatcaaag

SEQ ID NO: 76491 - DNA, 30 bp, Homo sapiens
  chr14:105173303-105173333
  hypo
ctggagcccaccctccgctccagccagctg

SEQ ID NO: 76492 - DNA, 143 bp, Homo sapiens
  chr14:105174251-105174394
  hypo
tgggtccccagccatcggcgggtgaacccacccacactgcgcatgaagaagctgaactggcagaagctgccatccaacgtggcacgtggtgagggtccccagacccccaagggaagcttcccctaggacgggggctggtctct

SEQ ID NO: 76493 - DNA, 43 bp, Homo sapiens
  chr14:105194951-105194994
  hypo
ccccttgctctgtgccgggcacagtcgtcgtacaaactgccat

SEQ ID NO: 76494 - DNA, 80 bp, Homo sapiens
  chr14:105195803-105195883
  hypo
gcagcatggcgtcggcgtgggagggaggaggtagcgtcggcgtgggggaggagcgtggcgtcggcgtcgtggggaggagc

SEQ ID NO: 76495 - DNA, 273 bp, Homo sapiens
  chr14:105196272-105196545
  hypo
gtgggcagaggcccacgaacctggccctgaccctcagctcgtccccagctcacagcacagccctcccctggctgcctccaaggagtctccagttactgagtggccactccgtgccagctcagcccacccctcaccttcccagtgcctgtggaggcccaactagggtgacgctgggagaggagagggcttggaggagccacgggtcaaatgcaggaggccacacctgcctgcccaggaggactgcaggagccggatccttaacacctggagggg

SEQ ID NO: 76496 - DNA, 38 bp, Homo sapiens
  chr14:105218308-105218346
  hypo
ccagagtgggcgccgagagcgagcgagggctgccagca

SEQ ID NO: 76497 - DNA, 43 bp, Homo sapiens
  chr14:105235762-105235805
  hypo
aatgttgtaaaaaaacgccgtggtgcagcggcagcggcagcgt

SEQ ID NO: 76498 - DNA, 240 bp, Homo sapiens
  chr14:105240937-105241177
  hypo
ctgcaggacagagcccgggcctcaacaaaagcctggcaggcagggctgcagggcatggggagctggggcctcctggagcctcggcagagtgcaaggaagaccagggccacctgccccacccacctgcccgcacacgggagcagcgagcacagcccctagcccacactgggcacctccacagcctgaccctccagggcaggcctgtctcaccagcggcggagtccacggtgtgtaaagccc

SEQ ID NO: 76499 - DNA, 30 bp, Homo sapiens; identical to SEQ ID NO: 44194
  chr14:105254641-105254671
  hypo

SEQ ID NO: 76500 - DNA, 143 bp, Homo sapiens
  chr14:105268653-105268796
  hypo
tcccacaacctgagccggcacaccgtagtgcacactcgagagaagccgcatgcctgccggtggtgtgagcgccgtttcacgcagtccggggacctctaccgccacgtccgcaagtttcactgtggcctcgtcaagtcccttct

SEQ ID NO: 76501 - DNA, 108 bp, Homo sapiens
  chr14:105292310-105292418
  hyper
cttggatgttcactccgagtgcgatgggagctgcaggaaggtttgatccccggagagaccagatcgggcttgagctctgaccgcaacccctggcgctggttggagggc

SEQ ID NO: 76502 - DNA, 746 bp, Homo sapiens
  chr14:105309697-105310443
  hyper
tcaccccgggatgcccgcccagcgcgccaagccccccacgctcacctgtaagtgcaggtggtgctggaggccaggccggggccctgcaggggcaggcacacagtggggctccgtcgccgcagcgccccggcggcctcctcctggccgctggccctcccctaaggcttcctcatcctaaacagcaagtgaagccaaacgaaaaccctgtctctcccgccgttccctccctcctggcctccgtcccccgggctcgcctgccccgccgcccggcggaccggtcccttcctgctttccctggcgggtgctttccgctgctctgttacccggagccaggacgcgcatatattcccagaatccgcgctcagtgcgttcggtcccccgggacacctgttctctgcacaggcgcgtctgggcgcagcgggggcagacacgcgttcccgggcagcgactccggaaggcccgagggagtaaatctggccctcccggttcagcacaaagctcccctggccgcctttcaaaaccgaccgcctcccaactctccgcggacacgagtggcggctgcctcccctcccctcccctagggccgcgcacgcctcccgcagggtctcagtgcctcctgggcgggggataattcctgtccccaccggtgtcctgtactcgcggggtcccgggtgtaagttctgggtcccgggctggctccctggtgagcaaagccgcatcgctcgaattccagaaacccttctcgc

SEQ ID NO: 76503 - DNA, 349 bp, Homo sapiens; identical to SEQ ID NO: 35575
  chr14:105310485-105310834
  hyper

SEQ ID NO: 76504 - DNA, 231 bp, Homo sapiens
  chr14:105433929-105434160
  hyper
cccaccctcagccaccgcactgggagcggctgttcctacactgcctgtagtggggatggagtgcagaggctcagcgagcggcagacctgcctctggccacagagctgcgcagtggggacccctccagtcactgggctggcaggagcctggcccaggaacacaaacaggaagggggaaatcctgcccgcctcgggataaggctgcgcagccaggctaccggcctcggacccg

SEQ ID NO: 76505 - DNA, 19 bp, Homo sapiens
  chr14:105434286-105434305
  hyper
cgcccggcctccggttctc

SEQ ID NO: 76506 - DNA, 182 bp, Homo sapiens
  chr14:105444452-105444634
  hyper
cggcgcgcgccctcgcgcgtagcccacccgccccaggggagcgggctgcaggcggggaggggcgcaccgctgccgggggttccgggccaggtgggcagcaccatgtggaagcagtcgcacatcgcggcggccaggcggtgcgggcctggcggcccgtcgcgtccagtcgctggtcccggctc

SEQ ID NO: 76507 - DNA, 20 bp, Homo sapiens
  chr14:105444788-105444808
  hyper
cggagcgcgctcgcgggcgg

SEQ ID NO: 76508 - DNA, 81 bp, Homo sapiens
  chr14:105457696-105457777
  hypo
gcctcttggcttgtgcgcgtctcggcttgcgggtaaaggccaggcgccccgctgcgtgcctcgggccgtgcctcatgatct

SEQ ID NO: 76509 - DNA, 99 bp, Homo sapiens
  chr14:105479261-105479360
  hypo
gggtatgtgtgtgtccggggcagggggggtgggttcctcaccagtgtgttgtggcagcccagagctggccaaggcagtgtttctcggcgtatgcctcag

SEQ ID NO: 76510 - DNA, 393 bp, Homo sapiens
  chr14:105511966-105512359
  hyper
cacacaaggcagtatcgcgtattttccacgagtgcctgtgcaggcaggtaaggatttaggaaaggtctggaaggatgtgcaaaatgttccgcctgcgaaggttccgcggtggcggggacactgctccggctccgctcccgcccgcccgagcgctcggatggggccgcctctgcactgcgtggccacaggcgcggcccggctgcccacgggcgccctttgcagctgctgccccctggcggccgcgggcggctactagcgggaaagcgaaacccgcccggtccattcaagccccgctgcctggcgccctctagggtcgttcttgggaacgggcggacctttcgtcaacactttgcctgcaagatcccccattgggggaaccgaggaggaagttaa

SEQ ID NO: 76511 - DNA, 393 bp, Homo sapiens; identical to SEQ ID NO: 76510
  chr14:105511966-105512359
  hypo

SEQ ID NO: 76512 - DNA, 30 bp, Homo sapiens
  chr14:105523817-105523847
  hypo
tcacattagccactgcgactacatacgatt

SEQ ID NO: 76513 - DNA, 30 bp, Homo sapiens; identical to SEQ ID NO: 44196
  chr14:105538919-105538949
  hypo

SEQ ID NO: 76514 - DNA, 34 bp, Homo sapiens
  chr14:105590655-105590689
  hypo
atgaggccatcaccacgttcgagcccagtcttgt

SEQ ID NO: 76515 - DNA, 76 bp, Homo sapiens
  chr14:105658349-105658425
  hypo
cttcctcctccacctcggctcccgagtgctgcttctcctgggacttccgacatggctccctcgtccatccccatct

SEQ ID NO: 76516 - DNA, 111 bp, Homo sapiens
  chr14:105662505-105662616
  hyper
tcagatggtcaggagcgccgcagggcccccgtgaaggagggatgaaccctggccgcatcactcccctcccaggcctcagcccctcttcccagcccacggtcctgggtgggc

SEQ ID NO: 76517 - DNA, 183 bp, Homo sapiens
  chr14:105662937-105663120
  hyper
gaccccaggctgggccggcctcctcgtctgggcctcggctcggagggtttcctgcccgcccgctcctagcctggcaggaagcggacacctcagaacaaagggaccggcggacaatggccattgaattgggccggggcgctcgcgcagggacaggccgccagctgcccgcgctgataagaccct

SEQ ID NO: 76518 - DNA, 186 bp, Homo sapiens; identical to SEQ ID NO: 35579
  chr14:105714232-105714418
  hyper

SEQ ID NO: 76519 - DNA, 186 bp, Homo sapiens; identical to SEQ ID NO: 35579
  chr14:105714232-105714418
  hypo

SEQ ID NO: 76520 - DNA, 146 bp, Homo sapiens
  chr14:105715247-105715393
  hyper
cggacctagccaacagcaacgccggcgccgccgtgggcaggaaggccgggccgcgcagcccgcccagcgcccccgcgccagcgccgccgccgcccgcgcccgcgccgcccacactcggcaacaaccaccaggagagccccggctgg

SEQ ID NO: 76521 - DNA, 47 bp, Homo sapiens
  chr14:105715982-105716029
  hypo
gtacagtgatgagatcgatctggaagccgacacggtgctggccactc

SEQ ID NO: 76522 - DNA, 129 bp, Homo sapiens
  chr14:105723744-105723873
  hypo
cagcccactcatccacgccctgggctggaggcccctgacctctcttgcaactccatgcagaacagcaaggcctcccaccctaagaaggtgccagggctgggtacaggggcattccgacacagagcagaa

SEQ ID NO: 76523 - DNA, 30 bp, Homo sapiens; identical to SEQ ID NO: 44200
  chr14:105739229-105739259
  hypo

SEQ ID NO: 76524 - DNA, 202 bp, Homo sapiens
  chr14:105739460-105739662
  hypo
ttaggctctgagtggcgtgtgcggtgtggctgaatgtgcctctctccagggctctgaggtgcggcgtgtctggcaagggcttggtttgggctggctggcaggtgctatgcccctgactgccctgggctacagtgggaatgccccttttcctacagccacatgccccagcgccaccgccttccccaaccgcacagagtctggg

SEQ ID NO: 76525 - DNA, 30 bp, Homo sapiens; identical to SEQ ID NO: 44202
  chr14:106334145-106334175
  hypo

SEQ ID NO: 76526 - DNA, 38 bp, Homo sapiens
  chr14:20707559-20707597
  hypo
agagctggtttcggccgggcgcggtggctcatgcctgt

SEQ ID NO: 76527 - DNA, 125 bp, Homo sapiens
  chr14:20928177-20928302
  hypo
atttttattgagaaacgagaaagacagctataacattcctgaggcacatgcttcaaagccttttctcctaaataaacactaggctctctcacctttacattctctgtatacgctcatcctttttt

SEQ ID NO: 76528 - DNA, 30 bp, Homo sapiens
  chr14:20936882-20936912
  hypo
taacagaattttcttcgtgggaggagtcct

SEQ ID NO: 76529 - DNA, 77 bp, Homo sapiens
  chr14:21093454-21093531
  hyper
aattttgcacttgtacgctggggcaaaatgctgacagaatgaagaaggtaattgcaaactcctataacgtgtgtggt

SEQ ID NO: 76530 - DNA, 196 bp, Homo sapiens
  chr14:21093591-21093787
  hyper
tcgaatcccaccactgccagtggtacgttttagcacaacaaggatcctgaagtactaacactttctaactagtaaaataattaaatcttcctttcccaggattctcccggattacacagcatcagttcctctgaattctgcattcgtaattaaaatcctgatttccaattggcatttctttcggttaggcagggag

SEQ ID NO: 76531 - DNA, 283 bp, Homo sapiens
  chr14:21098864-21099147
  hyper
cagagcagaagccaccggcttggggtgaatctgcatagcttctgaactaggctgccctcagagtaatctgcgagccagttttcgccccaggagcgcaggaagggaccaccaggcaggctacaagtggagaagtgcgcaggactccgggagtcatggctatcagcagattagattagatctgttccccacaaacacagaggtatggaccaagtgtaacatttttctcccagagacgtgaacagtctagtttcttcctcgcttactgcagcgtacaaacacctat

SEQ ID NO: 76532 - DNA, 381 bp, Homo sapiens
  chr14:21100626-21101007
  hyper
acagcaacttttccccgacggcacctcctgggcgcccttgaaagacgccttaaatctaaacctataatacataggtaatcaactaaagctgaaagggaatggccaaagcacccacgtggagtgctgggtgctgtaggcgagaggtctgaggtagtggcttttagagctcaacatcttggtaatgttggttcgaccttttcccctgccagtcccgcggtgacctttatctttcggtgagtgaaatcggtcgttcgtgtttttcgtgggtcttccaaccacaggccgcctgagatggttctagtccctttgagtatacagacccttcctgtgcattgaccgacacagctcggcccggatcccgaaatgaacgtttctaccttc

SEQ ID NO: 76533 - DNA, 3 bp, Homo sapiens
  chr14:21101008-21101011
  hyper
gaa

SEQ ID NO: 76534 - DNA, 19 bp, Homo sapiens
  chr14:21101037-21101056
  hyper
cgcacgttgactttcctgg

SEQ ID NO: 76535 - DNA, 60 bp, Homo sapiens
  chr14:21121400-21121460
  hyper
ccttgcaactctagtcgtccaataagctttaagttggttggaactcgccttagagagata

SEQ ID NO: 76536 - DNA, 15 bp, Homo sapiens
  chr14:21121902-21121917
  hyper
ctcatcccccacccc

SEQ ID NO: 76537 - DNA, 17 bp, Homo sapiens
  chr14:21141354-21141371
  hypo
ggcgtgagccaccgcac

SEQ ID NO: 76538 - DNA, 68 bp, Homo sapiens
  chr14:21172544-21172612
  hypo
tcactctctcaaaaacgccctggagaccgcttccacactagcactccccgactcgtcccattcttttt

SEQ ID NO: 76539 - DNA, 117 bp, Homo sapiens
  chr14:21190395-21190512
  hypo
agttctggctgctgccgttaactgacgccatctttctggcacggatgtcacagccaaatcacgcaaagtggaaggtggtggtaaggagggatggggtgatgccggcagacagaggaa

SEQ ID NO: 76540 - DNA, 24 bp, Homo sapiens
  chr14:21265229-21265253
  hypo
gcacctggccgtagcttctaattc

SEQ ID NO: 76541 - DNA, 23 bp, Homo sapiens
  chr14:21282035-21282058
  hypo
atgtttctggctgggcgcagtgg

SEQ ID NO: 76542 - DNA, 37 bp, Homo sapiens
  chr14:21287757-21287794
  hypo
actgcaggccgggcgcggtggctcatgccggtgatcc

SEQ ID NO: 76543 - DNA, 18 bp, Homo sapiens
  chr14:21289138-21289156
  hypo
agcactttgagaggccga

SEQ ID NO: 76544 - DNA, 20 bp, Homo sapiens
  chr14:21297174-21297194
  hypo
aagagcgagaaaaaaattaa

SEQ ID NO: 76545 - DNA, 209 bp, Homo sapiens
  chr14:21341988-21342197
  hyper
ggaactgggagaccacgaaggctctgggcctgcggagttgcccaagctcctccggcttctccggaaacggctttttccggtgacacccctggagccacagtgatttgtttccctaaaggaagcggtttcccgccagggtatcgtccctaataccctccgaaggagcccattgaggagaaaggcatagaatgtcccgcagaaggcagaag

SEQ ID NO: 76546 - DNA, 132 bp, Homo sapiens
  chr14:21439185-21439317
  hyper
aagaaccaggagacacggctttggtgcctctcggcccgctgggtctcggcggcgcagcgtcccctgccggccactgtggcggcggctggaatcagcctcagcacttaaggggccgcgcgggaggagttgccc

SEQ ID NO: 76547 - DNA, 130 bp, Homo sapiens
  chr14:21492900-21493030
  hyper
cggaacccgtccctacgagtccctacgcagcccgtccgcgtggagactgacacccttgcgtggccggtgccaagcgccccggaccttgcacacaacctcgcgcgcaccccaaacacgccctgcagctctt

SEQ ID NO: 76548 - DNA, 251 bp, Homo sapiens
  chr14:21493570-21493821
  hyper
tctggctccttccttcgcccccagactcagtggtgggaaccggtagtggggagacgaacccgggatactgacaccccacgagttcgactccccccgcccgaacacagagaactagattaagaaaggaggaggtgggcgggaccgccgctgaggaggcgggggtctcgccggctggcaggggcaggtgtgctggcgccgaaagggggcacgggggaacgtcgagggcgcaggagttccgactccctcgtgcc

SEQ ID NO: 76549 - DNA, 28 bp, Homo sapiens
  chr14:21609905-21609933
  hypo
tggaaagctaacaaccgtcaggccggga

SEQ ID NO: 76550 - DNA, 32 bp, Homo sapiens; identical to SEQ ID NO: 43943
  chr14:21657875-21657907
  hypo

SEQ ID NO: 76551 - DNA, 30 bp, Homo sapiens; identical to SEQ ID NO: 43944
  chr14:21721854-21721884
  hypo

SEQ ID NO: 76552 - DNA, 30 bp, Homo sapiens
  chr14:21766806-21766836
  hypo
atctgcaggattggccgggcgtggtggctc

SEQ ID NO: 76553 - DNA, 349 bp, Homo sapiens
  chr14:21769030-21769379
  hyper
tattatagatcaattcgtgattatatgtcccaaataacccgtagaaataataactgtcatgaaaggagaagccacgtgctctatttgtccacaggctgaggaccaccttgctgcggttgaccgctgctggccgggacctgcgggtcgcggaggaggcggcgccgctctcggagaccgcaaggcgcgggcagaaggcgggatggcggcagcgcctctccatgcaccagcgcccccagatgcaccgactgcaagggcatttccactgcgtcggccctgccagcccccgccgcgcccagcctcgcgtccaagtgggacacagacagctccacacagccggtgcaccggtgcc

SEQ ID NO: 76554 - DNA, 30 bp, Homo sapiens
  chr14:21943010-21943040
  hypo
attttgtactctcaccgtatcccagatttg

SEQ ID NO: 76555 - DNA, 174 bp, Homo sapiens
  chr14:21980230-21980404
  hypo
gaggtgaggagggggcggtggtgggtgcgggcatgcttctttgtgttgacgaggcgtggggaagtggggagggctgatgaaggaaaaatccgagaggtcttcaaatacgtgatctctctcttaggctaaatttacaaagtacgtgtaatctattaaaatcgggttccgacacta

SEQ ID NO: 76556 - DNA, 233 bp, Homo sapiens
  chr14:21994155-21994388
  hyper
cgcccccacccctgcccagcccgaccgaccctaccgcacctccgagctctgccggctccccgcagggcaccccgagacgagagctcctctcggattcgtgcgccatggttgtgggggaagtggagggccaggtggggtgggagacaatggatattgggattgagggaggcgatggccgctgggtctgcggcagcctctgcacccagcggcccagactgcggagatggagatcg

SEQ ID NO: 76557 - DNA, 30 bp, Homo sapiens
  chr14:21994769-21994799
  hyper
ctcagtggagcaaggcgataggcttctctt

SEQ ID NO: 76558 - DNA, 183 bp, Homo sapiens
  chr14:22004998-22005181
  hyper
gggaccttcgcagtccgagattaactgttggggtttccgctgctttcgccgagacattcccgggtagagagttgggagagggaggggcaacgctcacttggtcttaaccggggtgacctggtctcgtctcccccttgggtccgaagccaattgatgcctctcccccagcgcaaatcactgtga

SEQ ID NO: 76559 - DNA, 38 bp, Homo sapiens; identical to SEQ ID NO: 43946
  chr14:22551269-22551307
  hypo

SEQ ID NO: 76560 - DNA, 95 bp, Homo sapiens
  chr14:22763687-22763782
  hypo
ttttaaacttacaggcgaaaattttttggaaatgcatttcttaagaaaatcactggggtcggcccggcgcagtggctcatgcctgtaatcccagc

SEQ ID NO: 76561 - DNA, 32 bp, Homo sapiens
  chr14:22812323-22812355
  hypo
gcctaagattaatctcggctattggggaaacc

SEQ ID NO: 76562 - DNA, 31 bp, Homo sapiens
  chr14:23028684-23028715
  hypo
aatatttgatgttgtcgggcacggtgctcac

SEQ ID NO: 76563 - DNA, 176 bp, Homo sapiens
  chr14:23183874-23184050
  hypo
tacacccctcccccccgtgatatagttcctaatatccaggaggagagaagatgatattactctcaatacctcaatatcgcagggaatgtaaacacccctgtgatattgttcctactacccaggaggaggggataaaattatattactcccaatatcgcaggcgctgtacaccccac

SEQ ID NO: 76564 - DNA, 232 bp, Homo sapiens
  chr14:23291733-23291965
  hyper
tccctgtccgctcctcgctcccgcacagctggattactgcggggaaatgaaaatgaccgcggatacccttagagactggtcctccaccccatgaacgctcagcttcctcttccctccctcccaaccctgcataagctggcggccagacaggagtctgggcgagcgccccaacccctgaccacaactgcctccggccccgagatgcttggctgaatctcggtagtgcccccag

SEQ ID NO: 76565 - DNA, 23 bp, Homo sapiens
  chr14:23293758-23293781
  hypo
actgcgcccggtttttgttgttg

SEQ ID NO: 76566 - DNA, 120 bp, Homo sapiens
  chr14:23339352-23339472
  hypo
atcgcaccactgcactgcagcctgagcaagactctgtctcaaatatacatataggaatagtcaatatactttattgtttagggaataatgacagggaaataaattatgtacatattcaaa

SEQ ID NO: 76567 - DNA, 94 bp, Homo sapiens
  chr14:23355390-23355484
  hypo
cgttggaaacaagagcgacttggcccgctcccgggaggtatcactggagggtgtgtatcctgaacagattccatacttgcgatctcaggggaat

SEQ ID NO: 76568 - DNA, 43 bp, Homo sapiens
  chr14:23355778-23355821
  hyper
tcccgtacagcccagcgggcgcctgagccggtgccttcctgca

SEQ ID NO: 76569 - DNA, 56 bp, Homo sapiens
  chr14:23399557-23399613
  hyper
atggagaggagaacacggtacaagagaccccacgcaggcgccgctggcagaactta

SEQ ID NO: 76570 - DNA, 206 bp, Homo sapiens
  chr14:23426887-23427093
  hypo
cgtgagctaccgccctcggccaggcctcgtttagttcttaaagcgtcctgtgagaaagtcaccattatactcattttacagagggggagaactgaggcacaaagggttaagttcgaggtcgccatttggggggtctaaacctgtcccaatagctctcggaaggaaccttcccagacctgccacccaagccgcgtcctgcgagtctc

SEQ ID NO: 76571 - DNA, 318 bp, Homo sapiens
  chr14:23450428-23450746
  hyper
tgacgggtcccttcccgtccctaaccacttctctcactcaccgaagtagtcctccctggcctctggctcccgcatccgggcccgggcggcctccggaacgaaaggacctggtggctcctccagacccgacggctcaatccccgagggttctccgcgggctccggcttctcgcccaccggtgcccaccgtcaggcgaagcaaagctgttagctcgtcctggtaccgggcgcccacggcgcagtccccgtagccggtcacagagtgtcgtccgggttgcgccccccgtctctccaagggccccgccgctcccactccggc

SEQ ID NO: 76572 - DNA, 30 bp, Homo sapiens
  chr14:23537948-23537978
  hypo
accggcccccacccccgcaacacacaccag

SEQ ID NO: 76573 - DNA, 30 bp, Homo sapiens
  chr14:23545233-23545263
  hypo
tagcattgttgattacgctttcaaaattgg

SEQ ID NO: 76574 - DNA, 34 bp, Homo sapiens
  chr14:23577687-23577721
  hypo
acgctccccacctcccagacggacacccatctct

SEQ ID NO: 76575 - DNA, 188 bp, Homo sapiens
  chr14:23652713-23652901
  hyper
ttcttttcccttccccgtcttctgcttccgcctttcccaggtgtcctcttctttctcgctggtcttcgtgcccttgttttcctcttttcgatccccgttctactgcacagccggccccatccctctggtttcgggagagtggcttctccacacactaacgtgcttctctttagcgaggggttttattc

SEQ ID NO: 76576 - DNA, 100 bp, Homo sapiens
  chr14:23706665-23706765
  hypo
ttttaattgaaatttgttagttctcaattaatatcacactgttctttgtccgcatcatttttaaattttcctgtttccgattttacgctattctttcaaa

SEQ ID NO: 76577 - DNA, 156 bp, Homo sapiens
  chr14:23707497-23707653
  hypo
aaagttagtgtatcacgatcgaacaaataggacaacgaagctcgtggcactgtgggatgcgtttgcgttgagctgtttattcagtacattttttatcgtaaatcttacgaagtttgtatccctcagcggttacacacacacacacatcctacgaaa

SEQ ID NO: 76578 - DNA, 285 bp, Homo sapiens; identical to SEQ ID NO: 43952
  chr14:23776954-23777239
  hypo

SEQ ID NO: 76579 - DNA, 192 bp, Homo sapiens
  chr14:23821384-23821576
  hyper
cagcgggggcgccagcgtgaagatggggtccgaggccatgcccagagccacgaagagcaccggcaggcagcagaggccgagctgcagctgctggccgccgcccagcgcccccacctgggcgagcagcgcctcaaagctgagggggcctgggggcacggccagcgacaggctgctgcccagtccgtcgccgcc

SEQ ID NO: 76580 - DNA, 592 bp, Homo sapiens; identical to SEQ ID NO: 35141
  chr14:23821601-23822193
  hyper

SEQ ID NO: 76581 - DNA, 94 bp, Homo sapiens; identical to SEQ ID NO: 43953
  chr14:23884288-23884382
  hypo

SEQ ID NO: 76582 - DNA, 49 bp, Homo sapiens
  chr14:23939668-23939717
  hypo
gaaaacctcataagtcgaaatttaggcttgatgccgctgcccagcatca

SEQ ID NO: 76583 - DNA, 93 bp, Homo sapiens; identical to SEQ ID NO: 43954
  chr14:24021398-24021491
  hypo

SEQ ID NO: 76584 - DNA, 5 bp, Homo sapiens
  chr14:24045413-24045418
  hyper
gcttt

SEQ ID NO: 76585 - DNA, 30 bp, Homo sapiens
  chr14:24608282-24608312
  hypo
ttggtccagtcctgccggatgtcatcaagg

SEQ ID NO: 76586 - DNA, 91 bp, Homo sapiens
  chr14:24682617-24682708
  hyper
tcccgaagagcctgccgagaccactcatcgcgagctcgcctctcccgcctccgcccctcagcgtcctccagacttccgccttgctcctggg

SEQ ID NO: 76587 - DNA, 454 bp, Homo sapiens
  chr14:24803463-24803917
  hyper
aagtctgtcagaacccggacagaaacgagaagcatccaggactcagctttctccctgagcagacccagaagggtagagtgacttgcccagggtcactgcagttcctagccaggctcaatggtcctttctttctctgctcccagcaacgaaaacacatcgaaaagaagaccccacaaaccccaaccccgaaaatgctccccaggtagagaccctcccgcagcagaggctcggctcaccctgccgctggcccaggccactgcgagcagcgccgcgagcgcacagagcacgatccccagcagcagcagcagcagcgggtactgctggctcaggctgtagtaggtctcgtagaagaggtcttcgctggggggcggccgggggctgaagaggcgggccatgatctccccagccccgagccccggggctggctagggccgggcgccgggttacctccttc

SEQ ID NO: 76588 - DNA, 205 bp, Homo sapiens; identical to SEQ ID NO: 1132
  chr14:24803918-24804123
  hyper

SEQ ID NO: 76589 - DNA, 70 bp, Homo sapiens; identical to SEQ ID NO: 35144
  chr14:24804424-24804494
  hyper

SEQ ID NO: 76590 - DNA, 152 bp, Homo sapiens
  chr14:24808711-24808863
  hyper
cccggaacactgtgccgaacccgcctttgccgacgagctcctggttctccagttcctcgatggacaccaagggggcgggggcaccgctgggcctgagagaggggtgtcgcccactagccggccgtgccgtgcctcagcgctgctccccgcgc

SEQ ID NO: 76591 - DNA, 80 bp, Homo sapiens
  chr14:24837744-24837824
  hyper
gagggagtcagaggtcgaagggagtcggggggactcgttggcctgcggaagtgaggctgggggcccgggcaccactttct

SEQ ID NO: 76592 - DNA, 30 bp, Homo sapiens
  chr14:24860993-24861023
  hypo
gggcgcggtggctgacgcctgtaatcccag

SEQ ID NO: 76593 - DNA, 153 bp, Homo sapiens; identical to SEQ ID NO: 15809
  chr14:24862082-24862235
  hypo

SEQ ID NO: 76594 - DNA, 45 bp, Homo sapiens
  chr14:24868518-24868563
  hyper
cgggtgcagcggcagcggctgcaagtgcagcgcatctttagggtc

SEQ ID NO: 76595 - DNA, 66 bp, Homo sapiens
  chr14:24901940-24902006
  hypo
cactacttctccagccggggcattgccattgctgtgcagtacttctgggaccgtggtcaccgtgac

SEQ ID NO: 76596 - DNA, 30 bp, Homo sapiens
  chr14:25156087-25156117
  hypo
aggctggaagagttccgtgtgtctcttggt

SEQ ID NO: 76597 - DNA, 250 bp, Homo sapiens
  chr14:25518419-25518669
  hyper
agccacgttgcccggcggtgttggtgaggctcgatgccggcgtgcacggcaagcgcgaattcggaacctggcgcccttgaccaagcctgagatcggaaagggggcatcgcccagggccagcgccctgggggcagggtgccgtgcccgccagaaaagctcgcctcagttttggcagtaatgattttcctagaagatgccagagttcgcgaagatcggagtgattcgcggatttctgcgctcaagctagagg

SEQ ID NO: 76598 - DNA, 634 bp, Homo sapiens
  chr14:25518982-25519616
  hyper
ggacggagcgccaggcgccccaacagccgtggcggctgcaaccgcatctcccgggcttggcctccgccctgaccgcctggctcccctcgccccggtcctaccgtgcagcctggctcgcgcccctgccgtgccagtgcgcggcacgcgtcccagagcacgaggctcctccccggggggctgccccgcgcggggctccgggctccggacaaggcttagccggcccgggtgctggctcgccgccgctcgcggctcccgcgccggctcctgctgccgcgcgcgaaaagggaggggttggggggaaactcccggcaactccaactccgggcgctggagctccagctgcagccgcgcgcccgcccgccgccgagtgcgagcgcctgcgaagcaaacctgcccgcgcggccgcctctgagcatgctcagtgccgccgtgggcgagcccgagcgccctggcccggggcaaagagcagcggctaggggctgggggctgggggccgggacccgcgacccgccccaggcctcggagcgcggaggtggcagaggaagggaaaggccaatgtaggggcgggggccctgagccaaagacccgggagaaaccgatctgggtgcaagagccggtgcgactttcacggctt

SEQ ID NO: 76599 - DNA, 309 bp, Homo sapiens
  chr14:26674308-26674617
  hyper
ccgcccgccgcagcccgactctggggcgtttgggaggtgggcctgaggtttgcctaggactcgagttcctttcaaaggaaggcgagagggagatggggagaaggagactcggagacttctctattaaagccgcgctgaactctagccttctggcaagccgcggcaagccgccaatttgaagtgtgtgagctttaatctgctcctagcctgatgggctcccgtgtccacagggagctgggaggcatccattacgccggaccaaggagatggagcgtctaggaaatatgttaatgccggagccctccccgc

SEQ ID NO: 76600 - DNA, 30 bp, Homo sapiens
  chr14:26960497-26960527
  hypo
cactggggttttattcgttgagttttagga

SEQ ID NO: 76601 - DNA, 124 bp, Homo sapiens
  chr14:27066218-27066342
  hyper
ggtcaacctctggaccgattaaatggaaagataggtctattccgaaaaactggtcgccattttgatgaatgataaacacagaaatggaaatgtgtcggggacacctaggcgcggggcaggtgca

SEQ ID NO: 76602 - DNA, 85 bp, Homo sapiens
  chr14:27066596-27066681
  hyper
ccccagtgtgggtcccgttctgctggatgggagctgccgccatcatgtttgcagttcctgccgctgctaccgggagaaggttctc

SEQ ID NO: 76603 - DNA, 60 bp, Homo sapiens; identical to SEQ ID NO: 11772
  chr14:27067097-27067157
  hyper

SEQ ID NO: 76604 - DNA, 95 bp, Homo sapiens
  chr14:27067604-27067699
  hyper
ggaggggtgaaaggtcgctggtccccggcaacacggctcaggcaaacgtaagcggcttgtcgcagaaaccaaggggtccacgaaacgcgctaggc

SEQ ID NO: 76605 - DNA, 205 bp, Homo sapiens
  chr14:27068077-27068282
  hyper
cgcactgtgtgacaccgttaggggacttagagtgtcactcgccgccttaaatcctttcgggaacaagccaggatataaataaataaagctaggtgtgggtcttcccttcacaaggcgctggtaggcagactaaagacaggcaacagctgagtgtgcacacagaactaaatattgaacgaaatacgagtgtcggaataaaattcat

SEQ ID NO: 76606 - DNA, 96 bp, Homo sapiens
  chr14:29224711-29224807
  hyper
tgagcatttttgttgcgttaagtggccggcattagcagcctaaacacgtaggggaaggctaacatcgccgttaatataatgcgggagaggaatgat

SEQ ID NO: 76607 - DNA, 237 bp, Homo sapiens; identical to SEQ ID NO: 35156
  chr14:29225531-29225768
  hyper

SEQ ID NO: 76608 - DNA, 534 bp, Homo sapiens
  chr14:29226033-29226567
  hyper
gagatctcagatcttcgcgtttggggtggggagtgggggcgctggggaaaagtcgggaatagccccgcggtacctggggatcccagttgttttttctaagaaagcccggggttaaaaaatgcattggaatgtggcgatgcctccatcagccgtcactttataagttcccaagtcacgctgctctagaccattgtggatgaaagtggattgtctctccagaaccaaatattccctgacctgcttccccaacgcgccctcacgctttcctgggagagcacagcgctgccggagacgcggcgcttctgtcaattgtgcagagcaattactaagaaaatattgtgacgatgttgtagggcgaaaggggacgtgaggaggaaagggagggggagttagtttggagagcaatttgcaaaggaatattaactttgattcccgaggtcaccgcgggaaaaggggttctgggctgcagagctcttcctctaggtggcggactttggcaccaaacaaccgctagatgagcgctgacttcaaaca

SEQ ID NO: 76609 - DNA, 1598 bp, Homo sapiens
  chr14:29227651-29229249
  hyper
cagcaagcagacagacgatatgatatgatcttaagggaccatctccaaaactgaaggagcagagaatgtgtaattcttttcccagtaaatccttccagttcctaggacaagactcaaacgtcccgctaggagctgcagctgcgaggtggagccaaaggctctgacaagtggcttgtgtatgacccaatatttatcaataacaacaacaaaatcaagtgaaaccaaggctgcggattttgaaatgcttctgcagccctggcgtggatatgcacgtgagcgaagtaaaagtcgctggagatgagttggctccacttgtccgccctggggagcaatcctggggcaaaatccagtgctaattgatcccaaccagccacattatcagctgtaaatgttcaaggggacaaagaatgagcattgtgtactaaagatactccaagcattttttcaagtaaatagggacgtgtaatcagtagcgtgtgtatgcatataaataggaaaagagaattatttttaattaattaggaaaataatgtttcatgtgtaattccagaattctctagcgtctcccactgtccgactgttttgtgattgggacttcctctaggaaaacctgcgggccctgttttgtgtttcgagcgggagagcagacactcagctcaaatagaggcctttctctcgtctttcggggtgtttattctatggccaaaaggtaagatggccaaggcagcgatctgagcgtgatgtctggccccgcggggggcccaggaggcccaagttgggacagctccggagctaccccggtgcccctcagctgggggagggcgcgcggcagccgcctgccagccccacaggctgctctccaaaggagctgggctttttcagcgtttctgtttccttgtagcctcatctatcttatctaacaagttcacgctccgggagaaaagaagagggtgagaaaaaaaaaaaagaaagaaaaaagaaaacctcttcaccgcggtgattcatagttcataggctccggagccaaacttgccgacccagcttttttctcgaacattactttctctcctacgtgccttaggacaaacccagaaggaagacactaaaattgccgaacaagaatctaggattgttttaaaaataaaagtgaccccccacagacacctttgatgttgttgattctgacacagaggagtcgagttgttttgtttacacatgctaacggtaacttgctcctgatgccgctctacgcgcagcttagtctgtcttctcctctcctccccgcaggcgactccttccaaagagcgagagagaaatacgggtattactgttatcccccactgggttcaataccccttacatgtaattgaatattcgaattaacgtcacctgcatgcaccccagtcttttaactctgaaatgtgctttatagcaatacagacttgaaacctttaactgttttctatatccccgcgtttaccgtggcagatgacctcttagcccaaaattgatttggtgtgtatccggtcttatgtgccaaaaaaagagatacctaggctgaaaaggcaactttaaggggggacatctagagagatgac

SEQ ID NO: 76610 - DNA, 603 bp, Homo sapiens
  chr14:29229250-29229853
  hyper
cctagaatcaaggcctctggctcgattgcgttcggcaagcgtctgcaacaaaggagcgtcgggcaagctcgcgggtatgcgcagggagcagcggcgcgcagacctgggagccccagctccgcgaagctcctcgaagggaaccctcgcagttacagcctcaagaggcaaggcaggggagggagaaaagctggacctcttgagaaacgctcctccaacagattttccatggcctcgtgttggagaaggggcgcgggggaggagcgagggttggggtaggaagacctactggaaccgactccggagagtgagggccaggtgggtgtaagatgagcacaaagtaaaaacttgcccattggtttgtccacgcaggtttcttgaaagaagcagatagatctgattagtagatactactttccccacgcaaagggagactttggggtgaagggttctctgcgtgcttcctggcttgcttaccccactcatgaagttttctctcctctcattccttcagacctttagtgggtgcaagcatttcctataagatacttattaatctcatatacggaccttgaactgttcaatgttttccgtgtacatttaaat

SEQ ID NO: 76611 - DNA, 335 bp, Homo sapiens
  chr14:29230851-29231186
  hyper
ttttgctgaagatcacgggacttttcttttggctgcgtacgtacttggcttcagagagcctggaacacctggcagcgtcacagagacttgcctggagagtcccaggggtctctgtcaaggccttctcctcatccttgtcctcttcctcctcctgctcctcttcttcgccttggactttctcccttttaaagtggctccctagcttacacaagctaaacatttccactctcatagacgaggctctcccatagatttttttactcgaggttctcaagcaaaattgccggtgccacaatgttatgatggaaggatgctgaaatgacaggcctagtaga

SEQ ID NO: 76612 - DNA, 437 bp, Homo sapiens
  chr14:29231289-29231726
  hyper
cggggacgttgagggtgcgcgtgcgcgcgctgagagcagccactgacaacctgcagctccctaatgagtgacgaggcagggctgctgcagaaaagtaacacttccctggtgtgaagacctcttactgagaagtttagttcactactgttctcgcaaacctaatcgtataacctgtaaccaaaacccacagaacgaggatacaacacgctaaagagtaacttctaatcactaaatgttagcaccattacctgctgttaggaagatattatagacgagttggctccagcgagggcagacctcacctgccacaggatctctggaaatacctggatgcctctgtatgggatctcctcactcccaaacgtcacaaggtcagaaattctctgtgcatctgcaggaagagaactttagctagagcttggcgctgggtgccactc

SEQ ID NO: 76613 - DNA, 754 bp, Homo sapiens
  chr14:29234555-29235309
  hyper
tccttttaaagcccccgattcgcaatttccccattcacttcaacctccaaccgaaccttcccagttccaaagcccaagaagctgggactgtgagatccacgttcccaaggctccccggtgctttccagcagcactcagggttggcaagagctggcttcagtatactgttatttcaggaatgaggcccgcacaaaataaaagcatttgagaaacggaaaggaaaaaaaaggagtgaaaataggaaggcttaaaaaaaaaaccggaaagaaatagacgcccacccttattttccctccaatgtcaacaagcaaaacgaaaatatttccagggtgatcgctcgcagctacccgcttccaattcggattagaagctgaggctggagcggcgaggagaaaacgacatcgagtcaccccgcgcgtgagcgacgctctggagcaggagagaaggaaaaggaagagacacacgtatatagcatgtgttacctgatttatttcgagattgtttggtactgttttctctctgggcacctctcatttcggaaggccatcagaggcgcccactactgagcggccccggccgccgcagcagcacccggagccccagtcccggtttccccgcggtgccggagcccggagctcgccgccgcccaggcctcaggaatcgagtaagtaacccctgtttggccccgcgctcctctgcccacttcctcctcctcatctcatcgctcccaaagctctcccacaccctcctcccc

SEQ ID NO: 76614 - DNA, 298 bp, Homo sapiens
  chr14:29235341-29235639
  hyper
cggtgggccttatctccccccttatccaaagctgcgctagactattacctacaaagggcacaattttcctgctggctcagaaatgccagacactggcctgcaaggccgactcggaaaagtagtgcctcgcctctacctcctccatttcctgccctctcgcatcctctccctgcactcccactcttcccactaccaccaccacccccgctttcaaaaataaaattggatacaaactttaatcactaaggacaaatattgacgcttaaacgaaaatgacccagtacaatgaggaggaagc

SEQ ID NO: 76615 - DNA, 368 bp, Homo sapiens
  chr14:29235826-29236194
  hyper
cggcagccggcgggcggggcgggggtgggtgggcccggcccctccgattggtcgacggcgagagagacgctcccgcacgccgccagctctgattggcccagcggtaggaaaggttaaaccaaaaatttttttacagccctagtgtgcgcctgtagctcggaaaattaattgtggctatagccgcctcgatcgctgtctccccagcctcgccgcggccgctccgggacgcgcccgcccgccgcccggctctccccccctttgggctgctgctgctgctgctgtgactgctgctgcgagaggaggaggaggaggaggaagcagcgggggggggagcggggggtggggggggagaccaagaagtacagttg

SEQ ID NO: 76616 - DNA, 81 bp, Homo sapiens
  chr14:29236254-29236335
  hyper
cttttcctttttttttttttttctaattcctgaggggtggttgctgcttttgctacatgacttgccagcgcccgagcctgc

SEQ ID NO: 76617 - DNA, 201 bp, Homo sapiens
  chr14:29236413-29236614
  hyper
ggtcgccgccgcccgccgcgccgctgtcccgctcccgcgccgccgccgccgtttccccccgacgactgggtgatgctggacatgggagataggaaagaggtgaaaatgatccccaagtcctcgttcagcatcaacagcctggtgcccgaggcggtccagaacgacaaccaccacgcgagccacggccaccacaacagccac

SEQ ID NO: 76618 - DNA, 149 bp, Homo sapiens
  chr14:29236674-29236823
  hyper
caaccgccgccgccgccgcagcagcagcagccgccgccgccgccgcccccggcaccgcagcccccccagacgcggggcgccccggccgccgacgacgacaagggcccccagcagctgctgctcccgccgccgccaccgccaccaccggc

SEQ ID NO: 76619 - DNA, 208 bp, Homo sapiens
  chr14:29236859-29237067
  hyper
cggcaagggcgagccgggcggcgggccgggggagctggcgcccgtcgggccggacgagaaggagaagggcgccggcgccgggggggaggagaagaagggggcgggcgagggcggcaaggacggggaggggggcaaggagggcgagaagaagaacggcaagtacgagaagccgccgttcagctacaacgcgctcatcatgatggccatc

SEQ ID NO: 76620 - DNA, 128 bp, Homo sapiens
  chr14:29237139-29237267
  hyper
cgcgagaacaagcagggctggcagaactccatccgccacaatctgtccctcaacaagtgcttcgtgaaggtgccgcgccactacgacgacccgggcaagggcaactactggatgctggacccgtcgag

SEQ ID NO: 76621 - DNA, 162 bp, Homo sapiens
  chr14:29237282-29237444
  hyper
cggcggcaccacgggcaagctgcggcgccgctccaccacctcgcgggccaagctggccttcaagcgcggtgcgcgcctcacctccaccggcctcaccttcatggaccgcgccggctccctctactggcccatgtcgcccttcctgtccctgcaccacccccg

SEQ ID NO: 76622 - DNA, 320 bp, Homo sapiens
  chr14:29237573-29237893
  hyper
cgtggaccggctggtcaacggggagatcccgtacgccacgcaccacctcacggccgccgcgctagccgcctcggtgccctgcggcctgtcggtgccctgctctgggacctactccctcaacccctgctccgtcaacctgctcgcgggccagaccagttactttttcccccacgtcccgcacccgtcaatgacttcgcagagcagcacgtccatgagcgccagggccgcgtcctcctccacgtcgccgcaggccccctcgaccctgccctgtgagtctttaagaccctctttgccaagttttacgacgggactgtctgggg

SEQ ID NO: 76623 - DNA, 102 bp, Homo sapiens
  chr14:29242506-29242608
  hyper
ctcttgtctccctcccgatttctactgtgttttgtttttgtttttccccaccacctaaggctctgcctgaggttgtccgaaggatgccgaggaaaaggatat

SEQ ID NO: 76624 - DNA, 114 bp, Homo sapiens
  chr14:29243157-29243271
  hyper
ccagagctggccctccgcccccagctccttggcctgggtcacaccagggtcccggtcggatttagccgggctgctccgggtcgggtgaggcactgggtgcgtgtgggagtcttc

SEQ ID NO: 76625 - DNA, 157 bp, Homo sapiens; identical to SEQ ID NO: 35176
  chr14:29243513-29243670
  hyper

SEQ ID NO: 76626 - DNA, 562 bp, Homo sapiens
  chr14:29243730-29244292
  hyper
cgatccccgcagagggtgaagccgggcgctgcgcagggagcagcaacatgagggcgctcttgcccaggacaagcagagctgtacgtttgggtagctcatattggctgatgccaagaaaagtgacttcagaaccttggctggcgcgcttccctaccttttccctttcttcttaatcttctgtgtgccaccacctccccccaaccttttttcccctcccaaagttgtttccttttgtttacccggtgcggtttcagatctcagcacttctcagctagtagataaaattatttgctctgtaatggacatctcttctcctctccacttgttaccccactcgcccttcgctttctaccccattttgcttctctctgcccaagcctgtggtccaaggtgcagggatctcacaggaaaacaggtagcctcggggtgggaattcccagagcactgaaggcgccggttgttggccagagggaggccgggactccggtgggcagagtaccccgcgagtgcggagattttcaggctgtaatcttcagtctgggaaaggcgatgggaaggaagg

SEQ ID NO: 76627 - DNA, 645 bp, Homo sapiens
  chr14:29247097-29247742
  hyper
atcttctcaccctggcgagttttcctgaaactacttatccttagcgtcagcgctgtaagaggtggagccgctcagtcccgcgggtggctgcagacagaaggtgggcgagtcctgggacttaaaaagttttgcagaaggttgaaaagaggagcagagggagagttttgagtttatttattttattttcctttttttttttttgtcttgtgccaagcccttgaagttaacgtagcgacgacgtggtccttgtaggaccaagcattcttggcattctgtcgagattgagattccagagcatcggatgaacgggacttatagctaaggcgtactcacccacccctcccttcgtctttttacgcacgcagcaactcgtcctcacgtgcataggggtagtggacagtgttgacttgaattgctgtccctcgttccaagcctttcctgtgaatgaacccgaaaacactcgacaggtcgtgaataatcgttttaatgagtgtgcaaagcgtgcgacggggtgcaccgagctgtcgggttaaacaaacaacttgtaccctgaccaaatccgattgttaaagtgcaaagtgatgtcagtaccatttccattgcctttcggaaatccacagatctgacacgcgggagtccaatttt

SEQ ID NO: 76628 - DNA, 353 bp, Homo sapiens
  chr14:29254087-29254440
  hyper
agtggctcatatggtcgttctgtgttttgtagaatacgtaggggactcctgaaatgtgtgggatgtaggtaggggcgggagcgactctgtggggagagaagggagaaaaagattgagagaaggaaagagaagtgtatttgcaaggcaggctgacaatttctcaattaatttggggcagagacagaaagactccgagtttctagcttcttttctatacctcagataaaaaactgaagacagccttattctaacaactcaatttaaaaagagcccccctgcgtacgtccccgcacccctttcgccccagcggccgctcacaaagcgccacccgcgcctcgggcgcccgcagaagc

SEQ ID NO: 76629 - DNA, 522 bp, Homo sapiens; identical to SEQ ID NO: 35180
  chr14:29254611-29255133
  hyper

SEQ ID NO: 76630 - DNA, 30 bp, Homo sapiens
  chr14:30066780-30066810
  hypo
taaatgggaatgtgccgcttaggcttacat

SEQ ID NO: 76631 - DNA, 23 bp, Homo sapiens
  chr14:30126794-30126817
  hypo
gggcgcagtggctcacggctgta

SEQ ID NO: 76632 - DNA, 30 bp, Homo sapiens; identical to SEQ ID NO: 35181
  chr14:30396081-30396111
  hyper

SEQ ID NO: 76633 - DNA, 128 bp, Homo sapiens
  chr14:30396380-30396508
  hyper
gcggagagggccagccgggcagcgccccctgcgccgcggggaggcgccgggctggcagcggtgcggcgacttaccttctggtcgacaatggagcaagccatctcgcggacgtgcgccaggctgtagtc

SEQ ID NO: 76634 - DNA, 478 bp, Homo sapiens
  chr14:30396920-30397398
  hyper
aggagggaaaatggccgaggcgggaggactctgaggcccggaacgcggcagccggctcggggccgccggcactggggaggcgccgccgccgccaagaatctgccgcctggcgcgctcggaaggacggggcgacgggtcggcgcggcccgagcgccgggcgggggccggggcgggaagggggcgtgaggggcggggaaggggagctgggggcgggcactggggagccaccacccggcgggcgcgggagtcgcaggagcagcggccgcagtggccgcagggtgcccggtcgccgccccctccgcccgcagttcccggggcctgagcctccgcgagccgggataggaccgagtggcggggctcggagccgcctcggcaggcgcggcccttccctccctgcagggattcccgtcctctcgggtcccgctgccccgccccgactgcggacggagtggatggggtgcaccgcctcagacccgct

SEQ ID NO: 76635 - DNA, 57 bp, Homo sapiens
  chr14:30739946-30740003
  hyper
gttcacatcagcagtcgtcagcggcgatgtcaggcgccgtgtcgttcttcaaaccct

SEQ ID NO: 76636 - DNA, 142 bp, Homo sapiens
  chr14:31027434-31027576
  hypo
acaaaggctaaaggtatgctgtcatggtttggtttgtactgatccgtttaggtaattcaatgttattagatgtgaggatgatctggtggcaacatcaatcacagccataaaggtcagagttatttagcgcccctcaccccct

SEQ ID NO: 76637 - DNA, 34 bp, Homo sapiens
  chr14:31309552-31309586
  hypo
ggtataactgccccattgacgctgtgcatgagag

SEQ ID NO: 76638 - DNA, 1298 bp, Homo sapiens
  chr14:31343340-31344638
  hyper
ccaagttgagaagttcggttctcaggccgcgtggacctgacagctctcagaagctccaggcctcgctgggtggggcgggtagcggccgccgctgcctcagcagccctggtcccggcagagcagggctggcgaggccgctgctgccgccgtcggggccgccggccctccacactcgttgagacgccggcacggggaccttcgtgcccctctagggactggcgccgcgtccaggtggccgagcctgcgctgctggaggaggcgcctccgcgccggcctcaccccggggccggcagggggcgaaggcggagctggaagtcgccgccgggccccgggggaccggctcccgcgcttcctcccgcgccccccgcacagtgctcatgcgcacggcccagcctttatagcggccgcgggggccttgccttccgcactcgggcgcagccgggtggatctcgagcaggtgcggagccccgggcggcgggcgcgggtgcgagggatccctgacgcctctgtccctgtttctttgtcgctcccagcctgtctgtcgtcgttttggcgcccccgcctccccgcggtgcggggttgcacaccgatcctgggcttcgctcgatttgccgccgaggcgcctcccagacctagaggggcgctggcctggagcagcgggtcgtctgtgtcctctctcctctgcgccgcgcccggggatccgaagggtgcggggctctgaggaggtgacgcgcggggcctcccgcaccctggccttgcccgcattctccctctctcccaggtgtgagcagcctatcagtcaccatgtccgcagcctggatcccggctctcggcctcggtgggtgcgcgcccctcacgaccccggccccttgctccgctgggtggaggctggagccagccctcacgcttctctcttcgcaggtgtgtgtctgctgctgctgccggggcccgcgggcagcgagggagccggtgagtgggggagctggggtgcgtccaggcggtcgcaggggctgagcaccagcgggtacaagcgggactcagatccagccccttgggcttcagccctaccgcctgaggaggaaggcgcgaaggttgagccgccgcgtggcgcgcccgcgttaacccctgcagccgatctgctcctgctcacctgtttctcccatggtagggggcccctggggtccagtggggggacgttctccaagagcactaggaagaaggcctcctccaggcccacccacagccccagaccccgggcccgctgagcgccggcagcaggaggtcgaggaaggaggact

SEQ ID NO: 76639 - DNA, 157 bp, Homo sapiens
  chr14:31534496-31534653
  hypo
gtagctcattcttcacgacctcacatcagtgccccttctccgggaagcagttcttcactctcctgtgatgttccttgtccctcccttctgtacacctatggaagcggacctgtcccagttataactcatcaccttgtactgccgttgtttacctacc

SEQ ID NO: 76640 - DNA, 40 bp, Homo sapiens
  chr14:31713750-31713790
  hypo
ctgggattactggcatgaaccaccacgcctgtcaaggaca

SEQ ID NO: 76641 - DNA, 100 bp, Homo sapiens; identical to SEQ ID NO: 43959
  chr14:31925624-31925724
  hypo

SEQ ID NO: 76642 - DNA, 172 bp, Homo sapiens
  chr14:32597712-32597884
  hypo
tggctctgctatctgcgtgtcggctatcggtgctgaggctggcccgcctctgcgtgggcaggatcttggcattccttttgctccatggacgctgcctccctgggctcgccgcgcctggccgcccggcaggcagccccaggccccggctgctccatcccgctgccctgatttt

SEQ ID NO: 76643 - DNA, 82 bp, Homo sapiens
  chr14:32671453-32671535
  hyper
cccagtagacacctacgatgctgtccgggcctcccaccagtcctgtcgcacagtgggcacacttcctcgacagcctccatct

SEQ ID NO: 76644 - DNA, 16 bp, Homo sapiens
  chr14:33163277-33163293
  hypo
gtccatggggccaggc

SEQ ID NO: 76645 - DNA, 244 bp, Homo sapiens
  chr14:33401981-33402225
  hyper
cacagatgctcattacgattctttttacgtgcaacacgtgggggacgaagcagtttcatatctcctggtattatctgccgtccaaagcattttctttgaaaggaaaatggaaacgcagctgcgccgtgggcccggccagcgagagctggggctccctccctctgtttcccagcggctgccgggtgcaggaggcgcctccggaaactgacttgggttaggggagttcagaggttgccccagcagg

SEQ ID NO: 76646 - DNA, 145 bp, Homo sapiens; identical to SEQ ID NO: 35189
  chr14:33402367-33402512
  hyper

SEQ ID NO: 76647 - DNA, 404 bp, Homo sapiens; identical to SEQ ID NO: 35190
  chr14:33402513-33402917
  hyper

SEQ ID NO: 76648 - DNA, 1208 bp, Homo sapiens
  chr14:33403210-33404418
  hyper
tccattgcacaaaagcggcttctttttttctctccgtctttgcacaccatccctcctcgataagtatcaagttctcgaggagcccaacttgcgcttggcagccctcgcgctgcctgatgtgcataagacgggcagagaggggttccggccaggaagggaggctctacgtccccattcctgcacacgcgggctggcttccaggttgctggaagccgcgggaggcgcgagcttgcctggatggtggttatttctctagagaaaggaggagagagagagcgcgcctgagtcttgcactttgggtcggaagtgcgcggcgtgtgtgtgtgtgtgtgtgtgtgtgtgtgtagaggggggcgggaaagaaacgcaccctccgctgccggtcattcccttgcaccggccaagtcctcgccaagcctcccggtgcatccttcctccgccaccccctccccttcttccctcagctgggctcgcgcggcgcagccggagcagccagtgagagcaacatcctggaaagaggggggagcaccgccgccccccaaaagggaaaaaaggccccaccctgacacgttttgctgtttgcaagtccctcgcacgccccccgcacctcctcctcgcgcttgcggccccccccacccccagcccgctgcgcgcacatcaaagctcctctccgccgcgcacagtggccgcggctcactaatgggattgcaggctggtgcctggctccgctgctgccgccgccgctgctcgcgctgctgctgctgccgccgcccgagcccgagcccgagcccccgccagccagagcccagagccgccgcgcccgggggccgaagccgcggcgatgatccgaatctttccggatttcagcgtgcaggtgacggccgcggcggccggcggggcggccgcgggggtgccggccggcgcgggcatggggagggccggcgccgcggccaacggcaccccgcagaacgtccagggcatcacctcctaccagcagcggtgagtagtcccgcctgggctgggatagtgcccccgccccggggtgctggggtgggactcactttgcctcctgttttgtgtcttacaacacacatgcacattgccagggctcactttgcctgcccctcgttctacagatgaggaagaaaaacacacttcactttggtggattgaaaagcactccagtgcgctggcgaagtgaaatcatc

SEQ ID NO: 76649 - DNA, 88 bp, Homo sapiens
  chr14:33407604-33407692
  hyper
actgcaactgagtggcgttgttgcgccggcagccgagcctcccagtcccccaacgagaaagagagagagagagagagagagagaaatt

SEQ ID NO: 76650 - DNA, 27 bp, Homo sapiens
  chr14:33407752-33407779
  hyper
cgtacgagagagcgctctggagcaaag

SEQ ID NO: 76651 - DNA, 98 bp, Homo sapiens
  chr14:33408303-33408401
  hyper
cccacctcagcagcacggccgccgccgccgccgccgccgccgccacggccacggccacggccccggccccggccaccgcccgccgggcagcccagagc

SEQ ID NO: 76652 - DNA, 204 bp, Homo sapiens
  chr14:33408623-33408827
  hyper
cgccgcctccgccgccgagggcccctctccgcagcccgcccgcctcctgggccgcgagcccgcggggacctcgtctgggcgcagcgctcgcccggggccccgcgcattgtccccgcggcggctgcggcagcgagaggctctggcggcggccgggctctctgagcagtcgcacctcctcggctcggcgaatagagtgactcactg

SEQ ID NO: 76653 - DNA, 84 bp, Homo sapiens
  chr14:33408887-33408971
  hyper
agatgcgaaggcgctgccgtgtgacgggagcagcagcgagggtggggggccggggatccccggggccgccgcaggtcccctagc

SEQ ID NO: 76654 - DNA, 30 bp, Homo sapiens
  chr14:33801361-33801391
  hypo
taaacaaaattattacggtagtaaaattcc

SEQ ID NO: 76655 - DNA, 20 bp, Homo sapiens
  chr14:34408709-34408729
  hypo
ccggccgaaacaatcttaaa

SEQ ID NO: 76656 - DNA, 177 bp, Homo sapiens; identical to SEQ ID NO: 35196
  chr14:34419561-34419738
  hyper

SEQ ID NO: 76657 - DNA, 367 bp, Homo sapiens
  chr14:34420004-34420371
  hyper
agggaacgatctacacgagcgcgaagccgaggcgcggggagcgtggcccggggttcagaaacctgcggctgccacggtacccgagccgctgcagcgtcggggacaagggaaagtttctcgcaactctcgggagaagggatctgccttcgggaaccagcgggagtggtgcggagctccacgacccgtttccggactggcccggcgagcagtgcggcgcaaggagtcggagggcgccttttggggatgggaagccaccactgccgcgactgcggccagactccgggagacgctgaggtccggcccttaagccggccgactccgcgcgtcacgggctccgccccgggaccgcctccgggaccgccctttc

SEQ ID NO: 76658 - DNA, 53 bp, Homo sapiens
  chr14:34499201-34499254
  hypo
agcagttactttctgcgctttccagcacaaggaggcagcggttgtagcctgct

SEQ ID NO: 76659 - DNA, 213 bp, Homo sapiens
  chr14:34529691-34529904
  hyper
ctcgccttccctgggcggagtccccatcggtgcctgcccgcccggaagtaggggcgcgagggtgacgggcaagaccgagcccggcccgtgattcttcctcagccggagctcgaccttctccttgtcccttgcgtttcctttctttgaaccacacactcgctcgctcacgtttgtcccgactaagttgcccccggcccccgcagctgtcatgaa

SEQ ID NO: 76660 - DNA, 19 bp, Homo sapiens
  chr14:34554235-34554254
  hypo
gaactcagccaggtgcggt

SEQ ID NO: 76661 - DNA, 23 bp, Homo sapiens
  chr14:34920639-34920662
  hypo
caattctaggctgggcgcggtag

SEQ ID NO: 76662 - DNA, 16 bp, Homo sapiens
  chr14:34921211-34921227
  hypo
tagcgtggtggctcac

SEQ ID NO: 76663 - DNA, 80 bp, Homo sapiens
  chr14:35009476-35009556
  hypo
acatgctacatgcagcgtctcatcacctacgaagcaggaatctagacgctgagggacacacagcccgaaatccaataagt

SEQ ID NO: 76664 - DNA, 180 bp, Homo sapiens
  chr14:35017114-35017294
  hypo
cttttaggagagtctcgtgacagcctctgtacatgtccccaggaggaaacaagagactctgatgttcagggccaccatcctgacatggacctttcctccagttataatgttgccattttgctgtcttaagacccttatgtccaagccttcccagacctcagcacccccgggatatgtgta

SEQ ID NO: 76665 - DNA, 461 bp, Homo sapiens
  chr14:35023150-35023611
  hypo
ataaataataaataaataaatacttaataacaataaagaagaattcgtccattcaacaaccgttcactgagcgcatagcctgtgcccagacactgttccaggcctctgggagcaaaaaggcctcggtgcccgtattctagttagacaacgagaagcgcggggaggtggggggcgggggtgggagagagaaaatctacaccgggctgcataggtaaattcgtaggttaggtgctaagtgctttgaaaaagcaaacaaacacagggaaagtgagataaggagttgcggcaaggggcaggtggctgtgttaaatcgagtggttggaagaagctgctatgagaaggtaccgtatgagcaaaggacttgaagcaggtgaagggagttggtcacggggcatccccagcacaaacatcagctacagcaaaggcccaggtaggactgggtttggcgaacagcaaggagg

SEQ ID NO: 76666 - DNA, 92 bp, Homo sapiens
  chr14:35024362-35024454
  hypo
gacagaatgcacattcggactcagcagatacagcaaaggtggggcctaagagtctgcactctttaattaattaatttatttatttatttatt

SEQ ID NO: 76667 - DNA, 30 bp, Homo sapiens
  chr14:35032127-35032157
  hypo
cacagtgcggcatcacggcacacagactgg

SEQ ID NO: 76668 - DNA, 43 bp, Homo sapiens
  chr14:35133216-35133259
  hypo
tgggattacaggcgtgagccacggtgcccggcccagtataatt

SEQ ID NO: 76669 - DNA, 35 bp, Homo sapiens
  chr14:35507693-35507728
  hypo
cctcctcaagacttacgaatagagcgccgcccggg

SEQ ID NO: 76670 - DNA, 30 bp, Homo sapiens
  chr14:35838869-35838899
  hypo
ggcctccggaggcaccggggatcatatgtc

SEQ ID NO: 76671 - DNA, 107 bp, Homo sapiens
  chr14:35866805-35866912
  hypo
actggaatatgagctcgggtcccgtctctcccacctgcactccgcgctggtgcctgggctcagctcccgtgctatgggctttcatctcatcacgcctttccatgcag

SEQ ID NO: 76672 - DNA, 404 bp, Homo sapiens
  chr14:36002600-36003004
  hyper
agaagcacttaagagcgcagacgcccaggacccagccgcgctcgggcgtcccgactcggaggctggcggcgggcaggcacgctctcccgcgctgagagcccttctgcggagatgaactctcgagtgtcgccgccgcgcgcgggcccgatcgataccggcgggcggacgtgctcccgccgccgacagcagccacagggcggtgcagtcagctgtccggccgctcggtcgcacttctcatcagctcaatacccgcagaggacgtgcaccggttccctcccggacacccaccccgtggtctccgccgcaccttctgcccaccgccccttccgctcggccgtccggcgcagagcgggagcttttcagccagacgccctcgcgttgggggcagccgggtcccggcccga

SEQ ID NO: 76673 - DNA, 411 bp, Homo sapiens
  chr14:36003546-36003957
  hyper
ggccccagggggcgccgcccttcttggaggaggctcccagcgcctccttgcccggcgcggagcgggcgacaccccccacccgagaggaaccaggaaaggggttgacggcggaggcggcccgggaacagtcggggtcgccatgtcgggcggctggggtgagcccggggacgggcgggcgggaaggcgcggagtggcgggcgggtggcagggaaggtcccgggcccagccccagccccagccccagtccagcgaagccggcaggcgcagagctgcgtcgggcgttcctggagcgctgcctcagctcgcccgtctccgccgagtctttccccgggggcgccgccgccgtggccgctttctcctgctccgtggcgccagcagccgcaccgaccccgggggagcagtttctgctgc

SEQ ID NO: 76674 - DNA, 655 bp, Homo sapiens; identical to SEQ ID NO: 4075
  chr14:36004080-36004735
  hyper

SEQ ID NO: 76675 - DNA, 101 bp, Homo sapiens; identical to SEQ ID NO: 4076
  chr14:36004821-36004922
  hyper

SEQ ID NO: 76676 - DNA, 3 bp, Homo sapiens
  chr14:36005011-36005014
  hyper
cgg

SEQ ID NO: 76677 - DNA, 93 bp, Homo sapiens
  chr14:36458302-36458395
  hypo
gccatcaccattctacgccatttcactccacagcagctggaatggctgacagtgttccaataattgtcttagttttggcgagtgttccacact

SEQ ID NO: 76678 - DNA, 30 bp, Homo sapiens
  chr14:36790254-36790284
  hypo
attggaaaactcacacggaattatcatgat

SEQ ID NO: 76679 - DNA, 516 bp, Homo sapiens
  chr14:36972706-36973222
  hyper
ctgactttattcttacggaattaaacacaataatttttttaaaatatcttctttgaggcaagtgaccacgagagcacctgttatttaaaagtttattgggtagtttaaaaagcggtgtctccctcttcccccttcaaaaataaatggcattgaagtcctccgtttctcttgtttagatcctgcggttggctcgctcatgaatattaactgagaaaggtgaagcagtaatttagggaatcgaatcaaactcactaggagcaaagaagtggtcctgaatcaaaatggaataaacgataacccagagtcattgtcaagtctcccaaatgaagagatgttctgggtaaataaaagtgacaaagtcgtaccacataaacaaatgtagaagatagatgccccagatcaagaaatactactaaagtgacctgacttgacagtaattgcaggcagcttttgagaactgcatcggggttaaacggcagagatcctgacgacctgggcgaccgtccctgcgcagcc

SEQ ID NO: 76680 - DNA, 412 bp, Homo sapiens; identical to SEQ ID NO: 35203
  chr14:36973454-36973866
  hyper

SEQ ID NO: 76681 - DNA, 293 bp, Homo sapiens
  chr14:36974507-36974800
  hyper
gagatgaaacaaattcgcccaaaagatagaaatctttgcctcggaaattatcggagaatattaacggagagggaggggagcgcgcgggtcgccgaggaaggacgcgggtacggccccttgctttggggtggcagagccgggctcaggagccagccaagctgacttcgcgaggtggcgcctgggcctttcgggggaaagccccgacggcggagccgcggctgggcggggactcaaatgctggcggcctctgggctggggccgagcagggggtgccgaccgcgggaagtctgggc

SEQ ID NO: 76682 - DNA, 127 bp, Homo sapiens; identical to SEQ ID NO: 35205
  chr14:36974801-36974928
  hyper

SEQ ID NO: 76683 - DNA, 262 bp, Homo sapiens; identical to SEQ ID NO: 35206
  chr14:36974967-36975229
  hyper

SEQ ID NO: 76684 - DNA, 252 bp, Homo sapiens
  chr14:36975280-36975532
  hyper
cggggagccgggatccgccttccatcctgggaaacgactcgggttagggaagcgggatgggctccgctcggagttcccaggcagctggggcgccctccaagtgacgcctttgtccaggctgcgctcgcggagaataaagggggcgctgtccaacctcaggttcggggaaaaccaaggaaccaagggactctttttctaaaatgccctctccaaactacagggaggaggaatgggacacgtgtgcagaaaaag

SEQ ID NO: 76685 - DNA, 30 bp, Homo sapiens
  chr14:36976704-36976734
  hyper
tgtcctcccattttgcggaaccagggagcc

SEQ ID NO: 76686 - DNA, 587 bp, Homo sapiens
  chr14:36977343-36977930
  hyper
caaagaaagattgtgcgttaagatcttttttaaaaatccctgcaagttagagtttgcatcatcgtcgtgacctagtgaactaatatttgtatattctgggatcgaaattccgaggaagtttctgctcttccgcacaccagacttgccggtgtggtctccaggaggggttgggggccgcgtcctcagggggcgcgcggccgaggctgttcccagcgcgggaacgggagggagaacctgggcaggggcggggcggggcggggcgcggggacctgggtacgcggagacgcggggcgggcgggggccgagagcgaggctgccggctgggtgttgggagagaggccgcgggtggacggggtaaggactgggactggggagactgagagctggggggtgcggggaggatgaggctgcggacaggaaacgaagggcctgggacagctgcttctcttggtcctagaaaccaaactttcgtagcgagagaccctaagacagctcgagatttcaagtgtccacacttctagtttagacatttggcaaccaattcggaacagccgggccgcgaggggcccccaggtctttggcggcgt

SEQ ID NO: 76687 - DNA, 714 bp, Homo sapiens
  chr14:36977974-36978688
  hyper
cgcagactccccgccagtcccggccacacccagccagggctttgcagctccagcctgagaatgttagccccggcaaccccttctggcggttgttcctttaaaaaccaattcattttttccatcaagtcttctacccaatgggtagactcttcgttaaatgactgttaaccagtactgaggagaagcacaatcaacatagtttctctgtcacctttcttgccggttttttcctcccaaccatggagtctccattttctaagcaattaaattatatattcaacaggaacattccatttaaaatggttcgggacagaagactgatgcacaaggtctgaagctggaagaaaatatttagtgcttgcctacagattctgtcacccatcatctgctcggaatgcgctccgtatctttcagcgtgtccggctcttatgattgcaaatggccctgttttcaaatggaaataagacttgcaaactgattatgtgtattgaatcagaatcactcgctagatcctcttgtttaaaatgtattgaaaaaaggatgatgggtgcagacctctgtaaccagctctgtctcttctctgggaggtcgatctattttgcaactttttgccatttgagcgtgtttcagccagataattacgttgccattgtgttaccggcccaaagctcagacagggtacacacaccaccacccagccgtctcccaggccct

SEQ ID NO: 76688 - DNA, 67 bp, Homo sapiens; identical to SEQ ID NO: 35211
  chr14:36979742-36979809
  hyper

SEQ ID NO: 76689 - DNA, 857 bp, Homo sapiens
  chr14:36981839-36982696
  hyper
gaacatggtgtccagcgtctcctaaccaggatctagccgagcagagaaaacattcagcctcctccctcccaatacccgtgtctgtcactttctttccattcaaaaagaaagtcctagttgaactaaacaagccagtaacccatgcctaagaatcatatcatctcagattctcatctcccaatgggctttctagttctccacaaataaaatcgtctactctgcttcctcgcgctaataattggggggtggggagcagggaagggagagcgatgtctggagacatatgatcagaattcaaggcagcttctcacaactctcttgtttatagaaaatgaatgtctgcctggcttgcttttagttcagaaaaggggtcagtctttatcagcacggttcacacagatcctggattttttttcccttatcttaaattgacccgcttttaagataaagacataatagagaaagcattgaccttacctggtccctaatgagttggaagtcagaaaacccggctctcatttcctcttatctggatcgcctgagaagagactcgcgctaccttttgtgcactcgcgcctcgagatagcccctcactgacgcctggacgcggtgagcgcgctgaaggctgtgcggcctctaaagtctcagaattcctccctgcggcctcaaaattggagagttggattccagaccaagacactgtcactagagctccctagccctggcccaggaagatttaaaatcccttaaaatcccttagacttgctcccgagcaagtctttccctatgaaaggccaaactctaagcttcgtgaagaagcctcctacaaggacactggtctggagcgcccgggcctc

SEQ ID NO: 76690 - DNA, 673 bp, Homo sapiens
  chr14:36982869-36983542
  hyper
cgcagtgtgtacccttgttggtagcggcagcagcccgggatccctgtctcccctgctcagagcatctctgtctcgctcttctccccgcttctgagcttggcccagtccctgaccccctcgctagctgagagagctgctttccttcctctcctgcccacagctcccagttcccaggctggggccagggtggggagcagctttgggatgctaaacatcaaaaaagcccagcctggggtttcagggcccgaagccactagagcggctctccaaggctctcgagaaagtcctagtgtttacatggcgaagtgggggtggggagaggaggaaggggggtgcagtgtgcaaaatctcccccactcctctcagccgttggggcctagggatgggtagggtactttggcggaggcaaagcttcgcggtgatctcggggtgaaccgtacttgctcccaaacctcggaagcttccaagcacctcagcgccaggggcatcctcagaatgctgatttctccgagaggggaggccagaaattgggcacgagttgatgcaggagattcccagaaaggaggactgtcggctttccagaagccgacggtgctgtaggggcggagggtgtccccaggttgcggaaccctcttgcactgctcccagcgcgcacctatttccctaatgaaac

SEQ ID NO: 76691 - DNA, 57 bp, Homo sapiens
  chr14:36983543-36983600
  hyper
cttcagattgcgttctaggtctcttcccgcagctgcgacaattcccccagccgggag

SEQ ID NO: 76692 - DNA, 940 bp, Homo sapiens
  chr14:36983673-36984613
  hyper
cgattgagttcacctttccccgggacaagtaaacagacttcaaactatgccgactgtagacggcgaggagaagaatgtatttgatggaaactccatccaatgcaaagatgataaggccgagggtgccacagcctactaaaattgtgactcccaaaggcttcctcccagctagaatggggtgcggggcagccgccagaaccacagccgggcaccgccagccaggtccccgcccgggcttgggctaggctggggcaggttaagcgaagctccaattccgtgggatccggacctagagccaaacagcagctgcagtatccatgtcccctgcccggccggcctgagctgggtgccttagccacctacactcccggtcccggaaccacagctgaccattccaacgcaagtggtcaaatttgtttgttttccaaaacgtgagacctgttaaaatctcccttccccgccttccaacaagcactctcactagacccaaccatcctcttgggaatcttcgagtccctctggctgttggaaactgtgtctcagcagtgaggcccaggtttctgagggagaaagcccggcctagcccacagtcttaaggcaccacgccagaggaggctccaggaagttaacaaagaggactgctgggcccggagcgaggactccggccagtctgctttcctcacaagctcttggtgggggagcgggagagagggattgggaagagatgcagacgaataacgaaatgagagaggggaagagaggaagaaaaagaaagttgaaaacctgggcgagaagtgagtacatgccaaataagaatcaattgcccataatccaatacttccaggcctagaggaaagtgctgggaggggcgtctgcccgcagctggctcagctgcctttcgaccggagatttggcaagggtgacccggaagggctacagc

SEQ ID NO: 76693 - DNA, 98 bp, Homo sapiens
  chr14:36985841-36985939
  hyper
tccaacttttgacagcgttttacagctacaagttcacattaaacaaactattttcgcggagggcggtcgccgctgagcctaggcggccagagggtgcc

SEQ ID NO: 76694 - DNA, 332 bp, Homo sapiens
  chr14:36986140-36986472
  hyper
tgtgccccgccctagcgtggaaaacccatttgaatcaccaaaaaaagacaccccaaagctgttttatgcccttctctgcttaaagattccttgagattggatgcgcttggttgtttttcattttctttttttaaaaaaaaaaacccacaaattttagggggggaaaaaaagaaagacgtccagcagtttggcctttgtggtttttttgttccttggtctaaacgcggccaggttgttaagaaaagtcgaagcgcgtggagcagcggtggatggtggtctgtgtggcgggcaggagggaagcggtgaggcagagcgctgggctagggccggcc

SEQ ID NO: 76695 - DNA, 852 bp, Homo sapiens
  chr14:36987301-36988153
  hyper
gcccggcccgccccaaccgacggcgccctcctgacccaggcagcctagcgctggggcccaagaggcccatccgcggggaactgccagcgcctgccccaggccgtaccgtcgagggggctgtactggagcgctcacagccccaaccctggctgccctccctcagtctcagttccctctttcgaaccaaaagacgcagtgggggaaaggccgcttctgctcctttcgtgcccagcccgggtcagagcattaggattagctggccacaggcggcgaactgggctcaggccgggagctggggtcctacggtagaccccagtttggagaggttaggagagggggtgttgacttccaaaagctggagcccccagacgctttgcctcttggcttctctcctgtcaggccccagtgagggcacctgctcggacccttagagtcccctctggaactgcgagtcctcccacctgcccagactccgctggagagagggccgggccgggcgctcgagtgcctcccaacagggcagcctccctcctggcccggtctagcctctccgcgctctgctcgcccctgctccttgagctcggggtcgcttcccttggctccccgaggtcttctgcgccgagcagagctgccagtccaccgcgcctaggagacgccgagtacccgcatctgaccgcaggaccccagcgctaccaagtgcctgttcttggacccccagccgagcagggggaagcatccccagctcccgcacccaagtccctggcgccgctgccgggccgccctccctgatgcccagcgcgcagcctgccggcgccgcgccttctggacggctctcgccgcacctcctgagct

SEQ ID NO: 76696 - DNA, 93 bp, Homo sapiens
  chr14:36988551-36988644
  hyper
ctcatcgacatgattcggcggcggctggaggaggaaggaagaggaggaaaaaaaagggagagggggaaggcgaagcctcgctgcttttttttt

SEQ ID NO: 76697 - DNA, 155 bp, Homo sapiens
  chr14:36989186-36989341
  hyper
tcggtcggggttccccgggcacggacaggtctttaggaggagggggctgagggacagggtgggggtttcacctgagcctgccggggctgctcctccctcccgccgcggcctcccagccccgcgccttcccactgcctccggaccacatcgggctt

SEQ ID NO: 76698 - DNA, 1131 bp, Homo sapiens
  chr14:36989403-36990534
  hyper
cgcactgttggtctacgtgtctgtcagtctgtctgcctctcttctgccgccgtcagagggacacctctgctccccgccccctttccccctaccggagagaatccgagcgggcggagggggcgctgagtaggggatcgactgcctcccggaggctgtcccggatccccgagccacaacccgcccccgcagctcaggggtttttcagtgggccacccccgctaacacgcctcccccaaggtcttccccccccccccccacccccggccgagcaaacacagcactggcccccagagctgggaggatgggaaggggtctcacgggagggtccgtcactgaagttgccccacctcgaacaaacctggtgtccctgaccctcgcccatctcccagacacgcggggatctggggctggagctgactttccgaggacatcacagccccagcacccgagcccagagccacgctgttttcccctctgatgcttcagggagcgcgcgagcagggagcggcgtgagtgcccgtctgtctgttgccgggcggaactgagcctgaaccccggcggctggagcgctggccaggagggggcgaatgccgaggtgcgggcagctcagcgggcgggaggctgggccgaggctcgcctccgcccgcagctcagccatgcaaaagtgctcttgcttcccgggaataaccaaatatctttgtttaaagtggtggcgtaaatggccagtcgctttgtggccacgctggatattagtagatgaggatcattctgcttcaattgggcgcctctcatccgacgagcaagaaactgcttaggaggaagagggtttcctgtctgcgcgttcccaggcttcaagtgtgggccccgcgccttgagggtccttgggcgcctggcgagggggagctgtgggctgcgctccccagcggaatcgggggtgtcccccgcgttgctccggccaggccggggcctgcagccgagtcgactaccgagtggagcactgaacggcgcggattttgagaccgactccggtttttgtccttggattttaaacgtttttatcattgtttttgttttgctttctccttagctgttttagtctcctctgcgcgccaggggctgggagggcggagc

SEQ ID NO: 76699 - DNA, 498 bp, Homo sapiens; identical to SEQ ID NO: 35223
  chr14:36990535-36991033
  hyper

SEQ ID NO: 76700 - DNA, 243 bp, Homo sapiens
  chr14:36991094-36991337
  hyper
cgacgccgggcttaagcgaaccacagaggagaactggcaacgctgaatacagaccttgtctgcaggcgcgacctggccgggcctgagtcccgaatggggtctaattgcgaaggcggggtgggtttcccagtcacccagcttctttctctcactcgccattatttcatagttgtttgtaagtttaaggaacaccaagtgtagaatgttgtacatctcttccagtctcaacgccatttagaaatg

SEQ ID NO: 76701 - DNA, 199 bp, Homo sapiens; identical to SEQ ID NO: 35225
  chr14:36991579-36991778
  hyper

SEQ ID NO: 76702 - DNA, 176 bp, Homo sapiens; identical to SEQ ID NO: 35226
  chr14:36991988-36992164
  hyper

SEQ ID NO: 76703 - DNA, 280 bp, Homo sapiens; identical to SEQ ID NO: 35227
  chr14:36992221-36992501
  hyper

SEQ ID NO: 76704 - DNA, 37 bp, Homo sapiens
  chr14:36993177-36993214
  hyper
aaccccccagtgcctcgagaaacgctgaggaaacaca

SEQ ID NO: 76705 - DNA, 50 bp, Homo sapiens; identical to SEQ ID NO: 11824
  chr14:36993438-36993488
  hyper

SEQ ID NO: 76706 - DNA, 1316 bp, Homo sapiens
  chr14:36993693-36995009
  hyper
cgcgggagcccggggcgtgcagacaggcggctttcacagacgcagcgggaggaaggatccctctactgctccctttcccgatttgaccgtctagggcctttgagaggactttccttttgggaaagcttttctcaattcgtggcctgtgggcaggctggggggtggggcgccaagtcatccgagcgcggcttctgcttctccctttccctcacaggcatgctctacggagggtatgggaggcgagggcgcgtctatgagggccagagtccgcgaagagagtccggcccttaggcctttggtgttgaagaatctgctcctctgtcgggtcaagccccactagaagttaacacctgtggtctccaaacttgcctattttcctgtcacgcagttcaagccaagattcaactcgtcttgaatttttgtatttagagcccctaccttctccaccgactccaggggcgccctctggcgggaaggggcctggggtaggagggaacctgagggagcgggttacaaagcagagaacagcgggagctcagcagctccctttgaattgcgaggaaaccaagacggagacgggaggtaggagcacgggcctgaagcggtcagccgaccctgtgaggcccgcgctgccgtgctacgccgcgaatccgccagacgcccccgtcggaaggggcagggacaccctcgggggcgctctagggttcgtgctgcgctaaggtaagtttcgcagctgctcctgataattaaaggacagattcccgaagcatccttgtggcggcgcggctgttttcgccccaggacctgtgcagcctcattcagctttaggtagtcgaaacctatagctctttctgccctctgttccccaacaaatctcagtcccaacagtgggagcccgtgggccttgggtgttcgagtttcccgcgggcttgccagcagcgctggggttccctcctccgctcctttcctcctctccaacctcccaccacagcccgtctcccccacatccccaacacttgtcccaggcagtttccggtggccgcagtatcgaccccaggccattggggtgggtgtgagggaagggtggagggggaatctccgaggcccaatgttttctgggacttgagggaggctgaattctccctcgctgcctaggacttggggtctgaaggttgcagaccgaggcgatccgcagcgccctcttccggcggccgtctggagaactgcagctttagagcggtctcggggaagctttgctactagtttccggctagggaaaactggtggtggtcggagactggtagtacatcatccac

SEQ ID NO: 76707 - DNA, 63 bp, Homo sapiens; identical to SEQ ID NO: 35231
  chr14:36995010-36995073
  hyper

SEQ ID NO: 76708 - DNA, 33 bp, Homo sapiens
  chr14:37050213-37050246
  hyper
cggcggctggaggggcgccgcacttctcctggg

SEQ ID NO: 76709 - DNA, 39 bp, Homo sapiens
  chr14:37050500-37050539
  hyper
aggtaccgctgctgccggaagcgccgctccaactccagc

SEQ ID NO: 76710 - DNA, 152 bp, Homo sapiens
  chr14:37051044-37051196
  hyper
gggtgggggtaaactcgccaacactggccatcccagacggaggcctggagatcgtggccgtgttttcaggcatggagagggggcggggggtggggtgggggcggcaggtggcggcgcgttttaaatttcaattattccgacctctagaaatc

SEQ ID NO: 76711 - DNA, 364 bp, Homo sapiens
  chr14:37051599-37051963
  hyper
aggaggggaaggaggcgggggcagggcaggctgggaacggaggggcggccgggacgccgctcctacggatgggcgtgggaggcgctcgccatgcgctggcagccgggatattagcgcatttacagcggaatctctgtttatataaacagctcttcccacccaggccgctttgaaagccgaggtccgggtctccagggtgttaagtacctgaatgagcactggaccagagccggggcgagcccggaaggtgccacctccgcccccgccccgccccgcaccccgccccgcaccccgccccttggcgcccagttacctcccagaggctgcaggaagcagcatttggcattagcgattctgtctgatt

SEQ ID NO: 76712 - DNA, 190 bp, Homo sapiens; identical to SEQ ID NO: 4091
  chr14:37116105-37116295
  hyper

SEQ ID NO: 76713 - DNA, 870 bp, Homo sapiens
  chr14:37116771-37117641
  hyper
cgtggctgctcttggtgcctcatgggagcgcccggggtagggactcggctagtgacctgtaggacatgaggggcgagctgggagccgattcgcccacggcgtctccttcgccatggaggccccccacccattccactccggggttgcggccacgcaccataagagcaccttcaggtctgagctctttaggggtgggagtaggcagttcgtgagtccgggaaggcctgcggggtttcccgcctgctgcggacttagcgtggggccgaccggggctggcgagggctggcgaggactggcggggacccgcggggctgagccagctctcgcgaagccctcaagtgaggaacggcgcttgtggctgcgcgctctccgcagccaagttgcagggtccagcaggggctcaggtcctgttccctccgcagatcccggatctagggctctagtggtctcggccggagggaaggtgacgcgcagtgggcgcagacgcagagtgcggggcgccgaacgtgggaaggagcgggttcagcgcgctggtgagagtttcaggaaatccgggagagggcggtatttaccagtcccttccccgagagcaaccaggcaaatcggggaaggttagaggtgggggacctgcctgagccgggacaaaaaactttggagctagggccttctaaccctggagacttgccgactccggggcgggctctcgcactcaagtcccgagatgggatgattttccaactttcgtccagcctctccttccgctcccgccgctctgctagcactcccgcactctctccctgggtcacaaccctcgcctgcggaatacctgtctgaagggcgcgtcagtagaagcttcgtttcatactacct

SEQ ID NO: 76714 - DNA, 858 bp, Homo sapiens
  chr14:37123336-37124194
  hyper
ctagaaagccacagccgctgtggaggaggtaagaggtcagctctttcgttggtcctggtgagggtaaaatttttaggcaggaggagcactgactggcaaagggaagaggaaagggttcgccctggaccccacaaatccgcctcttggagcaaacagcctgcaggtagaggggcctattagagcctgcccagttcccgggagggccaaccccagccagtaagaagacctgaggcgtaggatccctgcgcaggaggttgcaggaatgcccccgctagccgcaaggttcctgctggcctgtagagctttcgtgatccccgccaagatgcgaacagtaaggtcctcgtatggatcgcagtttttgtccgaaacctgaaaacactaacttgggatttcgcagttctggccctcgggcccgcctcggaggcgcacccccaatccccacggaacgaattccgcggctaaaatgcattttcccaaggcagtaaaagtgacccctgcacctaacaacctttgggctttctcttctcctgactaccacctctcgcagggtgcgctgaaatctctttatcgttatcgttttttataaatgaaatgatttatttattcgctgtttgcagggaatgaaaggagttgatcctgactccaagatgcattccaaagaaagaaaacgcaactgtagcccggactccgcggaggaaggccaactgactccactacgtgcacttccgagccacttgggcccagctagctgtgttaattatgggttctaattttattgcaactcggcacctcctggtttgttcccactatagtggtcttaaaaagaaacacacacaggcataccccagaatgaatccc

SEQ ID NO: 76715 - DNA, 279 bp, Homo sapiens
  chr14:37124481-37124760
  hyper
cgtggactcttggccagcagtgaggaggacaaggttgcagatcctctttgctgcgggttctgggtccggccttgggcggcattctgtcttctaaagtgtggaggtgggtagaagagtgtccactttcagtgtagacacctgaggtatgggggcttctttgggggctccagcgtgagctgctcctgcagattagggaaatggagagaacaacaatggggacatggtggaattcagatttccccctgttaattaacaatatgatttcgcttagtccaagtg

SEQ ID NO: 76716 - DNA, 676 bp, Homo sapiens
  chr14:37124976-37125652
  hyper
gtagcccctgggggccgcaagagaatccgcccggtagggcatagaagatgggttttcggtgaatcgtgaaaagacatgatcgggtttcccttggagcatggtggagaatgatgcggagccttggggtcaatggagagttgagggtgcagagggatctgaaagggggaaccaaaaatatcgggctttgaaattctgtggattttcaaaggcggttcccaaccttgtcaaaaactacagtgggtgcgcgatctaatctggctcctataggtggcgctgtgacaaggtgcggtggccgggagaggcggctgggggactcgaagactgcgggaaattttctgcgactccgacgctaacccgctgctcccagcctccgcttcctgttttcgagggattagctaggactgtgcaacaccagtctccgctctcggagtcggcacgggggctggtgggtggcgggatgaactcggggaaggcgacaggctggaaacgcagctcctcgactttgcagcgcaccaaccccctatcgccccgtccgctgctcaggtgcgaggattcgccagacgccacaggactgggggcgactcgcaagggcatcatgccacctagaggaaacgcgcagtgagtgagccctgggtcactgaaaatgggagaacgttcgagtcggtcaagatgactc

SEQ ID NO: 76717 - DNA, 951 bp, Homo sapiens
  chr14:37125763-37126714
  hyper
cgtccggctctgatcagagtacagcgggctgggcctggcagcctgcaggcaacctggaccttgcaataaagctgcattcaacataactcagaccacagtgggagcccccgaagggcttcatgtgagtcccgaaaccagagtttagaggcgcggcctggttctcgtttatcttttccagacagcatttaggccaataaggtctttgaaaggaggcagccccaaagccctcaggccgacacctgagggcagggtctcaaacagctgtgcttgaagaaccggcaatcttgcttttcccacacgcagctgcacctctcctgagcgctgcagctgatggctgtatagtgaccacggactgcgtcctcctcacgaagctgcgcaacttctgctaatgctgcaaccctggcaagacgaaatccccctccctctggctagatcagcccagcctcccctcagggaccttcctgcccctccctacccctccctacccctaggccgctccccccttcctctgttgggatccgatccttgttcgctcttgcaatcccgcagcccggagttttgccccgtgcattaaaacatgttctctttcatttgcagatttaataaacaaacgtaaccatatcacatggagctccacactgtccttctgaaagcaattccgctgttgaaaactgaaaaatgggtgtaatttgctttcagaaagtaatgttagggtcacggcaatttctcgggccgttatttatttttactttaaagtctttaggaaagatttgcttatatgctcggaaaacttccaaatgcgcgaataccagcaatcccgctcgccttcaacgcgtggggtaagggggggtggggaacaattactgagtgacgctaatatggggaaactgaaaagaaatgtcgattgtttttattgtaatagaaggagtgagcaaacagaaaaaccaaccc

SEQ ID NO: 76718 - DNA, 816 bp, Homo sapiens; identical to SEQ ID NO: 35242
  chr14:37126964-37127780
  hyper

SEQ ID NO: 76719 - DNA, 197 bp, Homo sapiens
  chr14:37128139-37128336
  hyper
ggccagcgccgagtgtactggttcctcccacccagtgtagccccctccttcacactctcggcccggcttccagtctcccactgagtaaatatttatccagagagcgagtcgcccctcggaggaggcctcgacgcggctagggaaaggctttttggcttctccctggcctgagccagctgcaggccttactggtgttt

SEQ ID NO: 76720 - DNA, 167 bp, Homo sapiens
  chr14:37129080-37129247
  hyper
aactgctaaagctctcgcagagtccccagaccccccgcgggacatgaggtcttgcctgttcgtatgcgaacatccttgtacccgcctagcagccctgcagactgcaaattttccctgggtgcacggaagtagagcagatttggcgcagaggtcgatactcactgcct

SEQ ID NO: 76721 - DNA, 799 bp, Homo sapiens
  chr14:37130018-37130817
  hyper
ctgcaaaaaagcatacggtacactttagattagacttacagtgaataaaagtgaaaattcagaagtaggcagaacgacagggcctctggagcttaatggaagacgagggaattacatccatgtgcagcgtcggtgtccactgtcttgggactaagtctctttcatatttaaacaaaactctttcgagagggctcgctggtttggagaaccctcacaaacgctgccaccgagggccaggggcccaggacagtggctgaatgtggcagagccttgggctccgtagtgagtgccccacgcactggcaattggtcgacttggggctgtgcgctagcgttagccgcctgtggttcagttccccgcacacggcgtggcccgtgcctcgagcctgtgtggctagtggttggccggtccacctggactggggggtcgccgcaggaagctggcggtaggaggaacctccctggccttaacagtggcccccacctgtggctcgggctccccgcaacctcctggtttctttggccggcctatcttctcacacctgcgctctcgccacctggcatggactgaagtgaggtagaatcggcaggtgacacagatcctctcctgacagtccccagaggcccgcatgacagattttgctaagacaactccctcacccctgtgcacggtggcgcccgcctcccacctatagccttaacttcaattctgagatgtccatcgttccccggaggaggtctcctcgggccccttctcccttcgagtcattcacattcagaccaaacgctttcatttgttt

SEQ ID NO: 76722 - DNA, 200 bp, Homo sapiens
  chr14:37131143-37131343
  hyper
ttccttttgccctctcgcctcctcctcctgggaagaagcggaggcgccggcggtcggccgggatagcaacaggccgggccactgaggcggtgcggaaagtttctgtctgggagtgcggaactggggccgggttggtgtactgctcggagcaatgggtgagtggcggcgggggactctgtcagagccgggaagggagggag

SEQ ID NO: 76723 - DNA, 54 bp, Homo sapiens
  chr14:37131834-37131888
  hyper
acgctcggagaggcccggcatctcaccactttacttggccgtaggggcctccgg

SEQ ID NO: 76724 - DNA, 264 bp, Homo sapiens; identical to SEQ ID NO: 1144
  chr14:37132290-37132554
  hyper

SEQ ID NO: 76725 - DNA, 780 bp, Homo sapiens
  chr14:37132602-37133382
  hyper
cggccgccaaggtgcccacgccacccggggtgcctgccatccccggttcggtggccatgccgcgcacctggccctcctcgcactccgtcaccgacatcctgggcatccgctccatcaccgaccaaggtaggggctcagaggctgggcgtgtggatgtgcagcgtctgcccccgcactctcgcggaggtcccagtatctgcagcctcagggacactgtctttcccaccacctgaggctttttcctttggaaacgtaaggagtcttcctagggggtgttctgatctcattaacttgaaactcatgcccctggtttccttgccacacacagtcttctgcctcatctcaaactaccagacccataacatccccccatccccaacacatggttcgcattttccaccctcccccgcctctcgcgccgaggcagcctcagcccggcttgctcacttggagagtgcggccggggctggacttggggcgcagcccgggaggcccgagcctgcttggggctgccggctgcagactccgctgtgggcagagcagcttgcttggggatcactacggccgggagaagtctggccgggaggagtccagcacgccttggaaattgaagtattctccgattctggtaatcaggccaaatttgctcaggcaggaagttcaaatgtcacctaattggtttcgttcttatgcttcacttcattttcctcggaaatggaggtcccgaagttactactagtaacttgcatgtaactcattcccagacgaagtcatattcac

SEQ ID NO: 76726 - DNA, 86 bp, Homo sapiens; identical to SEQ ID NO: 35247
  chr14:37133668-37133754
  hyper

SEQ ID NO: 76727 - DNA, 36 bp, Homo sapiens
  chr14:37135739-37135775
  hyper
cgccgccccgcacgcggtgaacgggttggagaaggg

SEQ ID NO: 76728 - DNA, 15 bp, Homo sapiens
  chr14:37136003-37136018
  hyper
acccccgccaggggc

SEQ ID NO: 76729 - DNA, 324 bp, Homo sapiens; identical to SEQ ID NO: 35249
  chr14:37136294-37136618
  hyper

SEQ ID NO: 76730 - DNA, 52 bp, Homo sapiens
  chr14:37641710-37641762
  hyper
ttcgaggcgcagattcgtcgcgcgatctccggcgcgtcggaacctgttcgca

SEQ ID NO: 76731 - DNA, 30 bp, Homo sapiens
  chr14:37641962-37641992
  hyper
gcgccaagtacaaagcggggacgacacttg

SEQ ID NO: 76732 - DNA, 201 bp, Homo sapiens
  chr14:37666791-37666992
  hyper
ggtcttgggaaaactcgacgaggccaagtatgaggccacaagacaccgtttttagttccgcgttctccctcttctaatcctattaggttttgtccagacaacgttttgctctttcagaagagaaagagcgttctgcgctcgtcgtcttggattcgacaaccataagcatcccgttagggcaaccaccgcagcagactaagt

SEQ ID NO: 76733 - DNA, 438 bp, Homo sapiens
  chr14:38052765-38053203
  hyper
cgggacctggtgtcccgcggtccccgcccaggttcctggggcgcttttccgcaatggctggcgtggaagcgagagggggcccagtttttccttgccaggttgcgggtacagccagctccgcgccggggttgggcggcgcggccgggatgctgagagccctgcgtgctcagccaggggcgcagggcggcccttctgcccagcgcgccccgggcaccagggatggcttcccagctggaggccgggagggaggagagtaaatacccattctgcgggggcagccctcgggggatggttgcgaagggagaaacgaaaaataaatcagacaagagagccgtcccgcccctcctcgcccggtcctggcgggcggcgccactggtcctgcagcctcgggcgtgcccgcgcccccccgagcccagggggcgtcgcagcgggccgggc

SEQ ID NO: 76734 - DNA, 249 bp, Homo sapiens
  chr14:38057123-38057372
  hyper
acccctcccccatctcgggcgaaattcctaagaccagcgagcaggagcaccgcggcgggacggtcagcagcccctttccggccctggtcttcgggagctggcgaggtgaagaaatgtggaaacacccagacgaaaaggggatggggtgggggtcgcaggaaggcggcgccctcaggcagggtctccgcactccctcggaaccacagatgttttcttcctgacccaggggcgcggcgccccagcccgggc

SEQ ID NO: 76735 - DNA, 30 bp, Homo sapiens
  chr14:38057802-38057832
  hyper
actagaaaatgtctccggcaagtaacagag

SEQ ID NO: 76736 - DNA, 273 bp, Homo sapiens; identical to SEQ ID NO: 35253
  chr14:38060644-38060917
  hyper

SEQ ID NO: 76737 - DNA, 160 bp, Homo sapiens
  chr14:38061931-38062091
  hyper
cgagtgaagaagccccggagggcggggttagtggtgggcactggagggcggccgtccgggacctaacccgggggcaagtgcagagcactttgcagaacacgggacgcccccacccggggcaaatggctaagcgccctccccagaccgagcaaagatgtct

SEQ ID NO: 76738 - DNA, 30 bp, Homo sapiens
  chr14:38063973-38064003
  hyper
gggcagcggtggcaccgagaaggcgccccc

SEQ ID NO: 76739 - DNA, 30 bp, Homo sapiens
  chr14:38064995-38065025
  hyper
cccaaagttcaaccccgggagactggagaa

SEQ ID NO: 76740 - DNA, 30 bp, Homo sapiens
  chr14:38065668-38065698
  hyper
ggagagtcttcccaacgcaaagtctcttta

SEQ ID NO: 76741 - DNA, 128 bp, Homo sapiens; identical to SEQ ID NO: 35255
  chr14:38072551-38072679
  hyper

SEQ ID NO: 76742 - DNA, 175 bp, Homo sapiens
  chr14:38677313-38677488
  hyper
aaagtacagcagggacgcgggtggagcccttccaagcggcgcagccttatctttcccgagtgaacacctaggtggattcccaacaccgcgcctggcacgtttctggagggagtctcaagctcctccagagctcccagctgcgcgtcctcgtttctgcagtcgatattcctgtggg

SEQ ID NO: 76743 - DNA, 30 bp, Homo sapiens; identical to SEQ ID NO: 35257
  chr14:38678172-38678202
  hyper

SEQ ID NO: 76744 - DNA, 819 bp, Homo sapiens
  chr14:38678518-38679337
  hyper
gagggagggcgcaggcggcgggtgcgcgaggagaaagccccagccctggcagccccactggcccccctcagctgggatgttccccaatggcaccgcctcctctccttcctcctctcctagccccagcccgggcagctgcggcgaaggcggcggcagcaggggccccggggccggcgctgcggacggcatggaggagccagggcgaaatgcgtcccagaacgggaccttgagcgagggccagggcagcgccatcctgatctctttcatctactccgtggtgtgcctggtggggctgtgtgggaactctatggtcatctacgtgatcctgcgctatgccaagatgaagacggccaccaacatctacatcctaaatctggccattgctgatgagctgctcatgctcagcgtgcccttcctagtcacctccacgttgttgcgccactggcccttcggtgcgctgctctgccgcctcgtgctcagcgtggacgcggtcaacatgttcaccagcatctactgtctgactgtgctcagcgtggaccgctacgtggccgtggtgcatcccatcaaggcggcccgctaccgccggcccaccgtggccaaggtagtaaacctgggcgtgtgggtgctatcgctgctcgtcatcctgcccatcgtggtcttctctcgcaccgcggccaacagcgacggcacggtggcttgcaacatgctcatgccagagcccgctcaacgctggctggtgggcttcgtgttgtacacatttctcatgggcttcctgctgcccgtgggggctatctgcctgtgctacgtgctcatcattgc

SEQ ID NO: 76745 - DNA, 182 bp, Homo sapiens
  chr14:38679732-38679914
  hyper
gtaatggcacctgcacgtcccggatcacgacgctctgagcccgggccacgcaggggctctgagcccgggccacgcaggggccctgagccaaaagagggggagaatgagaagggaaggccgggtgcgaaagggacggtatccagggcgccagggtgctgtcgggataacgtggggctaggaca

SEQ ID NO: 76746 - DNA, 30 bp, Homo sapiens
  chr14:38680274-38680304
  hyper
cccctactggagtcccgggaatgaccgctc

SEQ ID NO: 76747 - DNA, 376 bp, Homo sapiens
  chr14:38724150-38724526
  hyper
ttgaagggtagacatcgtgctctgtgatccccatcgaggaatctcaggaatagatgttactgaattgtcttgttcagggacaagtggtgtctctcccagcttctcgtcgaccctgattggccatgttctctgcggcacggggctggttgcagtggccggcgggcgcctggtgggcaccccggtccccccaagggtcggctgtccttccccactggtcacacaagagcggccgtccttccccagctcgaagcccgtagcacattcgcaggcaaagcctcccaagtcgtctaggcagttagggagctctgcgcatttgccagcacggaggtacctcccggggcagggacacaacacatcgcccgagagtttgtcccag

SEQ ID NO: 76748 - DNA, 382 bp, Homo sapiens; identical to SEQ ID NO: 1146
  chr14:38724978-38725360
  hyper

SEQ ID NO: 76749 - DNA, 15 bp, Homo sapiens
  chr14:38725454-38725469
  hyper
cggagcgctgccagg

SEQ ID NO: 76750 - DNA, 23 bp, Homo sapiens
  chr14:40221669-40221692
  hypo
cgagagtccgtctcaaaaaaaaa

SEQ ID NO: 76751 - DNA, 382 bp, Homo sapiens
  chr14:42074205-42074587
  hyper
ttggtgcaactccaccgccctccagtgaagtcccagaagcgatcaagtttaaagtgaaagggggatggaagcattttttctccctatgccttcggagtctgtggcttcagtttgctgcaggttctctccgtggacttctcagaaacctcaactttccacttcgagggacagaaagctacaaggaaaacgctgatggttttggtggagattctcctggacttcagtggtgtcctctggtacatctgtccgcggtgtccctttggtttatttctgtggtcttcctgcgcagtccctcagcggctcggagtttggccttccagctctccaactcagatcctgagcctcctaagctcccgcggagaccctgaagtcccggatctgg

SEQ ID NO: 76752 - DNA, 175 bp, Homo sapiens
  chr14:42074668-42074843
  hyper
cgtggcttgagtggattcctaagccaaggattggatccggagtaccaggggcagagagggggagcagaggaaagaaaggagatgtgaggagtttccacctaaagcacttcactcctcgtgttcttccccgacagagatagctgtgtggttcttccttacgcgtgggtgcaggtgt

SEQ ID NO: 76753 - DNA, 226 bp, Homo sapiens
  chr14:42075097-42075323
  hyper
ggtgctctcagtgtccgaagaccacgtgctggtgaacccacaatgagaagcgaaagggtttcaggactctagcagaaaggaagagcaagatttcactcagggtttcttagaagaaagagttaactttgctcactggcttttccaggatggagggagtggggatagggtcggggagagaagcattgggagtcttgtcggagtctcaagcaaaaccaggcgagggctc

SEQ ID NO: 76754 - DNA, 414 bp, Homo sapiens
  chr14:42075396-42075810
  hyper
cgtctgtgccggtgaccttagagactaggtctggcttatgaagactgttgggctccctttctgcccttcacatagtaaaatgtgaccaactgcagtattcgtaatgtctgatgctgagctgagttgattcccaaatataaatgttcttttcagaatccgctcccatctgattagtaagcaaatcaccacccacaactaaggggacagcggaagccagcctcagatgactgaaacccccaagtcagtagctctcctcaaaatttccggcgggttattatagataatgacttttcccaccgccctaagcagccgaagcttgactcagtgatgattctctctatcccgtaactgcgaggaagtgggcgatcagcaaattgcccttttgcaggaggctggggacgcccctggaagttc

SEQ ID NO: 76755 - DNA, 233 bp, Homo sapiens
  chr14:42075811-42076044
  hyper
ctttcattctccaggttttctgccttttcccttcccccttcctgcaacgcccccgcgcctcctcagcctggggatttcctggcgcttcgccggccctctccgcaaccccctgataaatcggttcagaaccagtctggctgggaggcccgagggctgacagcagcggagcggccccggccggggtctcacggactctcggggtctggccgacacggccgctcccgtcactgcag

SEQ ID NO: 76756 - DNA, 281 bp, Homo sapiens
  chr14:42076105-42076386
  hyper
cgcagggctcagttccacgcggccaggaggccgccgttgcccacacgcgacgctttgggaagcccagctcccgggtccgccccggccgcggccgcagccccggacctcggctgcttgcctcgcgcctgaactgcggactcgccccagcgcggtggccagcgggcggggcgctgtgttccgcggcgcgcagggaggcggtgagcgtgtgcagagctgcccgaacggaggactatgtatgtgtgtgcgcgtgtttgcgtgtgtttgagcgtgtttttccttct

SEQ ID NO: 76757 - DNA, 740 bp, Homo sapiens
  chr14:42076628-42077368
  hyper
ggcccttctgtgttccggaaagatcctggatgttggctaccttttcaagtcatcttggcatgtctctagtgttttgtaagccgctttccagctagctgcgtgtgtgtgtgcgcgcgcgtgtgtacgcgcgcgcctatctgatgcatttgactgtcttttatccaactgcccagaagcaaatgtgttaactcggcgatgccccttcatgcccgggttcttgcagagctctgaggacgcccagacccattttcctggctggatttggagcggctgctgggctgtggacccaggtgtgtggatcgctttacccagaagcttggaaagcgccaatattaacctgcttccaggtacatcacaaggtcaagagagtgtcttgcagccctcttgtttccgtgtatctacaccttcttctcttggccagaaggatatttacgttttggttcacagcatttgaagccaaaagttcagcccttcgaactggtttgctatacaaaacaaaacaaaacaaataaggtaatgaggattgcttattaaactgcttaacaaaatccccgactcttcctcagccctttctcggctccctcctccccaccaaaatgtcaccagctcttgaattacgtggattcgggttggaggagaacttgaaggaaacgtgattaaagggctatgcgagaacgctctctttgctgcccgcggtccggtgggcttcgaagccaatcgtgagaaggaccggttccctc

SEQ ID NO: 76758 - DNA, 231 bp, Homo sapiens
  chr14:42077488-42077719
  hyper
cgccctgcctctgcccgctccccgggcgcggagccgcgggtttcatggggcgattgcagcgattcccccacccagagcgacctgcgggcagcggcggcagtggcaggagccgcctttccgattccctacgatgcgggtgctgagctatggcaaagggcagcgaagtgacgagcgagacccgcgtacgactgtgaaagccacctggagccaccttgccgggattgtacctgc

SEQ ID NO: 76759 - DNA, 690 bp, Homo sapiens; identical to SEQ ID NO: 35271
  chr14:42078799-42079489
  hyper

SEQ ID NO: 76760 - DNA, 93 bp, Homo sapiens
  chr14:44004339-44004432
  hypo
tgggacctttttactttcactctgctcaataaagcctacagctttttctcttttggtctgtgtctctatcactcgccgcggtcagctgccgca

SEQ ID NO: 76761 - DNA, 25 bp, Homo sapiens
  chr14:45382862-45382887
  hypo
ggtctcgaaacgctagcctccagtt

SEQ ID NO: 76762 - DNA, 30 bp, Homo sapiens
  chr14:45434972-45435002
  hypo
accctaagaataccccgacaacttttcacc

SEQ ID NO: 76763 - DNA, 25 bp, Homo sapiens
  chr14:45997179-45997204
  hypo
agtgaaactccgtctcaaaaaaaaa

SEQ ID NO: 76764 - DNA, 81 bp, Homo sapiens
  chr14:46293369-46293450
  hypo
gcagggagtatacatcgcccaacccccatgatattgttccaaagaaggagaggatgatattactcgcaatattgcaggggg

SEQ ID NO: 76765 - DNA, 182 bp, Homo sapiens
  chr14:46443145-46443327
  hypo
ctacatcattgtgtgcgccaaatctttatactaaatctctttatatatattgtgtgttctatacaaacacacacacacacgtacgcatgcactcctcaacttatttgatttctcagatatcaccccatcctaagtcaaggagtatgctgaatgcatgtgactgtcaccgcacagaacagtca

SEQ ID NO: 76766 - DNA, 35 bp, Homo sapiens
  chr14:48095553-48095588
  hypo
attcttcttcctgtccgctacactgtgaggtgaca

SEQ ID NO: 76767 - DNA, 28 bp, Homo sapiens
  chr14:48135049-48135077
  hypo
caccatggactcctgcgttgcctcagcc

SEQ ID NO: 76768 - DNA, 486 bp, Homo sapiens; identical to SEQ ID NO: 35272
  chr14:48143051-48143537
  hyper

SEQ ID NO: 76769 - DNA, 102 bp, Homo sapiens; identical to SEQ ID NO: 11855
  chr14:48143617-48143719
  hyper

SEQ ID NO: 76770 - DNA, 161 bp, Homo sapiens; identical to SEQ ID NO: 35274
  chr14:48143797-48143958
  hyper

SEQ ID NO: 76771 - DNA, 406 bp, Homo sapiens
  chr14:48144358-48144764
  hyper
cgaaggtccccggaggggcgtcaagcggcgacagcggcccgcccgcccgcagtccgaagcccccagccctgctgtcttgccttcccccattccatcagttgccattgcaacgccaatcctgttacacgatacagactcgcatcgccgaacggggagaggaggaagaggaggaggaggaagaggaggaggaggaagaggaggagtggggctaggggaacgggggtggggaagagggaagggaggagggggaagaaggaggaggaaagggtccaacagggagcggagtgtgcgtctggagctcgcttgggcacaccagcccagccgccaccgccaccgctctccaaaatagcctttagcgcccggccagcgtagaggtgctctggccggccgcaccaattcccggagc

SEQ ID NO: 76772 - DNA, 126 bp, Homo sapiens; identical to SEQ ID NO: 4104
  chr14:48145236-48145362
  hyper

SEQ ID NO: 76773 - DNA, 218 bp, Homo sapiens
  chr14:48145469-48145687
  hyper
cgaggccggcggcatctggcctccaacctcccccgccaaagcgctccctcgcctctcggggagctccgcggtggcgaatgcccgttatgtatttctgatgccgccgtctgcgtttgcacgctgaagggccagctaccaccttagacccagggtaattacatgacacgctatctcctctccgccgcccaaggtcttccaggatccgttatgcttggcta

SEQ ID NO: 76774 - DNA, 30 bp, Homo sapiens
  chr14:48852289-48852319
  hypo
gagcacacaggtgagcgagtgcgggatccg

SEQ ID NO: 76775 - DNA, 45 bp, Homo sapiens
  chr14:50098049-50098094
  hypo
cagaagatttgcagccgggcgcggtggctcatgcctgtaatccca

SEQ ID NO: 76776 - DNA, 171 bp, Homo sapiens; identical to SEQ ID NO: 35279
  chr14:50155136-50155307
  hyper

SEQ ID NO: 76777 - DNA, 180 bp, Homo sapiens; identical to SEQ ID NO: 43975
  chr14:50233117-50233297
  hypo

SEQ ID NO: 76778 - DNA, 144 bp, Homo sapiens; identical to SEQ ID NO: 43976
  chr14:50233597-50233741
  hypo

SEQ ID NO: 76779 - DNA, 52 bp, Homo sapiens
  chr14:50287126-50287178
  hypo
gtcactgcatgacttcgctgaagttccttaccctctccgtttcagattctga

SEQ ID NO: 76780 - DNA, 30 bp, Homo sapiens
  chr14:50316746-50316776
  hypo
tgccaaagtaaggagcggagcaggaaggaa

SEQ ID NO: 76781 - DNA, 20 bp, Homo sapiens
  chr14:50333655-50333675
  hypo
caacctcgaatcagccgttt

SEQ ID NO: 76782 - DNA, 120 bp, Homo sapiens
  chr14:50333975-50334095
  hypo
accgcgcccggccagccgtttgcttttttaacagtgcaaaaaacaaggccgtgtctggctatatggggctttgcttgttcaaaatgtaacctctatacggccgcgcgcagtggctcacgc

SEQ ID NO: 76783 - DNA, 20 bp, Homo sapiens
  chr14:50334335-50334355
  hypo
gactccgtctcaaaaaaaaa

SEQ ID NO: 76784 - DNA, 39 bp, Homo sapiens
  chr14:50337688-50337727
  hypo
attacacgtgtgagccaccgcgcccggcctatatgtata

SEQ ID NO: 76785 - DNA, 29 bp, Homo sapiens
  chr14:50434015-50434044
  hypo
catttatgcataaacgatcacatgacatg

SEQ ID NO: 76786 - DNA, 53 bp, Homo sapiens
  chr14:50474165-50474218
  hypo
ttcctaaggtgatggcgaggtaggatgaggagtgtaaacggcccaccctgctc

SEQ ID NO: 76787 - DNA, 28 bp, Homo sapiens
  chr14:50681829-50681857
  hypo
aggcgtgagccaccgcgcccggcaaggt

SEQ ID NO: 76788 - DNA, 77 bp, Homo sapiens
  chr14:50777921-50777998
  hypo
agcgtagcctcttcttaaaacccttttaaatagcttcccgtggctcttagaataaaagtcaacgtgtggttaaaata

SEQ ID NO: 76789 - DNA, 20 bp, Homo sapiens
  chr14:50828512-50828532
  hypo
agccctggcagtcctcgctc

SEQ ID NO: 76790 - DNA, 18 bp, Homo sapiens
  chr14:50888271-50888289
  hypo
gcccggcaacaaaataaa

SEQ ID NO: 76791 - DNA, 469 bp, Homo sapiens
  chr14:51026665-51027134
  hyper
tttgtttgtgttttccgttgaaaatgttgcggtacgtggtctatcactgtcttcacggtctgggggtggactgaggtagggagggtgtgacgctggtatctgtgtgaactcgggcttgtgatgctgagcttggttcatctgctttctcctcccttttcctccccactccttcccaccagcgccacagcaacatcctcagagtctgagcgaactgcgcccagcgcgggcacggagcctcccaccgccagcaacctgcggccccggagaaggcagcgagcgcagtgacagcgcctcaccgccaccagctcctggaccaccatggccaagaaccgcagggacagaaacagttggggtgagtagcaaatgagaacttctgcagcctgcacggggtcttctggccctccactttctgcttctgtggagacagggagggccaagggctgctaggtgcctgcgtccacggctggga

SEQ ID NO: 76792 - DNA, 36 bp, Homo sapiens
  chr14:51027845-51027881
  hyper
ggtgggcggtgctcacgcaggcggagaagaacgggc

SEQ ID NO: 76793 - DNA, 35 bp, Homo sapiens
  chr14:51338697-51338732
  hyper
gtgtgtgtgtgtggccgcgaacagcctgacccggg

SEQ ID NO: 76794 - DNA, 49 bp, Homo sapiens; identical to SEQ ID NO: 35282
  chr14:51410296-51410345
  hyper

SEQ ID NO: 76795 - DNA, 171 bp, Homo sapiens
  chr14:51410569-51410740
  hyper
tgtgaagtggacaggcgagaggggcctgggcttttgcccacctggcggtttccaggggcggacggcacagtggtttgggcgggacactggcgggtggcacctcggagacatgagttcggcgtctgttgggaggcctaatctgtcccccaggctgcccgcccacagcctaga

SEQ ID NO: 76796 - DNA, 126 bp, Homo sapiens
  chr14:51411033-51411159
  hyper
tcttcagctctgccacgttctccacgcccacgatgccgcggatgctgatctgccgccgcttctcctggtccgtcaggggcttcgccatggctggggcggcgggctgcgcggcgggctgcgcagaga

SEQ ID NO: 76797 - DNA, 427 bp, Homo sapiens
  chr14:51560287-51560714
  hyper
ggtctggcccagagccgggctcatcagtattccgcctgcggcgtctccccgaccctccgccgtgcctcaccaggtccgcctatccagcagcgacagactcccgccgtccgcgcgaccccaccgcccccatcccagtccctccccgagggttcgcagcccgccctgccctcgagcgtgcctagcggccctgggcactggcgcggctctacccagctatgcagtgctttcccacacactggccgcggccactggctgcagacccgccgcggaaagggggcgccctgagtcccgctcgcaggcagcgcgccccgagagacccgctctaaggcatccccgcaacaactctgtgggggcattcaactcccccgtgcgccggttaagattcccccatgcctcctgcaatgcaccagaccagggaggtaaacat

SEQ ID NO: 76798 - DNA, 523 bp, Homo sapiens; identical to SEQ ID NO: 1148
  chr14:51560770-51561293
  hyper

SEQ ID NO: 76799 - DNA, 718 bp, Homo sapiens
  chr14:51561294-51562012
  hyper
gggcaccggggccagggccggtgacaagtgggtggccggtggcggcatagccgggggaaacacgcggacgccgttgggggacttctggcacggggtagtgggggcgctggcgaaccccccgtaggagccatagccgctgtccgcctcgctgtataggctcatcttgtccaggtccagatagtcatagtcggagaccccggagcccgcggcccgatggctctggggggattcagactctggggtctgcaccaggatgttgcgggcgcacgcctgacacaaattgtgagagcagggcaggatgatgggctcccgatagaaggagccgcacacggggcatttcaactcctcttccatctcctccatggggaccggtctgggaggagacagcgacggctgcagcgggtgcctgagctggcgaggtggccgacgggcccgtcttgtccagcaccctggccagcggcggcggctgtggtggtggtgccttcccgcgcagcactggcacggacacccagagaggcgctagctctgtgagccgcagccgcgtagccgccgcgccgcgcgccagcccggaccgcccctacctgccctcctagtcccgccccggcccatgagcagcggcccattgggcggggggcaagagatcgaagctctcattggccaccagacccgtccgtctcctcgtctccgcaggccacagggggttcggtagagtctgagg

SEQ ID NO: 76800 - DNA, 425 bp, Homo sapiens; identical to SEQ ID NO: 35288
  chr14:51562235-51562660
  hyper

SEQ ID NO: 76801 - DNA, 165 bp, Homo sapiens
  chr14:51849769-51849934
  hypo
cccccgaggactctacgcatgagtgagacctattatttcctctcttctttttcaccatctcaggtgttggaaccggaataaacctgcgttccagttctagctccagaacttggttgccatgtgtcctaattagcaagtacatgatctttccgtgcctcagtttcc

SEQ ID NO: 76802 - DNA, 39 bp, Homo sapiens
  chr14:52119506-52119545
  hyper
aggtatggacagctgcggtccacccgtgtaagtgtaaag

SEQ ID NO: 76803 - DNA, 70 bp, Homo sapiens
  chr14:52226939-52227009
  hypo
ggtgatattattccccgaatcgcggggggtgcctcacccccccgtccatgtggatcgtcatatccagggt

SEQ ID NO: 76804 - DNA, 30 bp, Homo sapiens
  chr14:52241137-52241167
  hypo
caggggcggcgagggcgtggcttttactcc

SEQ ID NO: 76805 - DNA, 17 bp, Homo sapiens
  chr14:52321531-52321548
  hypo
gccgtggctctttctta

SEQ ID NO: 76806 - DNA, 23 bp, Homo sapiens
  chr14:52395020-52395043
  hypo
tacaggcgcggtggctcacgcct

SEQ ID NO: 76807 - DNA, 30 bp, Homo sapiens
  chr14:52484814-52484844
  hypo
atgagccaccatacccgggcaacagttaac

SEQ ID NO: 76808 - DNA, 447 bp, Homo sapiens
  chr14:52534580-52535027
  hyper
ccgagggcagcgccccgcgcttgacctcctcgtaagcgcctacctgctcccaggtggccaggaaggcgtgggtgggggtaaagcgcgcagagcgcgggaagccagcgcgcacatagcgggcggccaggcccagcactgcgggggaggtgtcctctcggtacaggactcggcctctgccgtggctcgtgtcgatgtccgccagaaaaggggcgatggccgggaagtcggtggggaaatcatagtccacatactgcgtttccctggggaagtcctgagtggagatgatgccgttggtgcccacctgggagaggagagggacaaaaaggtgacagtcgctcaagcccaaggacgctaccctttcgcgcagggagggaagggaactgacttaggcaaaaagcctctctctccttccccactggccagggagtctggattcagggaaacaag

SEQ ID NO: 76809 - DNA, 209 bp, Homo sapiens; identical to SEQ ID NO: 1151
  chr14:52535055-52535264
  hyper

SEQ ID NO: 76810 - DNA, 91 bp, Homo sapiens; identical to SEQ ID NO: 1152
  chr14:52535334-52535425
  hyper

SEQ ID NO: 76811 - DNA, 332 bp, Homo sapiens; identical to SEQ ID NO: 1153
  chr14:52535426-52535758
  hyper

SEQ ID NO: 76812 - DNA, 214 bp, Homo sapiens; identical to SEQ ID NO: 1154
  chr14:52535759-52535973
  hyper

SEQ ID NO: 76813 - DNA, 92 bp, Homo sapiens; identical to SEQ ID NO: 1155
  chr14:52535974-52536066
  hyper

SEQ ID NO: 76814 - DNA, 38 bp, Homo sapiens; identical to SEQ ID NO: 1156
  chr14:52536067-52536105
  hyper

SEQ ID NO: 76815 - DNA, 162 bp, Homo sapiens
  chr14:52536342-52536504
  hyper
cgcttcgctccacccagagacgccctgaggagaagcgagcctttgtacgaaggcagagggctgactcctaagttctgtccccctcccgaaggccggccgctagggaagacttggccaccctctggaagtaccttcccccgggaaaaccgcagcaggaaagac

SEQ ID NO: 76816 - DNA, 44 bp, Homo sapiens
  chr14:52734481-52734525
  hyper
gggccctcgcccttccgcagccttcactccagccctctgctccc

SEQ ID NO: 76817 - DNA, 476 bp, Homo sapiens; identical to SEQ ID NO: 35298
  chr14:52734526-52735002
  hyper

SEQ ID NO: 76818 - DNA, 380 bp, Homo sapiens; identical to SEQ ID NO: 35299
  chr14:52735044-52735424
  hyper

SEQ ID NO: 76819 - DNA, 34 bp, Homo sapiens
  chr14:52735451-52735485
  hyper
cggatcgggatggacgcggcgccaggcgagctgc

SEQ ID NO: 76820 - DNA, 96 bp, Homo sapiens
  chr14:52735486-52735582
  hyper
ccctgggccaggaaggtttgctgctgagttccccaaattggattccttccacagccccgagatataactcagtttgcggagcgaaatgagggaaag

SEQ ID NO: 76821 - DNA, 46 bp, Homo sapiens
  chr14:52780697-52780743
  hyper
ccgaggtcagactgccgtgcgcttcgagtaccggaccccgaggaag

SEQ ID NO: 76822 - DNA, 30 bp, Homo sapiens
  chr14:52780977-52781007
  hyper
cgggggcggagacgacggctcccctaggct

SEQ ID NO: 76823 - DNA, 554 bp, Homo sapiens
  chr14:52781428-52781982
  hyper
gggtgcagcgccggccgcaggagctccctctccttgttccacgtgctggtgaccgagctggtgttcaccgacctgctcgggacctgcctcatcagcccagtggtactggcttcgtacgcgcggaaccagaccctggtggcactggcgcccgagagccgcgcgtgcacctacttcgctttcgccatgaccttcttcagcctggccacgatgctcatgctcttcgccatggccctggagcgctacctctcgatcgggcacccctacttctaccagcgccgcgtctcgcgctccgggggcctggccgtgctgcctgtcatctatgcagtctccctgctcttctgctcgctgccgctgctggactatgggcagtacgtccagtactgccccgggacctggtgcttcatccggcacgggcggaccgcttacctgcagctgtacgccaccctgctgctgcttctcattgtctcggtgctcgcctgcaacttcagtgtcattctcaacctcatccgcatgcaccgccgaagccggagaagccgctgcggaccttccctggg

SEQ ID NO: 76824 - DNA, 89 bp, Homo sapiens
  chr14:52940008-52940097
  hypo
atataccccagacaacgctgctgctttgatttcatcaataaacatctggtgatgcttgtttatacaaagtgccacgttacatattttgc

SEQ ID NO: 76825 - DNA, 30 bp, Homo sapiens
  chr14:53259141-53259171
  hypo
ggtttagaaacctttcgttaggagaagaaa

SEQ ID NO: 76826 - DNA, 1018 bp, Homo sapiens
  chr14:53416802-53417820
  hyper
tcctcattcttttatcgttctgtcagtaaatgttaagaattaacgagttccccggcacacatcccccgtcccgcgtaactacgcaattaaggttataattgggaggctcgaatcattacatatgaaaattcagagaatagcaaaacaaaataagacgcaaaggggaacaggtctatctgcttaaatactgaaagattttacatctccaaaaagcatttgcgagatgccaagatttctcaaatgggcccctcccccgtcgtgagcctctttcctccccctaccaattctgggaagtcattagttggacgcggctgggatgctactcaccgagtttctccaccagcttaagcatcacgcctccaatgtgcacctcgccggtcactctcagggtgacatcgcggttcaggtccgtcacatggacactcagttcccacgtcccgtccgcgtagcagccatctggcatccttatcccgtccagagccatggctccttcctgcgagcgcggaggaaatggctctcgtaagcgtcactcccccaaagaaaggcgaatcccaccgaattcgcagcgccggccacgggctgggaggtggtggaggacccggggctttcggcagaaactcgggagggcggcggcggccggggctgcgggaggaccctacgccccgctcgccccgcagcgttcctcggtcccggcgccgcccgccccacaccgtccccgcctagcggaccgcggagggcttcacctgccggccggccccgagacacagcgcgggctgactccccgttcccctccccgccgcgccccctcgggtcccggcggggtcccgctccctcaccgcgcgctcctagcgctccgggcccgggactcgcgcggcaacaggcgaggggctggaggctcgcggggcggcggtgtccgcgtccggttcctcggctggcgaagcgctgcctgtggccggagcggctaatggagtcccgtcgtcgcggcccctcgcctggctccccgcgctccaccctctcc

SEQ ID NO: 76827 - DNA, 30 bp, Homo sapiens
  chr14:53819535-53819565
  hypo
ccccaagggaagaatcggggcaaagtaacg

SEQ ID NO: 76828 - DNA, 222 bp, Homo sapiens
  chr14:54421079-54421301
  hyper
agatcttaatgtggccgaggttttacaactcccgacccggcgcagaaaggaaatcccaccatgttccccggagtcgagaaaacggtgaacagctttcggcctgcgctcgacctctgcgtctgcgtctctctcgcctcggcttcccttattttttaaaccaccaccacactccttcccccgccacttccttcccccacccccttcctccgttgcaccagcagc

SEQ ID NO: 76829 - DNA, 584 bp, Homo sapiens
  chr14:54422341-54422925
  hyper
cttcaactcacaaaccgcgatccttggaaaccatcctccaaagcagtgcttggaggcctctaaggcccccggaccaactcccgctggaagaagcctgcagggactcgggaatcacgggaacctttcccgtcggttccgggcctggagggccaggaagagccgcgcgtccgcctttcgtcccgccaggaactccccataggacacgacaccgcaggaacaagcgtcctgggagcccctgggatcttggctgtcgtctctagggaccctacaccgtgaaatgatagaggcgaggttccttgggttccgcaagtcgacgaaaatagctcgtggagaaggcgcgtcctgcaactgcagttcgcaagctctcagggcgccccgccagctgggggccagattgggtgacactcccctcgacgcagcctccggagcggcgcgcactctccagaggccagcaggactgcgctctctaccgcagaacctgctccagctaggtgttctctccccatctcgccgtcgctctgccccctcactctctctggacctcagagccggttctctccttcctcctcccgcgctttccgtcc

SEQ ID NO: 76830 - DNA, 45 bp, Homo sapiens
  chr14:54422926-54422971
  hyper
gggatcgcaacctccagcccgtgggcaacgcgttcagcccaagac

SEQ ID NO: 76831 - DNA, 106 bp, Homo sapiens
  chr14:54423369-54423475
  hyper
tcgagatagcttggacgggaatcccatcggggagacaagctagatactcagccggagcagcagcggcgtctcaggctcgcgtccctcagctcggatgccacactca

SEQ ID NO: 76832 - DNA, 461 bp, Homo sapiens
  chr14:54430146-54430607
  hyper
tacttccccgatgtccgctaactaacgtaaagaaacgtccgcgtgctccgctgataccccagggccaccggaggagagcagtggggtgtgagaactaggctgtgtccagtggctggtggtggggggagcggctactgcgccttccccttgggcactcctctcgggtccctgaggcgacgccctagtaagcctccacgcacgtcagcgaagggtgggtggagggtcaccctgaccgcgccccacagctggctcccgcgctctgcccaccgccacgccaccttcaccgcgcgatctcggcactcccgcctttctcttgccctcgttatttttagttcggctgctgcacctccctgcctgcaacagctcgccccactctcagactcgttttgcaggatttgtgcccctggtggctaacctgatccacacttgaataaacagcgagcgcccgggcaacctgggcg

SEQ ID NO: 76833 - DNA, 30 bp, Homo sapiens
  chr14:54687020-54687050
  hyper
ctcctccggagcccccggctgcattcccgt

SEQ ID NO: 76834 - DNA, 42 bp, Homo sapiens
  chr14:54687254-54687296
  hyper
tggggagaggggttccgtttcgggtcacggtcctgccttgta

SEQ ID NO: 76835 - DNA, 17 bp, Homo sapiens
  chr14:55370202-55370219
  hypo
cttaaaatccatttccg

SEQ ID NO: 76836 - DNA, 39 bp, Homo sapiens; identical to SEQ ID NO: 43985
  chr14:55517158-55517197
  hypo

SEQ ID NO: 76837 - DNA, 233 bp, Homo sapiens
  chr14:55519752-55519985
  hypo
cattctaagtgggggcgaatagaaactataaatagcttcaggtcacattttgccaccatgtaagttttgtgccaaactagggcagataaagatttatggacctaaaagtaggcatcataaaagctaatatttgttgaggttttgctatattccaggcagcgactaagagatttgtttattaaaagttttacagcaaatctatgatgtgggtacgattccgatcttcctttgcc

SEQ ID NO: 76838 - DNA, 52 bp, Homo sapiens
  chr14:55596101-55596153
  hyper
gagggttcggctccccgggaccgggccggggcgcgcgcggagagccccacag

SEQ ID NO: 76839 - DNA, 30 bp, Homo sapiens; identical to SEQ ID NO: 15822
  chr14:55664068-55664098
  hypo

SEQ ID NO: 76840 - DNA, 321 bp, Homo sapiens
  chr14:55765285-55765606
  hypo
ttggcagggtggaggcggaggagggcgggcgccggagcccagccggagcgggcgttgaaggctggcgcggcgagcgctgttcggggctggagggggtaaggccggcaagggcggcctgaccctccaggaggccatccagcggctgcgggacacggaggagatgttaagcaagaaacaggagttcctggagaagaaaatcgagcagaggcacggcaccaaaaacaagcccgcggccctccaggcactgaagcgtaagaagaggtatgagaagcagctggcgcagatcgacggtacattatcaaccatcgagttccagcagca

SEQ ID NO: 76841 - DNA, 74 bp, Homo sapiens
  chr14:55766010-55766084
  hypo
gcaggcaggttccatcgctctcgactctcactccaaagcagtagggccgcattgctgctcgctctctgcatagc

SEQ ID NO: 76842 - DNA, 30 bp, Homo sapiens; identical to SEQ ID NO: 43988
  chr14:56077686-56077716
  hypo

SEQ ID NO: 76843 - DNA, 267 bp, Homo sapiens; identical to SEQ ID NO: 43989
  chr14:57045520-57045787
  hypo

SEQ ID NO: 76844 - DNA, 232 bp, Homo sapiens; identical to SEQ ID NO: 35308
  chr14:57260863-57261095
  hyper

SEQ ID NO: 76845 - DNA, 234 bp, Homo sapiens; identical to SEQ ID NO: 1159
  chr14:57261174-57261408
  hyper

SEQ ID NO: 76846 - DNA, 415 bp, Homo sapiens; identical to SEQ ID NO: 35310
  chr14:57261465-57261880
  hyper

SEQ ID NO: 76847 - DNA, 262 bp, Homo sapiens
  chr14:57261965-57262227
  hyper
cgcgaaggaggcctcaaccttaggacaacccgggcgtcccgggcgaaggtctcgatctgccggagccactgcctttcaggcatcgctccattaaagccagggaggagagggtcattggccagcgacccgccctccttacgtccggaggtcaccccacgcctacaggcaggtttttctgtctcctttgcagaacactatgcgtttgttacaacgattaaatgaagaacacagaagtctctggctctgccgggcagaacgcctc

SEQ ID NO: 76848 - DNA, 850 bp, Homo sapiens
  chr14:57263796-57264646
  hyper
agggcggaaacggggcgactaggggaatcaggttttatcagagcaccctgcgctgacaggctcgggcggtttagaagagaaaatcagaggtgctcagggcacctggtcacaaacctgggcatgcagatgcctgatgggggcttggaccctttcgtggcacgaaaaggagagagactgctgttcatcttaaaagtctcgaaggaggcaaaaacccaggcggaagtcatggctgactctgatcctgcatcttctcattctggttgttttccaccgcgtctgctcccatttgcgtgggatgcgctggtctcctgcccgactcttttgtgttcctcttttgcatgattaaaaacacgtttctatatgcactaaaccatcacctagcactggcacgcctggttttgggttacagctttgtccgtataataacagcgaagttctccctgggtgtgagatgcgggttcgaacatgtggtgtgcgcgccagggctggccgcttccggttaagtggacgcggggacttgactgcgtcccctgccttgcaggtaactggaatgggttgcctggcaagttggccctgcccgggacgccgaagggaccgcttccccattccagagcctgcctctggccttcagggccgctgacaggtccgaaaagaaagagaaggcactcagttttaaaaaaaagagatctagaggactggggaaaaggggatgagccaaggcaaactgggaattgctcgggcttcccccgaaagcctcagctcagtgccgggggagaccccaacggagggccagactcccccaaatccagtggccgaagacctggatttcctgggaggatccccgggggcc

SEQ ID NO: 76849 - DNA, 43 bp, Homo sapiens; identical to SEQ ID NO: 1162
  chr14:57264764-57264807
  hyper

SEQ ID NO: 76850 - DNA, 209 bp, Homo sapiens
  chr14:57265147-57265356
  hyper
gccctgggaccggcgcccccgaggcctgagaactacgcccggggggcgcgggctgaggctcaagagaggtcctaggtgcgggccagggatggagccagcccagagagaaaggggaaaacccggcaaggcaagagcctcagtctcgcccctgcctggcccgccaggctgtgagtggggcccattgggcagcgccaacctggggagtccgg

SEQ ID NO: 76851 - DNA, 208 bp, Homo sapiens
  chr14:57265469-57265677
  hyper
cgcggcggagagcgggccgcccggcaccacgttccttctggcagttccgccccagcctcccagcgtcttgcgcctgtggcggcggcagtacgggcctggggggtcacccacaggaaaggtgagattagcagcaccatgtgggagaggggttgaggaaacccaccattatctaaaacttggaggtttccaaagccggaacttaattgag

SEQ ID NO: 76852 - DNA, 36 bp, Homo sapiens
  chr14:57270936-57270972
  hyper
agtgccacctcctctcgcatgaagatgtctgggtac

SEQ ID NO: 76853 - DNA, 96 bp, Homo sapiens; identical to SEQ ID NO: 35317
  chr14:57271153-57271249
  hyper

SEQ ID NO: 76854 - DNA, 37 bp, Homo sapiens
  chr14:57271647-57271684
  hyper
tggagggaacaactgcgaagcccgagagtgctaagga

SEQ ID NO: 76855 - DNA, 105 bp, Homo sapiens
  chr14:57272009-57272114
  hyper
agggtgttgcatccccggagggtgggcatggggaagaggggtgcgggagtgcagcagggctcacttacccgggtagcccacggaggggtgcagcaagtccatacc

SEQ ID NO: 76856 - DNA, 200 bp, Homo sapiens
  chr14:57272210-57272410
  hyper
cgggggtacccagctggaagatcttgatgcgcccggggtggacaggttcagagtccttggtgggtgggtttggagcagtggaactaagggcaaagcaaacaaacaaacagaggggctggtttactgcttcggaggcagcagctcttccacgttccagcactaacttaaaaagagcacggactaggcgaggcagaggcttt

SEQ ID NO: 76857 - DNA, 30 bp, Homo sapiens; identical to SEQ ID NO: 11888
  chr14:57273051-57273081
  hyper

SEQ ID NO: 76858 - DNA, 322 bp, Homo sapiens; identical to SEQ ID NO: 1166
  chr14:57274417-57274739
  hyper

SEQ ID NO: 76859 - DNA, 310 bp, Homo sapiens; identical to SEQ ID NO: 1167
  chr14:57274740-57275050
  hyper

SEQ ID NO: 76860 - DNA, 476 bp, Homo sapiens; identical to SEQ ID NO: 35324
  chr14:57275210-57275686
  hyper

SEQ ID NO: 76861 - DNA, 1168 bp, Homo sapiens
  chr14:57276073-57277241
  hyper
gggggttgggaggctgcgtaattacaacccagggtggtttggattttggggggtggtggatatttaaaaacaaaaaggagatctggaagcttttgggagaaacagacaaccgagctgtgctaggctgagggagaggaggccaaagagagcgagcagtgagcgccggggcggacgagaagccagcgctcccagcctcctcggttatccgctccggtttccgctcacgttcaacaggggccgacaggggctcgagcggcggcccccggcccaggccgacccgcaagcgaaccgagcttccggcgcgcgggcccaaggaggcgcctggctttttattattgttgtttcaatccatccatctagttacatctgcatctttttgtctcggactctaaaaaggtccctgggatccatccaaacgaccccaaccaaatctgggggccaaaacgcaaagatcgcgggagaagcccagaacggcgttgacataaaaacaaaaccacaaacaaaaccttccaaaacaccccagattacattcgcagcgtttcgacgacgttttgcagaagcgacgacccccaggagcacgctctctgcctctctcccactaccgctctcatctctagatcacatttttctttttgcaacgatcgttattacacctcaaaatttgtaagagaaaaaatacatccgcctacagaactccacgttcgcagaggggcatcggtcggtctattggaggtactggggtgatggccgacagacacggggacacgtagatatggatatagacaagacagacggacacttaccttacagcctcatgggaggttagaaaaagtcaaatatcctttaaattccaaatagccagctatcctaaaagaaatcaagagtattgagttagaaaccttgcagtcttcacccttccatgaaaagtcaaacacaaccaaaaaaaattttttttaaagaacgaaaatgaggaaggcggctagagttctaaacacgcgtgggcccctctgcaatacatacaaagtagatgtggcgagtgagggctgctctagcaatttttatttttaatcacagtggaggctgtgttggagctgaggccggtcccgctctcagggagatttgctgagaaagcgcctctctggcaactttttgacgcaaactctccaac

SEQ ID NO: 76862 - DNA, 884 bp, Homo sapiens
  chr14:57277879-57278763
  hyper
cttctctattccctacgcccttataaatatccttacacatataaataaatgatccccgagtgagagaccccggcttctggtaggttcctggggttttttggaattgagaagcccacgacagactgcagggaacacgaaccccggaatctaatctcagggcccatttaggagaagtagctgggaccacatcgggcctcgaggatgcgagtgtgaggtcgacaagatatcgtggaagagagcgaacgagggaggcccccgttggaaacagtttctgtgttagaacaaacgccaccaaacgaccgacactgcgaggcctggagctacctgggctggcgccgcccgagccccgggctgcgagcccagaggctgggaagtgatgggacctgggggcccgagccggagagtgcgacccccagcccaacttttttgcctggcatagaaagcagggaccggacaggtttcaaacggatccgagtccctagaaaagcaaaaacagactgggcggagtgtggggtggggggtggctagtggaactggtgagtgtgtgtgaataagctgggtgggggtgggagcagaagacagctcttgcttcacaacacccagtgcaggaaaagaaaaataaaatctcttcctaaataccccaccccccgccacccacccaccaccaactaccatcaccaccacggccagtgggcccaaagaaacagctcgctgcctttaatttggggacctatgttaatgaagttggtaattaattcgtcgctttgttgtcggttcttatactgtatgtgtactcaaatgtggccgtccttgggatttacagcaattaacgaattacgggagtgcgcacgaggcagcaagctctcggcagccgggctccggct

SEQ ID NO: 76863 - DNA, 728 bp, Homo sapiens; identical to SEQ ID NO: 1171
  chr14:57278837-57279565
  hyper

SEQ ID NO: 76864 - DNA, 30 bp, Homo sapiens
  chr14:57280814-57280844
  hyper
acaaaacccatattccgtgagaacatagcc

SEQ ID NO: 76865 - DNA, 126 bp, Homo sapiens; identical to SEQ ID NO: 35328
  chr14:57281138-57281264
  hyper

SEQ ID NO: 76866 - DNA, 110 bp, Homo sapiens; identical to SEQ ID NO: 1172
  chr14:57283299-57283409
  hyper

SEQ ID NO: 76867 - DNA, 592 bp, Homo sapiens; identical to SEQ ID NO: 1173
  chr14:57283445-57284037
  hyper

SEQ ID NO: 76868 - DNA, 624 bp, Homo sapiens
  chr14:57284070-57284694
  hyper
cgggactgggggacccctgggatcccgccctcgtagcggaaggagtggcagcccttggtgccgggcctggtccttgaggctgccggccctccggggcgccaggactcgaggacgcggtttgcccccgcagtcctaagatccccggggccgtgacagcttggggaaggggcaaactctgtttggtctccacgaagtgcttcgatgttcgcaaaagggtaggcccctcttgcttggggtcctacacccctcggaactggctctgcccctgcctcttccccagcacagtctcccagctaaggctcagacagccggggaaaggggcgcccccatcactattccccacaacccgccccagtgtgagccagggcgcggctgcaggctgacaggcgcaccgtgaccacgccgtcacttcccttcaccaaaggttagatgggaggcgtgcaccctctggggagttcgcaaagcttctcgctttgatcagccgcgcgcagtgccagggagagatattgctggggtctgagtccgtcggaagtgtctagaaaagaagagagaggagcaggtaatcagactttggcggctgccctggagacactttcacacatccagcctcgtggaggaggaagg

SEQ ID NO: 76869 - DNA, 242 bp, Homo sapiens
  chr14:58332163-58332405
  hyper
tcaccaggtcccctccgcacctccccccaaggctacgactgtttccaaactcctgggcgcacccagccgggccccttgccctctcacggttcagcaccgaggacagcggacatacttttctccccggggggtccccgccgccaggaaggcggtgttgacagcgtccgcagggctgcaggtgtccgtaccgcgcgcccgcccgtccgcatccccgcggcacccctgcgcgcccacctcccttc

SEQ ID NO: 76870 - DNA, 68 bp, Homo sapiens; identical to SEQ ID NO: 11902
  chr14:58332640-58332708
  hyper

SEQ ID NO: 76871 - DNA, 22 bp, Homo sapiens
  chr14:58404059-58404081
  hypo
acaggcgcgagccaccgcacct

SEQ ID NO: 76872 - DNA, 41 bp, Homo sapiens
  chr14:58410326-58410367
  hypo
ctcttcaccaatctgcgacttcccaccgcctccacacaacc

SEQ ID NO: 76873 - DNA, 39 bp, Homo sapiens
  chr14:58599573-58599612
  hypo
attacaggcgtgagccactgcgcccggccaacccttgtc

SEQ ID NO: 76874 - DNA, 100 bp, Homo sapiens; identical to SEQ ID NO: 35334
  chr14:58618341-58618441
  hyper

SEQ ID NO: 76875 - DNA, 60 bp, Homo sapiens
  chr14:58797784-58797844
  hyper
atttatgaaatgaaacgagtatagtcatatgtaatgaagggcatacgctatttctttcct

SEQ ID NO: 76876 - DNA, 40 bp, Homo sapiens; identical to SEQ ID NO: 43992
  chr14:58893188-58893228
  hypo

SEQ ID NO: 76877 - DNA, 36 bp, Homo sapiens
  chr14:58922879-58922915
  hypo
gaggctgttggttttcgaggccgccacagagttggg

SEQ ID NO: 76878 - DNA, 30 bp, Homo sapiens
  chr14:59014447-59014477
  hypo
taaatactcaggttacgcatgttgagctga

SEQ ID NO: 76879 - DNA, 30 bp, Homo sapiens
  chr14:59649485-59649515
  hypo
catagccagatagcacgggttggcaaacta

SEQ ID NO: 76880 - DNA, 6 bp, Homo sapiens
  chr14:59931116-59931122
  hyper
ggccgc

SEQ ID NO: 76881 - DNA, 246 bp, Homo sapiens
  chr14:59931193-59931439
  hyper
ggggcgccccgagcagctcccagggcaaggagaagcccagggccgtcagccaggcgcccgccagcagctgcagcgcgcggcggcggccgatcttctcccgcggcggccgcacgatagcgcagtaacggtccaacgagatgagcgccacgctgagcgtggacacgatgccgaagcacgagctgaagaagcggctggcggcgcagaagccgcgccagggccccgcggcggcggcaggcgccgaacccc

SEQ ID NO: 76882 - DNA, 112 bp, Homo sapiens
  chr14:59931719-59931831
  hyper
ggacccgccaaggccgccgccaccgggagcggcagctgtgccgcctccgcttgcgtcgctcaggttccccagcgccgcggtcgccacggtgctgaaggagagcacggccgcc

SEQ ID NO: 76883 - DNA, 352 bp, Homo sapiens
  chr14:60043255-60043607
  hyper
cccgctcagggttcccgctgagtgcctcctaagcgccacctctgaggagacgtcccttccagcgcccgaggggcgtcttacccacaacaaacagctgctccagcgcctcgaccgcgaccgaggagcccagggtggagggtaaggtgcataactccagggaggggccagtggagacggcagccgcctgcaccagcttctcgccagcgcccagccctggggtccaggggctcagggccattttgccgctctacttgagcgcctcctaagccagagccaaggattgccggttgccacgggcaacgaggacaccgaggtcgtggggcgccccctcgtggcccgcacctctagtagg

SEQ ID NO: 76884 - DNA, 54 bp, Homo sapiens; identical to SEQ ID NO: 11904
  chr14:60097193-60097247
  hyper

SEQ ID NO: 76885 - DNA, 266 bp, Homo sapiens
  chr14:60097406-60097672
  hyper
ggcagcgaatcagcgcggcgcggccccggagccgcctgcgcgcatggggatgcgggcgccgctccacgcgacagcgttggctgggctgcccaagggtgctaccctggagacgggtaaagcggttctggccgcgaaggcgctgacgcggacagtgggtgggaggtttgggaggaggggaaaaagggctgacggtgggggtgagaggaggaggacttgggctgttcctgggagttcttgactcccagaatatgcgaggtgcatattct

SEQ ID NO: 76886 - DNA, 260 bp, Homo sapiens
  chr14:60336793-60337053
  hyper
acttgtacccagactcgccagcagccagaatgctgctgtttgcctatgagaacaatttttaaagcggaaataatcatgataatgaaataaaaggatcaaaagcatcttgactttttctgagcctttgggaaaaataaaattgttgttttctaccagcccgcgaatattcccagtcgcccgtggcgacgcgggggtggggtcggcgctcaaggcagaaagcgcgaggcaggtgcccaggagagccgcgcagaaggggactg

SEQ ID NO: 76887 - DNA, 71 bp, Homo sapiens
  chr14:60385979-60386050
  hyper
cgatcatgggccctgcgagtctgtgggtagcggctcaccctgctggactgcgcagatccagagaacgacac

SEQ ID NO: 76888 - DNA, 686 bp, Homo sapiens
  chr14:60386051-60386737
  hyper
agacctgcggttgctttggtttgccttttactaagttcatttctcagcctctctgcccactctgaaaagtctcccctttccccccttttaattctactctattttgtaaattactgttgtctcctgaaaattttggaatgcttaaaaggcactcaaaagcctgtccgagatcgactagaagaccctcggaaggtccctctcttctctggacctcactgggcgttcgtttgcccgcgccgtccttccattcggcttgccgggcgcgcagcggcttgcggctgtggtcagccaccttcccgggaggcggtggtcgctggccgcgggaaggatgccgcgctgggggtcggggttcgtcccggctgtcacgccaccttgtgacatcacagggccatgccctcggggctcaaggccagagaggctccgcgcttccaggacccgagagctaaagataatgaatgggagagagcgagactggaggaggtaacgaataagtccccaccaccttgcccataacgcgttgctttcagtcacgttccgcgaactggcgaaggtaagtgaaaagataagcgcaggtacagaaaaacctgccagcgagaagctcccgccgtttcccaggagccccaggtggggtcttccggttggacccctgcttccgctgattggttggaggtcgccaccacgtgatg

SEQ ID NO: 76889 - DNA, 407 bp, Homo sapiens
  chr14:60794473-60794880
  hyper
ttaaaaaaatatcctcgtggcttaatgaccaaggcgggtttattctcaaggaagggggagcggcgtggtggtgttactaaacataacagatggcagctgtctgcggctatatagggcgcgctgacaaatccctctggatggccacgcggcgctgggctgcggggcctgggtgcacttcgcgcctggctcggagggcgccgcctgcgggaggacctccgggagccgagctgcctccccgcaaacccggcccgggcccacgcgggctcagggcgccaggcggggtgcgccgaggtgcagctccccggccctaggcttcgctggggtgggggtcgaggcctctccgcgggtggctccctccaccctgccgccccgcctcgcggctgggagttgcccgggagctgtgaatt

SEQ ID NO: 76890 - DNA, 30 bp, Homo sapiens
  chr14:60798457-60798487
  hyper
gccttctgactgcatcgccctctgccttat

SEQ ID NO: 76891 - DNA, 132 bp, Homo sapiens
  chr14:60951858-60951990
  hyper
ggatatatttcgtaacgaccttttcaatatagcattcttcacaggaacatgtgggcagagccagaactggaagacgagaggcccccttgagcccatggcgacattcccagccccttcccgggccaagcccaa

SEQ ID NO: 76892 - DNA, 225 bp, Homo sapiens; identical to SEQ ID NO: 1175
  chr14:60952195-60952420
  hyper

SEQ ID NO: 76893 - DNA, 117 bp, Homo sapiens; identical to SEQ ID NO: 1176
  chr14:60952516-60952633
  hyper

SEQ ID NO: 76894 - DNA, 230 bp, Homo sapiens; identical to SEQ ID NO: 35345
  chr14:60952729-60952959
  hyper

SEQ ID NO: 76895 - DNA, 769 bp, Homo sapiens; identical to SEQ ID NO: 35346
  chr14:60973239-60974008
  hyper

SEQ ID NO: 76896 - DNA, 15 bp, Homo sapiens
  chr14:60974077-60974092
  hyper
cgatgtttctttcta

SEQ ID NO: 76897 - DNA, 47 bp, Homo sapiens; identical to SEQ ID NO: 35348
  chr14:60974368-60974415
  hyper

SEQ ID NO: 76898 - DNA, 505 bp, Homo sapiens
  chr14:60975384-60975889
  hyper
gaaaaatgagaagatcgcttccccccaccggcttcctgctcccaccgcaaggtttgctgtttcgttacaactaaacttgcgaattctcggagcatttcagtttggcccagtcctctttgtcctctggagacctctcgaccgagacaacgcatcgccccaaagtgaattcctgaattcctgtggcatcactgcctatttggtgggaaaaagggagggaggggtagagcggggtgggggagggaggagtagtgaacgctgccgcactcgcctctctttttctcccagacactcgcatgtcttttcaacctccaggttctgcaaaatactgaagaaaagtccaggagctaacggcgggcgctgtcgagcacggggaggtgctgaaatagtcctggcgtgctgattcaagctttgattggcagagccacccggtgactgacagggggtctccatggcgcccgcgccgccaatccgcccaccccaatagcggagccagctcgcctgccgg

SEQ ID NO: 76899 - DNA, 536 bp, Homo sapiens; identical to SEQ ID NO: 35350
  chr14:60976074-60976610
  hyper

SEQ ID NO: 76900 - DNA, 58 bp, Homo sapiens
  chr14:60976802-60976860
  hyper
cggtctgtcttgggttaagagccctgcgttctgggctcctggccgggagttcccttgc

SEQ ID NO: 76901 - DNA, 429 bp, Homo sapiens
  chr14:60977284-60977713
  hyper
ttttgcggaagagcccggcctcatcccccaggcccaaatgctccttacaatcctttttgcctttaggtcgggccgacccgatccaacgcgatcgcgggagcacttgctcaggcgtaagccccaggcagacgcaccgttagaaatggtatcccatgtccctgggaccgatctgtccttgtcacccacacttcgtttatttcctgacagtcctgtaaatctcccaaaagtgcacaacaaacagggaggacactgcaagcccagtatataaaagacctgggagctgcggcgctgagaaagggcgcgaatcatggtggggcacaacagtagggacccgcggaggggcggccgcggactcctgcccgacctctgtcgccttgccgagtaatcctcgccttaactgctggggtcttcggaagaacctctagccgc

SEQ ID NO: 76902 - DNA, 410 bp, Homo sapiens; identical to SEQ ID NO: 35352
  chr14:60977879-60978289
  hyper

SEQ ID NO: 76903 - DNA, 30 bp, Homo sapiens
  chr14:60978879-60978909
  hyper
tgtccacttgacactcgtttacatgaagtg

SEQ ID NO: 76904 - DNA, 656 bp, Homo sapiens
  chr14:60981157-60981813
  hyper
ggtcaggctcttttccggcttataaacatttcaaccacactccagtttcaccaaaaaaaacgacggcccctgctccccaaatgccgcagttcctctcgcctccactttaatgacccactccacttccacccgtcactccctcctttcccttcgccagtttgtttataaaaaatctgggagggaggggagaagacgatgggggtggggagggcttgctctttgtttacattaaacaaatgacaggcaaagagctcaagcaaagtcttccttgacctcgttccctctccctaattttaacaaaaaggaaaaaaatattgtatccaaagagaatgtgaatggggcgggaggagaggagaagcagcttttcgctctattcaacggggacgcgagagcgcggacgatttccgctccttttgtgaggcggagcccgggggcggccgtgaatggggggtctgtggagcggccggcggggctgtcaggcggctctgcgtaatcagggctaatgacggcggccgggcgctcggcgggacaatgcgcggggccgcggggttttgtcggcctgaatggctaataggtttgcctgtgagctgcgagggggcggtgtcggggaggaggcggcggcgaggggagaaggggtcattgtccgcgcgctggcc

SEQ ID NO: 76905 - DNA, 396 bp, Homo sapiens; identical to SEQ ID NO: 35354
  chr14:60981972-60982368
  hyper

SEQ ID NO: 76906 - DNA, 426 bp, Homo sapiens; identical to SEQ ID NO: 35355
  chr14:60982573-60982999
  hyper

SEQ ID NO: 76907 - DNA, 15 bp, Homo sapiens
  chr14:61104140-61104155
  hyper
cctaccccccagtgc

SEQ ID NO: 76908 - DNA, 316 bp, Homo sapiens; identical to SEQ ID NO: 1182
  chr14:61104241-61104557
  hyper

SEQ ID NO: 76909 - DNA, 241 bp, Homo sapiens; identical to SEQ ID NO: 1183
  chr14:61104623-61104864
  hyper

SEQ ID NO: 76910 - DNA, 254 bp, Homo sapiens
  chr14:61108567-61108821
  hyper
cgcgacagcctgacccgaagcgcgctgcagacctaggctggtgccttccccttggggccagggctgtgcgtgggggacaaggccgctgctctccctagggccgctggctaagaaggaaatacctgacctggccccaccaagaaagtggagctcctccacccccagttctgctggagacactagaagccagggcccctctctctgccgcgggaagttctagcgacaagcccagaaagtgacgtcctctctacctg

SEQ ID NO: 76911 - DNA, 1157 bp, Homo sapiens
  chr14:61109111-61110268
  hyper
cagccgggtgtccagcgccgctcacgtgcctcgcctggagcttagctctcagactccgaagagggcgactgagacttgggcctgggagttggcttcggggtacccaaggcgacgacagctgagttgtaccacgaagctcaggccgaggcctcctcccttgtctggccttcgaatccatactggcagcctctcctctcaggcactccgcgggccgggccactaggccccctgctcctggagctgcgctatgatccgggtcttgagatgcgcgcgattctctctgaaccggtggagaggaggctctgccccgcgcggagcgaggacagcggcgcccgagcttcccgcgcctctccagggcccaatggcaagaacagcctccgaagtgcgcggatgacaggaaaagatcttcagttcttctgccgctagagaagtgcgggatacaagcctctattggatccacaacctggagtcctgccttcggactttgccaaagacttgcaggcggtggggaggcagtaggaaatgaagccccctccagcctcagccgccgccgcgttcggtgcagcagcagcagtgccactgccacagagcagaggaaggcccgctccgcgcgagttctgtgccaggtgtcccgttggccctcagcggacaagggagagccgctaataagggtcgctgctcagcaaactcagagctcatccataagtgccaacgccactgcttctttctggaagcttccactccggcccggggtccggccccagccacgctgtcctagcccagagaacaggttcaagaacggtggtgcccagccccagcggtgcccttctccgtccctgtagctcgctgggctcttgagcccctacccactaagccaaaaattcgggaaccgggagccaaaccccttggcctctgagaatttaggaagcttcgttttcagccaagaggtcaaggcgagcagagagtggggactcgaacaatcgcgtgtttaggtttaaaacgttaaaaaataaacatcactcgagtgttttttttttttttcatttcacttggcacaatgctgtatggtttcgtcctacaaactatttataagccgttgttcattacttttggctaccgttatgacatctgtagaggagaaacgaaaagtggcttta

SEQ ID NO: 76912 - DNA, 197 bp, Homo sapiens
  chr14:61110508-61110705
  hyper
catctggaatatgcgcgctctggatttagtgccaggggttttacaaagagtttatgactgtgacagaaaattgtccttttaacaagtttacaagcagtaatcacgggggcttttacaggaccagcgctcttgctcctcgccggatctgcagacatttccaagattcaccaactaagggagcaggaagtgggccgggg

SEQ ID NO: 76913 - DNA, 58 bp, Homo sapiens
  chr14:61110749-61110807
  hyper
cggagctgggagagtggagggtagtcaccggagtaggaagagacggcatgtaagaaat

SEQ ID NO: 76914 - DNA, 608 bp, Homo sapiens
  chr14:61114114-61114722
  hyper
caggctgccagcgggcgcggcgcgctggggcgtcagtccgggcactcggtaccggttaacttcaggatttcgcttccctcgccgcttccgccttccgagtgctcgtcagtcctcccgactcctagcgcctgtctgtctcctttctttccccttatcctcacagtctctgtctcccgacaagcccatttcagcagaatttatcctggctctggttttccaccaagacaagaaagggagcaagatcttcggcccctagtcttggaagcgaacaaaggaaaacctaaccggcccctgcgctcaggttttcccccaaactctttggcttcgcggagcgctctccccgccacagccacctccccaccgtccttctgaatctctgtccgaaacgctatagagaacagaaggagcctgcccaggtggccgaaggtgttgccccgaggtgggggaaagtagagaccaatttttaaaatattgccttgtgagctccagtgcgagagagggctgcgactggagaccctttcctcgtctgggcatgcggcgcggtcagccagaccgacgggctgcagtgccgggccacgcgcgagcgagcacggcgaggatcaaccctt

SEQ ID NO: 76915 - DNA, 1613 bp, Homo sapiens
  chr14:61114997-61116610
  hyper
caacatttcactgcccgttgatttagaaactcactctccacccaccactcatagccgcggccagccagggaggcataaagaccaaatctagcgccaatatttcccgacactcacatcccagagaaacccacgcgcgggtgctcaaagcaaatgaggccccatccttagcaaggaacctcagagttcatgaactttcgctgcagcgccgcggagggcctgcgcgccgccccgtggacgggctccggccggcggggaggacttggtggctggtgcctgcgggggcgggagggggcggaggagaaaggacggcttcctagggtcgcccgagtcgcgggaagcacgccgcgtacctttccttggcctccgcggcccggtctctttgcctccggttcttaaaccagttgctgacctgggtggtggtgaggccggtggcctcggccagctcccgcttctcacgcggcgatgggtagggattgtgcgcgtaccactcccgcaggacacccctcgacttctccttgaagcagtagctggtctcctcgccgtcccagatggtgcgcggcagtggaaattttcggcgcacccgatatttgcccacggcgcccaggggtcggccgcgcagcttctcggcctccacgtaatgcgccttcagccacagttgctgcagtttggggtggttgtgaggcgagaactggtggctctccaggatcttgtagagctcacggaagttgccgcggtggaaggcgaccaccgccttggccttgagtacgctctcgttcttgtgcaggtggtcgcaggcgggcagtgaccacaggaacctgcccaggcgctccaggtttccgccttgctgcagaacctcgcacacgcacgccacttgctcctgcgtaaagccaaacgacggcagcatcgacatggctggggcctgccggggcgcacggcccaggcgcacgcggcagggagcagagccgagaggcagggggcggcggccgcagggaggggggcgcggctgttcctaacctcctccttaggctttgcaaaggcgaaaaccggagtcggaacttggcggtgggcggccaaggaagagaaggcggaggagtaggggaggttctggacacggaacggccggcgcactcagtagcctttaaggccttgctgcctccgacctcccgcccggtggatgctgctagttgccggggaacttggtttctgttctccccgcagcggccttaaagcgcgcagcgtccccggcacgctgattggctgccggcggcgcctatccggggctggccagccagcgcgccgcccggctgggcagagaggccgcaccgcccagagcggggagggcgaggctgcggagctgggggttgggggtgttgccggggctgcgcgggtagggagtggtgggaggagaaggaagaggaaaggtgggaagccagttggggtctgagggagctgcgctgcggaggtgtggggaggtagggagtgggtgagcgcgtcaggaccctgcaacgcgggacccgtcgccagtatcacctaaggggagtcgcgcacaactccgcacaaatcaatgactccaaaccttaattcctcccctctccctccgtactcttgtcctc

SEQ ID NO: 76916 - DNA, 160 bp, Homo sapiens
  chr14:61116868-61117028
  hyper
acaagtactcccagtcggacagcgtttccctcgttcacaaaagacctccatgatttgagaccaggcagagagctgtttagagcatacttgctgagcacctagagactccgagcgttcatttgtgatttggtatcttaatgttctgcgattgaaaccagca

SEQ ID NO: 76917 - DNA, 358 bp, Homo sapiens; identical to SEQ ID NO: 35364
  chr14:61118778-61119136
  hyper

SEQ ID NO: 76918 - DNA, 34 bp, Homo sapiens
  chr14:61120426-61120460
  hyper
ccatctgaaagaggacgctcgttcattctgtctg

SEQ ID NO: 76919 - DNA, 141 bp, Homo sapiens
  chr14:61123540-61123681
  hyper
gactaggaagaaggccgtaagatctttccttacctctactcaagttcacccgccaccctcacccatcaaccctcgtgcaggcccgggtccacgtttcgcggactgatcctgagcctcagtataactcgctgtgccaggtgc

SEQ ID NO: 76920 - DNA, 393 bp, Homo sapiens
  chr14:61124304-61124697
  hyper
gccccggacggcactcgcgaggagggagttttctttggcttctttagctgtttccataatcgccttcttttagggccatccctccctcactttttccctccaaaaactggaggcgttgggataaggacggcgacgcttcgctggcgaatgaggtgcctcaatttgcccgaggcgagcggggaaatcgggatctcctttcatgaagccgagttggcttctcggtttcgtggaatctgcggccggaagccgcgaccccagccagtcattcgcgttgaagcgccgcagcaagtggcaatgcttttggccgcgcattgcccaggaacagcaaagagatggaagaccctctcatttaccatcaccaactggtcggggagcacacgcagagaccaataa

SEQ ID NO: 76921 - DNA, 125 bp, Homo sapiens
  chr14:61188120-61188245
  hyper
atccccgcagtgccccgcggtcggttcgctttcatgccgaggggaggggattacccgggctttgggctgcggggccaggagcgcagaaagcgctttgatttacaagctgaggctgagccgccgtc

SEQ ID NO: 76922 - DNA, 381 bp, Homo sapiens
  chr14:61188246-61188627
  hyper
ccgtctgcgagggtgactcaccgggggtgcgggtgggaggtagatccggagaggggcctaaaccaggcaactgggccggcggcggggtgggtgtggagtttatggggtggggcgggggggacgaagaagccagcagtggagcgtgggggagtcccagggagcgtgcccggctcgcgagcggaggcggcggagcagctggcctgctcgcggtgcccccttgccaccctctgccccggccctgcggattccgttggtttccgagcgcgggatccgcggcctctagtgggcgcagggcaggtggctcggcgtaaccaaagcgccttctctggacctctccgcatatctgcggaaggcgcacgcacatcccggtgcaccttttgt

SEQ ID NO: 76923 - DNA, 190 bp, Homo sapiens
  chr14:61655782-61655972
  hyper
ggacagcactgggatcgaaagacgatctgctccttcggaagaaaacacagggtgcggcggtgactcgcagagctcccagcgccccagcgcccccgcgaggcccgggcagcgtccgcgctccctacagggggaagcccgccggtgtttgggaatcccagcggggtccccagcttgccgatctcccagccct

SEQ ID NO: 76924 - DNA, 140 bp, Homo sapiens
  chr14:61747388-61747528
  hyper
gatgggcaggccggccgcgctgcgctggtagggggcgcactcgttgacagggtggcgcagcgcgctggggagtccgctcagctgcgcgtcgtcgcgggacacgccgtagcgccggttgttctggtagaagttggtcagct

SEQ ID NO: 76925 - DNA, 156 bp, Homo sapiens
  chr14:61747582-61747738
  hyper
cgcacgagcaggggggcggcagcgcccggccctggccagccgcggcgcacaccgagcagttaccggtgcccgggtcgcctgtatagtcgtactccagctccttgatgccgttggaggagtagtagaggcccaggcccaggccgatgaaggccaggc

SEQ ID NO: 76926 - DNA, 107 bp, Homo sapiens
  chr14:61748097-61748204
  hyper
acccccgcgggtcaccgggagccgcacctcgcccgccccttccgaggtgagcaggtgggtgttttttacctcacctggtagactcagtctcgcgtttcctctcagtc

SEQ ID NO: 76927 - DNA, 237 bp, Homo sapiens
  chr14:61788181-61788418
  hyper
cgggcactggcctcccgggggcttgcgcggggatccacccaccgcagggccgggccgcggaccgcgggccacgcccctggggtccggaaggcgcgggagcggacgcgggggttctgtgaacttggaacctggcggtgcgaggttctcgccggggatgcggcggcggcagctgcttcctggtttgaagctcgccgagtgggggagagcgtgagccttcggaggcgggggcaggaggag

SEQ ID NO: 76928 - DNA, 483 bp, Homo sapiens; identical to SEQ ID NO: 35370
  chr14:61788722-61789205
  hyper

SEQ ID NO: 76929 - DNA, 30 bp, Homo sapiens
  chr14:61943693-61943723
  hyper
tcagatttcctcatgcgggtgcttttccac

SEQ ID NO: 76930 - DNA, 140 bp, Homo sapiens
  chr14:62148179-62148319
  hypo
aatggagctgggatccgggagtcaatgggccataggcagagacgagatgaacaaccataggctaaggtgtagataaaatccgggtgatcaaccaattgacagttgaactgtagtctggtgaggatcgcatgaaggaaagg

SEQ ID NO: 76931 - DNA, 178 bp, Homo sapiens
  chr14:62279298-62279476
  hyper
gctgggctctcaggacgccggcggcggccgcagggctggcggctgctgggcgcggggcggcgcggggcggcgcggcgcggcgggggcgcgcggcaggaggggctgtgcgcggcgcggcccccgagcgcaccgggcctgccgaggagcgcgcgcccggccgggctcggcgccggtttcc

SEQ ID NO: 76932 - DNA, 104 bp, Homo sapiens; identical to SEQ ID NO: 4152
  chr14:62279519-62279623
  hyper

SEQ ID NO: 76933 - DNA, 229 bp, Homo sapiens; identical to SEQ ID NO: 4153
  chr14:62279624-62279853
  hyper

SEQ ID NO: 76934 - DNA, 108 bp, Homo sapiens
  chr14:62279898-62280006
  hyper
cgagttctgggtcgggtttgtgcgtctgccttttggggatcagggtggcttgcatggctcggctgcccggtggcccacgggctgtattcgcagcgggcagcacaaggc

SEQ ID NO: 76935 - DNA, 23 bp, Homo sapiens
  chr14:62483117-62483140
  hypo
agttatggcattggccgggtgtg

SEQ ID NO: 76936 - DNA, 30 bp, Homo sapiens
  chr14:62523769-62523799
  hypo
gccgtgcaaaggccccgtggtcagccagga

SEQ ID NO: 76937 - DNA, 206 bp, Homo sapiens
  chr14:62583664-62583870
  hyper
cactgagccaaaccccgctgcttcctcagccgctgaaagtgccgccccacccctctccccaaacccgacctccgtaggggacaccgagccaaggcctgcagcgagtgacctgcccggggaggcgcgggaccgaggctcacctacccgggcccgcgagtctcgcccagccccagcctcccaacccactctgccggccccaacttagg

SEQ ID NO: 76938 - DNA, 360 bp, Homo sapiens; identical to SEQ ID NO: 35376
  chr14:62583918-62584278
  hyper

SEQ ID NO: 76939 - DNA, 120 bp, Homo sapiens
  chr14:62584279-62584399
  hyper
atctggtgagtggacccagctcacaaggtatgtctggattcatccagccaggtgccttcctccgagctcagaagggactcctttccttgagggggaggatagggacgtgttccgggatcc

SEQ ID NO: 76940 - DNA, 151 bp, Homo sapiens; identical to SEQ ID NO: 35378
  chr14:63511856-63512007
  hyper

SEQ ID NO: 76941 - DNA, 646 bp, Homo sapiens; identical to SEQ ID NO: 4156
  chr14:63512063-63512709
  hyper

SEQ ID NO: 76942 - DNA, 473 bp, Homo sapiens
  chr14:63512740-63513213
  hyper
cgctgctaccgcccccctccgggctccggcgcctgaaaccttcctgaacactggcgctttccgcaccgcccttaccccaccccggagcgggagcgcgagccctgaagtccgagcgcacagccggcgcccggaatggcccctgcgacccgggccgggcttggcgtctgggggagcgtgcggccgcccaggggagtttcccccaggaccgctgagcgcaggaggcgatccgcgagcccgccaccgctgcaaagttgcgggaaaggttgcacttgatgtgaagagtaggggaagagggtgaataattcacacccgagagagggggagtgaggagggcagtgttagcgatggaaaaacggtaaaggctgtgggggcgaagatgcgccagggtggagcagggcacgaatcacctctaacaaaccccccaatttccaggcgttgagaacggacagcagcggcaccgttacaaacagtcc

SEQ ID NO: 76943 - DNA, 30 bp, Homo sapiens; identical to SEQ ID NO: 35381
  chr14:63670862-63670892
  hyper

SEQ ID NO: 76944 - DNA, 88 bp, Homo sapiens; identical to SEQ ID NO: 43993
  chr14:64022981-64023069
  hypo

SEQ ID NO: 76945 - DNA, 37 bp, Homo sapiens
  chr14:64222413-64222450
  hypo
cctatggactaggcacggtgactcacgcctgtaatcc

SEQ ID NO: 76946 - DNA, 78 bp, Homo sapiens
  chr14:64760774-64760852
  hyper
gccttctctaaaatgcggacacgtgcttttcccgcattagggggggtctcccggcgcgcgccccgccgccacctgttg

SEQ ID NO: 76947 - DNA, 181 bp, Homo sapiens
  chr14:64761073-64761254
  hyper
tgaaaagatcacaagcgacttaacgataagccccttcttccttttaaagaccgagaggagggtagaggggagtagtgcctgagcccacgtgaccgagccagggagcccgacggtctcaggaacgcccgacgccgcgcgtgacctctaagtgggagcaccctcgaaccgactcctggtccac

SEQ ID NO: 76948 - DNA, 59 bp, Homo sapiens
  chr14:64932461-64932520
  hyper
aagaacgcgggaggtcgcttgtccgctggaatccgcggccagggcgaccctcatcaggt

SEQ ID NO: 76949 - DNA, 141 bp, Homo sapiens
  chr14:65005802-65005943
  hypo
catgagcctccacacccgtccaggagcccatttatatgggagcctgcttctaaagattattacctggtgccagggtattttccagacctgtcctcacattcctgttaaacaggaggaagtgaatcgcgctccttttcatct

SEQ ID NO: 76950 - DNA, 226 bp, Homo sapiens; identical to SEQ ID NO: 35384
  chr14:65007311-65007537
  hyper

SEQ ID NO: 76951 - DNA, 59 bp, Homo sapiens
  chr14:65007552-65007611
  hyper
cgcctttcagtcaggatgtctgcccgtggcccggctatcggcatcgacctgggcaccac

SEQ ID NO: 76952 - DNA, 44 bp, Homo sapiens
  chr14:65008676-65008720
  hyper
ggcggtggcctatggcgccgcggtgcaggcggccatcctcatcg

SEQ ID NO: 76953 - DNA, 38 bp, Homo sapiens
  chr14:65008937-65008975
  hyper
cctgctgggcaagttcgacctgaccgggattccccctg

SEQ ID NO: 76954 - DNA, 282 bp, Homo sapiens
  chr14:65008997-65009279
  hyper
cgaggttaccttcgacattgacgccaatggcatccttaacgttaccgccgccgacaagagcaccggtaaggaaaacaaaatcaccatcaccaatgacaaaggtcgtctgagcaaggacgacattgaccggatggtgcaggaggcggagcggtacaaatcggaagatgaggcgaatcgcgaccgagtcgcggccaaaaacgccctggagtcctatacctacaacatcaagcagacggtggaagacgagaaactgaggggcaagattagcgagcaggacaaaaa

SEQ ID NO: 76955 - DNA, 340 bp, Homo sapiens
  chr14:65016476-65016816
  hyper
gaattatgccctgggcggctttacaatggataggccaatacgtcgccacggcttttaagactgggaaacggggcaccaggctgggctttagaaatcgctggagaagcctgggtgcggccgcagcccgcgcggcctaggacggaagcgacgccccgccccgctccgcgccccgggcagccgtgtgcaggcgcctgcgggcggtatcctcggcgacgccgtatggcttccagggcgaggccatgtaccgggtgcccgagttttatgcgaggaggaagcggttaggtgggcagaccccttacttgatggatgtaagtgcagccttggtcgcccccatacccgg

SEQ ID NO: 76956 - DNA, 149 bp, Homo sapiens
  chr14:65086478-65086627
  hypo
cagcttcttctagagcgaggtgggacttcatttgaagtttttagagagagtgtctctagagtcttccttgagatctgcaggggatttcccttaatattctggcccctcccattggaagcatccaaagctgcctactggaccgactgaaa

SEQ ID NO: 76957 - DNA, 395 bp, Homo sapiens
  chr14:65170679-65171074
  hyper
ttggaaaagcggacacggccggctctggtaggattaggatccccagatcgatcccggctggtcactcacttgggaaagccctcagcccccttcgcagggcccggtgttccctgtccatacaaggggtacgttctggcagtccatgctgtctcgggaggcggtgatagcaggtctgtgacaccagggtgaccccaccacgtgcgtcttggtatcctagagcatctaggctgcccgggggtgcgcgctcatcaccctgcgggcgttaatcgttaaccgcgcccaggcctcgccgccgccgcagccttaccccggctctggctcgccgcgccgcgaaggttgccccggcccccgcagagccgccaattgctggactgcagccgcgagctggagtctcc

SEQ ID NO: 76958 - DNA, 98 bp, Homo sapiens
  chr14:65171275-65171373
  hyper
cagctgaggggctggcggtgggcgggagcggtcggcggcctcagccccttcagagagcgactttcaaactcgcgcccgcgtcgcggcagcacctgggc

SEQ ID NO: 76959 - DNA, 92 bp, Homo sapiens
  chr14:65171678-65171770
  hyper
caaaaggggcaaatgcgccgggcggctccagagaggctcagtttgaaatccaggaagcccgcgaggccgcgcgcgcccgagggctggtgttt

SEQ ID NO: 76960 - DNA, 161 bp, Homo sapiens; identical to SEQ ID NO: 43995
  chr14:65233318-65233479
  hypo

SEQ ID NO: 76961 - DNA, 30 bp, Homo sapiens
  chr14:65236314-65236344
  hypo
gaggcctggtgctgccgctgcagcagggac

SEQ ID NO: 76962 - DNA, 532 bp, Homo sapiens
  chr14:65239262-65239794
  hypo
ttggtagcaggtgggcggcagggggctgaaggtacctggacacccagcaggtggagctcccgctcgaaggctgtgtgcacccggtggaaggactcggccgtgctggcgtccagccccacgtcctcgggcagctcgcggtgcttctcgtcgatgaggcccaggatctcggcacccgtgtagaagtagcggtgcaggtcataggaggcggccagcagctgcatgcgcgtgtcaatgagctccaggaggtctgcccacatctcgttcagcccgtccttccactcggcgatggtggccgcctcgctgtggcccgcgtcgatgagtcgctcgatgaaggcattcacattgtccacccgctcctgcccaatcgccccggtctcccgggcaaagtcccggaacttgtcccgcagaagctaggcatggggcagacagaaatgtggttatggggggcacaggggttacaggtgtcaccagcttagccaaagactttcccaggcagcaactgcagctccgggagctgcgctgtcacaccttc

SEQ ID NO: 76963 - DNA, 63 bp, Homo sapiens; identical to SEQ ID NO: 43997
  chr14:65273132-65273195
  hypo

SEQ ID NO: 76964 - DNA, 30 bp, Homo sapiens
  chr14:65282538-65282568
  hypo
tagaagggctttgggcgtcatctagttcaa

SEQ ID NO: 76965 - DNA, 30 bp, Homo sapiens
  chr14:65310281-65310311
  hypo
acaacccttagtctccggtagtaggaaaaa

SEQ ID NO: 76966 - DNA, 78 bp, Homo sapiens
  chr14:65345911-65345989
  hyper
ggatctttcctccctcggtctacacggggtcactctctgggtggctcccagcacccggaggcccggccccctctgctg

SEQ ID NO: 76967 - DNA, 57 bp, Homo sapiens
  chr14:65346254-65346311
  hyper
tagcaccaagtgcctcggacgcccgcgcgcgttcccgcgtcccgggatgatctttgc

SEQ ID NO: 76968 - DNA, 179 bp, Homo sapiens
  chr14:65406280-65406459
  hypo
gaagggctctccctccggccctatgaggaacttctcaaagttccaggccacatctgagcggcgcacagggctccaaatgatgagcttgggatcggtcatgagggaaaatgggtcatcataagggtaggggagcttgtccttcaggtaggcgaagacaggatgctcgttctgcccattca

SEQ ID NO: 76969 - DNA, 30 bp, Homo sapiens
  chr14:65493283-65493313
  hypo
aatgtgtttttcagccggatgcagtggctc

SEQ ID NO: 76970 - DNA, 155 bp, Homo sapiens
  chr14:65604586-65604741
  hypo
catctgcgataccaccgcccttccccgtggcccatccccactcactgagctgtttaagattctcctgctgttctgtgaagaaaacaagaagctcaggtgctgttccaccaggcaatccccatccgccctgcacggagtttcggacttttcctaga

SEQ ID NO: 76971 - DNA, 29 bp, Homo sapiens
  chr14:65619090-65619119
  hypo
ttcaagggccgggcgcggtggctcacgcc

SEQ ID NO: 76972 - DNA, 89 bp, Homo sapiens
  chr14:65694375-65694464
  hypo
tgccccagcttccttcgcaccaagcgtgatcttaatcatttttcccaatacttcattcatagtaatttttttttatttttatttttttg

SEQ ID NO: 76973 - DNA, 33 bp, Homo sapiens
  chr14:66499270-66499303
  hypo
atgctgggagctgtagaccggagctgttcctgt

SEQ ID NO: 76974 - DNA, 93 bp, Homo sapiens
  chr14:66560626-66560719
  hypo
gtgtccacactgcctcgagcgtgcacacacctgcccaggctgcgacagcgtccaggcttgactacaactttgctccaagatcagagcaagtgc

SEQ ID NO: 76975 - DNA, 201 bp, Homo sapiens
  chr14:66792112-66792313
  hypo
atggcactccattcccgaatacagatccagcatctgacagcaatgccagcagcgggaacttccagtgtgggaatgtagatgggagtggtgcaacaggccacctgggcattccagacaatccagatacagtggtactgcccggcagcctcagcacccaccctgaatccacctggccgtgaggcatcacgtggcattgcctcc

SEQ ID NO: 76976 - DNA, 181 bp, Homo sapiens; identical to SEQ ID NO: 44002
  chr14:67688245-67688426
  hypo

SEQ ID NO: 76977 - DNA, 40 bp, Homo sapiens
  chr14:67876449-67876489
  hypo
gactgctctgcactccggcttccaacgcaggccctgcccc

SEQ ID NO: 76978 - DNA, 216 bp, Homo sapiens
  chr14:67878803-67879019
  hyper
caggtgcgccttccccgcgcctcgcgctcctcggcacccgcgcagcccgcgcagtccgcgcccacggcgcccaggaagcagctccgacgcggcagggcgacgcctccctggcgcgtgtccagagcctgaggccccggggcaggaagtcagaccaagtcgggatttctgacgtgacgtttccacccaaaggtgctccagggtcggtggttggtcctc

SEQ ID NO: 76979 - DNA, 30 bp, Homo sapiens; identical to SEQ ID NO: 44003
  chr14:67879219-67879249
  hypo

SEQ ID NO: 76980 - DNA, 143 bp, Homo sapiens
  chr14:67886180-67886323
  hypo
aaggcaaatgggggccggaggtgcagtctgcgttcaactaccaaaggcatgcctccacgcagggctgccttccccaaagaaagcaggggggttctcatctcataaaggctgcatccaggcggggggcggtggctcacgcctat

SEQ ID NO: 76981 - DNA, 82 bp, Homo sapiens
  chr14:67886563-67886645
  hypo
tcaaaaaaaaaaaaaggctgcatccattcgctaagccacatggcagtgggtctgcatctccccagagcgggtgcttttttct

SEQ ID NO: 76982 - DNA, 206 bp, Homo sapiens
  chr14:67893599-67893805
  hypo
agttttaagagacaacgtctgcagattcctagggcttatagctcaggggcagaggagtcagaagtcacctagtcctccccaggcctccgcaggctccaggactcttccctctgcccactgggaaaaactagatgagccaaagcaatgggaaagctggagtgttggaggtagctagagtgtattgtgtcgcgcgggggagggaggga

SEQ ID NO: 76983 - DNA, 30 bp, Homo sapiens
  chr14:67906990-67907020
  hypo
cgaacctccttgatacggatgtaaagttac

SEQ ID NO: 76984 - DNA, 256 bp, Homo sapiens
  chr14:68067573-68067829
  hypo
gcgtgagccaccgcacccagcccaaacccacagttttaatcatgcttttgcttggcaagccgatttctctaagccagagtgagccgcaaggagagcccacgggtattcatttcacttactcttttcctgtgccgggtagtttgaggtgcttgaggatgcagcagtgaacgatgttgatgacagtctctgccctcgggcagcttcctttctagtaggagacaatatggaaataagagagtatcgttggcaatactat

SEQ ID NO: 76985 - DNA, 30 bp, Homo sapiens
  chr14:68142255-68142285
  hypo
tctagctgctaggcccgagtaattctcctc

SEQ ID NO: 76986 - DNA, 86 bp, Homo sapiens
  chr14:68187960-68188046
  hypo
gagaggaacacagagcgaggaagggcaatgaatcccacttacccttctcccatctcacacacatccagaggcacgatcctagctca

SEQ ID NO: 76987 - DNA, 30 bp, Homo sapiens; identical to SEQ ID NO: 44006
  chr14:68231335-68231365
  hypo

SEQ ID NO: 76988 - DNA, 36 bp, Homo sapiens; identical to SEQ ID NO: 44007
  chr14:68284131-68284167
  hypo

SEQ ID NO: 76989 - DNA, 200 bp, Homo sapiens
  chr14:68841379-68841579
  hypo
tttatcttaaatacacgcctcattatagatgtgtcacacttagcacagatggtctcagaagtttttcctggcttcccataccctaacagtatctagtatgttaatgtcaatattagctttactgttttaggtaactttggtatgcttctcattagctgaaaccgtaaagagctcagttttacctgcgctgagggatcact

SEQ ID NO: 76990 - DNA, 61 bp, Homo sapiens
  chr14:69014044-69014105
  hypo
attctgccttccttccggccatccactgttacctttcacttcctgtcggcacgtacaggcc

SEQ ID NO: 76991 - DNA, 198 bp, Homo sapiens
  chr14:69143363-69143561
  hypo
ctacacctgcacaggcgcttctggaggaggcaggtgtggcaagccccctgctgaggaatccagccagggaaggcatcctttgtcttgctctggtggctttcaagcaaagagcccagtgtgttttgcaggcgtccattcatgagcttagctcctgagctgcactgactggatgacgggcgtccccgcccaggagccaga

SEQ ID NO: 76992 - DNA, 40 bp, Homo sapiens
  chr14:69245934-69245974
  hypo
agtgccaggcatcagcgttgacatgaaatagaacggtgaa

SEQ ID NO: 76993 - DNA, 30 bp, Homo sapiens
  chr14:69657584-69657614
  hypo
gactgattggatgaacgatttaatatataa

SEQ ID NO: 76994 - DNA, 1557 bp, Homo sapiens
  chr14:69726355-69727912
  hyper
ctcaggactctcccccgcccagccgcccctacacaaggactcgccgaacacaccttgaatcccgcgccagagcgcagcccggaactgcagctcgcggcgcgggcccaggtcgggggtcgcgcgtctccagtcggtgactcaaggccgctcggtccgggggtgggtgtgggtcggcaggaccgaccagggccgcgcgggggcagctgccgggcgttcggtcacctagcggtgggagccgaggctggctttggccagtcgccattccgccgcgggcgtctgtctcgccgggttcccgggcgcgggaggaaggcccgcgccgcttcccactcggcgcgcttctctcccagtgcgcagtggcctggtgggtcagccggcggcggctggagcgcggggccggccctgcgcacgaatgaatgggcgcccgggggacgcgcgcgctcggggctgaagggcattaggaccgtgaggatcgctccgcgatcctgtctctccctatcacccccccgcccccccacctctctcctttttctgctctgcaggactgagcagctaggcgcgagcgaaaacaaacagctggggctgcgagcgcccccgccccggccccgagagcacgccggcccagtcccccacctggggcgcccgtctgcccaccatgaggaagatccgcgccaatgccatcgccatcctgaccgtagcctggatcctgggcactttctactacttatggcaggacaaccgagcccacgcagcatcctccggcggccggggcgcgcagagggcaggcaggaggtcggagcagctccgcgaggaccgcaccatcccgctcattgtgagtacgccccgagcgtcggccggccggctagggagccgcggcgcgcgtccagaccctgcgcggcggccgagggcgcggggcccggccagggctgagtgcccgctgcgccgggccggctttgtatatgttggagcattcctgcccgttgttatggcaacctctgccgggcggcggggctggggcgcaccgactaagggagggtgacagagggtgggggctgggagaaagtgctgcaagtttggtgggcccggcgtgcgcgcgcggctgggaacgtggcggctctcccggctctgcgctgccggggccgggagtctgggggctgcgggagcctcgtgtgccccggaaggctgccgggcccagcgcgcggcgagcgggcggtgggaaccactcgcagccgagcgcgtaggtggcagtgcgcagcccctctccagccttctgggggcagaggacatcgggtgggggcgtgggtaggggaaggctctctaggcgctgcgcctggcttcgaacccccttctgagccgggtcaacttgaacccgcttcttcggcgcggacacccagcttccccggagttctctgggttgaggagaggtctcgcactgtacgcgtctctcactcccaaccttagggtccgccaccacgggtaggtgggcagtgtcagcgcccgaacttggcgatacccttgcatgaagtcagcctcgcgacatctaagcgggcagggaaacaa

SEQ ID NO: 76995 - DNA, 32 bp, Homo sapiens
  chr14:69728306-69728338
  hyper
aggggtgaggagatccgcgggggaggtgcaag

SEQ ID NO: 76996 - DNA, 174 bp, Homo sapiens
  chr14:69867022-69867196
  hypo
aatttttggttaatacgttttgacattttcgttaatttgattggcaccttgaacagatgttaagcgagggtcccgggaagagggatagatgaaagcactgttcagtgaacatgctgataggtcctttaggtaggcaaaaggaattcacgaagtgcacagcgttcaaagatttag

SEQ ID NO: 76997 - DNA, 30 bp, Homo sapiens
  chr14:69867731-69867761
  hypo
atatagatgaggaaacggagactggatagg

SEQ ID NO: 76998 - DNA, 58 bp, Homo sapiens; identical to SEQ ID NO: 35395
  chr14:69950779-69950837
  hyper

SEQ ID NO: 76999 - DNA, 228 bp, Homo sapiens
  chr14:69951108-69951336
  hyper
aaccccattgcaaagcggacgtggccctcgtctcgatgtcggcgctgctcgccgagagggaccccggggtggtgttgggcgcgcggggcggggacggggacgcgctgcggccaagtccccgggccctgcgacccgcagggaccttctggacgcacggagcccggccctccagccggcgcccgccctgattggcgcccgaggccggcctcccgccggctcacctgccac

SEQ ID NO: 77000 - DNA, 372 bp, Homo sapiens
  chr14:70014616-70014988
  hyper
ccttgccagggtgggcgagacacggccgccttccttcacatccaacgccggtgaggctcagcactcattgtctcactggcagcacagacaaagccttgcgggctccacgggataatcaacagcgagaacgcccccagggacctccggaaagagacaccattggttgcaggcctccaggttctcgtctgcctggtgagtgaggtggcacgcagcgtcagtcgtctgcaggaatttgtgctggggtaaatgcgcgcttcgtgcagaccgcagagctggaggcggagggctggggtccctgggccgcgggcgggttccgcgtgcccctccctcgccgcaccgcgcagtcccgccagggggcgccaggcaccggcc

SEQ ID NO: 77001 - DNA, 30 bp, Homo sapiens
  chr14:70236264-70236294
  hypo
gtgggttatcctaatcgttgtcttggtcac

SEQ ID NO: 77002 - DNA, 602 bp, Homo sapiens
  chr14:70345928-70346530
  hyper
tatcccactctctcccggggcctactcccgcggagctcctcggcggggggttgaccacgagtggctcctcttgcccctctcccattggctttcacctgccagagggtcggcttcaacaggcctcttggcccgtcaatcaggcccgccgtgctccgccccgcccctcccgggggtttataacgggaattcccatggcccgggctcaggcgtccaacctgctgccgcctgggccccgccgagcggagctagcgccgcgcgcagagcacacgctcgcgctccagctcccctcctgcgcggttcatgactgtgtcccctgaccgcagcctctgcgagcccccgccgcaggaccacggcccgctccccgccgccgcgagggccccgagcgaaggaaggaagggaggcgcgctgtgcgccccgcggagcccgcgaaccccgctcgctgccggctgcccagcctggctggcaccatgctgcccgcgcgctgcgcccgcctgctcacgccccacttgctgctggtgttggtgcagctgtcccctgctcgcggccaccgcaccacaggccccagggtaagtgcgcccccagctttgcgcccacctgcggag

SEQ ID NO: 77003 - DNA, 86 bp, Homo sapiens
  chr14:70346797-70346883
  hyper
cgtcggagagaagctcgctctccgctcatgcagggcttccctgtggtctcacgctggcgcccggtccagcgcgctggagttgttgg

SEQ ID NO: 77004 - DNA, 608 bp, Homo sapiens
  chr14:70653682-70654290
  hyper
ggaagattaatcacacgccgctgcaagtcaccgggtcgccaggggccgaggaggcttcccttttggtgccccaccggaaggccggatgtgttcctatcacgtacccacattccacccccgctcaactccctcctccccccacccccttcgggtgtttcttgaccacccaggagcttggctgcgcctgctgcagtctgcgtttctgataaattgaaaccagttttaattcttctgcccgggagacctaaccgccgaatgcgttcggaggtatgttttttaatcgccaggaaagggggagagagagagaaagagagagagagagagagaggaaaggaggagagaagagaagagaagcggggggcggggggagagagagagagagagagaaggaagctgcgatgagcgggtaaatttatggtactgcattaaaggcatttcttctatttaaccccaccccgccaccaccaccactaccacaccgttaaaaataaaatacaatgaattaagacgaagaactgcttttttccccggagcaaattgctttcatcatctttcccagtggctcgggtcctctgggcaggtcagccagggcctgtaggagcagcagc

SEQ ID NO: 77005 - DNA, 15 bp, Homo sapiens
  chr14:70654291-70654306
  hyper
ctagcctctgaatca

SEQ ID NO: 77006 - DNA, 231 bp, Homo sapiens
  chr14:70654366-70654597
  hyper
cgtgtgtgttgggggatcgggggagggttagttatatatttcgattctctccaccgagtcccggatcacgcagaccaccaggggctggagagtgcagcactggagaaaccctccttctccctcgcccccttggccccagcggtgggtgctctggggctgcagctcccgacccgcggcggtggagtcccgagattggggtgagcgcgtgcgtgcgtatgtgcacgcgggcgc

SEQ ID NO: 77007 - DNA, 41 bp, Homo sapiens; identical to SEQ ID NO: 1186
  chr14:70654598-70654639
  hyper

SEQ ID NO: 77008 - DNA, 1250 bp, Homo sapiens
  chr14:70654640-70655890
  hyper
gcggacactcacagcaccagaagcacaacacgccctggcccaggtggcacacatatgccgacatgcatccagcacacacaacacagcagtcagtctccccaaacagcacccgctaccaacccagcatgctcacgatccaactgtacccacctgcccaggcatctctctctgcccctccccacccggcggcaccctcctgtagacacccactctgccagatctgcccccccaacactgcatacacaatgtacactttccggggcaccctcaccccacttctcctggcactaaatccacaggaaggcggttcatatgaatgatcttgagaaataacttaaccccgttactcacaatcagggatcctcttaggggcatcccaagccccccaacctctacctcccatgtctcggctgcccgctaagggggaagggcaggaggctcaccccattactcaccgtttcctctcggcctcccgagcggagtgggcaagggaggggggtgaggaaggtacgcgatgcccccgccgcccggcgcctcaccggtcgcagcggctcatcgcccccgcgggctgcccgccggccgcagccgcgtccggggcatgtcagtccgccgccgccgccctcccgccggggttcgtgggctcgcagctgtcagggagctgcggggcagcgcatctggagcgcggggtctgggagggagggtgtctggggccagggcgaggggccccgggaggggtccttccgcacggatttcagaaagagggaaaccccgacccagagcggtgactggaatctacgcccgggagaggcccggagtcccggccgcgggcggcgggggattcctgcaggaaggggcaggaaggcaagcagcccggcgcgccctggcggctccgagggacctgggctcgggcttgcggtcgcgtcgcctgggctttccctgggctgggagcgcgccgggtctccgccttgcacgctgtcaccgcgggagacgtctcggcctcgccgcgcgcagaggggacgcgcggagaggctggtttctgggcgagcggagagctttgcccattaagctgccggaagaagccaaatcaaaaagccaatctccaagcctccaaacggaacgtcaccctatcagctgggagacagcgccgcactgactgacaagccgcgcatatttatcctcgcgcgcggaggggagactctcagaacgctcctcgaccagcagcgaggaagtcgagcccgcatcccgcatcc

SEQ ID NO: 77009 - DNA, 211 bp, Homo sapiens; identical to SEQ ID NO: 35407
  chr14:70655919-70656130
  hyper

SEQ ID NO: 77010 - DNA, 349 bp, Homo sapiens
  chr14:70701157-70701506
  hypo
ggaaccccagatcctcgttccccccaggtggcctgggaggtggccccctcgaggatgactccactagctccctgggaccccaactacgaagccaaagcaggacctcggctggtttggggggccaactgtagctcaggagcctcgttctcaggccagacggtgtgtcacccctcgttctggccgctgtacgaggcagcctcgggcaggggtctcaggcccgtggcccctgccacagggcattggaatggacagcaggcggccccggatgcagggttcccggtgatgtgctgtgaagacgtcttcctctcggaccctctgctgccccggggggcagcgtgtccccctgtac

SEQ ID NO: 77011 - DNA, 18 bp, Homo sapiens
  chr14:70725489-70725507
  hypo
agcactttgggaggccga

SEQ ID NO: 77012 - DNA, 17 bp, Homo sapiens
  chr14:70725747-70725764
  hypo
aacgaaaaagaagccac

SEQ ID NO: 77013 - DNA, 30 bp, Homo sapiens
  chr14:70904873-70904903
  hypo
gctcgggcttgtgagcgttggtttggggga

SEQ ID NO: 77014 - DNA, 138 bp, Homo sapiens
  chr14:71659705-71659843
  hypo
ggcaagttgaggggtcgcaccacctgaagcccatgaggctcggcatggcgagtgctgggaggagcagaaggcaagactgggcaggtgcgagtgggacaggcttccatgcacctgtcctcctcccgcaaacactggcat

SEQ ID NO: 77015 - DNA, 30 bp, Homo sapiens
  chr14:72286297-72286327
  hypo
tctcatcctaactctcgtttcttcttccaa

SEQ ID NO: 77016 - DNA, 635 bp, Homo sapiens
  chr14:72398598-72399233
  hyper
atattccaaatgcagcgtgtggtgtgcatgttgaatacataaaaatgacgaggttaggaacaatatcgctgacggtcgcggtgtcccgttttaatttagagggcgccagcaacacgtcagtgagggagattcagaagccgccgggcacctcaccccgggccgggaatccctaagagaaccttgacgccgctgaagtttccggaccgggccagtttggaattgacgaaagcagcctccgcccggtcgagccagtctctcggttttctcggcggcttcttgaggatgaggcatttctaggttttctcctcctcgagcaaatcacggtctgcgccttccgcggctctgggaacaggtgagccgtgcggcggcgcccgcgggacgcgctcaggtgccggtccccgcccgccggcccctccctgcagcacgcggtccgggcccaggtgccggggcccaggtgccggcgcccaggtgcgcggggcacggggctgcagctccgctcggcatccgacagcgggcgccgctgcagcagctcgcgggccgcggagctgaacggcttcgcgagttggggcagctcctcgcgctcggccctgctcggcggcgagagctccgcctgggcgccgcgttcctacagccgc

SEQ ID NO: 77017 - DNA, 35 bp, Homo sapiens
  chr14:72399451-72399486
  hyper
cgctcgccaccacggaaactcggaaagaggaggcg

SEQ ID NO: 77018 - DNA, 459 bp, Homo sapiens; identical to SEQ ID NO: 35410
  chr14:72399780-72400239
  hyper

SEQ ID NO: 77019 - DNA, 195 bp, Homo sapiens
  chr14:72720654-72720849
  hypo
tcccagggcacctcacgtggcattctttgttactgacttctttataatgtttgcgttgtagaccacgatgacagaatttacttaacgatgatgttttgattatcatgcaagtgtgggggaggattgttctgttgaaacagcgtgactgcaaatattttaccaatagatcagtgaaattcacgtgcccttgaacat

SEQ ID NO: 77020 - DNA, 30 bp, Homo sapiens; identical to SEQ ID NO: 15833
  chr14:72892242-72892272
  hypo

SEQ ID NO: 77021 - DNA, 30 bp, Homo sapiens; identical to SEQ ID NO: 44013
  chr14:72976891-72976921
  hypo

SEQ ID NO: 77022 - DNA, 202 bp, Homo sapiens
  chr14:73029646-73029848
  hypo
ccactacatccccaccgccgcctgtcatccctcacgtctctgtggccacccgggtgtcactgccagcaccaggcactgctttcacgtaaaatgtccaaatcacatcttcagcaagaaagcaacctcacggattgccccgcctcaaggtctttccaccctctttgagatcagcgttcggagaggtccccgccagcccggtggc

SEQ ID NO: 77023 - DNA, 30 bp, Homo sapiens
  chr14:73138163-73138193
  hypo
ccaaagggattaacccggtgcatcacctgg

SEQ ID NO: 77024 - DNA, 30 bp, Homo sapiens
  chr14:73140382-73140412
  hypo
gcctcattgatctatcggggtctcttctgt

SEQ ID NO: 77025 - DNA, 250 bp, Homo sapiens; identical to SEQ ID NO: 44015
  chr14:73140612-73140862
  hypo

SEQ ID NO: 77026 - DNA, 151 bp, Homo sapiens
  chr14:73146774-73146925
  hypo
ctccggcaggcccagcgtgaagcagagccaggagagggttaaaagtggcgtgatagagactgtggggaaggctggaccagagggcaaagggagcatcaaagccgggataaatggccttaattctcatgctcccactcgctggtcgtgttta

SEQ ID NO: 77027 - DNA, 319 bp, Homo sapiens
  chr14:73147249-73147568
  hypo
cagctctgaggacaccgtgaatatatgggaaagtaaaggggactacgctggagcggatgcggaaggcgctgaggccagggctgctgtcatgagtcctcacatttatggatggggctgataaactgtcacactccgcaccgtcaaggacaaggtgagaagatgagctggaatggcagcacatgccacaggagagctggaaaggcaggtggctaacaacgaaagccatggccagagggcgggcttctctggagaggcctctgcacacagggaagggcccctaggcccggggttttgactgcgttgccgatctagaggcaag

SEQ ID NO: 77028 - DNA, 175 bp, Homo sapiens
  chr14:73149208-73149383
  hypo
gtctgtttaagttgtcgggatattattatcgacataattaggattcaacaagccccttgttttgctttgcccagccgtgccctctcaaccctcttcactagcaccactgaactctgtctgcaaggggaccagcattttctttgttcttcagacagaaagccgtatttaagaaaag

SEQ ID NO: 77029 - DNA, 30 bp, Homo sapiens; identical to SEQ ID NO: 44018
  chr14:73150302-73150332
  hypo

SEQ ID NO: 77030 - DNA, 37 bp, Homo sapiens; identical to SEQ ID NO: 44019
  chr14:73157349-73157386
  hypo

SEQ ID NO: 77031 - DNA, 149 bp, Homo sapiens; identical to SEQ ID NO: 5153
  chr14:73167750-73167899
  hypo

SEQ ID NO: 77032 - DNA, 143 bp, Homo sapiens
  chr14:73168818-73168961
  hypo
tctgcccttgaagcacgtgactgaaaggtgcgctggtgagtctctgcttggcactgcctccctccccacccaccccaacggcctggggctgactggcgtggcctgcttcacccatgctcccttgctctcggcaagaaggaggc

SEQ ID NO: 77033 - DNA, 151 bp, Homo sapiens; identical to SEQ ID NO: 44021
  chr14:73172944-73173095
  hypo

SEQ ID NO: 77034 - DNA, 255 bp, Homo sapiens
  chr14:73174955-73175210
  hypo
tctggccagtcctgccggaacacctgcaacctgtgtccatgacacaatggcatttaaatatttaaacagacccagctttgctggaacggcgcactcagtctccagggatcaatcccatgccacaagccccgctccacaaatcaagtttctgggggcaccgagcctttcctcccctccccgatcctacccccatccaaggacctgcaagacaactgagtgatgagcccagcttcccttccgcgacaaaggcagtga

SEQ ID NO: 77035 - DNA, 30 bp, Homo sapiens; identical to SEQ ID NO: 44023
  chr14:73176464-73176494
  hypo

SEQ ID NO: 77036 - DNA, 67 bp, Homo sapiens
  chr14:73178102-73178169
  hypo
gaaggaataatcaaacgcataagtagaaaagagcatgcacctggagaggcatcgacaccgaggctgg

SEQ ID NO: 77037 - DNA, 202 bp, Homo sapiens
  chr14:73178763-73178965
  hypo
acagagaagggcaatcgacggtggcccctgctccaccgagagagggagaggaggcagcacgcatgcggacagagccaagaaagcagccgctgagacttccagaaagcctgccgtcaggcctcccaggcactacagggcacacagaaggtgggagagagcctgcggggagggcatcgagagaagcaaacgtcactgagagtcc

SEQ ID NO: 77038 - DNA, 146 bp, Homo sapiens; identical to SEQ ID NO: 44026
  chr14:73180113-73180259
  hypo

SEQ ID NO: 77039 - DNA, 80 bp, Homo sapiens
  chr14:73185163-73185243
  hypo
ccttgttcactctcacgctctcacaggcatccagtggagtcttccagaggcgacatgacacgtgacgatgctgtcactgt

SEQ ID NO: 77040 - DNA, 38 bp, Homo sapiens
  chr14:73185482-73185520
  hypo
tttttttttttgagacggagtcactctgtcatgcaggc

SEQ ID NO: 77041 - DNA, 30 bp, Homo sapiens
  chr14:73189045-73189075
  hypo
gcacagccccacatgcgacaggctggagca

SEQ ID NO: 77042 - DNA, 146 bp, Homo sapiens; identical to SEQ ID NO: 44028
  chr14:73194579-73194725
  hypo

SEQ ID NO: 77043 - DNA, 513 bp, Homo sapiens
  chr14:73195193-73195706
  hypo
ggaatggagaggacacgcccaggaaggtcacgctcatccttttcgatttatttagtgggaaacaacagttttttagcagagttttgctctagaacaaaaggacagctagcaaagtaggacatgtcagagacgggaagaactggggacagggcgattcctggaatctgttccctcatgtgtccattcaacaaatatttatgttgcacctggtaagcaccaagcactgtttgggtgcttatgagatataagcaagcaaaactggcaacggatcctgccctcgaggagtttacattctactggaagaaaacagacaataaacaataacataataagtaagtaaattagaaagtacattagatgatgataagagtgatggaaaagaacaagaaaagcagagtggaatcgggaggcaggggcagtcagggcaagggtgtgagatgaagtacggcacggtcagggacatctttgagagaagaggaaggccaggcaccgtggctcatgcctgtaatccca

SEQ ID NO: 77044 - DNA, 30 bp, Homo sapiens; identical to SEQ ID NO: 44031
  chr14:73196936-73196966
  hypo

SEQ ID NO: 77045 - DNA, 30 bp, Homo sapiens; identical to SEQ ID NO: 44032
  chr14:73197190-73197220
  hypo

SEQ ID NO: 77046 - DNA, 103 bp, Homo sapiens
  chr14:73197913-73198016
  hypo
ggtgtgcacccttataatcctattcagtgagagttttagaagtggcatggatagagggtagtggacccatggggacagagcagccatccgcctgaagggtgag

SEQ ID NO: 77047 - DNA, 52 bp, Homo sapiens
  chr14:73198555-73198607
  hypo
tcttctcaaccccctcgccacggagcaaggcttccagcgtggtgctctctga

SEQ ID NO: 77048 - DNA, 30 bp, Homo sapiens
  chr14:73199030-73199060
  hypo
acatgtgttcatttgcgggaaagtgtttca

SEQ ID NO: 77049 - DNA, 243 bp, Homo sapiens
  chr14:73202777-73203020
  hypo
acagaaatgtaataccggccacttatgtaatttttaacttactagtagtcacatgtagaaaaaggaagaaagtcaggtgtcattaattttaataagatattgtatccgatctggtatttctaaaacattaccattcaacatgaaatcaacataaaaatatggacgcaaaattttacattcttttatctgcattgtcttcaaagtctggtgggtattttccatttagagcgtatctcaattcag

SEQ ID NO: 77050 - DNA, 30 bp, Homo sapiens
  chr14:73207724-73207754
  hypo
gaacacagcaaggcccgtctctaaaaataa

SEQ ID NO: 77051 - DNA, 30 bp, Homo sapiens
  chr14:73207963-73207993
  hypo
accctccatcccacacgcctctcagaataa

SEQ ID NO: 77052 - DNA, 470 bp, Homo sapiens
  chr14:73209578-73210048
  hypo
ctcaccacccctgctcgagctggccagactcaagtccctccgcctggaccacccctttgggagatacccctctgcaggtccctacgacttgcttgttggccagcctgtggccctctctgctttgggacaccttaagccactgtcgtcttcggggtgcatgccctcttgtctgagtttcccccaacgacatgggatgggggcgatcatcctggtcgttcatccccagtcattgaaggactgccaaaaacagaaaaaatacaagagaaagaacactatccctggctgccctccctcccatcaccctcggaattcggcaagggtggcaaagagccaccctgctccccaagagtcctggagcagaagggatcgacaaggcctcaggtgcattccaggtacaggaggagcgtcaactgtaaagcccttttcatctgcgggtccaggataagtgagtgtgtcgggccttcaagcaa

SEQ ID NO: 77053 - DNA, 76 bp, Homo sapiens
  chr14:73226814-73226890
  hypo
acatgaataattatacgagatgtttttcttattattttaaactcattaaaagatgatcaactatttttaaaaatac

SEQ ID NO: 77054 - DNA, 28 bp, Homo sapiens
  chr14:73231480-73231508
  hypo
gagccaccgcgcccggcctgttttcctg

SEQ ID NO: 77055 - DNA, 32 bp, Homo sapiens
  chr14:73232361-73232393
  hypo
agggagtacacaggccgggtgcggtggctcac

SEQ ID NO: 77056 - DNA, 182 bp, Homo sapiens
  chr14:73263871-73264053
  hypo
cttagcatatgaatacgcttgggctagcctgctggagaatgagcagacacagaacacaaacaagctatcctagatgaagctattcatctaggacaagctgactgcagacacataggttaaccagcccaaatcagaagaaccagctagctgagcccaaatcgaattgccgacccacggaatag

SEQ ID NO: 77057 - DNA, 144 bp, Homo sapiens
  chr14:73273275-73273419
  hypo
caaaacactttatatcgtaatccttttttccccacccgcactgggcgaaagaacctattcttgcaaccaacactatcctgaaaatgtggaaaacctctaatggaagtgcaaccaagtgctcctggaattcgacatgctttttta

SEQ ID NO: 77058 - DNA, 30 bp, Homo sapiens; identical to SEQ ID NO: 15844
  chr14:73275087-73275117
  hypo

SEQ ID NO: 77059 - DNA, 30 bp, Homo sapiens
  chr14:73280813-73280843
  hypo
cctccatgttgcaggcgacgtggccctgga

SEQ ID NO: 77060 - DNA, 260 bp, Homo sapiens
  chr14:73299836-73300096
  hypo
agctaggaagactatcggaatgacaaagacctgaactaaggcagtctgagcgggagtgaactgataacacattaggaagagctattgaccacagcaaatggacaaaactgggtgggaagagggcagatgtgtctgagagagacagaaaggatcccagatgacgtctagcttggccaactaggtagacgatgacaacactcaccctgacggggaatccgggaggaggcgaaggcttggcagaggaacgtggtgagttttga

SEQ ID NO: 77061 - DNA, 412 bp, Homo sapiens
  chr14:73302316-73302728
  hypo
aaacagcctgcttcccgggagacccttaaatgtcttcacacatccacagctgggggaggagacgctgatgaacaggagaagatggagcatcggcctcccctggctactcactctgtgctcgggccgcctcgcccacttgtaaaaccccaaatgccagggtggcagcaaggcatacatgcaactatgacttgacccgcagcgaggcagcaaccaggtctcacctgggcatagttaccccacaaggacaggaaaggagaaatggtttccaggcccaggacacccagaagccaccaaaaaccaacctcatggttcatcccccttatttgactcttcgacacctaaaacctgtgcgttgtgttcaagatacacccgccggagaccacattcccagacatcccgagggccagccgtc

SEQ ID NO: 77062 - DNA, 19 bp, Homo sapiens
  chr14:73305454-73305473
  hypo
actccgtctcaaaaaaaaa

SEQ ID NO: 77063 - DNA, 30 bp, Homo sapiens
  chr14:73306326-73306356
  hypo
ctgaggtaggacaaccggatgccctacttt

SEQ ID NO: 77064 - DNA, 50 bp, Homo sapiens
  chr14:73309119-73309169
  hypo
tacaaccacagccaacgctgggtgaatctcacaaacgcaatgttaaaggg

SEQ ID NO: 77065 - DNA, 48 bp, Homo sapiens
  chr14:73313912-73313960
  hypo
cactctggaccagaccgcgtcctaagagcttcacgtgtgtggtcattc

SEQ ID NO: 77066 - DNA, 590 bp, Homo sapiens
  chr14:73318385-73318975
  hypo
cacaaactaacttcccgagggatgagtattttgatgcagatacttcttcaagtgaaaaatgtacaatgtacaaaatgtccactcgaggatctgttcctccccgtgtgggtaatcgccctcctaccacgggcaacgggtaggcaaccgatatgcccagaaaggcggccaatgggaggacagctcgcccagcctcccgattggccaggcccgccaccagctggaaccatggcgagctttgaggacagcagagccacttgatgggattctctctctcttcaaagcatagagcaaacatcaattaatcctcaaaagacgctttcaagaagaacattatcccttttggagacgcagaagctaagaggtgccgcaggtaggtgaagggaaggcaggaagttgaagaggagaggagaaagtggagcaccgggctttcagccccagttctggttctcctgagagagtcaagttgcaggagaagaatgaacctgcagaagccgggcagggagaggtggtggagaagccgctgctcttgggtgcgcccctcaaggcttcccactgccccatcccctaggagaccacggagtgaaaaaagt

SEQ ID NO: 77067 - DNA, 30 bp, Homo sapiens; identical to SEQ ID NO: 44043
  chr14:73331141-73331171
  hypo

SEQ ID NO: 77068 - DNA, 30 bp, Homo sapiens
  chr14:73332342-73332372
  hypo
cgaggacctcactgacggctgaaaccacag

SEQ ID NO: 77069 - DNA, 256 bp, Homo sapiens
  chr14:73333000-73333256
  hypo
accctcaacattcatcgtgccaaaccttaagtaactccccagcacctgcaggatcagtgccaaacttttcgcccaagtatttataatcaggtccttcgtgacctgtccagcttctctctcccagtgacctggctggtgttctcactgctcctttctgaacccaagcttattcgaatgcacaggctcaggtacccgcctctgctccatcgataccagccatggagtcttgggcaaatcttgggcaactccttggagt

SEQ ID NO: 77070 - DNA, 75 bp, Homo sapiens
  chr14:73333616-73333691
  hypo
gccatcatgcctagcccactggtactcattttctaagggtattcttttctaaccagaccacgaaatctccaggct

SEQ ID NO: 77071 - DNA, 36 bp, Homo sapiens
  chr14:73349481-73349517
  hypo
ctatcaccagcaccgcgttgccgcccctctccccac

SEQ ID NO: 77072 - DNA, 42 bp, Homo sapiens
  chr14:73352048-73352090
  hypo
atctagaaatgtagccgctaattttttgggtttgtttgtttg

SEQ ID NO: 77073 - DNA, 38 bp, Homo sapiens
  chr14:73352791-73352829
  hypo
ctgggcagctgggcacggtggctcatgcctataatccc

SEQ ID NO: 77074 - DNA, 76 bp, Homo sapiens; identical to SEQ ID NO: 35411
  chr14:73358964-73359040
  hyper

SEQ ID NO: 77075 - DNA, 196 bp, Homo sapiens
  chr14:73359294-73359490
  hyper
taccgtccccgggagcgaacctggttttcaactccaggagtggccaggggtgaagacgagaatgcgctgaattaaaagaaccagggtcgacagcggccacgcaccagggagaattcggcatgaaccgccccccacccgacctgcacctccctctgccacttcgcctgcggcttcgtccgggcggggaagtcccggt

SEQ ID NO: 77076 - DNA, 30 bp, Homo sapiens
  chr14:73392384-73392414
  hypo
cacaaactgtctcttcgggacacaagccca

SEQ ID NO: 77077 - DNA, 23 bp, Homo sapiens
  chr14:73472913-73472936
  hypo
accgcgcccggccaaaacacatt

SEQ ID NO: 77078 - DNA, 30 bp, Homo sapiens
  chr14:73591774-73591804
  hypo
tgttcagtatactgtcgaggcaactttcta

SEQ ID NO: 77079 - DNA, 157 bp, Homo sapiens
  chr14:73602342-73602499
  hypo
cggaattacaggcgtgagcgactgcacccggccgcttgggggtggatttttaaagaaactttagaagaatgtaacttgcccagataccatgtaccgttaatttcattttcggttttttgaatacccatgtttgacatttctccgttcaccttgatta

SEQ ID NO: 77080 - DNA, 30 bp, Homo sapiens; identical to SEQ ID NO: 44046
  chr14:73691528-73691558
  hypo

SEQ ID NO: 77081 - DNA, 30 bp, Homo sapiens
  chr14:73704186-73704216
  hyper
aaagtcccacccctgcgggcgttccttgcg

SEQ ID NO: 77082 - DNA, 49 bp, Homo sapiens
  chr14:73704924-73704973
  hyper
cttcccgccctctggcgcctagggtcgccgccttcggccctagctcaag

SEQ ID NO: 77083 - DNA, 30 bp, Homo sapiens; identical to SEQ ID NO: 15848
  chr14:73958845-73958875
  hypo

SEQ ID NO: 77084 - DNA, 109 bp, Homo sapiens; identical to SEQ ID NO: 44048
  chr14:73959120-73959229
  hypo

SEQ ID NO: 77085 - DNA, 46 bp, Homo sapiens
  chr14:74058905-74058951
  hyper
ctgggccctggaacccgagaagcctttttggcgcttcctgaagcgg

SEQ ID NO: 77086 - DNA, 196 bp, Homo sapiens
  chr14:74079595-74079791
  hyper
agtgctggacggccacgacaccgagcccgggcggctgctgtgcctggcgcagaacaagcgcgactttctccggccgggggtgcggcgcgagccggtgcgcgcgggcccggtgcgcgccgcgctcttcctgccgccggatgagtagtctgcccagaatttggtcgagctctgcgacccccaccggcccctttcctgt

SEQ ID NO: 77087 - DNA, 110 bp, Homo sapiens
  chr14:74208209-74208319
  hyper
gttagcaaccccagccgctcccaggaaaccagccagcagcagcggagggcagggctgggcgggcacagggtcccgactatacccagtttgcagttcggcccacccccagc

SEQ ID NO: 77088 - DNA, 66 bp, Homo sapiens
  chr14:74252666-74252732
  hyper
tttcttcgccactaccgaggtcttgcacaatagcctgtgtataaacatccacgccaacaatgcctg

SEQ ID NO: 77089 - DNA, 241 bp, Homo sapiens
  chr14:74254402-74254643
  hyper
gggtccctgtccccacgttctctctaaaagtctgcatgatgtccctcgtcatttctacgggttataagtgagcaagacgtttaccacgtatcacacttctgggggctatttcaacgcccaagctggggctgcagaatggtttctgttctaatcctcccccgcgatttccacctctttacactcaactcacagaaaatagagtctgatgcattctgtgtttcatcaccggtcaaaagtgact

SEQ ID NO: 77090 - DNA, 30 bp, Homo sapiens
  chr14:74273409-74273439
  hypo
ttgacacacccatctcggtgccagctgggc

SEQ ID NO: 77091 - DNA, 20 bp, Homo sapiens
  chr14:74529016-74529036
  hypo
tgactaggccgggtgcggtg

SEQ ID NO: 77092 - DNA, 382 bp, Homo sapiens
  chr14:74706015-74706397
  hyper
cgacattgcctgcggcgggagctgccagctttttggaattcctaatcgctcctggccccggtgattggctgctcagctctgaccccacttgggctgccgcctggttggataaaaggggaatctccttgggctccagagcattagacaccggagggggcacctgggaccaacttcgcgaagcgggaagcccggcgggggggtggggggagctaaagacctgcggcctcagcccctccaaagaacagggagatgacggggaaagcaggggaagcgctgagcaagcccaaatccgagacagtggccaagagtacctcggggggcgccccggccaggtgcactgggttcggcatccaggagatcctgggcttgaacaaggagcccc

SEQ ID NO: 77093 - DNA, 605 bp, Homo sapiens; identical to SEQ ID NO: 1189
  chr14:74706940-74707545
  hyper

SEQ ID NO: 77094 - DNA, 176 bp, Homo sapiens; identical to SEQ ID NO: 1190
  chr14:74707572-74707748
  hyper

SEQ ID NO: 77095 - DNA, 120 bp, Homo sapiens; identical to SEQ ID NO: 1191
  chr14:74707791-74707911
  hyper

SEQ ID NO: 77096 - DNA, 621 bp, Homo sapiens
  chr14:74707912-74708533
  hyper
aaaaatgtccaaatctgctttaaaccagaccaagaaacggaagaagcggcgacacaggtgaggcccccgctttctgttacctctcctgcccgcgcaccccgctgccgtcccccgttccgggatcgggtctctcggaccctattttcgccgacaacggatctgaggtccgaggccgtgccagggcgcagaccacgggttgtttggcggaatctgcccgggggccttggcgtcggcaccggttgagcaggatgagtggccgccgggaaagcggcccggttcgggctttctcctccttgttcaggagaaaggaaaggctccaacacaggccaaactgagccacagagtgggggcggtccccagatccccgcaccagtacattctgagagccacacagacccggcggcgggcagattagctcccacctcctgccagagccggttctttgccctcggcctcaaccgccgcccccatttctctcccggggtccctgtcctctctgccaactccctaagctttctgctcccaccgttctccaaagctggagcgatctctgcactgacagagcattttcttttggcttctgctcattcgtgattctgaccgagtcgcttcccttctgtg

SEQ ID NO: 77097 - DNA, 333 bp, Homo sapiens
  chr14:74708774-74709107
  hyper
cccttccgcaccagccgcactgctaccagttccttgggtacatttgtaaggtggttttcaaggaaataaaggagaaagaaccaaaaatctgcctgcctttctgcgggtgctgctcgcaggtgctgccccggcgctcacctcggagctatttccccgcaccccactccgtccccatcaggtggggccgccacagactctgcgccctttcaagacatttctccactagggcgttctctggcacccccgccgccacatcgttttctcccaccctaatttgttttcagcctctttgcaccctctctgcgcttttctatgcttcgttcttccttggcc

SEQ ID NO: 77098 - DNA, 86 bp, Homo sapiens
  chr14:74717661-74717747
  hypo
tttaaaatgcccatgcgctcccccggccaacacccagcaattccgatttaattggtttaaaatcaaacatcttcggcaggtcacag

SEQ ID NO: 77099 - DNA, 387 bp, Homo sapiens
  chr14:74724894-74725281
  hyper
agtgcgggtcaatgccgcggctcccgggagagcagccgctttaatttcccgtggtatttcagtgcctgaggcccatcgattcaaactgaaattaacttatttttcaatcagcccagggctgcccctgggggtgactcttcttttgccgcctcctgaatagagctggagcaatttttcattaaaagctgatacctctgccgcgggggagggggcccggagggaagggcggcgccggcccagacccaggcaaggaaatcgggaggaaatgaacagatttcccaagcccgcctcggtcctcccctcccgactccctcgacttccctggggcgactcgctgcccccggggtctgagcctttaaggactgtgaggggcgagaagggaaccgc

SEQ ID NO: 77100 - DNA, 36 bp, Homo sapiens
  chr14:74824362-74824398
  hypo
aaaagcaccttctaccgctggcggcggcagtcccag

SEQ ID NO: 77101 - DNA, 30 bp, Homo sapiens
  chr14:74824734-74824764
  hypo
acactggtaccctatcgctgcttcaaacgc

SEQ ID NO: 77102 - DNA, 223 bp, Homo sapiens
  chr14:74892548-74892771
  hyper
ccccagctcactccccgctccgtgcctagctctgcgctcccgcggcgcccccagaccgccccttacctgtcccgccgcggacggtcccgcctcctccgcggggctcgggggctcggcatgggccggtgagcgacggcgcccccgcctcgcggtcgcggtggaactcccaggagggctcccctgctctcgtccccgcgtccctgagcagccgccgcttcagcac

SEQ ID NO: 77103 - DNA, 315 bp, Homo sapiens
  chr14:74892798-74893113
  hyper
cgccgccgcccgccccgccccgcgcggtcccgggagccccgcatcctggccgggccccgccgccgccgccgccgcgcagccctcggcccggcccgaggcggctccgcgccgacttgggagagcagcgaggagggtccccctccttcccgcctcccgccgccgccgcctccctctcgcttccgtgctccgtgctcccttccacgctccggaatcagcccaccaggcactccggacccggctccggggcggggcggggcgggaagtcgggggagcccggaggaggcggcgaagcgaggggcgcgcagctggaacccg

SEQ ID NO: 77104 - DNA, 348 bp, Homo sapiens; identical to SEQ ID NO: 35424
  chr14:75077895-75078243
  hyper

SEQ ID NO: 77105 - DNA, 574 bp, Homo sapiens
  chr14:75078651-75079225
  hyper
cggggcggctggagagtggtgcgcgcgggcaccgcgaagagctttgtggtcggcacgctggacgcccgcgggctgttctcccggccccgcccggcggccagcttctctgagtctagggggccctgaagcggccgactgggggcccggctctcggcggaacgagggctgcgcgccccgagcctcgagtccgcgctcctactccagctgggctcgcacggctgctgcaccttcgcgcctcctccctgtgcctgcagccgtctgaaggggacccggacggttttatttttggaaacctcccccggctttttcgtctcttttatccacaccaggccccctcctcggagggacagctcagccccctcattaccggagagggagcgaggaattccagcaacacccactttggcaccgggaagccagcgggcggcgagcgggcggcgagggggattaacccgtgcggagcagggggcggcgcggggctgacccaggcgctggtcgggcagatggcgcctgccacgaccgggacactgggccgcctttctcctgctctgggcaagttcgaactgcagacctg

SEQ ID NO: 77106 - DNA, 30 bp, Homo sapiens
  chr14:75326230-75326260
  hypo
ccctttaacaagagtcggagaattgtgatg

SEQ ID NO: 77107 - DNA, 30 bp, Homo sapiens
  chr14:75332119-75332149
  hypo
ggaaactggagagagcggttggggagaagg

SEQ ID NO: 77108 - DNA, 80 bp, Homo sapiens
  chr14:75389373-75389453
  hypo
caaagggatgacagccgtggctgcgggaagggaaggggctcagagagaggcccacaaagctaccccgcctttgctctccc

SEQ ID NO: 77109 - DNA, 30 bp, Homo sapiens
  chr14:75411978-75412008
  hypo
tgggaacaggagccacgggacactttctgc

SEQ ID NO: 77110 - DNA, 30 bp, Homo sapiens
  chr14:75422033-75422063
  hyper
gagtggggggctggacgcctccctcactgc

SEQ ID NO: 77111 - DNA, 43 bp, Homo sapiens
  chr14:75422408-75422451
  hyper
ccggtcagcccgcagcgcccggccagcccgcagcgccggagcc

SEQ ID NO: 77112 - DNA, 51 bp, Homo sapiens
  chr14:75446328-75446379
  hypo
ggcaagaaggcaagacggattgcatttcagcctgaacgtgcctgggatatg

SEQ ID NO: 77113 - DNA, 18 bp, Homo sapiens
  chr14:75517394-75517412
  hypo
gcccggccagaaggtcat

SEQ ID NO: 77114 - DNA, 19 bp, Homo sapiens
  chr14:75749479-75749498
  hypo
aaaaaattttcaggccggg

SEQ ID NO: 77115 - DNA, 209 bp, Homo sapiens
  chr14:75760140-75760349
  hypo
taatatagtctggggcgcagaggtctgctcaagatcatccaactggagtggcagcgctggaattagagtccaggcagtgtggcttcaatgcctgaactcttagccattagaaaggaaaaacaaagcaaaatcagtatccgcaacaaccttgcaggcacggaggccctcagaagggacaggagaggccgggcgcggtaatcccagcactt

SEQ ID NO: 77116 - DNA, 51 bp, Homo sapiens
  chr14:75791653-75791704
  hypo
attcggctccctccccggtgtactgctattcctcttcgtcctcctttaccc

SEQ ID NO: 77117 - DNA, 30 bp, Homo sapiens
  chr14:75938324-75938354
  hypo
ctgtgatccctccctcgctcactcctctca

SEQ ID NO: 77118 - DNA, 34 bp, Homo sapiens
  chr14:75996120-75996154
  hypo
acaatgggccgggcgcggcggctcacgccttaat

SEQ ID NO: 77119 - DNA, 232 bp, Homo sapiens
  chr14:76001805-76002037
  hypo
gactaggatcatgggcgtttttaacttttaaaaaatatctttaatgtagttatactgtatttttttatttttaaagaaacagaagaaaatggccaaatagagagctgaaggaactctggaggacatcaagtacaaagagacaatattactgagctcgaatttggggatcaggttttggtaggagaccttataatttataccccaaataggaatacttcgagagtggaagatg

SEQ ID NO: 77120 - DNA, 34 bp, Homo sapiens
  chr14:76101271-76101305
  hypo
gaagaattggcctgacgatcgtcattgcaggaat

SEQ ID NO: 77121 - DNA, 69 bp, Homo sapiens
  chr14:76597656-76597725
  hyper
cgtcggtgggctgggcgggagcgctgaccctggcgcctcggaggagggagggggcgggctggggagggg

SEQ ID NO: 77122 - DNA, 890 bp, Homo sapiens
  chr14:76604575-76605465
  hyper
tagagagattcagcccggacaatcagggttggcttcacggaggagggggtatctgagctgagctttgatgaatacgtcagatttgggggaaaggttgctgctggatagcggggcaggaagaacgagcgtatctagttgtaatgccaacaggtcagggggggaaagttggggaatggggtgggaggaggaagaattagactggccccttccatcatcgccatccttctgtgttgacccaccccggctccgtcccaactctcccttcctctccacatccaggaaagattaacttctctccgtgcgagaaagttatcattagccaagaattaaaagagtgattaatgatgccccctcccctgccccctccccaaggccttatctggtggcggtcagctggacaatgcggcagggtgggagggggaagcgagggcgacggagaaaatggaaaacaataaatattaagcgcaagaaaaaagggagcgcagcgccgttcccacttgttagattgaaggcgcctctccagaggggggaaggctccaaattgctaattagcgcctgtgaaaaggcctagctctgatatgcgcgccgctgaaaggccgacgttaatgaagccgcggcgcgcccgcttccctttgactggccttcatccctcctccgcgccccgggccggcccgaacaatgcggcggggagcgcaggctcccccaggcctcgccgggacggcccgggcagcgcgcgcggggggcggcgcggcgccggcgaaatgtggagggggagataaggccgagcgcagggaagaggctcactcccaggggcccagggaaaatttgcagttattatgaaggagatgagacagattaaaagcccttgtgttcgccgctttgccccttta

SEQ ID NO: 77123 - DNA, 169 bp, Homo sapiens
  chr14:76744173-76744342
  hypo
gggcagggggcactgcggtgaggtgtgtgctattctgatggggcctgggagtggaacagaccaggccattggtgcctcacgtgctacaagcctaggagcatgaacttgcctagcctcaggcagcgcctagtgctggaggagccaactcgaagtgcgtcctgggagagca

SEQ ID NO: 77124 - DNA, 109 bp, Homo sapiens; identical to SEQ ID NO: 35428
  chr14:76795936-76796045
  hyper

SEQ ID NO: 77125 - DNA, 255 bp, Homo sapiens
  chr14:76819137-76819392
  hyper
ctaaccctcgaactccgggctttctgggaacgcgggctctctcccctctttccctccgcccccacgcgcacacaggcgagcaccgtccgcccttcctagttcccaccgcgcgcccctcgctgagcgctccgcacactctgagatccagcgcgccctctggtggcacacggccccgaatcgccgcgctcctgcgggccgcgcgcagggtcgccgggtaggcacaggcacgtcccgtggccacggacctttgccctc

SEQ ID NO: 77126 - DNA, 443 bp, Homo sapiens
  chr14:76842512-76842955
  hyper
cgcatcccctctgcccgctctctccggagcgtgcggatgagtggagagctgggctgtgcgcgcacggctctctgcctccctctcccccgccgcggccgcctcctcccactctgcgttctcgcgctcactgtgccctgcccgggctcgcaccttgcccgtgcccttcactcgctcttccgcgtgatttccccgccgtctttctctaccaactgggaatgctaaaacgggactgatggacgtgtccgaactctgcatcccggaccccctcggctaccacaaccagtaggtgccctgcttctcggtctgtctgtccttctgcccgtctggcagtctctgtcctggggatcgcagttccttttctgcacattcttgtgtaaaagtggaagggacttcgggggggcacttgggggacgaaggaggggaaaagccgcacacttctgggt

SEQ ID NO: 77127 - DNA, 202 bp, Homo sapiens; identical to SEQ ID NO: 35431
  chr14:76843184-76843386
  hyper

SEQ ID NO: 77128 - DNA, 262 bp, Homo sapiens; identical to SEQ ID NO: 11972
  chr14:76843732-76843994
  hyper

SEQ ID NO: 77129 - DNA, 180 bp, Homo sapiens
  chr14:76998049-76998229
  hypo
gtcacaggcatctgccgtacagcacacactaatttctggcgataattatctcttgggtttcccaccctctcctccttgtgtcaccctggctaaatgacacacgcagatttcattgaccagccatgaacctcaccttcatggagaccgacgatgtgatcgggtttccgcttctgctgatct

SEQ ID NO: 77130 - DNA, 415 bp, Homo sapiens
  chr14:77227599-77228014
  hyper
tctccatggagtttgcgctccctctggcacgttgaaaacgtcctccgcagcttcgcaccggcttcgcggcgccctgacagctgggtgaggagggagcgaatgcccaccggcgtccttggggtaacttgggacagaggcaccgccgcggggggcggaggactgggcgcgaaggcgctggccctttaagggggggacggagcgcatgcgcggcgcgggccgtagtcgagcctggtgggcggctggctggcaggggacgtggtcggcggcagcggggcccaggggcggcggggctgcagcagcggcggccccagcttcgccgagcagcgatcggctggtgggcttctcgttggcgggctccgcgttggcgggctgctccccaggcaccagcgcagcgcgcgctcgcccggcttcgtca

SEQ ID NO: 77131 - DNA, 247 bp, Homo sapiens
  chr14:77228556-77228803
  hyper
ctcccggacttgtctcgtcgcgtcggagaaatcgccccccagcgccgctctcccgcccgggggtcttggttccgagctcgcgcggccgggagtcgcctcggtcttccttggggcgcgcgcagatgtgagcgtgcgagagttgtgtaggggattttgttccctccgaaactgagacccagggcgcccagtgggcacccgtgccttgactctgtcctttctgcagccgctggtccgagctgtctggcct

SEQ ID NO: 77132 - DNA, 258 bp, Homo sapiens
  chr14:77242433-77242691
  hypo
gaggccgcctacggccgctgctggcacgtgctcaagaaggtgaagctgggccagagcgtgtcacacgacccgcacagcgtggagcagatcgagtggaagcactcggtgctggacgtggagcgcctgggccgcgatgacttccgcaaggagctggagcgccacgcccgcgacatgcggctcaaggtctgcccgccttccacgccctcgccccctccctcgccccctcccccgccccagcagaggcgatgtgaggattga

SEQ ID NO: 77133 - DNA, 222 bp, Homo sapiens
  chr14:77519615-77519837
  hyper
cctgctggggaagaccgcataatttgaagcctcctgacataaaacaggctggttgagggagggccctttctgtctaatacaccactcgtcgggacaggattgcaaagggggcctggggaggtgagcccactggaaaacaatgtgtgcgcgccccctgctggctgcgagcagaggtcccgcctgtccgctgggggtcttcaggtggttcgtgttagcaccacc

SEQ ID NO: 77134 - DNA, 578 bp, Homo sapiens
  chr14:77591173-77591751
  hyper
ggagacgcggtgatgcgcggggcccgggccgtggacaagactgcagtgtcctgcactacctgccgcccactcatcaggccgattctcctcaccttacgcttagatgagtttcgagtaagaccactgctggcatcaagagtctgggcccatgatctcgccctttcgggctaggcgaggcagacccaggttggctgcggcccgcggtccccgcgcagccaacactggcagccaagcgcggggcgcgcgcgccgggagagtggagcgcggaggcccgacggcgccccctcccggcgggcccgagccacggccgcgggctctggcgggtgccggggaggccacgcgcgacggcgtcgcagccggagcccagacagacgccccacgctgcgcggccttcatcccacggctggggcgatggaaaggtggtcccgacacgcgcaggggtctgaggaatcggcttcgggattctgtggtctttgtggtccgcagccggcaccactgcttcctgtaatttaattttctctcccgaaagcgttgctaattaaatcctttctccggcgagccgtcgccccccgcccctg

SEQ ID NO: 77135 - DNA, 15 bp, Homo sapiens
  chr14:77600201-77600216
  hyper
ggtggcagcagaagc

SEQ ID NO: 77136 - DNA, 125 bp, Homo sapiens
  chr14:77600264-77600389
  hyper
cgaacatttcagaacccaggacagctcctgcagggcacggggaggggaaacaccagagccgctttacacccaggccaccggcataactgcgatctaggcaggctttccaccgggagggagggaga

SEQ ID NO: 77137 - DNA, 93 bp, Homo sapiens
  chr14:77606256-77606349
  hyper
ggcaggccagagacccgagcccgcagcggcctcgggtctaggccccacctgggggtgagtgttgcctggggttttgagcgagctcggcgcctt

SEQ ID NO: 77138 - DNA, 99 bp, Homo sapiens; identical to SEQ ID NO: 35438
  chr14:77606757-77606856
  hyper

SEQ ID NO: 77139 - DNA, 1396 bp, Homo sapiens; identical to SEQ ID NO: 35439
  chr14:77606921-77608317
  hyper

SEQ ID NO: 77140 - DNA, 30 bp, Homo sapiens
  chr14:77646077-77646107
  hypo
cctggcctctctttacggcatgaccttgat

SEQ ID NO: 77141 - DNA, 165 bp, Homo sapiens
  chr14:77703958-77704123
  hypo
gttcattgagggttgcgcttgggggctttaactcctcccctacttggccctgcacaaaagctgaacatgccccaaggccgggaaagagcagtcgcagtatttgaagcatgctgcaggtgttggtgtgcagagatgactgacggggggccacgggcaggcaccagc

SEQ ID NO: 77142 - DNA, 85 bp, Homo sapiens
  chr14:77736611-77736696
  hyper
cacccctctcccctgcggtgaggctcccgcatctgtcaccccttccccggctgctctctggctctttcctcggaaaggtttgtct

SEQ ID NO: 77143 - DNA, 166 bp, Homo sapiens
  chr14:77736980-77737146
  hyper
ctggttggcaacaggcgcccacggtcgagagagaggcagaggggctgtgccacccgtcgccgcgccccgctcctctggcgcacatctggcaggcgccccagcgccccggcagcggccagttttccctccttcggggccggtcctgccgcgtgacccctttcccgcc

SEQ ID NO: 77144 - DNA, 462 bp, Homo sapiens
  chr14:77737147-77737609
  hyper
aggcagcctccacccgcatccccgggcgctcgtgtagccctcacctggcaaacaggacggtgccgtgctccagcgggctgcggctcactgcccgccagctctgccggatcagctcgggctccgggcgctccatgctgtcccggggacgcggagcgcggggctgggaccctcagggctcgggtgccgtcaccgcacgtgccgcgccatctcctccgcgacgcggtcccctccgcccctcgtacgccccccgtgcctccgcccggcgggggccgcagccgctccttccctggcgcgggagagaaaaggcgcgcggccagtcgtaggtggagacaccccagctgtgcttccggggaccccgcttggccgctgcgccctgcgccccgcagccgccagagccgccccaccccgcgacgcctgggctgggcgctttaaagccgccacggcccccgccccctccaggcc

SEQ ID NO: 77145 - DNA, 675 bp, Homo sapiens
  chr14:77964462-77965137
  hyper
cccacccacaggccacgaggacagagccagtctcaggctggccacccctgccggcggctggagagccccactgtgcctccgcttgtctcatggaaggggctcacctgaccgtttgaacctcagcggccctggcccgccactccgcaaagcgccagattcctcgcaccggcgggactcctctccgagctagcgcgcacctggaaagggggctgcaggcgaggtccgctcagggcgaggaagcccggccaccgtggagtgtcggccacctcactccgcacagaagtcaaacttgtcacccggctggtccgcggcagcccggctcgcggtcacgcgcgaggagtggaagccccgaagtccggcgcacctgggcaacgcccggtgtccgggagcttccggccggccccggcccctctctccatcggggggtcgctgcctgtgtgtgtcccggtcccgctccccgcacggctggagccggcgggctggggaggtgggaccgacagcgcgctccgcagcccggtgccgccgccactcacctctgcgagcctcgtgaggctcccaggccgtggtccgcggagccgcggcttcttcacggggagccctagcgccgcctccagcagcgccgccagcagcagcacgcagaggaggagcccggctcggtcgcggagcgcacgcatc

SEQ ID NO: 77146 - DNA, 259 bp, Homo sapiens
  chr14:77965424-77965683
  hyper
atctggccgcctccccgccctcagtccccgccgctgtcgccgtcgcagcccccagcgaattcctgttcgcgggaagctgcggcccggcgcgctccggccctgcgctgcgactcctgcggggccctgagggtccgacgccacctctgccctccccgaccgcgctccaactgcgacctggaccggcggtgccgcgcgggcgagggaggcgcagcccgacgggagagtggcgcgagtcttcggatgccgggcagatgtttgg

SEQ ID NO: 77147 - DNA, 30 bp, Homo sapiens
  chr14:77968899-77968929
  hypo
tgttttttttttcctcgagatggaatctgc

SEQ ID NO: 77148 - DNA, 30 bp, Homo sapiens; identical to SEQ ID NO: 44058
  chr14:78141401-78141431
  hypo

SEQ ID NO: 77149 - DNA, 22 bp, Homo sapiens
  chr14:78165413-78165435
  hypo
ccttattcggtctctttagcac

SEQ ID NO: 77150 - DNA, 40 bp, Homo sapiens
  chr14:78247790-78247830
  hypo
aaaaataattaggtgcggccgggtgcggtggctcacgcct

SEQ ID NO: 77151 - DNA, 30 bp, Homo sapiens; identical to SEQ ID NO: 11983
  chr14:78624601-78624631
  hyper

SEQ ID NO: 77152 - DNA, 36 bp, Homo sapiens
  chr14:78709766-78709802
  hypo
ttcctcatggtgagccgtgaccgcctgcgcacggtg

SEQ ID NO: 77153 - DNA, 30 bp, Homo sapiens; identical to SEQ ID NO: 44060
  chr14:79111630-79111660
  hypo

SEQ ID NO: 77154 - DNA, 70 bp, Homo sapiens
  chr14:79745172-79745242
  hyper
tgggcattttaaccccgggagacacacgcgcctggagagtggtcgcccaagccaccgccaggcagggagg

SEQ ID NO: 77155 - DNA, 82 bp, Homo sapiens
  chr14:79745475-79745557
  hyper
gcacacacggcggggcgggagccgcgcgagcgagaggagggcgggcggcgtgtgctggaggctcgcgcgggtgtatacgagc

SEQ ID NO: 77156 - DNA, 30 bp, Homo sapiens
  chr14:79745998-79746028
  hyper
gcggctgctccgtggcgctagtccagcacg

SEQ ID NO: 77157 - DNA, 30 bp, Homo sapiens; identical to SEQ ID NO: 44061
  chr14:81489175-81489205
  hypo

SEQ ID NO: 77158 - DNA, 204 bp, Homo sapiens
  chr14:81902032-81902236
  hyper
gcacacacacgcacacgcgcgcgcacacacgcactctcatcttcaactcttcatcccagcgagaggcgggtgtcaggcaaattgcttggcaacgcgcagagaaaactccatccaagccccacgtccaggccgcctctgggcgctgtccagcgggcagagcgcctgaggccaagctggggtcctgcctcccgacaccccgaaggc

SEQ ID NO: 77159 - DNA, 182 bp, Homo sapiens
  chr14:81902823-81903005
  hyper
cccgccggctcccggcgccgctcccgccgctcctgattggccgcggcgcgctcccgagccgcgccatgattgggcagccggggagccggggcggggggactggccgggcgccgccgggatctgctggccaagcttcccgcgccgcagactcgctttcccgcggctcccggggccccaaccag

SEQ ID NO: 77160 - DNA, 30 bp, Homo sapiens
  chr14:82090665-82090695
  hypo
cacctctcacaggagcgatatgggagagga

SEQ ID NO: 77161 - DNA, 655 bp, Homo sapiens
  chr14:85996141-85996796
  hyper
caacttcaataaatccggtaactggaggcaaaaaatagactccgagggctgggtctggtccggatgaaacgctagggctccttcccttccttgaatcttgggcgctggaagccagccacgggcgtcttgccacgcgagtgcccctagacagcaacacacccactggaaacgcacgtgaacaaagctctcgcccccgggagccgctgcctgcggtttcctagtcgatcccagcttctctagggagtgtcaggcgcacacagggttaagttagttccctccctggtaggagggagaggaggaggaggggaaaagcagcatactgtctcaggctgggtaccttgtagttagttgtacgttcgaaacctgtcgccgtcacttgcgcgtttggcattatccattgtcaccgcggaggaacgagcgctcgagatatcatcagtgcccgcaaatctccgcgccaaggcgctgagctactcctttccgaggtgcgcctctggtcctccgtccctggtgcccagcagcggcgaggcggcatctccgctcccgccgccgtgtccaccgagccctgggatcagggtggcagttctcaacgatgggcaggagggacctcggcggcgacccctaaaacaataccatgccccgggatccccgctgctgc

SEQ ID NO: 77162 - DNA, 58 bp, Homo sapiens
  chr14:85996891-85996949
  hyper
cgttgccaggtgaagtttccagtaaccggccgagctgctgctacgctggcaccacgct

SEQ ID NO: 77163 - DNA, 473 bp, Homo sapiens
  chr14:85997453-85997926
  hyper
cctgcttgtcctcttcgggctggcgggcactgagctggggccatcacgcctttctagagcgcctgcggaggtggcgaaggcttggagagcatacgaggcggaatccggatcgagtgagttccttgagccgcttgcgtgggacgcagggagagggcgaataacgccctcaggcgctgaatgcaggggcaaggagccagcgagggtggctggagcaggccttgccagctgttaccaagtctctccacaggcttgggggcttggggcctcctggaaagatccctccgccgcgctgaccagtacggggctcgctcccgcactttgaaggctgccgcggtctttcgtcatttataatcaagcccaagatcaaggttgcaagctgaggtcggggtactgacaacgggaatgaagccataggggaagaggataactgggacgggctggacccatacttgatacccgggaaactcctagag

SEQ ID NO: 77164 - DNA, 15 bp, Homo sapiens
  chr14:85998560-85998575
  hyper
tagttttaaactctc

SEQ ID NO: 77165 - DNA, 104 bp, Homo sapiens
  chr14:85998629-85998733
  hyper
cgggctcgttctccctcttctgttcagattcagcctcaccggacttgttacaacatgacagcaacttactggaggcaggaagagcagcacgaaataagatgaga

SEQ ID NO: 77166 - DNA, 15 bp, Homo sapiens
  chr14:85999517-85999532
  hyper
agagggctccaggag

SEQ ID NO: 77167 - DNA, 134 bp, Homo sapiens; identical to SEQ ID NO: 35452
  chr14:85999596-85999730
  hyper

SEQ ID NO: 77168 - DNA, 653 bp, Homo sapiens
  chr14:85999838-86000491
  hyper
cgccgagtcccgggatcctccaaatccgaggagctccggcgccgcggggcagctttctgccgccttccccgctcgctgtacttcttttggggttcgttggcttggcgaagcggagagggggaggcggaggaggagagaaggcgggggtcgcggcggccgaagccaagagaaagtggcatgcccgaaccctggaggcggtggtggcggaggacgggggaagacgatgccgcagctccgtaggggacgtaggcgagagcaagcgaggcgagctgggcgccccggccccggcccgctgcggggaggcgcgcgccgctctgaggctccggcctccgcacccccgcgccccgacgctgcgggcgacagggcttggctccagcagccgccgccgtcgccgccgccgccacccggaggacccagcaaaagtttggatctgggggagggcgcggcgctgagcgggattaccaccagggctggaaggagacctcgagaacctttgcaggtaacgcgcgcccccaaccctcttcttccatgccccgccgctgcgctcccgcttcctcccagagcccttcctggccctcgcgggtctggcagaaagtaagagggaggcgaagttcaagatcccggggatgagcaccgagcgctggcagatcact

SEQ ID NO: 77169 - DNA, 213 bp, Homo sapiens
  chr14:86000988-86001201
  hyper
ggtgttgcagagaggcggaatttttctcggtggcctgatgcgcagtggtcctaaggtagtgagtggccgcgtgtgcgcattgaggcggcggcagcggagagaagacggtcacgtttcccgaacggcagccttacttaggctaagaaaatagctgcagctcactccaaaagcaaaaagattccagccccaactccccgacgccccctttccccc

SEQ ID NO: 77170 - DNA, 23 bp, Homo sapiens
  chr14:87889659-87889682
  hypo
aggagccaagatggccgaatagg

SEQ ID NO: 77171 - DNA, 40 bp, Homo sapiens
  chr14:88449385-88449425
  hypo
tttaagaaagttctccggccaggcgtggtggctcattcct

SEQ ID NO: 77172 - DNA, 30 bp, Homo sapiens
  chr14:88458934-88458964
  hyper
ccctttctggagcgacgctccccgactgcc

SEQ ID NO: 77173 - DNA, 222 bp, Homo sapiens
  chr14:88459409-88459631
  hyper
cagcagcaagggcaccgcggcgcggcccgccgaacccgcggccgcagtcatagctttcgctcggcgttgccaggaagccgagagtagccactcagccattgtgtgggtcacatgactccggcgcccagggaggcgggtcccgtcgccgccacgatagatacgggcaggaggccgctgatgctgacgccgccgccgccattttgagtgcgggtcaagggcctc

SEQ ID NO: 77174 - DNA, 30 bp, Homo sapiens; identical to SEQ ID NO: 44062
  chr14:88673478-88673508
  hypo

SEQ ID NO: 77175 - DNA, 323 bp, Homo sapiens
  chr14:88789333-88789656
  hyper
cttgggtgtttgcaccggccagggggtggccggccgcggccccgtgggtaaaagaaaaagtaagatcggcgaggggtggatgaaaggatggagaggaaggcttggggagatggaagagccaagctgcttcccaaaagcggtgccggcaggttaggggctgcgcagcctgaaggctggggctacggagaagcccactgcagtgtcactccagcccccgaaggcgtgtgcgcacacactcccgcacacacacacccgcacacacactcccgggcgcgcgcttgggcgggcacgtcagcctcgctcggccgcgctgagcgcacacg

SEQ ID NO: 77176 - DNA, 285 bp, Homo sapiens
  chr14:88789962-88790247
  hyper
aacgagcggtgggcgcgccgctacttactggctcggccggccggcgggcgggcgtggaggcggcagcggcgcgcttgctggagttgcagccggagacacgcttggttgcctggaaggcgctgcaggaggcggaggaagggccgctgcggctccgccgcagacctcggcctccgggtcacctcttctcaccgctctcaccctgagctctccctccttctcttttctcacttcattttttttcctcccgcgtctggctctctcgcctgagtcccgaacccacgtccc

SEQ ID NO: 77177 - DNA, 384 bp, Homo sapiens
  chr14:88790298-88790682
  hyper
cgctccgcatctgctgcgctctccccgcccggggaagctcgctcccaaggcacagcttggtcccttccccagctacctgcagccggactggggccgctggtcgttggctggaaaggaggcttgagagaggcacgggggcccccggaggaaagcggagttgccaagacccggcagctcccggaagcggcggccccgggatcctgggaccagcagggcagatgcgaagggacccagacctgttcccggaaaggggctaaacctggagcattcgtctaacgccctctcactgcccctgcttgaagccccacaggggtttgtggtggggcctcagtcttcagaaaagccaggtggtgctgaggtgctcttgaacgggtcactccgagt

SEQ ID NO: 77178 - DNA, 506 bp, Homo sapiens
  chr14:88792857-88793363
  hyper
ggctattgcttcaggcgggttaagtctggtggaaagagactgcctagcgttcctgcggcaggaaaacaaaacatcgtggcgcaaagtctccctgcactcgccggcccccagcaggagacccgggctggcggccactgcgtcctgggtgcactcggtggcaaagcgctgctaccgggcacgggtctctgcagctcaaaacctgcccggctggagcgcaccaatagttgccccaccactttaatgaatgccgtgtggcccggcatgggaaggctgggaaagcccgaaaaccccagtcatctctggcaacgaagtttccccgagttggctggctcccttaccccctccccacgctccagcccggggtagctgtgagaccggaggagacgatgcctgccgcgtggggagtctcagggtggctggcaatgaacagctcagccagagaagagtcgaacacggattccggggcgagtcaggagaatttcctgggacagcgaatggcagggagt

SEQ ID NO: 77179 - DNA, 30 bp, Homo sapiens
  chr14:89017832-89017862
  hyper
tagactcggaggccccggaaccctctttct

SEQ ID NO: 77180 - DNA, 356 bp, Homo sapiens
  chr14:89493134-89493490
  hyper
gcgagcaagagcccacgatggggttggcggagaggcgcgtcctcgaggtaacagggatgctgagaggtggctgaattcttccttctttcagcgcccctgacctcccggcacggcgctggggaactcacgggtctggagcgtgtccgtgctgggcccccggagatgatttctggaatcgcgacccggggacctgaggccactctgggacctgcgaggcagttgttgcccaaagacaaggcctgggtacaggagctcgggaagctctctgctgcccgtctccgttatccacgttcgtctgggcaccctcctcgggtgctgcccattattcctcccgcacctgccggatccaagagtag

SEQ ID NO: 77181 - DNA, 155 bp, Homo sapiens
  chr14:89493899-89494054
  hyper
gctcatcctggaacccgggcgcccgcagggtcgcgaggccaagtgtaggtcattcccctccccgcgggacccgtgcctggtggacgcatcgccgacgcggaccctgaacgctcacatgagatccttagggaaactgaggccgaagaattgggaat

SEQ ID NO: 77182 - DNA, 54 bp, Homo sapiens
  chr14:89579245-89579299
  hypo
agcagccgaggggcccgggcactgcagcctgagcccggccgtgcacccaccaca

SEQ ID NO: 77183 - DNA, 102 bp, Homo sapiens
  chr14:89606032-89606134
  hypo
ctttaaaagatgactcggcggcttttctttaggtgtgcctccaaacacctgggttcaagtcttagctctgccacataatagctatgacgcctcaggcaaatt

SEQ ID NO: 77184 - DNA, 30 bp, Homo sapiens
  chr14:89606445-89606475
  hypo
atgtaaatgcgctaccgggaagaagccggg

SEQ ID NO: 77185 - DNA, 140 bp, Homo sapiens
  chr14:89657653-89657793
  hypo
gaacatctgccccagcgcagcgtcccagctgccctggggcgaaattcactaatagtgcggtgatgccgcgtgacagaagctgccgcctgtgccctgtccaaataaatgaagtgtgcaattgaagtcgacatcaaaatgcc

SEQ ID NO: 77186 - DNA, 194 bp, Homo sapiens
  chr14:89817840-89818034
  hyper
caaattttctaaaaccgttctgtggagagagggaggcttcctgtgaggcccacttcctgtgaagcgtttggtctatggacagcctatttttaaaaatgtaagtccttcctttgaggccccccggaactggcagcaggccgacgggcaatcgttcctctggccgcacactttcaagtgaccgaatgtacccaaac

SEQ ID NO: 77187 - DNA, 30 bp, Homo sapiens; identical to SEQ ID NO: 44065
  chr14:89895234-89895264
  hypo

SEQ ID NO: 77188 - DNA, 30 bp, Homo sapiens
  chr14:89898427-89898457
  hypo
aatcataaagaacatcgcattgcagtctct

SEQ ID NO: 77189 - DNA, 58 bp, Homo sapiens
  chr14:89918692-89918750
  hypo
gtgggaaggttccctcgccaagcccatccccatctccccagcacgctggggagggccg

SEQ ID NO: 77190 - DNA, 103 bp, Homo sapiens
  chr14:89938186-89938289
  hypo
cctttccctcggccacggagatgaggaatgacccatcagcttcgatccaggaatgggaataaagatgacttggaacagagtcctcatcaatcttcaacagaaa

SEQ ID NO: 77191 - DNA, 19 bp, Homo sapiens
  chr14:89941442-89941461
  hypo
ccaccgcgcccggccaggt

SEQ ID NO: 77192 - DNA, 85 bp, Homo sapiens
  chr14:89954654-89954739
  hypo
ttcattaaagaccaccgagcaggcaccagtggctgatgtttaattaatgtctgggccaggcatggtgactcatgcctgtaatccc

SEQ ID NO: 77193 - DNA, 41 bp, Homo sapiens
  chr14:89962244-89962285
  hypo
gttctctataggggccgtgctgctcctaagcatgctcacaa

SEQ ID NO: 77194 - DNA, 41 bp, Homo sapiens
  chr14:89962525-89962566
  hypo
cagcctgggcaacaagagcaaaactccgtctcaaaaaaaga

SEQ ID NO: 77195 - DNA, 25 bp, Homo sapiens
  chr14:90002828-90002853
  hypo
aagattaaataaggtcggcgggcgc

SEQ ID NO: 77196 - DNA, 20 bp, Homo sapiens
  chr14:90006790-90006810
  hypo
aaatgaggctgggcacggtg

SEQ ID NO: 77197 - DNA, 41 bp, Homo sapiens
  chr14:90043896-90043937
  hypo
aaatccatatattcccggggcaatcacggggaatttctaat

SEQ ID NO: 77198 - DNA, 30 bp, Homo sapiens
  chr14:90083564-90083594
  hyper
cttctttaatgaaatcgctttaaaggctca

SEQ ID NO: 77199 - DNA, 630 bp, Homo sapiens
  chr14:90084018-90084648
  hyper
taagctagtagctgacgtctgcaaagaaatttgtcaccaaaatggcctactttatgtggatagaaacaacaacaaaaaattaaacataaaggtatctcgagcaaactgcacccaaatgaaaaaccgaccctgcagaaatctgtgcacaagagggctatctgaaactacagcacgattttaaaagaaggttttgggtgactgttttcataagtctcaatctaactgaccaatcagtgtgagagttaaagtgggctccagtcattcgtgcagccttcagagctctgcaccctccgagctgctctcctctccaaggcagagtcggcgatcaatgaaaaacagggaacaaaaggaatataacaggatgtcttccttagctaaggaaaacgattccctttttcctcaatgagccagtcgcaccctgcctacgacagctccacacgggagcttccagcagaccagtcctttcgggtgaggcacattttacatttgcaatcatgtgtcccaactgctagcaaatgtgtcaccttaagcacagcctgtgacggagggctccccgagcccaaccaattgaaactaataaattaaataaattaataatcccacaattaaaacctccggagaaagattgca

SEQ ID NO: 77200 - DNA, 153 bp, Homo sapiens
  chr14:90085797-90085950
  hyper
ctaggatctgcagcccgagggtaagcgtaggggcagtacctggcagacagaggtttgccgggtgcactggtgacattggccgttcacagacggtgagacgcggtacgggatcgataaagatagatttcaaaaatataacgctaaaaagaaaaa

SEQ ID NO: 77201 - DNA, 20 bp, Homo sapiens
  chr14:90201050-90201070
  hypo
ttaaccgatagtaaaacata

SEQ ID NO: 77202 - DNA, 62 bp, Homo sapiens
  chr14:90204670-90204732
  hypo
gcaaggtccaaacaccgggaacggcaagaggatgcgttagccactcccgtgtcgctagcacc

SEQ ID NO: 77203 - DNA, 30 bp, Homo sapiens
  chr14:90323596-90323626
  hypo
atctggattcaaagacgcatttcacagctc

SEQ ID NO: 77204 - DNA, 625 bp, Homo sapiens; identical to SEQ ID NO: 35465
  chr14:90526555-90527180
  hyper

SEQ ID NO: 77205 - DNA, 419 bp, Homo sapiens
  chr14:90527512-90527931
  hyper
gaagcggggctggctcgcggtgcgcgcttggtccgggcggagcctactagtaggcgcagaggacgcccccgcgcaggatccagagaccaagggcgctctggcatggtcaaggcgagggaggctgcccgggggagaagcccctaacttcctttgctccctgttccaacctccctttctggtctcctctctccagcccgtccgcccaacggatgcgcagcgttggggcccggccggaggtcggagccctcggacgccgcagccctcggacgccgctcagcacagcccctctctccgtgcgcccgccctggaccccctccatccctaagccccggcagccgattcggagactcgggaggccacaggctcagcgcgacaccacgaccacaactaggaggcaccatcgtcgatctacctgggga

SEQ ID NO: 77206 - DNA, 650 bp, Homo sapiens
  chr14:90528157-90528807
  hyper
ctcccctatctgagccggacagggagccggggtggaaactgcgcccgcatcccagcgccaagcagacgtgaactctgcgcccgttccccgggaccttcagcgttaaggagaactccgaggagagcagggggagtggaggggaacggcggcgacaaagcggatttgaaactaggagtcaaggaggacgtggggagctggcgccacaggagctaccgaggcggcggccgggggagcctcgcggcctgcgggagagcccggcggtcatgggcgagccggcggtggggcgcccgggagctggctgagcgccggggcccttatttcccgggggtgtgggcgagactccgccgacgcccggtgccgtgggcctgggggctgcccccgggggcccggccatggctggccggggtttcagctggggcccgggccacctgaacgaggacaacgcgcgctttctgctgctggccgcgctcatcgtgctctacctgctgggcggcgccgccgtcttctccgcgctggagctggcgcacgagcgccaggccaagcagcgctgggaggagcgcctggccaacttcagccgcggccacaacctgagccgcgacgagctgcgcggcttcctccgccactacgaggaggccactcgggccggcatc

SEQ ID NO: 77207 - DNA, 278 bp, Homo sapiens
  chr14:90528869-90529147
  hyper
cgtttccaccataggtaagtgtgctggccggactcgctgacaacctccgggcggcctccacttcctccggggggcaggaccgaccctctcatcctttcattcatccatctgggcgcccagccagactccactgacatgagctgtcgcctgatcaacaggtggtattgcctccccgctgctctaatgtggtccaggcaccggcagcttcagcgtcacctggcagcttgttagaaatgcagtctcagtcccctctgcagacctgccgagtcagaatctgc

SEQ ID NO: 77208 - DNA, 67 bp, Homo sapiens
  chr14:90632615-90632682
  hypo
attgatagcggtaaccgctgcaaaatgatagctcaagcacagagtggaaatacgttccctttggctt

SEQ ID NO: 77209 - DNA, 30 bp, Homo sapiens; identical to SEQ ID NO: 44069
  chr14:90650692-90650722
  hypo

SEQ ID NO: 77210 - DNA, 61 bp, Homo sapiens
  chr14:90651094-90651155
  hypo
ctccatagagacagacggggtggcagagagtgacacggacgggcgccggctctcaggggag

SEQ ID NO: 77211 - DNA, 32 bp, Homo sapiens; identical to SEQ ID NO: 44070
  chr14:90724207-90724239
  hypo

SEQ ID NO: 77212 - DNA, 526 bp, Homo sapiens
  chr14:90849950-90850476
  hyper
caaatacccgtgctgcggcccgtggccctccatagggccacctgaactagcctcgcctgtccccttgctctttgccgttcgtccttcgcgttttgtgaaaacagttggcgccgcagaaatgagataaacgcccctgagctcgaaacccgcactcgaactgccaccgagccgacccttcctgttttggaactcagggcccggccacccgagaagcaccctcatgggcactttgtttctacaagggcccgtttccatttccttcctaaggtttccttatcccctgcggcaggaggggcccgctgggctcgggttttcagctgcgttggagctgcagaggctgcggagtgaacgcggccaggagcccgcctgggagcgcgcagcgctctaggagccgagagccgctgcttggccctcgctggccgggtaaaccgaggggaagctcctggcctcctttcccttaagccccttattgcttctgtggggaaggccctcctaggtagaggcgaaggaccggggagataacctc

SEQ ID NO: 77213 - DNA, 30 bp, Homo sapiens; identical to SEQ ID NO: 15852
  chr14:90983280-90983310
  hypo

SEQ ID NO: 77214 - DNA, 46 bp, Homo sapiens
  chr14:91059788-91059834
  hypo
gctctggcacagcagcgggttgtgggtgaggcggagggtacctgca

SEQ ID NO: 77215 - DNA, 30 bp, Homo sapiens
  chr14:91065728-91065758
  hypo
ggaatcctgcccacccggtgacttggcgag

SEQ ID NO: 77216 - DNA, 77 bp, Homo sapiens
  chr14:91580352-91580429
  hyper
ctttaagaactggggcgggctagctgccgaggagaccacgctgctgcatgggccacgtgagctcaggctgtgggagc

SEQ ID NO: 77217 - DNA, 64 bp, Homo sapiens
  chr14:91580430-91580494
  hyper
gatggagctgctacagtcagcgcttggggctggcctcagcttgtagacccgagccctgcagaac

SEQ ID NO: 77218 - DNA, 30 bp, Homo sapiens; identical to SEQ ID NO: 35471
  chr14:91581588-91581618
  hyper

SEQ ID NO: 77219 - DNA, 40 bp, Homo sapiens; identical to SEQ ID NO: 44073
  chr14:91691266-91691306
  hypo

SEQ ID NO: 77220 - DNA, 30 bp, Homo sapiens; identical to SEQ ID NO: 35472
  chr14:91720177-91720207
  hyper

SEQ ID NO: 77221 - DNA, 38 bp, Homo sapiens
  chr14:91730743-91730781
  hyper
cgccccggtagctggcggggagccggcctcgctgaagg

SEQ ID NO: 77222 - DNA, 30 bp, Homo sapiens
  chr14:91743801-91743831
  hypo
aagtgtctgctttctcgaatgtggcagaat

SEQ ID NO: 77223 - DNA, 146 bp, Homo sapiens
  chr14:91747935-91748081
  hypo
acctcgcctggcacccggatcccagtagctccagctcttggggatgagggaatggcatgcagatgctgcctttgggacctgcctctcctacccctccaccgtttctcctgctgggacaaccctgacactcccgattcccatcccct

SEQ ID NO: 77224 - DNA, 55 bp, Homo sapiens
  chr14:91754739-91754794
  hypo
accacccaaggctttcgggaggtcttatatacatggagaacgtgttgagtgcacc

SEQ ID NO: 77225 - DNA, 30 bp, Homo sapiens
  chr14:91757392-91757422
  hypo
ttttccttatgtcttcgtaaggcatttaat

SEQ ID NO: 77226 - DNA, 96 bp, Homo sapiens
  chr14:91758260-91758356
  hypo
ggagtcacggggctgcgcccacagtgcattcggagccgcgctgcccatggtactgaggactgctgcccactcatgcctcagcgctgggtggtcttg

SEQ ID NO: 77227 - DNA, 325 bp, Homo sapiens
  chr14:91766265-91766590
  hypo
ctcacctgtccagctcgccccgcagcctctggttctcgcccatggcgagggcgtttgtcctctgctcctgctgcagcgcctctcgctcagtggtcaagaccttctcccgctcctccagctccgccttgcgcttcagcatgtcaccgtgcctgttggagggaagcacctgccgtgagtctggccagggccttcttttccgacaggtaactcacatcccagaggatctgcgtgcctcccgtgagaaaatgggattcctctggagagtctctctgcagaagtgaggggcatggggcagggaacaggcggggagcgcagccactgggag

SEQ ID NO: 77228 - DNA, 30 bp, Homo sapiens
  chr14:91837088-91837118
  hypo
gtaggtggacacatccgtgcatacagaccc

SEQ ID NO: 77229 - DNA, 90 bp, Homo sapiens; identical to SEQ ID NO: 44077
  chr14:91849645-91849735
  hypo

SEQ ID NO: 77230 - DNA, 30 bp, Homo sapiens; identical to SEQ ID NO: 44078
  chr14:91850063-91850093
  hypo

SEQ ID NO: 77231 - DNA, 30 bp, Homo sapiens
  chr14:91850338-91850368
  hypo
cacacctgggtaccacggcacactggtgca

SEQ ID NO: 77232 - DNA, 518 bp, Homo sapiens
  chr14:92040365-92040883
  hyper
ttggcagggaggaggcggcttgcagatgagaaggctggcaggcaagcgctgcgggcgaccgtgggtggtgggcgggttttcccctcaggcaggtgcaggtcctaagggggcgggccccgttgggtgctcatgacgcaaaggtccctaggatttgctcctcacagcgggagcgccctcgagaggaaccgcgtctgcgcctcccgagacggaccactcgggcgcctccgccccgcgccctgcctcgggggccgccccgcgcagtgagctcagcgtggaggcggcagcgccctcgcccttccgcgccctcccagcgcggtctctcctcgtccgcgcgccccgctccccaggcgtttctgggatgctggttggccgggcacttacgtgtttcaaagcgggtgacagccgccgctcgggtgtactgttcgctctctcccgccaggatccgagttcttgttccccgacaactcgtgggagtgcccgctccagcgtggtttctccttctccgggaacggccccag

SEQ ID NO: 77233 - DNA, 326 bp, Homo sapiens
  chr14:92414011-92414337
  hyper
tcggctgcgagcgcccgggcagaaggcgaggggcgggcgcgcgcaggggtgcgggggctgggagggcccgggccccttgaccttcccacccaggggcggggcggggctggcagcgcggcccggcggggaggggcgtgcacgcccgcgctgcgtggcaaggggacccgcgagaacgttgtcgcctccggaaggaaagggacttgaactcacgacccacgcagctccagggactagaaactcacgatcgattgggaaaccagaacctacgaagcagaggcttggggcgagcgacgggagagtcgcgatcttcccgaagaaggggtggg

SEQ ID NO: 77234 - DNA, 30 bp, Homo sapiens
  chr14:92672989-92673019
  hypo
taaaacacctgcctccgttctgccccagta

SEQ ID NO: 77235 - DNA, 746 bp, Homo sapiens
  chr14:92789076-92789822
  hyper
tttgttagctctgcacgaccaattaattttctcctgcatcttccccccgtggtgggtggcggggtggggagggggtgtgtggcggggcctcgggtcggctcgggggtcggagagcccggacaggagcgactacactgcagaaaccctttttctaagagtccccagcggtgccataacctgtttctctctgcagcagcctcagagggtaaaggaagggctcgttgcagctccatatggaagaaaggagagaaaaagggagaaggaaggggattatattggtcagtagaggtccaactactgaagagaagagtgcacgggggagtgcgccctacgggacgagtacacgtgctgggaagggcggggggtgagaggcgggcaggaggggaggagtagggaggcgagagcagcgggcgggaggcgccacggcctctcagacgctggcgcccgcagccgagaagccagagagaaagttcccggggagagctcgcccctgggagggccgacgtcgagcctgctcgccgcgagggtctcaggtaccgcgcgtccagccagccttcccgcggcgcgcactcggccgcccgggctcggctcgtcgggaagcaggggaacatcgccggctggcagccggggcggccgccgccaaacttggaggaggaggatgctgcgagtgggcgcggcggcgcggggcgcgggggcgcactgagtgctccctacggcgctgctgccagggctgtggccgggcgagc

SEQ ID NO: 77236 - DNA, 140 bp, Homo sapiens; identical to SEQ ID NO: 12004
  chr14:92789959-92790099
  hyper

SEQ ID NO: 77237 - DNA, 616 bp, Homo sapiens
  chr14:92790280-92790896
  hyper
cgtccggcctcttcggcagcttgggtgggtgctggtacgggtcccctcttcctggggagttgggggctttggctggggagtctcggggcggctgcgagatgttttcccctccttcctcatcaggttggtcccaagggttcatccagtcccctccccgccgggcaggtagagcgcgcccagaagagctgatggacgctctgggctgtggcgccggttcccctgagctacgagcggcccctgggggggctcaggacgcggctgcaggtgtgtgttactaagacgaaagcaagaaccgcttccgtcccgggagtgcgcccggaatgggcagcgcaactgcggggtgcaggcaggattctcttggtctggggtgggcgaaactgagtggcccgctttcctattctgcagagccgcaggaaccgccactgcgtctcgcccctgccctggttcaaaggggtcccctgggtgccctgaggtgtttgttcttcccaaaccctaaaggcgttggggcagtctgccgcggggggtagctgccatgtttcagcatcgcgtctctcaactccccttaactcccacggagggagaaggcgggtgtgtggagcctcgacccatgccccct

SEQ ID NO: 77238 - DNA, 101 bp, Homo sapiens
  chr14:92801293-92801394
  hypo
cctatgttgggcgctattctaagcacttttcaggggttacttgcttctcgtaacaactctgaaggcaggtgctgtcctcagtttgccgatgaagtgaaaga

SEQ ID NO: 77239 - DNA, 191 bp, Homo sapiens; identical to SEQ ID NO: 44080
  chr14:92829024-92829215
  hypo

SEQ ID NO: 77240 - DNA, 131 bp, Homo sapiens
  chr14:92839920-92840051
  hypo
tttcttttacacatccgaacaactcaggactgaggggaaagttttggaaatgatctgtctccatacccagtggactctgaggacaggggacggtgaaccctgtgggtttcgacgaccgcacatcagacttt

SEQ ID NO: 77241 - DNA, 30 bp, Homo sapiens
  chr14:92858667-92858697
  hypo
tttctcctgggtccccggattttgtcagtc

SEQ ID NO: 77242 - DNA, 1180 bp, Homo sapiens
  chr14:92979590-92980770
  hyper
gtgagctccttgtcacgggaagcatccaagaggaggcggcgtgcacatctgtcaggaatgtggaggaggcgccctggctctggtctgaggttgcccttgaacgatttcgaggctccctcgggcaaggctgtggctccgagtgggacgaactccccgccagctctgggcctccccacctgccggcccgcggtcggcgccggcacaggcggagggcgtcttccttcccctgcggccccaagccaagtggaagacttttctctaagtttccctctccgaagccccgcgggcctcccgcgccccagccccagccacagcctgtggaggcggcaccccgaggttgggcgcccgtgcggcgccttggccccagcaccccccgccccgaggcccggccccgggggcgcggccgcccgggcctccgtgtgccccagggggctccgggccgcgagccgctgccgaatggcttttgacaaaaaaacccttgaccaccaaggccagcctcttcctgaaagccccgctcgctccgatacaggaagtagaagggagcgagagccccagagcgcggcggcagcggcggcctggcccttccagagggccagagccagggacatgcgggcgcccgggactccgcgttccgcgcggcccggcgcctgagcgcctccgttccccgtcccggagctgccggcggcatgatccgacacgccggggcgcccgcgcgcggggaccccacggggtaagtccgggcggccgccccctcctccctcgcgatccccacggcccgcgtcctggccgccccactccacttcttgtcccagagagtccttcgggcgcgtgacctcggggttgtcgggctgatacgggacccccaccgtggccgaggccagaacctggttctgcggggcagggggcggccctggtgactccgctggacccgatgttggctaaactttcaaggccaggcatttcactgggaacccagtgcacactttaggctgctggtggacggattacgagggagtgcgtcgctacctgtcagcgccggggctgcccgcgtggacgcggccccctccctggcgtctgccccgcctgaactttgcaaacaaaactcgcggtcccagccccgccagcctgctgcacccgctgctctgcgagtcgcagcgcgcgccctcgggtactagagccc

SEQ ID NO: 77243 - DNA, 59 bp, Homo sapiens
  chr14:93065511-93065570
  hypo
cctggggaaccccagcgaaggacattaagtgtgggggcacgatccgatgtgcctgctaa

SEQ ID NO: 77244 - DNA, 21 bp, Homo sapiens
  chr14:93091187-93091208
  hypo
agggggcggtgctttcttgac

SEQ ID NO: 77245 - DNA, 30 bp, Homo sapiens
  chr14:93101791-93101821
  hypo
aataggagcaagctgcggaaaaggggatca

SEQ ID NO: 77246 - DNA, 107 bp, Homo sapiens
  chr14:93107944-93108051
  hypo
ggtcctgggagaagccgagctttaccccagggcccttctgagtgggagccagagagctgggcctggcagccaccacagccctggcccctcatcggatggaaaagcag

SEQ ID NO: 77247 - DNA, 30 bp, Homo sapiens
  chr14:93109368-93109398
  hypo
tcccacacctgccatcgtctcatggtgcct

SEQ ID NO: 77248 - DNA, 79 bp, Homo sapiens; identical to SEQ ID NO: 44082
  chr14:93151456-93151535
  hypo

SEQ ID NO: 77249 - DNA, 395 bp, Homo sapiens
  chr14:93154887-93155282
  hypo
ggcgccctcttcacacgtagctcctcaggccattccccatgagtcccccacacccaccccatcctcggtctttgcaaagaagggcccgagcttagtttccccaggactggcctaggaaggagcaccggccacagctgctccccgtgccactcagggtggacccagcatctcaggagcacctcagggtgtcggttaagagacaggcctccacccctgcaccagagcctgctcttagctcccggtgcccccagaccccgcagctctgtgcccggcaagaagcagctagacacacgccagggcgccaagcacggccagctccgcggacccatggacaagcccagccccgcctcagggaaaacagggcctttccctacaggacacgccccagagctgtg

SEQ ID NO: 77250 - DNA, 35 bp, Homo sapiens
  chr14:93379041-93379076
  hypo
agcgggagagggagcgggagcgggagagggagagg

SEQ ID NO: 77251 - DNA, 196 bp, Homo sapiens
  chr14:93389262-93389458
  hyper
tcagccacagccccccgcctcccacgccacctcttggaaaccagatacccgcctcgcggccaagacccaccagctccaagcggcggaggccagaggtagcgaggggtgaggttagaggtgggggcgagcggggactggacacctggggagtggggaaaggggaagggggcggcaccgctgacgtcatttccggggt

SEQ ID NO: 77252 - DNA, 138 bp, Homo sapiens
  chr14:93389556-93389694
  hyper
cgacagacggacgcacgccgaggcactgcgcccccagccccgcgccggtgccaccgcagcccgaccccggccgccagtccagccgcccctcgcccggtgcctaggtgcccggccccacaccgccagctgctcggcgcc

SEQ ID NO: 77253 - DNA, 423 bp, Homo sapiens
  chr14:93389712-93390135
  hyper
cgccgctgtcctggctcttctgctctgcgccgggcaaggtgagcgagcgcggggagctcgcgggagagggttccgggcgcccctgcccaccttgaggtccgggcaccgcgcggcgccccgcacccctccacacttcccttcgggcgcggcgagttttcagcaccgcggacagcgcctccgcctcccgcctgaccctgcagtgtggcctccgcctgggacccacaagacacttgggcctgactcccaaccccccggggcaactcccccttgtgcccaccccttgtctgggcttggcgcctcggttgcatcagggccagtgccggttgcgcggtggccggccaaggtcactgcggggaggtgggagcatggctgctcgcaaccctccacccctcttcccctttcatctcacgctccccgcctttc

SEQ ID NO: 77254 - DNA, 30 bp, Homo sapiens
  chr14:93425612-93425642
  hypo
gctaatccctcagcccgcagggccccagga

SEQ ID NO: 77255 - DNA, 30 bp, Homo sapiens; identical to SEQ ID NO: 44084
  chr14:93454054-93454084
  hypo

SEQ ID NO: 77256 - DNA, 37 bp, Homo sapiens; identical to SEQ ID NO: 15855
  chr14:93697020-93697057
  hypo

SEQ ID NO: 77257 - DNA, 159 bp, Homo sapiens
  chr14:93706719-93706878
  hypo
aaaggaggaaaagaccgtaagagaaactatagttttgggagaaatcagcgttgttgacacccaatagaaaacctatttacttcaaagtgcatgtaattcatttacccggtagctcataaacgctccctagccctgcatagttttcgagtgagtgtgagt

SEQ ID NO: 77258 - DNA, 506 bp, Homo sapiens
  chr14:93897125-93897631
  hyper
caggaagcctttggccgcctattaaatcccacccatttctccgggggcgatttcctaaccttccgggaccgaattctgcaatttgatgtgcgttttgtccgaatggtagcgacacgggcctaagggagggggaaagcgagggggtggggggtggggggtatgcactcttttcctcgcaacatcgctggcggagcgagggagctcacacgacacagattttggggcaaagcctttccaactggacagcaccatgtccaccaaagcggagcagtgtaagtagcagccggcccggcattccggcccggcctcggctgggagctattgcagctgcggcgtttgcggctgctgggagaccttggcattgtgctggtgcgggggtgggggctgaggttggggcgggtggggggtggcggagagagaaggtgggggagggtggacgttaatggcagcgcggcgctgtccccggtgctgaaaaataatacggtcttcctcgggctccagcgggg

SEQ ID NO: 77259 - DNA, 35 bp, Homo sapiens
  chr14:94222874-94222909
  hypo
cccggaccccgaccccgccccggccctatcgatgc

SEQ ID NO: 77260 - DNA, 36 bp, Homo sapiens
  chr14:94226375-94226411
  hyper
cagggcaacagctgccgtccccgagggctgcctgac

SEQ ID NO: 77261 - DNA, 165 bp, Homo sapiens; identical to SEQ ID NO: 35483
  chr14:94254294-94254459
  hyper

SEQ ID NO: 77262 - DNA, 786 bp, Homo sapiens
  chr14:94254498-94255284
  hyper
cgtgcacacacactgatccccgtgcacacccaccgactcctgcctgcaccctcgctgaccctgcatgcacggccccaagaaatctcacgctgcctgcacccacactgcccagccggcctcattgcgcacactgcaacataggcacctccgtgcgctgcccctttgcacgcctccgcccagccccgatctcccgctcccgggcgtgggttcccccacgcctccatctccgcccgcacccttccaacgcctcacgctaccttgcctggcggcggccccagccgaccctgggctcggggaaaagaggtccgcgttccccccgcggcagctctgtttcccagcagccggacagcccccatttaaagccagccgcctccccagtcccccgccctctaggcggggcctccgtcctcaccttggcggctgcgcgggcgcccgggggcttcacatgccggggaggagcgcccggcgctggagcaaaagtttgcgcgccggttgggcctcccgggccgctgagcagaggaccaggagcggcgtcctcgcacggggcgcagggcgcggtggctccggactgcgcctagccgcgcgcggggcgggaggggcggcaccccgctcccagggccagggctggccgccgaggcggaggcagagggcggggaaagtctcctccacgccgcctggagccggccgcgcgagccctccccgggcccgcgttggctccccgcctttcctggtggcgccgcgcggctgcccggggcactggggtgcccgagctctctactaccctca

SEQ ID NO: 77263 - DNA, 303 bp, Homo sapiens
  chr14:94255304-94255607
  hyper
cggcgggaggcgccggcagggagctcccgctggggcagcaaagccgtgggtggaggcgaaataaataatccacgaaaaaggaaaacagacgtgagccgagccagagcctctcccgcctcccgcccggggttgcgctccccccgccgccgccgccagcgccgctgcagtgattcctcgtctccatctagcgaggctattgtgtattgggcgcttaattatttattcaccctggaggccgaggattcccacttccatggggttttggcccttgcctgcgcttcccccaagcctctcccgaggctg

SEQ ID NO: 77264 - DNA, 46 bp, Homo sapiens; identical to SEQ ID NO: 12016
  chr14:94255669-94255715
  hyper

SEQ ID NO: 77265 - DNA, 39 bp, Homo sapiens
  chr14:94393706-94393745
  hypo
cggacggagctcggccggctgcgccggggcctgtcccag

SEQ ID NO: 77266 - DNA, 106 bp, Homo sapiens
  chr14:94394699-94394805
  hypo
agccctggataagtccgcaccctgccgccgctccgtggaccatcgcaagtacctgcagaagcagctcaagcgcttctcccagaagtattcccggctcccgcggggc

SEQ ID NO: 77267 - DNA, 30 bp, Homo sapiens
  chr14:94404198-94404228
  hypo
tgaaagagaacatgccgggaccaagaagtg

SEQ ID NO: 77268 - DNA, 396 bp, Homo sapiens
  chr14:94405641-94406037
  hyper
cggtggggtgcgtggcgatataggcgtcgatgttcgcgccgtggtccagcagcagctgcattgtgcgcaggcagccgtggcggatggccacgagcaaggggctgatgacgtcgcggttggggtcggcgccgtgttgcagcagcagctcggtggcgtacacgttgttgttgaccaccgcgaagtacagcgcggagctgcgccggtcttcgtagaggcgcgcgcgctcgggggccagcggcgtgttcacgtcgaagcgcgcgctcagcagcgcctccagcacctcgtcgtggttgcgctcggccgccaggtgcagcggactgacgccgctacggcgtatgcgcgtgcggctggtcaccggcagcagcatctgcacgatcctgccgggtcgaggggcgg

SEQ ID NO: 77269 - DNA, 284 bp, Homo sapiens
  chr14:94641377-94641661
  hyper
ccccaacctctggtccgctgacgccgcccgggttctggccccaggcccacccatcggtccacacattcccaactcctccccccacctctcccggagacaccaccccgcgtcccgtcccctcacccccagcccaagtcagatcaagctcgggtccttctgccctcgaggtagcccggcctcccctcgcttcccagccagcactctttctcagtgtcgtcctggtccctgtctacaagccctcgcgaccctttgccgccatcctgagtcaccgctcatcctttcct

SEQ ID NO: 77270 - DNA, 30 bp, Homo sapiens
  chr14:94890121-94890151
  hyper
attgagtctttgccacgctcttctggggtg

SEQ ID NO: 77271 - DNA, 40 bp, Homo sapiens
  chr14:94953764-94953804
  hypo
gtgctccggtgccagcggccccttccgtacccctctcatc

SEQ ID NO: 77272 - DNA, 30 bp, Homo sapiens; identical to SEQ ID NO: 44087
  chr14:95200361-95200391
  hypo

SEQ ID NO: 77273 - DNA, 70 bp, Homo sapiens
  chr14:95233491-95233561
  hyper
cttgcaccaaatacccgaggtagcccaagagaaagaacaaatccctgcagccggccgttgccggaagcca

SEQ ID NO: 77274 - DNA, 30 bp, Homo sapiens; identical to SEQ ID NO: 35492
  chr14:95234025-95234055
  hyper

SEQ ID NO: 77275 - DNA, 171 bp, Homo sapiens
  chr14:95234540-95234711
  hyper
atacagaatgtggcccgtctacatcgccatcactttattgtactgtcacccttaatttaactataaatactacggtgggggctagtcgcgggcggcctcgggctgctgggctgtgcgcgccctgaccccagacgccgaccctcccggctctgtacactatttacagctcct

SEQ ID NO: 77276 - DNA, 358 bp, Homo sapiens; identical to SEQ ID NO: 4177
  chr14:95235025-95235383
  hyper

SEQ ID NO: 77277 - DNA, 182 bp, Homo sapiens; identical to SEQ ID NO: 35495
  chr14:95235513-95235695
  hyper

SEQ ID NO: 77278 - DNA, 476 bp, Homo sapiens
  chr14:95236030-95236506
  hyper
cgcccagcggcggcacggccccgcagcaggccgggcccacgggcgccgcctgcacgtgcagctgcccgtagaagtagttgttgtagccgaggcgggagccgctgaccgcggccgggaggcccgcgccgccgggggccacggggcgcgggtagaaggcgccatagtccgaggaggcgccgccgctggcgccgtagagcgagtccccgtgcagggccgggaagacgacgggagccgccgcgctgtgcgccaccggcaacaccgagtccttgcagcgcggccgggcggctaggatgttgtcgatgctgaacatgctggcgggcatccccgagccccgcgtcgggaccggggggcggcgggaacgcgccgaggacagagccttaaagtgggggggtccactctcctccagccgccgaccaaaccgaaagagagcgccggcgagcgcgcagccctgcgcccctccccgccccctgcgtccg

SEQ ID NO: 77279 - DNA, 125 bp, Homo sapiens; identical to SEQ ID NO: 35497
  chr14:95237011-95237136
  hyper

SEQ ID NO: 77280 - DNA, 55 bp, Homo sapiens; identical to SEQ ID NO: 35498
  chr14:95237867-95237922
  hyper

SEQ ID NO: 77281 - DNA, 30 bp, Homo sapiens
  chr14:95238321-95238351
  hyper
gggattaggacatgacggagatgggtctca

SEQ ID NO: 77282 - DNA, 15 bp, Homo sapiens
  chr14:95239334-95239349
  hyper
ctccagacactctgc

SEQ ID NO: 77283 - DNA, 760 bp, Homo sapiens
  chr14:95239421-95240181
  hyper
cgcggaggcaggccccgggaaaggcagtcggcgctcggtgctcgcactgcgcctcggcgggcggaaactcacaagtgtcctcaacgtgctaaacaaaccatcagggccccgcatcgcctggcgcaattggaataacaaatgcgacgcacgcaaattgtccacctcgtgttgctaagcgattgtttgtcggccccgcacgcacagctcagcatgggaggaccgcgagcgtccagaggcagccggcgagcgcttaggtcggaaatgcagtaaacatgccgctgattttccctattatcacccaaacacgatttcacacaaagcaatcaccacgcagaagtctatgaaaatgtgtttgttgaggagtcactcgccccagtaatagtcctcatttttaagatattaaagaatagctcagcggattccacatgcataaggtctatttgccgttcggcatctgtcacggcgcttttgcactgcggtcatcactaaattgattcatagagtgtagattaaattgcttctctgatttaaaacagtgtccaactttggagtatgcgtgtgagtatcttctcccgccccaaggtatttttgtcagggagaaaactgtcgccccactatccttacaccccattccgcataactgtaaaaaaataatgcatcttcgaccccaacttcttacggttcgtttcaggaactttcttaattctctccgtctcctgcccggccacagagcagagttcacaatcggatgcgtttaagt

SEQ ID NO: 77284 - DNA, 30 bp, Homo sapiens; identical to SEQ ID NO: 12023
  chr14:95240484-95240514
  hyper

SEQ ID NO: 77285 - DNA, 30 bp, Homo sapiens
  chr14:95313261-95313291
  hypo
gacaacatggttcaccgagaatggcagaca

SEQ ID NO: 77286 - DNA, 30 bp, Homo sapiens
  chr14:95461950-95461980
  hypo
tcagagacctccagccgggatgccagctga

SEQ ID NO: 77287 - DNA, 55 bp, Homo sapiens; identical to SEQ ID NO: 44088
  chr14:95522889-95522944
  hypo

SEQ ID NO: 77288 - DNA, 30 bp, Homo sapiens
  chr14:95897683-95897713
  hypo
ccccttctgtttcctcgcgctgaaagttga

SEQ ID NO: 77289 - DNA, 30 bp, Homo sapiens
  chr14:95899653-95899683
  hypo
atcttccagctcatccgaggtcccccttgc

SEQ ID NO: 77290 - DNA, 72 bp, Homo sapiens
  chr14:95906284-95906356
  hypo
gggcccgcctctccccggtgtgcctccagcttttgcgtggtcacaacgatccactgccgcagctccagcagc

SEQ ID NO: 77291 - DNA, 130 bp, Homo sapiens
  chr14:95922717-95922847
  hypo
ctggcgcctgcaccacggttcttctcccttggcaccattgccacgtgggctggatcgctctgtgctgtgtggggctgtcctgtgcactgtaggatggttttgcagcatccttggccgccacccagaggca

SEQ ID NO: 77292 - DNA, 143 bp, Homo sapiens
  chr14:95927934-95928077
  hypo
aaaatgggttttcctcgttggagcagtggcctgttctagcatggcaagcagtggcaatgggctctcataggtaaaagtaggggcactaacctgaacctagagaccaatcccaccccgaggccaggcctcgacccccaggaagg

SEQ ID NO: 77293 - DNA, 29 bp, Homo sapiens
  chr14:96342281-96342310
  hyper
gcccaaagccacattcgccacgctcccgc

SEQ ID NO: 77294 - DNA, 41 bp, Homo sapiens
  chr14:96342590-96342631
  hyper
tgccgcagcccggctcgcagcgcgcgtcagcgggggctccc

SEQ ID NO: 77295 - DNA, 364 bp, Homo sapiens; identical to SEQ ID NO: 35503
  chr14:96342879-96343243
  hyper

SEQ ID NO: 77296 - DNA, 116 bp, Homo sapiens; identical to SEQ ID NO: 35504
  chr14:96343319-96343435
  hyper

SEQ ID NO: 77297 - DNA, 118 bp, Homo sapiens; identical to SEQ ID NO: 12028
  chr14:96343667-96343785
  hyper

SEQ ID NO: 77298 - DNA, 353 bp, Homo sapiens
  chr14:96505338-96505691
  hyper
aaagccaggtcactccgatcttggtcctcaggctcgggataacgtgtcagccccaagagagcgctgcccacagccccgggtgggttgggttcaactgcacggggcggggcgccaacagctcaggacttgggttgcaggctggttcttgcaccaaccagcggggcggcctcgggcctcagtttccccatcccgcccacgaagggaggcgattgcgagcgcttggggtttctgacggaccccgccccgggggtggggcggggagtggtcacgtggaggggcgccccgtccgccgagccccgccccaccccgccccgcccgcccccgcgctcggggccctccgcctagtagagatc

SEQ ID NO: 77299 - DNA, 153 bp, Homo sapiens; identical to SEQ ID NO: 35507
  chr14:96505900-96506053
  hyper

SEQ ID NO: 77300 - DNA, 177 bp, Homo sapiens
  chr14:96506343-96506520
  hyper
gaaggctctgagacccgctttgtgaccgtgacccgccaagcgtcgacgcgccgcggtcgtttgtcctgttttgctttgtgtagagtctgatggagccaccagtgcccagcgcggccagaacccccccacccccctccccgacacaaacaggctcccagtggccggaaaaacaaatct

SEQ ID NO: 77301 - DNA, 30 bp, Homo sapiens
  chr14:96671088-96671118
  hyper
gagctcagctggaggcggagggggaagtgc

SEQ ID NO: 77302 - DNA, 39 bp, Homo sapiens; identical to SEQ ID NO: 44091
  chr14:96967321-96967360
  hypo

SEQ ID NO: 77303 - DNA, 30 bp, Homo sapiens; identical to SEQ ID NO: 44092
  chr14:97045401-97045431
  hypo

SEQ ID NO: 77304 - DNA, 186 bp, Homo sapiens
  chr14:97058943-97059129
  hyper
cgcccgggcccgcggattgccgggtcggttctcagtcaccgcacaggtgccctggagagtgcgaccaccccctgccctccgccccgcgccggccctcggctcagtgccccgcccttcctggagcacggcctgcgcatgcgcgcgccccagggcccagccctgttcctgctccggctcctgcgggga

SEQ ID NO: 77305 - DNA, 30 bp, Homo sapiens
  chr14:97081601-97081631
  hypo
gtgtggtgacagcggcggggtgggtggcat

SEQ ID NO: 77306 - DNA, 184 bp, Homo sapiens
  chr14:97129784-97129968
  hypo
cccagttctaaacaccgatgccaaggcacctctctgccaagggtcctgtactgtttcctctgcagttttctgagatcttccatgctagtataattcctcaccccactttctcttttagtcccagaaaaatcttcctggcctctcaattgcgagctgcctgcctgacgcccgctccttcctcctc

SEQ ID NO: 77307 - DNA, 109 bp, Homo sapiens; identical to SEQ ID NO: 44093
  chr14:97188235-97188344
  hypo

SEQ ID NO: 77308 - DNA, 224 bp, Homo sapiens
  chr14:97262648-97262872
  hypo
aaagaaaagtaaaatcgacaaataaacccccaaagctatgtaaactcattgagggacctgcgcaagtgaggtcctgaagcttacgcttcattggcttcattgttaatctccctctgcctgtgacttcagtgattttgacctagaacaatgacccagtgcccaataagctctcagcctcatgggtgatggagacttagctgattataataaacacaatgcggccg

SEQ ID NO: 77309 - DNA, 140 bp, Homo sapiens
  chr14:97411536-97411676
  hypo
ttatcagcatggctccgaatcctatatccaccctccagccacaccccgggacactctggatcgaagccacccagcgtcagagcttggacgatcaaggtggacctacccgctcagaaagacagtggcgcttctgtcaaggg

SEQ ID NO: 77310 - DNA, 42 bp, Homo sapiens
  chr14:97431047-97431089
  hypo
ccctcttgtggattacggtctgtcacgcgacatccattagcg

SEQ ID NO: 77311 - DNA, 350 bp, Homo sapiens
  chr14:97499277-97499627
  hyper
atgggtctgggagtccgaaggctcgcggaggagagtgtgatgtggggtctgctcccagagcgcgcgcgctgtggctcttggaaggtggggctctgaggaccggggtcctgcgtgcatagacctggagcccaccttaaagacgctgcttcagggacgcttcaacaagccccaacccacccaactgcgtggcgctccccgcctttgggcgccctgttagggttgggggtgacccctgcagcccctcatgtgcgaatccaggttctcctcccctccaggctgcttcctgcacagcagcaccgagcagcagccacctcagggccagggagcccgagctgcgggatccgccgccc

SEQ ID NO: 77312 - DNA, 4 bp, Homo sapiens
  chr14:97499846-97499850
  hyper
gggg

SEQ ID NO: 77313 - DNA, 170 bp, Homo sapiens
  chr14:97524036-97524206
  hypo
attgatctcttattgcgatgtgatttttaaacagcattaaagtaaacatagtcttattgtgttcgttttactggataacacttatctagacaaaaggaggcacgaagctgccggagctactcagctttacctctaggaaagatacagcgaatcaccgccaataaaacaaa

SEQ ID NO: 77314 - DNA, 30 bp, Homo sapiens
  chr14:97673679-97673709
  hypo
agcgcaaactgctaacggaacagtgcgctc

SEQ ID NO: 77315 - DNA, 381 bp, Homo sapiens
  chr14:97684916-97685297
  hyper
tgggggaggagggtccgaaaggaaaggctggtgggggggtggggggaagggccccagtgacgactggattcggaattttcctctcacttcgtggtagtgaagaatttaactacaacagtaacaacactaataattctaaaagccgtgggaggtcagagcgggcgctgcccggcgtcacccctgcagcgtccggatcgctccgcataggcaggggtggtgccccctccccggggcacagaaacgccacatcccgggggcgccgcccagaggctgtctctgtttctgtgtcccttcatgaggctctgtcccacaaaggcagcctgagccaggaccctaaagaggcctggtcatcgggaccggagggagttccgcttcccaggc

SEQ ID NO: 77316 - DNA, 564 bp, Homo sapiens; identical to SEQ ID NO: 35513
  chr14:97685395-97685959
  hyper

SEQ ID NO: 77317 - DNA, 75 bp, Homo sapiens
  chr14:97708952-97709027
  hypo
gattcaatgagttcccgatctaaataccaagaggatttcttttttaagataacaacaaatcgattctaaaaaagt

SEQ ID NO: 77318 - DNA, 199 bp, Homo sapiens
  chr14:97791325-97791524
  hypo
tttcctaaggtgttgcgtttcatttgactctctcctgaaatcgctgctggggtgaatgtctgggtaaaagtggtgccaagggaaggtccagtcttcactggatgggctgcaaagggtcctgggcaggaggggaacccagctgtgttctcgggccatatcagggttcctaatctcttggttacaccgcctctccgaaagt

SEQ ID NO: 77319 - DNA, 35 bp, Homo sapiens
  chr14:97900295-97900330
  hypo
tctgcatacatgtaacgggtttagaatagtcccta

SEQ ID NO: 77320 - DNA, 123 bp, Homo sapiens
  chr14:98967846-98967969
  hypo
cctgaccaagcctcacgtcaccttctctgttaagtcctgagtcacctgggtggggccagtcatactacaagctgttccagcagccctggattaacctctgtctctgcacgtgttttactccat

SEQ ID NO: 77321 - DNA, 30 bp, Homo sapiens
  chr14:99529159-99529189
  hypo
ctgactctcccaccacgaaccttcccctcc

SEQ ID NO: 77322 - DNA, 96 bp, Homo sapiens
  chr14:99532931-99533027
  hypo
gagggcggtggagggcggcggcccacgtacacaacggcgccttccagctctgggaggcttgctccagagcctggaaacacgcggggcttcccagga

SEQ ID NO: 77323 - DNA, 170 bp, Homo sapiens; identical to SEQ ID NO: 35514
  chr14:99584575-99584745
  hyper

SEQ ID NO: 77324 - DNA, 30 bp, Homo sapiens
  chr14:99594536-99594566
  hypo
tgcgagtgtgtctggcgtgtgtgtgcgcag

SEQ ID NO: 77325 - DNA, 30 bp, Homo sapiens; identical to SEQ ID NO: 44096
  chr14:99615561-99615591
  hypo

SEQ ID NO: 77326 - DNA, 42 bp, Homo sapiens
  chr14:99626459-99626501
  hypo
agcatgagagggaggcgggaaaacagacggggacgaggcccc

SEQ ID NO: 77327 - DNA, 40 bp, Homo sapiens
  chr14:99640421-99640461
  hypo
aggtcagcattctctcggttggcaacggttccactgtaca

SEQ ID NO: 77328 - DNA, 30 bp, Homo sapiens
  chr14:99698209-99698239
  hyper
aggaaggaccccccacgtgggggcctctgg

SEQ ID NO: 77329 - DNA, 58 bp, Homo sapiens
  chr14:99713206-99713264
  hyper
cttgcaagttgcaaacgtcggggaaaccggaaaattgcagtagcggggaggcaggtgg

SEQ ID NO: 77330 - DNA, 98 bp, Homo sapiens
  chr14:99736115-99736213
  hyper
ccggccccagcccggcgaggtgcgcggcggattgcaagcatataacctgcccgcggtctcgatggcacccagaggatgttttatttctattgcagtta

SEQ ID NO: 77331 - DNA, 158 bp, Homo sapiens
  chr14:99736273-99736431
  hyper
gaaagaacggcggggaaatgttcgcgcgcagcgaagaagccgccccgcgggctgcggcgggcggggagcgccgcaaagccaccttcccggtgcaagtgtgcggggactcggggcgggttcccctgcaaacaccgtacctggcccgctcgcgctcgctt

SEQ ID NO: 77332 - DNA, 82 bp, Homo sapiens
  chr14:99736980-99737062
  hyper
ccgcccctggccctacggctcccccagccggaacgcaccccgctctcctccgcccgcgccgtcagcgcggacccacgcgctc

SEQ ID NO: 77333 - DNA, 385 bp, Homo sapiens
  chr14:99738148-99738533
  hyper
cgtaccccctcaccccgccccctcaaaaaacccaaagcaatgtaaaactgccccggttcggttgtttctgggttttctgcgggctgcctgtttttgtttttgtttttgttttttctcggagactgacccttccgaggctctggggggacaccaggagaggctccttcccagttcacctggcaggctggcgccggccggaggggctgccgagtccccgcgagcgctccccagcgctcccctggcgccgcgggcccggggggagcggggcggaggggcggctcgcccagtgcgcctgggtcggtgcgggcgcagactgggagctatagattgcaacgtgaagatggcggagtccgggttctctgggagctctcggtctctctatggc

SEQ ID NO: 77334 - DNA, 70 bp, Homo sapiens; identical to SEQ ID NO: 35520
  chr14:99739091-99739161
  hyper

SEQ ID NO: 77335 - DNA, 414 bp, Homo sapiens
  chr14:99739618-99740032
  hyper
tcagactgggaaggacgcagctgccttgtcagccgtttgatctccaaccggcgaggacaagaggagttgtggggcctctccgtggcccggggacaaggccagaccacggcccccgtggacaccccccattccccaggctgtggccaactttgtcaatttgatgacctggcctccagggctgggcgcgccacgcggctggcctcctctcccttctcagggtttctctggaggcggccagggcgggtcggggcctggctccggctaggcttcgcgggcgagtccagctgcacccaccccactccgcccccaggcctggctccggcggcttcacccgggcgcatggcgaggccgtgacgcctcagcgccgcctccctcggggccttttcctcggggggcacacgggggtttttgttt

SEQ ID NO: 77336 - DNA, 222 bp, Homo sapiens
  chr14:99740491-99740713
  hyper
ctttctgagaactagcgatgtgaagcccagagagggtgagcactttgccctaggacacacagcgcgtcagggacaggtctggacccaaaacaccgcggcgtgcctgcagcccagcgccgccggcggtccgggactcgaaatcccgacccacgaccctcaccttcctggggttgattacaaggaaggcagaccccgccagtggcaaggcgggacggggaggac

SEQ ID NO: 77337 - DNA, 30 bp, Homo sapiens; identical to SEQ ID NO: 44098
  chr14:99804005-99804035
  hypo

SEQ ID NO: 77338 - DNA, 79 bp, Homo sapiens
  chr14:99847959-99848038
  hypo
ccaccagagccaggacgagcgtgcctgcctgggcatcccaggagccaccagccctaggacccttcggctctcacatctg

SEQ ID NO: 77339 - DNA, 176 bp, Homo sapiens
  chr14:99849887-99850063
  hypo
ccaccagggctgatccgctgcttgggtggagcacaggcgggaagccctgccccgtctctttgtgagctgtgggtgcgcttggcgagtcacaagcctctctgggcccagttctttctatggaagtcatgggttgcagtgttgttgagggagccggtggtgcacgtggtgaagacctg

SEQ ID NO: 77340 - DNA, 30 bp, Homo sapiens
  chr14:99889404-99889434
  hypo
atcaaagagaaaatccgcaacactgtccct

SEQ ID NO: 77341 - DNA, 30 bp, Homo sapiens
  chr14:99891695-99891725
  hypo
cgaaaggcctgccagcgggcactgggagct

SEQ ID NO: 77342 - DNA, 30 bp, Homo sapiens
  chr14:99891938-99891968
  hypo
cagaagggattatctcgctctaagcaaggc

SEQ ID NO: 77343 - DNA, 28 bp, Homo sapiens
  chr15:100274301-100274329
  hypo
gcggtggctcacgcccgtaatcccagca

SEQ ID NO: 77344 - DNA, 39 bp, Homo sapiens
  chr15:100346202-100346241
  hyper
cagccctttcccaggcggtagcggggacggtggtgctgt

SEQ ID NO: 77345 - DNA, 60 bp, Homo sapiens
  chr15:100378951-100379011
  hypo
gcaatgctgccagagcggcagctacaactctatgattgaaggcatcgccctcctggttct

SEQ ID NO: 77346 - DNA, 24 bp, Homo sapiens
  chr15:100426310-100426334
  hypo
aggcacggtggatcacgccggtaa

SEQ ID NO: 77347 - DNA, 586 bp, Homo sapiens
  chr15:100881258-100881844
  hyper
gccgcaggcgctgagcgagacgagggagccggggtggccgagcacacggcccgagtagaagcacagctcggcggggcggccgcggcgccgggccgcgcccgcctcctccacctcgaagcctcgggacaggaagcgcaggtcgcggcgcagctgaaggtacaggtcgcgcccgaaggccggcaggtgcagcagcagggcgcgctctccgggccgggcgcgcggggcggctgggggcgtgcgggggcgtcgccgccgtcggggcccgggggctgcgggcagcggcggcaggtgcacgtcgtcggggcgcacccgccacgggagcaccacctccacgtcggccgccgcgtcgccgacagctgcggggagagaggagacgcgtcagcgcggcggggcccgcccggacgcccgccctcccgctggccgccagccgcgccagcgcggggacagcgcgacccggagccggcgctgccttcccttccctcgcccggcacctccacgctggcccgcgccacccggggagggtctccggcgcagccgcgcgagcacctcccggaacggcgccgcgcatcggcgagcggagacccgg

SEQ ID NO: 77348 - DNA, 126 bp, Homo sapiens; identical to SEQ ID NO: 35980
  chr15:100881966-100882092
  hyper

SEQ ID NO: 77349 - DNA, 30 bp, Homo sapiens; identical to SEQ ID NO: 44383
  chr15:100888957-100888987
  hypo

SEQ ID NO: 77350 - DNA, 173 bp, Homo sapiens; identical to SEQ ID NO: 35981
  chr15:100913423-100913596
  hyper

SEQ ID NO: 77351 - DNA, 40 bp, Homo sapiens
  chr15:100914039-100914079
  hyper
cgggagggagggagcagtgggcggccggggagcctggcag

SEQ ID NO: 77352 - DNA, 30 bp, Homo sapiens
  chr15:101089996-101090026
  hypo
acgtgatcatctatgcggaaattttggaat

SEQ ID NO: 77353 - DNA, 30 bp, Homo sapiens
  chr15:101417814-101417844
  hypo
ctccacccctcctgccgatgggagcagagg

SEQ ID NO: 77354 - DNA, 30 bp, Homo sapiens
  chr15:101419441-101419471
  hyper
gtggggcgcagcgggcgtctgtcctgctag

SEQ ID NO: 77355 - DNA, 36 bp, Homo sapiens
  chr15:101420348-101420384
  hyper
cggctctccagaaaccgcacctttcgcgggacgtct

SEQ ID NO: 77356 - DNA, 240 bp, Homo sapiens; identical to SEQ ID NO: 35984
  chr15:101420425-101420665
  hyper

SEQ ID NO: 77357 - DNA, 126 bp, Homo sapiens; identical to SEQ ID NO: 35985
  chr15:101420734-101420860
  hyper

SEQ ID NO: 77358 - DNA, 32 bp, Homo sapiens
  chr15:101420971-101421003
  hyper
cggcgagattacctgcccggggcagaaaggaa

SEQ ID NO: 77359 - DNA, 243 bp, Homo sapiens
  chr15:101459070-101459313
  hyper
atgcaaattgcaggtcgttaacgctttagaacgacacatttctgtatcgccccgtgaagagctctacgcacatgaatgttccccgtctgtttaactgttacggccgcagtgtgtgggccgcaggcgcgctgggggctcatctgctgattttgctgcccctggagcagagggatagcgaaagcggggctgagcgcagcacggaccgatcccatcgccgcgctcgccccgcgtggaggcagccgg

SEQ ID NO: 77360 - DNA, 329 bp, Homo sapiens
  chr15:101460006-101460335
  hyper
acgagtcgggagacacgagccggggagcccataggtttcctctgcctttggagcgaacccagtcccttagcggggagcgggcggagtgtgagcgcgcgggtgagcccgtgccggggtgtcggcaagagaccgcccgggagcctctcgctggtccggggcttcctggggttgcggggcggcccagcgaggcttcaccctcctcgatgtctgggtcacgcttcttgcccaggtggtctctggctggcgcagatacaactgctctgtctaccatggtctctgcaagctacaggggaccttcctggcaggcagggacgcgggaaggaagccta

SEQ ID NO: 77361 - DNA, 64 bp, Homo sapiens
  chr15:101513805-101513869
  hyper
ggtgccttcgcagcggccccggttgggttgcgggtcgcggggcggcgagcgcagggagcgtcgc

SEQ ID NO: 77362 - DNA, 30 bp, Homo sapiens
  chr15:101535285-101535315
  hypo
tcagggcacgtgtgacggaggttgttgctc

SEQ ID NO: 77363 - DNA, 34 bp, Homo sapiens
  chr15:101558833-101558867
  hypo
agcaccataggactacgcgcggtaccaatgctct

SEQ ID NO: 77364 - DNA, 30 bp, Homo sapiens
  chr15:101633788-101633818
  hypo
gcctggccctctgggcgagcttattattga

SEQ ID NO: 77365 - DNA, 126 bp, Homo sapiens
  chr15:101785815-101785941
  hypo
caatggaaacagtcacgcacaatccgctattgacagccacatctatccctggaatcaatccgctattgacagccacagccatccctggaaatccctggaatattgtttgagcgcttcaagatcttg

SEQ ID NO: 77366 - DNA, 30 bp, Homo sapiens
  chr15:101889834-101889864
  hypo
aacctacacaggctgcgtgagaaatttcat

SEQ ID NO: 77367 - DNA, 151 bp, Homo sapiens
  chr15:102028841-102028992
  hyper
tgccaaaggtcacaccgctcggccatcagaaccgcggcagaagcccccacacaaagcgccctccctccgctcctggagaggttttaaacccaggacccccggccctgcgctgtcccaaggcctctccgacggcggccgggctccagggtgc

SEQ ID NO: 77368 - DNA, 374 bp, Homo sapiens
  chr15:102042955-102043329
  hypo
gacaggccagcaggccgccgggagcaggcagagtcaggaattccatgtccgtgacctgagagccgcaccactccacctcctgggcctcactccgccctatacacgcgcacacttaatgacatctctgatcatgtcttcaggacgcataccctctttgacttgaaaaagtaacaactgtttgtggccttctcacaggccgaaaagaacaagcggggtccagtggagaaaggtgaggcatgggaaggcctggcccgagcactgtgacttcagcgaggcaccctccacccctctcagctttcctggtctgaaagtagaatttcgccagagggtgagccgacaggtagagctgtttccacctgcgtgtgctgcctgtg

SEQ ID NO: 77369 - DNA, 40 bp, Homo sapiens
  chr15:102043695-102043735
  hypo
catgaacaaagaatacgggccgggcacggtggctcatgcc

SEQ ID NO: 77370 - DNA, 47 bp, Homo sapiens
  chr15:102096642-102096689
  hypo
gaggggtctgggttccgggtcccaggtacgttcgtccacagcatcac

SEQ ID NO: 77371 - DNA, 160 bp, Homo sapiens
  chr15:102154203-102154363
  hypo
gggctccccagtccccgcagcagcattttcctctgactctcagggccctgctctgccttctgtgctcagcagttgtttcggattgggagtcaggaggccattcccacacttgaaacaaggctgcaagaggaggctgagcagaaaccgcacaccccgaggg

SEQ ID NO: 77372 - DNA, 22 bp, Homo sapiens
  chr15:102193729-102193751
  hypo
gagactccgtctcaaaaaataa

SEQ ID NO: 77373 - DNA, 30 bp, Homo sapiens
  chr15:102270624-102270654
  hypo
gggatctgtccaggacggcaccaagccatt

SEQ ID NO: 77374 - DNA, 30 bp, Homo sapiens; identical to SEQ ID NO: 44386
  chr15:102276370-102276400
  hypo

SEQ ID NO: 77375 - DNA, 39 bp, Homo sapiens
  chr15:102306422-102306461
  hypo
ctttcccaggagcctcgccatacccgcacctgtgccctc

SEQ ID NO: 77376 - DNA, 39 bp, Homo sapiens
  chr15:20499470-20499509
  hypo
ttaggagaaacaggccgagcgcgctgactcacgcctgta

SEQ ID NO: 77377 - DNA, 35 bp, Homo sapiens; identical to SEQ ID NO: 44204
  chr15:22515501-22515536
  hypo

SEQ ID NO: 77378 - DNA, 36 bp, Homo sapiens
  chr15:22587476-22587512
  hypo
tgatgcttggccaggcgcggtggctcacgcctgtaa

SEQ ID NO: 77379 - DNA, 20 bp, Homo sapiens
  chr15:22792239-22792259
  hypo
gccaccgctcctggccagga

SEQ ID NO: 77380 - DNA, 36 bp, Homo sapiens
  chr15:22822348-22822384
  hypo
taaagttccaggatacggccgggcgcggtggctcat

SEQ ID NO: 77381 - DNA, 93 bp, Homo sapiens
  chr15:22876959-22877052
  hypo
aggaatttttaaatgcgtccacgcagagatttgtatctgaatattcataagagctaaaagctagaaacatcctgatgacggtgaagaggtaga

SEQ ID NO: 77382 - DNA, 197 bp, Homo sapiens
  chr15:22977051-22977248
  hypo
gcagtactcactgggcgtgccctaatacgattatagtcaattggaggaaaggatgcttgttggaaggatgtgcagggcaaagtctgggaggtttccatgtgcaaagctttccctgtcctcagggacgcatcaccctccgagctctgaggtgggacgctcctcagggtactgccagccaggggcgctcacttgggctg

SEQ ID NO: 77383 - DNA, 25 bp, Homo sapiens
  chr15:23035596-23035621
  hypo
tttgagacagagtctcgctctgtcg

SEQ ID NO: 77384 - DNA, 20 bp, Homo sapiens
  chr15:23084842-23084862
  hypo
ccggccgcaagatgttcttc

SEQ ID NO: 77385 - DNA, 19 bp, Homo sapiens
  chr15:23087577-23087596
  hypo
tttgagacagagtctcgct

SEQ ID NO: 77386 - DNA, 264 bp, Homo sapiens
  chr15:23158318-23158582
  hyper
acccccgaaatgcgccgggcgggtcaccgcaccccgagatgtgcccccaaggctctttcgaccgccgtgaagtggcgggcccccttgaagtggccggcggctgcccggctccctcgaggcgcctccctggcgctcgcaggggcctcgcagagccggcggggatcccaccgcggctcagtgtctagggccggtcccggcagccctctctcccgcccggctccgcaggtcctagcgtccccctcccccccgcgcccctgcaggccc

SEQ ID NO: 77387 - DNA, 145 bp, Homo sapiens
  chr15:23182506-23182651
  hypo
tcaagcagggagcagcggccagccccttccctcgcagtccatgaatgatttggacagcgccttggtgccggtgatccatggaggggcctgccagctcagccctgtcgtcatggaactcattttttatattctggaagccgggcgc

SEQ ID NO: 77388 - DNA, 39 bp, Homo sapiens
  chr15:23217780-23217819
  hypo
ctgggattacaggctgagccaccgcgccctgccctggga

SEQ ID NO: 77389 - DNA, 127 bp, Homo sapiens
  chr15:23662038-23662165
  hypo
tgccagtgagagctccgcgaggcctggcccgagatgtggctggcgtgaggggtcccggacctgctgtggtggggacgcacccagttctgtggcgcttggtccagcgaggactcgagcccactgggga

SEQ ID NO: 77390 - DNA, 174 bp, Homo sapiens
  chr15:24515033-24515207
  hypo
taacaggaagccgagcgaggagcacaaagtgcttccagagactaggtgatgggccacatccctggccagtgtgttgaccccctgaaccaaagtctgtgcgaccaacacctttgcctgtctgccccagttttctgagcatgtgctccactgacacatatgcgccaggccgccagc

SEQ ID NO: 77391 - DNA, 113 bp, Homo sapiens
  chr15:25334863-25334976
  hypo
ttctctgcacctccccggtggtgttggtataaaaagcaggcttacatcagcaagggatgattgtcgtctcatgcgatcctgggagatggcagaagtcccgggacacatggagt

SEQ ID NO: 77392 - DNA, 150 bp, Homo sapiens
  chr15:25449793-25449943
  hypo
ttgtccctgagtacccgttctcccctgtgtctttcagtgagctcttctgcccaggtggtccccctggtcttgatgggcataggtgagtacatcctgctggtgtcctggtccatgagccagggtgcgtacggttgccggaggtcaccttta

SEQ ID NO: 77393 - DNA, 182 bp, Homo sapiens
  chr15:25477788-25477970
  hypo
ccgggtctctggggacggggcacattggaggctccttcctgagcccccattctctcctgtgtctttcagtgagctcttcggcccaagtggtccccccggccttaagcggcataggtgagtgcatcctgttttgatcatgggccatgagtgttgcagcatggggtccccgacattcagccttc

SEQ ID NO: 77394 - DNA, 32 bp, Homo sapiens; identical to SEQ ID NO: 35581
  chr15:25915272-25915304
  hyper

SEQ ID NO: 77395 - DNA, 350 bp, Homo sapiens
  chr15:26107394-26107744
  hyper
accactgtgcctggccgaagactgaggcagggacttcaggccagggggccaggctggcttttcctgcctttcacttcaggtgggagcggctgtggatgaggatgtccagcggccgtcggtttctagccttgggatcattctggccccgacacggagtgacaggggatccccacgcgtccccgcatccagggcgcccctttagctgcggcggaggcacagagaggccttggcggcgctgtggcttcggtcggcaccgggtcccgcgcagccgggccctccaccctgagtggagctgccttctaagcacccagcccctgccaatcactgtgcccaacaccaagttcccgggg

SEQ ID NO: 77396 - DNA, 482 bp, Homo sapiens; identical to SEQ ID NO: 4188
  chr15:26107845-26108327
  hyper

SEQ ID NO: 77397 - DNA, 283 bp, Homo sapiens; identical to SEQ ID NO: 35584
  chr15:26108548-26108831
  hyper

SEQ ID NO: 77398 - DNA, 30 bp, Homo sapiens
  chr15:26147501-26147531
  hypo
atagggctgatgcatcgcagtgtccacata

SEQ ID NO: 77399 - DNA, 30 bp, Homo sapiens
  chr15:26234528-26234558
  hypo
gttctgagccctccacgtggcacctgggcg

SEQ ID NO: 77400 - DNA, 235 bp, Homo sapiens
  chr15:26327329-26327564
  hyper
aggcttataaatttacgagtttcactgtgttccaaaagaaaggtccagtcattcccacaccgggagtcgaacccgggccgcctgggtgaaaaccaggaatcctaaccgctagaccatgtgggagatgacaagtaaccgttgaattctaaaccaattgaatcatttccgcctgcccttgctttccgccttctgccacgcctccgacaacaaatccctgtctgcgcctgcgcctgcg

SEQ ID NO: 77401 - DNA, 299 bp, Homo sapiens; identical to SEQ ID NO: 35586
  chr15:26327610-26327909
  hyper

SEQ ID NO: 77402 - DNA, 35 bp, Homo sapiens
  chr15:26869355-26869390
  hypo
tttcgctggtgtgggcggtgcgctggaactgaggc

SEQ ID NO: 77403 - DNA, 30 bp, Homo sapiens; identical to SEQ ID NO: 12083
  chr15:27016662-27016692
  hyper

SEQ ID NO: 77404 - DNA, 36 bp, Homo sapiens
  chr15:27016983-27017019
  hyper
agagactggcggtgccgggcccgggtctcccagtcc

SEQ ID NO: 77405 - DNA, 174 bp, Homo sapiens
  chr15:27017654-27017828
  hyper
ggcgcggggcgcgggcggctctgaggactgggggctatcccaggaggggcgcgggcgaagggcccccactcccacccgccgctgctccgcggatgcggcccccgcctccctccgcccaggccgccgccgccgtgggtcgcgcttcccgcaacggccgcgcgcagcccacttacc

SEQ ID NO: 77406 - DNA, 45 bp, Homo sapiens; identical to SEQ ID NO: 35589
  chr15:27018284-27018329
  hyper

SEQ ID NO: 77407 - DNA, 130 bp, Homo sapiens
  chr15:27018746-27018876
  hyper
gcctcccgacggtgcctgcagaacgccgggaagcccccgcctcacctgcggggctcagagcctcgggtccccagggtccaggagagccagatgggcagcaggagctccaggagcccggagcacatggcgc

SEQ ID NO: 77408 - DNA, 17 bp, Homo sapiens
  chr15:27079519-27079536
  hypo
ggagtcttgctctgtcg

SEQ ID NO: 77409 - DNA, 146 bp, Homo sapiens; identical to SEQ ID NO: 35591
  chr15:27111977-27112123
  hyper

SEQ ID NO: 77410 - DNA, 22 bp, Homo sapiens
  chr15:27112921-27112943
  hyper
ctcgcggggtggactcggaccc

SEQ ID NO: 77411 - DNA, 124 bp, Homo sapiens
  chr15:27113012-27113136
  hyper
cgcgctcccagcccaggaggaaggcgctgcctggcggagcgcttggctcgtacccggggcaggagcaggggaagtctgcgaaagccgggagcgagccggggagggccggggagctggagaccct

SEQ ID NO: 77412 - DNA, 195 bp, Homo sapiens
  chr15:27113215-27113410
  hyper
cgcgcccacctgccctggcgcgccggccctggtgagcctctgtgggggtccggagggtcgtgggagcgcagcctctcctgggggtccctggctcggggctgaggggcggcgggaggcgccgcccgggtttcccgcatgcagcgccgcgtgctcgccgcctggctctggcccgggccccgcgacgagccccccgga

SEQ ID NO: 77413 - DNA, 147 bp, Homo sapiens
  chr15:27113477-27113624
  hyper
cgaggtggaagtacctgttgtgtctcccaattccggagtttgcgggggatgggggttgggggggcttcttgggaaaatgcttcttttcgaagcatactgttcggatgcctgtgagcacctatttgcgttatgcgcatactgagaaat

SEQ ID NO: 77414 - DNA, 610 bp, Homo sapiens
  chr15:27212788-27213398
  hyper
ttgacaagggaaaggcgctttttcaaaatataaaaccacgaaacatcatgtaacccagaagtacagttttgggagtgggagagatgtttctcaaagcagaacctggggcaaccacggagcagcggatgcgcgctgaagggcgcgtgggcagcggggtggttccgcggcctgcggggcgcagcgcgccaccgcgggatctgaaaggcgcttcctggcaacgctgctagggtcccgccgcccccgccgaggtgaagtccaacccgcagctgcgcgggcagcccaggtcttccccagaacctccggagccgaggacccagcgccaagccaggagcaaagcagcgcgccaggctggagctgttccgtcattaccgccacgtctgcgcttcggttgtgagaaccgattcgttaccctaacctcttaggactaagagccagtcttctggtggcgctcgctttcacttactttttatttccctttctattcccgcgagctagggggagaaagtgtaaatcccgcccgcttctccagggctgaaaatggagaggctgaggcggcttggagagtgcgcactgcgcatgctccgcagagcatccccgcaggtcaaccggg

SEQ ID NO: 77415 - DNA, 177 bp, Homo sapiens; identical to SEQ ID NO: 35595
  chr15:27216067-27216244
  hyper

SEQ ID NO: 77416 - DNA, 94 bp, Homo sapiens
  chr15:27216830-27216924
  hyper
cggctgggctgcggcacggcgggccgggaggggactgggaagtcggtctgcacctcacctgtcccagctcccttggacacggtcatctgctttt

SEQ ID NO: 77417 - DNA, 30 bp, Homo sapiens; identical to SEQ ID NO: 35597
  chr15:27603952-27603982
  hyper

SEQ ID NO: 77418 - DNA, 30 bp, Homo sapiens
  chr15:27884112-27884142
  hypo
ctgcactacccagcccggaaaacttttttc

SEQ ID NO: 77419 - DNA, 30 bp, Homo sapiens
  chr15:28016476-28016506
  hypo
gcgctatagagaggacgggccctgcctgcg

SEQ ID NO: 77420 - DNA, 34 bp, Homo sapiens
  chr15:28051056-28051090
  hypo
gagcaccctggcctccgcccgcctccaggccgaa

SEQ ID NO: 77421 - DNA, 30 bp, Homo sapiens
  chr15:28076464-28076494
  hypo
cagtgagtccaggctcgcccctggaataaa

SEQ ID NO: 77422 - DNA, 32 bp, Homo sapiens
  chr15:28114883-28114915
  hypo
cattggctgggacagcgcggagtctcctgtgg

SEQ ID NO: 77423 - DNA, 170 bp, Homo sapiens
  chr15:28339763-28339933
  hyper
caaccccaaatcgttcgtgtgggctactgccggccctctctccggctctgcgctctttctgcctgcaaccgtgcccccgaactcgggccctgcgaggtgggggtgggcccgggcccctcctgccgcccctgctgccagcaccgttctctccgaggccctcaacgccccgc

SEQ ID NO: 77424 - DNA, 80 bp, Homo sapiens
  chr15:28339954-28340034
  hyper
cgccagacgctcaccaagcctgcccgagccccgcctcccgcagccgtgcccagggcggagtggggcgacggcaccggtgc

SEQ ID NO: 77425 - DNA, 268 bp, Homo sapiens
  chr15:28340309-28340577
  hyper
cacggctgagtgctccgggcatggtgggtctgcgggactcggagcagagctcgagctggcggatccccggttggcgcccggcgggagggcaggagtggcccagccaggccgccctgcgcactccccgcccgggtgcgcccgggggaccgcggccctcccaccccgcccctgtgaaacgacagccggcagcaggcgccgcacgccgacttcacagtggcggcgatcaacagcgtgtggaaaacagcttcttcgtaaatcttaagaacat

SEQ ID NO: 77426 - DNA, 28 bp, Homo sapiens
  chr15:28340877-28340905
  hyper
gaacattgttcttcgagttctttaaata

SEQ ID NO: 77427 - DNA, 360 bp, Homo sapiens
  chr15:28341620-28341980
  hyper
gcaggagaagccctgcggccaagaaggcctgaagaagcccgtccaggggtcagcctcctcctcagccggtcctgggctgagacaggggtgtcccgctgagggcagtgtagggtgcggtgcccccaccccacttcgggcctggaccgagaccgcgagtgtgaccgtatatcccttcaggtggatttttcaacatgtgaacttggttaaaagcttctagaacgttaagccaaacatcgtggctttccatccgttttctgttcttgtttgaaagagtacgcctccttccagcctgggaggaggggcggggcccgggagagggcctcgggaggccgcgggtgggctctgccgagggccgcgttc

SEQ ID NO: 77428 - DNA, 39 bp, Homo sapiens; identical to SEQ ID NO: 1196
  chr15:28341981-28342020
  hyper

SEQ ID NO: 77429 - DNA, 40 bp, Homo sapiens; identical to SEQ ID NO: 35602
  chr15:28342521-28342561
  hyper

SEQ ID NO: 77430 - DNA, 85 bp, Homo sapiens
  chr15:28344103-28344188
  hyper
tggcccaccagggggcgactttttcctgggtcgcctggcagagagccggagggggtgctcagggggcagctgctgcaggcccagg

SEQ ID NO: 77431 - DNA, 127 bp, Homo sapiens
  chr15:28344223-28344350
  hyper
cgtctgtgcacactaacctttaggggaacttgccttgcttcctaagccgcgactcagccggggctgtgtaaaccctccctgcctgttcccaggctagtctggctcctcgcctccttcctcccgaccg

SEQ ID NO: 77432 - DNA, 281 bp, Homo sapiens
  chr15:28344411-28344692
  hyper
cgcacctccgctctggatggtgagcggagcacagccttcgaagtaagaactcagagggagctcggcgctcccgcagcgggtcccccacccaggcacgcccccggcccggccccgcccacagcactccccactcggccccgcccacagtgcggccacgcccgtagcacgcccctcccggccacgcccacaaagctgcccacatggccccgcccacagctcgcccgctccgcacccccggcccctcagctccccagcccccggcggcgcgggctgagagcagc

SEQ ID NO: 77433 - DNA, 115 bp, Homo sapiens
  chr15:28346156-28346271
  hypo
gacactgttacagggcgggaaggggctggggcacagagcccgggggaggctccctgagtgggcagaaggctcttggtgtgcacgcagatctgtcgaaatgcgggctttgaaacgc

SEQ ID NO: 77434 - DNA, 340 bp, Homo sapiens; identical to SEQ ID NO: 35606
  chr15:28351758-28352098
  hyper

SEQ ID NO: 77435 - DNA, 22 bp, Homo sapiens
  chr15:28352099-28352121
  hyper
ggctctggccccacggtgagcc

SEQ ID NO: 77436 - DNA, 270 bp, Homo sapiens; identical to SEQ ID NO: 4194
  chr15:28352152-28352422
  hyper

SEQ ID NO: 77437 - DNA, 102 bp, Homo sapiens
  chr15:28352957-28353059
  hyper
cgacaggcggggagaaggcatggcccaccggctcaggagaaagtcctggaggggaggcagtccgcccctggggacaacgcggggggccgtattcggacacca

SEQ ID NO: 77438 - DNA, 206 bp, Homo sapiens
  chr15:28389827-28390033
  hypo
gcatgatgggatagacggtgaagcgccagccccagccattcacagacccatcgctgatgaacttccactttaactcatcccctgggatgcgcagctcgctggaccagtcggaccactctcggcctgcgggaggaaagcgcaccccggggttagcttcactccatcatccaatcaacacaaaccttcttagacgcaaagcagaatga

SEQ ID NO: 77439 - DNA, 122 bp, Homo sapiens; identical to SEQ ID NO: 44213
  chr15:28517076-28517198
  hypo

SEQ ID NO: 77440 - DNA, 23 bp, Homo sapiens
  chr15:29008573-29008596
  hypo
accgcgcccggcttccagaatat

SEQ ID NO: 77441 - DNA, 21 bp, Homo sapiens
  chr15:29029711-29029732
  hypo
ctgagcgcggtgaatcgcttg

SEQ ID NO: 77442 - DNA, 37 bp, Homo sapiens
  chr15:29034132-29034169
  hyper
cttgggggcacatctcggggtgcggtgacccgcccgg

SEQ ID NO: 77443 - DNA, 158 bp, Homo sapiens; identical to SEQ ID NO: 35610
  chr15:29077236-29077394
  hyper

SEQ ID NO: 77444 - DNA, 196 bp, Homo sapiens; identical to SEQ ID NO: 35611
  chr15:29077428-29077624
  hyper

SEQ ID NO: 77445 - DNA, 140 bp, Homo sapiens
  chr15:29077646-29077786
  hyper
cgcggaccgcccgcggctcagcctccggtctctctccgtctctaagtggtggtggctgtgggtttttctgcaggtgatccttttgagtaatttgtttcacgcaggcgccctgctgtagggtaaagcggcagattcatgct

SEQ ID NO: 77446 - DNA, 88 bp, Homo sapiens
  chr15:29087614-29087702
  hypo
gcaccgctcctcctgcgtcttctcctgctctcccatcctctccttcttctcccgcctcttctccacctgcctccggatcttctcctcc

SEQ ID NO: 77447 - DNA, 48 bp, Homo sapiens; identical to SEQ ID NO: 44215
  chr15:29112193-29112241
  hypo

SEQ ID NO: 77448 - DNA, 21 bp, Homo sapiens
  chr15:29119934-29119955
  hypo
ccactgcgcctggcctgcatg

SEQ ID NO: 77449 - DNA, 30 bp, Homo sapiens
  chr15:29123489-29123519
  hypo
tccttagagttcccacgtgtggctcaccag

SEQ ID NO: 77450 - DNA, 341 bp, Homo sapiens
  chr15:29130707-29131048
  hyper
cccccattacagctgcgcggggccgagcaagcagggcgcggcggccggggcaaggtgcggagcctcgcgttcaccggctctacctgcggagcctcgcgttcactggctctacctgcgggaccagacccctgcagctccccagccagcacggccggggcacgcccgggaatctgtgtgctccccagggcccggggcgttcggggcgccgcgccttccagcgcctgggtcccagccccgatcccggagaccggcccggggggacccggggtcccgagtgcaccctcctgccctgcagactgtcccagcgccggggccagggggcgcaggacctcgcgcacgcc

SEQ ID NO: 77451 - DNA, 99 bp, Homo sapiens; identical to SEQ ID NO: 4198
  chr15:29131532-29131631
  hyper

SEQ ID NO: 77452 - DNA, 152 bp, Homo sapiens; identical to SEQ ID NO: 4199
  chr15:29131755-29131907
  hyper

SEQ ID NO: 77453 - DNA, 297 bp, Homo sapiens; identical to SEQ ID NO: 44216
  chr15:29133536-29133833
  hypo

SEQ ID NO: 77454 - DNA, 166 bp, Homo sapiens
  chr15:29145324-29145490
  hypo
cttcccagcctcctccgcctggactcaggcttcttcgggctcatcagacctgaacagcctggcagtgtggctgtgtgggaatgggtgacaggtgctgttctccccagtgcaaatcaccaatgctgggcaccgtgcatcagcgtcgtggtgacggcagcattgggtg

SEQ ID NO: 77455 - DNA, 129 bp, Homo sapiens
  chr15:29158096-29158225
  hypo
aggcactgcggtgggcgagccagagggctttgttgctccaaggagcttgcattctagtattctagttattttcacgcatctgcactatctgggacagggaccattgcgttttgtcgtatataaagcagc

SEQ ID NO: 77456 - DNA, 30 bp, Homo sapiens; identical to SEQ ID NO: 44218
  chr15:29221674-29221704
  hypo

SEQ ID NO: 77457 - DNA, 68 bp, Homo sapiens
  chr15:29223705-29223773
  hypo
tggtgctgttgccaccgtgggcccaaacatccactgcccttttagcaaggcagcgctgctccataggg

SEQ ID NO: 77458 - DNA, 52 bp, Homo sapiens
  chr15:29263052-29263104
  hypo
tgccagtctcagtgccgctctttgccatgcacacacccgtatgtgtgcccat

SEQ ID NO: 77459 - DNA, 44 bp, Homo sapiens
  chr15:29283583-29283627
  hypo
gctgagctacagggccgggccgcaggaggcgtccttgtgccgga

SEQ ID NO: 77460 - DNA, 22 bp, Homo sapiens
  chr15:29302734-29302756
  hypo
acaggtgcgagccaccacaccc

SEQ ID NO: 77461 - DNA, 30 bp, Homo sapiens
  chr15:29389670-29389700
  hypo
tagcatttccttctacgtggactctgggta

SEQ ID NO: 77462 - DNA, 35 bp, Homo sapiens
  chr15:29396552-29396587
  hypo
ggccgccaagagccccgccgcgctcccagggctgc

SEQ ID NO: 77463 - DNA, 30 bp, Homo sapiens; identical to SEQ ID NO: 44219
  chr15:29397531-29397561
  hypo

SEQ ID NO: 77464 - DNA, 349 bp, Homo sapiens
  chr15:29407125-29407474
  hyper
gtgtgtatgtgtgcacggctgtggctgtgggtctgtgagtgggtgtgaggcatggggtgtgaggagagtgtgagtgggtgtgtctgtgtgtgtgtaggggtgtgtgaaggggtgttcagcacaaaggggctgcaggctctctgggaagcgtggtggccgcacgaggcgggaggctgagagctgaggagcccggcctacagaggggcccgctggggaccgggcagggaatttgggtctggggacagcagcagcaggccgggccgtctgtggtgctccccctggtggctctgtgaggctgagtgcgtggcgaccatccttgcagcctgtgggtgggcgggtgggtggaggg

SEQ ID NO: 77465 - DNA, 77 bp, Homo sapiens
  chr15:29407737-29407814
  hyper
ccacccgtggaggagcgggcgggagaacggggaagaggcaggaggcggccggggcgttggaatcctttcagccctgc

SEQ ID NO: 77466 - DNA, 260 bp, Homo sapiens
  chr15:29407866-29408126
  hyper
cgctgataaacaaggcttgcagttgcgaggggcctcggggtgggtttctggttgaggaacgccggggaatggctgatggaggaagcccctgccgggagcaggagcagcggaaacctacatcggccacacagatcccggcgggggagggagggcaacgctcagaagcagagctgcgcgatgtgcctttctgggctgctcagcccagggcccgagacctgcttgcctgaggaggggcagatgcacggcggctgcaccccgtg

SEQ ID NO: 77467 - DNA, 23 bp, Homo sapiens
  chr15:29408816-29408839
  hypo
caagactccgtctcaaaaaaaaa

SEQ ID NO: 77468 - DNA, 58 bp, Homo sapiens
  chr15:29409339-29409397
  hypo
accccagcctggccacgcagccaggacaccgggcagggccgcccgggcccagaggagc

SEQ ID NO: 77469 - DNA, 30 bp, Homo sapiens
  chr15:29409660-29409690
  hypo
tgaagctgtgcggagcgaactggcgcctcc

SEQ ID NO: 77470 - DNA, 33 bp, Homo sapiens
  chr15:29410533-29410566
  hypo
ggtctgttacctcagcggcgggtgcccgcctgt

SEQ ID NO: 77471 - DNA, 25 bp, Homo sapiens
  chr15:29449033-29449058
  hypo
cctcagcaggccaggcgcagtggct

SEQ ID NO: 77472 - DNA, 71 bp, Homo sapiens
  chr15:29561245-29561316
  hyper
gtttctttggatctccgaaaattaaatgcttcttggtggggtagacccctaagcgccgcagaaagtcccag

SEQ ID NO: 77473 - DNA, 22 bp, Homo sapiens
  chr15:29610811-29610833
  hypo
ccacgcccggccaaattaaggt

SEQ ID NO: 77474 - DNA, 171 bp, Homo sapiens
  chr15:29721859-29722030
  hypo
aattctgacaggatccggtagaagggacaaattcgtctgtggttgaaatctacggacagccatgagctgaaactacggaccccgtagttctcaaaggaatacagagaagcaggtatggaatgccaacagggctgtgcaatgcccgatccgggccggcgtgagggcacctcc

SEQ ID NO: 77475 - DNA, 524 bp, Homo sapiens; identical to SEQ ID NO: 35620
  chr15:29861915-29862439
  hyper

SEQ ID NO: 77476 - DNA, 352 bp, Homo sapiens
  chr15:29862870-29863222
  hyper
caggctgcggggcagcgcggcgggacgcggcgctcgggggccgccggccggaggcatcgcgccgggcgcccgcacgcctcgcccgctcccgcccggcccggcgcgcgccgccgcctctcctcacagagggtccgaggcaagttgcgccgggtgcagggacggcctcccagccggctgccagggctgcggcggccgcgcgccgggagcgggccgggccgggcggggagccgggcgcccgcagcccccgccggtgcccgcgcccatgccgccgccgccgcgccgcccgcccgccggccgcgccgcgctgcgccctcccccgcccgccccgcgcgctccccggcccgagcgcggg

SEQ ID NO: 77477 - DNA, 132 bp, Homo sapiens
  chr15:29863519-29863651
  hyper
cggcagcgggccagccgagccttcagagcctggggacggctcgggatgggcgcgcggggcgctgaggacggggagacgggctgggagcagacaggagggaaattccgagcgctgggccgcaggtgtggcgaa

SEQ ID NO: 77478 - DNA, 118 bp, Homo sapiens
  chr15:30113866-30113984
  hyper
ggagccgagtttctccgcgagggacctgttgcgtgtccccgccctcagcgagccgcagccaggcacaggcgccggcagctatgcacctgcccagtacggcggccgggcgcccgcagcc

SEQ ID NO: 77479 - DNA, 30 bp, Homo sapiens
  chr15:30114780-30114810
  hyper
ggcgggacgagcggccggggtcccgacccc

SEQ ID NO: 77480 - DNA, 860 bp, Homo sapiens
  chr15:30260547-30261407
  hyper
aaggacagacagaggcgggaggccgacgcccgggtgcgggtgccaggcgtcccggccgctccccgtcgccctacgcgccgcgggcacagcgagggtctcggcgaaaccagtcagcgggcacgcggtacaaggcggcgctcggccctgggctcggccttggctgctgcgccccgcgcggcgcgccccgcgtcccgtcgggcccgacagtcgcggcctcgccccccgcccgaccgccccggccgccgctcgctctcccactccggcccccgccccgctccgcgcctagcccggctggggctccgcgcccgcgcggccgcctcaccacagcttcctcttgagcggcaggaggctgccgcggttggagggggtgacgccgatggccatctgcagcaccgtcaggtatttctggtacttcatcttgtccccgctccgctcgcgggcagggccccgccgcctccgccgccgccgcagacacagcccctccaggcgccgcatagatcagctctgggccatccgccgccaccacagctcccaccgctcccgcgcccgccgcacccgcagctgcggccgtgcgtggcccgggctcccgctcccgccgccgccgtcgccgtgcgtgcccggccgctcccgccgccgccgccgtgcgtggcccgcagctcccgccgccgccgccccttccacccctgcaggccgtggcccggcggcgcgctccggtgggcgggtgcgggtctcgcgggaggccgggctggcttggcccccgctccggagccgctgggcgaggccgggccacctgcgcgccggccgccctgcccaggccctgcgcccgcgtgccgcggtgttttcagcggctggcaggagct

SEQ ID NO: 77481 - DNA, 43 bp, Homo sapiens
  chr15:31083763-31083806
  hypo
tacccaccccacaatagcagaagaaactcgacagagcaaattg

SEQ ID NO: 77482 - DNA, 60 bp, Homo sapiens
  chr15:31121966-31122026
  hypo
ttttgctagaatatacgttggtgtggccattctcagtgatgttctcggttagaagtaatg

SEQ ID NO: 77483 - DNA, 30 bp, Homo sapiens
  chr15:31126524-31126554
  hypo
gagtgaagctaaccccgagattcactttcc

SEQ ID NO: 77484 - DNA, 30 bp, Homo sapiens; identical to SEQ ID NO: 44225
  chr15:31221190-31221220
  hypo

SEQ ID NO: 77485 - DNA, 167 bp, Homo sapiens; identical to SEQ ID NO: 44226
  chr15:31377678-31377845
  hypo

SEQ ID NO: 77486 - DNA, 112 bp, Homo sapiens
  chr15:31455390-31455502
  hypo
aggattggatgcagccgatgcctcatcctcaggccgtcccagtttgcctccttgtcctcaggcaaatcctcagcaccctgcgtggtctgacatcttgcgtctaactggaatt

SEQ ID NO: 77487 - DNA, 30 bp, Homo sapiens; identical to SEQ ID NO: 44227
  chr15:31509535-31509565
  hypo

SEQ ID NO: 77488 - DNA, 30 bp, Homo sapiens; identical to SEQ ID NO: 44228
  chr15:31539632-31539662
  hypo

SEQ ID NO: 77489 - DNA, 33 bp, Homo sapiens
  chr15:31564940-31564973
  hypo
aagccccaaggcccccgccgtggccctgccccc

SEQ ID NO: 77490 - DNA, 30 bp, Homo sapiens
  chr15:31566708-31566738
  hypo
aacttcgcaccaacacgtgaaagggcaaca

SEQ ID NO: 77491 - DNA, 30 bp, Homo sapiens
  chr15:31597382-31597412
  hypo
ctccctgggttctggcgcagctcacagtct

SEQ ID NO: 77492 - DNA, 159 bp, Homo sapiens
  chr15:31599458-31599617
  hypo
gaggtttgaaggtcccggcccctcggggcatgcttctcacagcggtcccagagtttcccctggccctttcccctttcccttctgagcttctcagtcctttctctctctcctcaatggccttgccacagcatccagctgccttggcggcaagcacagtgc

SEQ ID NO: 77493 - DNA, 30 bp, Homo sapiens
  chr15:31601868-31601898
  hypo
cttcttaaaaagtcacgaatccagctgggc

SEQ ID NO: 77494 - DNA, 56 bp, Homo sapiens; identical to SEQ ID NO: 44229
  chr15:31603992-31604048
  hypo

SEQ ID NO: 77495 - DNA, 30 bp, Homo sapiens
  chr15:31668057-31668087
  hypo
cccacccacgacactcgagtgcaagatcgc

SEQ ID NO: 77496 - DNA, 30 bp, Homo sapiens
  chr15:31669119-31669149
  hypo
atgggagagaagtagcgtcccctaccctac

SEQ ID NO: 77497 - DNA, 142 bp, Homo sapiens
  chr15:31727629-31727771
  hyper
aaggtcacagacccacggttttccgccccctagggtccaagctctttcctggacatctgcaggcaatgtcgacacgccctccagtgtctgtggcgggcaaaggatgtgtctccacccccagaccttccgatcctgtgctgaa

SEQ ID NO: 77498 - DNA, 237 bp, Homo sapiens
  chr15:31775237-31775474
  hyper
gagtttccacaggtacgaggcagatgctaggctagcacacccacttccaacagtatgacttgtttcctatccgtctactacctgagtggcgtcagtgtaggttcaggcaccattaggaacgtttgaccaaacacgtacacggcactgacagaggaggcgccggccttccggtggaccagggcatgtaaaaaagacaccgacacaatggaaaagaaatcctcgaaggtagaacctcgc

SEQ ID NO: 77499 - DNA, 155 bp, Homo sapiens; identical to SEQ ID NO: 4201
  chr15:31775483-31775638
  hyper

SEQ ID NO: 77500 - DNA, 105 bp, Homo sapiens; identical to SEQ ID NO: 4202
  chr15:31775678-31775783
  hyper

SEQ ID NO: 77501 - DNA, 29 bp, Homo sapiens
  chr15:31776145-31776174
  hyper
ggagaggcgcgctccgggaccggcacgcc

SEQ ID NO: 77502 - DNA, 107 bp, Homo sapiens
  chr15:31778235-31778342
  hypo
ggagcgcactgagagcgggctcaggagtccctggctggaaggacccttcccacagttgtctgctgagagccctgcatctaacatgaaggcaccgaggcctggcaatt

SEQ ID NO: 77503 - DNA, 41 bp, Homo sapiens
  chr15:31813319-31813360
  hypo
gaagctatgacaggccggagggttcgcgggggtgaggactg

SEQ ID NO: 77504 - DNA, 70 bp, Homo sapiens
  chr15:31830234-31830304
  hypo
ttcatacgtccaagacgatctgtgcaattccactccccttgccatggactgctgtcgcctggctcacaag

SEQ ID NO: 77505 - DNA, 30 bp, Homo sapiens
  chr15:31862270-31862300
  hypo
ccgggctgtggctctcgctctggctgcttg

SEQ ID NO: 77506 - DNA, 196 bp, Homo sapiens
  chr15:31897790-31897986
  hypo
attagggggcgcctccgtgctcactttccaatgtagcctgcaatcatggaacaaatcgattaaagcagagaacaatcagttattttttcagactcattttcttaaatggcttaatctatgcctcaggccacacagactgttggttacgtaagcaactccagtgactgcattcctgtgacatcgctacagtgctgca

SEQ ID NO: 77507 - DNA, 30 bp, Homo sapiens
  chr15:31991592-31991622
  hypo
ttttacccttgggtccgaggtgagtttcag

SEQ ID NO: 77508 - DNA, 67 bp, Homo sapiens; identical to SEQ ID NO: 35629
  chr15:32162215-32162282
  hyper

SEQ ID NO: 77509 - DNA, 32 bp, Homo sapiens
  chr15:32162491-32162523
  hyper
agcccgcaatgcagacgcgccggcgagcccag

SEQ ID NO: 77510 - DNA, 407 bp, Homo sapiens
  chr15:32322366-32322773
  hyper
gcttctggctgagagcgggagcgggctgagtggggacaaagaacgcaagggagaggtagagcctggccttgggcagcccctggcctggccagaggcgcgaggccgagagcccgctcggtggagactgggggtggaggtgcccggagcgtacccagcgccgggagtacctcccgctcacacctcgggctgcagttccctgggtggccgccgagacgctggcccgggctggagggatgggggggcggggacgggggcgggggcggggctcgtcacgtggagaggcgcgcgggggcgggcggggcgggggcgcgcgcccggctccttaaaggcgcgcgagccgagcggcgaggtgcctctgtggccgcaggcgcaggcccgggcgacagccgagacgtggagcgcgccgg

SEQ ID NO: 77511 - DNA, 17 bp, Homo sapiens
  chr15:32934467-32934484
  hypo
tagaaggagggtttgcg

SEQ ID NO: 77512 - DNA, 149 bp, Homo sapiens
  chr15:33009613-33009762
  hyper
cgagcccgccaggttaacgggggcgccggggtcagcgccctcgaagttgggggcctcgggcggggccgccggggagccacgacggccgctcgaccagagcatcccgcagtcccgttccctccagaggggaagaatggccgaatctggca

SEQ ID NO: 77513 - DNA, 578 bp, Homo sapiens; identical to SEQ ID NO: 35632
  chr15:33009821-33010399
  hyper

SEQ ID NO: 77514 - DNA, 276 bp, Homo sapiens; identical to SEQ ID NO: 35633
  chr15:33010400-33010676
  hyper

SEQ ID NO: 77515 - DNA, 446 bp, Homo sapiens; identical to SEQ ID NO: 35634
  chr15:33010720-33011166
  hyper

SEQ ID NO: 77516 - DNA, 504 bp, Homo sapiens
  chr15:33011167-33011671
  hyper
gctggttcccacttccgcgcgcaccccttaaactgtgttctagaggccccagcctcgccttgcagcgcctcactagctcctgaggactagggactggcggctgaggcgggttggcggctgcaacgagctgggcgtctttcgttctctctcgctgcctggctggctccgctggcccctccacagcttgcggagcaaggccatagcaggggagtgggaggtatattggggctgtcacctccttgctggccggagttatttgtagactacagactccggaagaacagacgcgccaccgctctcgcttggcattgccttcggatcgcagctcctccttgggggtgccccagcttggcgtttatttgcctgcgccaggctctggcgacggtcaccgggccaggcggggagggacggacggcaggtgaccagcctctgctgtgaagaaattcctgcgcgcccggagctgtccctaatgcattcccgggtcgaatccgtctactgccttcc

SEQ ID NO: 77517 - DNA, 77 bp, Homo sapiens
  chr15:33438087-33438164
  hypo
aactaaagacttgaacgttttagaaaaaatacgtgaaatctgaatgaactgatttgtgactttattgtgaataaaac

SEQ ID NO: 77518 - DNA, 16 bp, Homo sapiens
  chr15:33438284-33438300
  hypo
tcgggcttcagcctcc

SEQ ID NO: 77519 - DNA, 223 bp, Homo sapiens
  chr15:33486950-33487173
  hyper
acaggccacaggccccgccttcctagcacgcgccggcctgacgagctgtttgggggaggtgagcagtaaactgatcggcagggctgaagaccagtggaaacgtgcagcggcgcccgaggtggcaggggaggcggggcgggaggcggcggtgcccaatcagcagccgagccgttgggccaggctgggaagcagtgctgtcttttggcaccgtctgatccgggct

SEQ ID NO: 77520 - DNA, 97 bp, Homo sapiens
  chr15:33541637-33541734
  hypo
tcagcctcccgtaaaggtttttaataaacttcccttccttctctaaaacttgccccggcctctccttctgcctatggcttctcggttgaattctttc

SEQ ID NO: 77521 - DNA, 903 bp, Homo sapiens
  chr15:33602706-33603609
  hyper
gcaaagcgggcaaagcgagcaaagcgagagggttggtacccagtctgggcgcgctggagctaagcaactggcctttgtttgtgaattggagcagtttaggggacatcctccggtcgccgcggggcgcgcgcctccgctgagtgtgcggtgcggtacccagcggtgcgggggaggctccaccgcgccagcccagggcccccgcaccgcccccgccagctcgacgcgcccagcgttgcgctctccacggagcgggcggccgcagcgcacttggctggggcgagaggcgagaggggtgggcggactgcttggttggcgttggcgctctgcagtgcagtggagtgttagcccagctccctatatggtcggggattagcttggcgctgctgaggctgaggctgagccaggagctggaggaggaggtggaggacgaggacgaaaaggaggaggagaaagagcgcagcagcagtcagcgcacgccgagcggctgccgggggaagcagaggcgccggaggctggggcaccgccgacgcctcgggagccatggccgaagggggagaaggaggcgaggacgagatccagtttctgaggactgtgagtctccgcggcgggggcgaggccgtgggcaggtggggaggagcgcggagcgcggcgaggaggggctggctgcgctgcgccgcggtgccgggtgcccggtgccgggcgctttctccgcacccgcgggctgcagaggcggaccggccacctacccgcggggccgcgaggggctgcgtgggaaggggcaccatctcctgcctctcccttgttcccctaccgccacccctgccccaggccctccacctaggaccgctcgctctccaggcaacttgctacttggtctgaaacccttgatgcccaaacttcagc

SEQ ID NO: 77522 - DNA, 128 bp, Homo sapiens; identical to SEQ ID NO: 35639
  chr15:33603647-33603775
  hyper

SEQ ID NO: 77523 - DNA, 37 bp, Homo sapiens
  chr15:33628963-33629000
  hypo
ttctaaaactctggccgggcgtggtggctcacgcctg

SEQ ID NO: 77524 - DNA, 25 bp, Homo sapiens
  chr15:33632111-33632136
  hypo
ttaccttagtcgtggaacaccaaag

SEQ ID NO: 77525 - DNA, 17 bp, Homo sapiens
  chr15:33633532-33633549
  hypo
cccggtctgattcagtg

SEQ ID NO: 77526 - DNA, 30 bp, Homo sapiens; identical to SEQ ID NO: 44235
  chr15:33727786-33727816
  hypo

SEQ ID NO: 77527 - DNA, 30 bp, Homo sapiens; identical to SEQ ID NO: 44236
  chr15:33746640-33746670
  hypo

SEQ ID NO: 77528 - DNA, 45 bp, Homo sapiens
  chr15:33879242-33879287
  hypo
acagctcagtgtgtccgggagattgagactcggcagcatagactg

SEQ ID NO: 77529 - DNA, 30 bp, Homo sapiens
  chr15:33952401-33952431
  hypo
caatgcccctgtcagcggccatattcagga

SEQ ID NO: 77530 - DNA, 229 bp, Homo sapiens
  chr15:33954397-33954626
  hypo
ggttccattaccacacgctgaggctctacagcgcggtgtgcgccctgggaaacagccgcgtggcctacgccctgtgcagccacgtggacctctcccagctcttctatgccattgacaacaagtacctccccggcctccttcgatctggtttctatgacctgctcatcagcatccacctggccagcgccaaggagaggaagctgatgatgaagaacgagtacatcatccc

SEQ ID NO: 77531 - DNA, 80 bp, Homo sapiens
  chr15:34014994-34015074
  hypo
gggtgaggggggaaacgggctcttggcagccatgcagggtgccattaagatctctgagaacccagcgctcgacctcccct

SEQ ID NO: 77532 - DNA, 30 bp, Homo sapiens
  chr15:34067983-34068013
  hypo
gcccaccaggtctcccgtggcctgctcaca

SEQ ID NO: 77533 - DNA, 30 bp, Homo sapiens
  chr15:34124561-34124591
  hypo
aaccacatatgtggccgggcacggtggctc

SEQ ID NO: 77534 - DNA, 19 bp, Homo sapiens
  chr15:34208027-34208046
  hypo
actccgtgctgttggagaa

SEQ ID NO: 77535 - DNA, 31 bp, Homo sapiens
  chr15:34339559-34339590
  hypo
gagccaccgtgcccggcggagacctagcagt

SEQ ID NO: 77536 - DNA, 30 bp, Homo sapiens
  chr15:34353236-34353266
  hypo
tttttttccctttaccgcccattatcatgt

SEQ ID NO: 77537 - DNA, 61 bp, Homo sapiens
  chr15:34394495-34394556
  hyper
ttagccccgagattacgcgctgctgtgcctgcgactgcagcgtttacgccgagataactcg

SEQ ID NO: 77538 - DNA, 267 bp, Homo sapiens
  chr15:34634214-34634481
  hypo
ttcttgatggtgattcggtgtcgagagtatttgtcatctggggagaaccgagcaggatgggctgagcaggtctgttgtcccatcgggtcaaatttctgctccaggaacacagaatgtatgtcagtacaggagtgatgaaatggggtggggccagcgcgaaaaagggcaaacatgaaaatagaagatgcaatggtcaactcaaaaagttgtacaaataaatagagaaatataaaatttaaaaaggccgagcgcggtggctcacgcctg

SEQ ID NO: 77539 - DNA, 30 bp, Homo sapiens
  chr15:34726887-34726917
  hypo
agcacccccagcccccgatgggcacacagg

SEQ ID NO: 77540 - DNA, 812 bp, Homo sapiens
  chr15:34728824-34729636
  hyper
ggagaaaaggaagttcgcccctagcctgggcttaccaaggcccgccgcccgacccatggagccctgcttggggaccgggggcctcgatgttctccttcaccatctgcggccagatctccctccagcagccttgccaggcagtgcctggcgtggagaaggggccctgcagaggcgcaggtccgcaccgtgcccccaacccggcgcctgcagcccaggggcaacaaggtgtggggtttttgagtttttccctctgggccttattatacagggaaagggaaggggcgaagatccgggctcgagttctcccagggaagtgaacccagaggcgatcccaaactcagtagttgccgcccggcacggggacttgatgccggcgccaagccgggcagcggaacgcaccagcggcccgaccagcccggcgagacgcgagcgggcggccccgccagacagcgccacttgccggcgccgagagtggcccctcgccgcggtgagcccctcccgggatgcgaaagccatcgcctagtccccgccgcacccgcccgcccatcgtgggaggaggatgggccggtccgagaggcgtaaggccgccgggctgcacccctagatcccagcggcggcctccccgcagccccgccgagtccggggggcagcgctcgggagctcttggcccgcagcttacgcgccgccccccacgcgtccgggtccccgcggcgccgcgggcggcccaaggctgccgccgccagcgagtcaggcagccgaggttccccagcttacctggccagggcgcggggctgccccggtccgccgccgtc

SEQ ID NO: 77541 - DNA, 99 bp, Homo sapiens
  chr15:34729944-34730043
  hyper
agctcccgcagagctcgcgcctagccgcacacctcgactgctgattagcccgacagctgaatagcggcgggagcctaccgcgagcggagtacggaaagc

SEQ ID NO: 77542 - DNA, 467 bp, Homo sapiens
  chr15:34786477-34786944
  hyper
gaaatgattttaaaacgttttggtggagcgctgcgggaggtgcgtgcgcgccccggccgccgaacaaaggagcaggggcgccgccgcggggacccgccacccacctcccggggccgcgccgcggcctcccgtccaccgccaccatgaccgccaacggcacagccgaggcggtgcagatccggttcggcctcatcaactgcggcaacaagtacctgagggcggaggcgttcgggttcaaggttaacgcgtcggccagcagcctgaagaagcagcagatctggacgctggagcagccccctgactaggcgggcagcgcggccgtgtgcctgcgcagccacctgggccgctacctggcggcggacaaggacggcaatgtgacctgcgagcgcgaggtgcccggtcccgactgccgcttcctcaccgtggcgcacgacgacggccgctggtcgctgcagtccgaggcgcac

SEQ ID NO: 77543 - DNA, 241 bp, Homo sapiens; identical to SEQ ID NO: 35643
  chr15:34787232-34787473
  hyper

SEQ ID NO: 77544 - DNA, 134 bp, Homo sapiens
  chr15:34806507-34806641
  hyper
cgccggagccgccctgcaccgccctgtcgcggtctccggagcaggctggccgactgagggcgaccatgggtcccaagaaggctccggcagtcgcgggctcccacctcggggcgcggcgacgggggcctagaggg

SEQ ID NO: 77545 - DNA, 513 bp, Homo sapiens
  chr15:34806875-34807388
  hyper
gcagtggagcgtgagcgggggctgcggctcctggttcttgtggaagatagtcccagaaacttccctttggccttgaaccctgacacggacatcttccactcatctacggcgggaggggcgcggaaggggagcctgtccggagccgctgtcacggccgcgactacccagcggggccgcccagccgagctttcgcgactctgcctctgcctgccgcctggacccttgtgggagcgcggctggaaaatggcaagggcacggaggccttggcgggagctgtgtggcggcctggggggctgctccctttgtaaccgactccacccacaggaggcgcggctcctgtcaagccgcagcttcaaagggcaacataaccactgcccccactaccgcctgggaaagggctgcccctaccctgcccccgtcaccctcacccctcacccctcaaccaggcgggccctgcgcgcaccagtttcggcgggtgcacgagtccagagcgtgcgcgcgctcccggctgcc

SEQ ID NO: 77546 - DNA, 42 bp, Homo sapiens
  chr15:34876396-34876438
  hyper
ggggatcgcggcctccgaaagccccatcgggcaggggaggcc

SEQ ID NO: 77547 - DNA, 36 bp, Homo sapiens; identical to SEQ ID NO: 44238
  chr15:34879893-34879929
  hypo

SEQ ID NO: 77548 - DNA, 30 bp, Homo sapiens
  chr15:34911483-34911513
  hypo
accagcatgagccaccgcacccagccacaa

SEQ ID NO: 77549 - DNA, 30 bp, Homo sapiens
  chr15:34915716-34915746
  hypo
atctagaaacatgggcgtattaccagattg

SEQ ID NO: 77550 - DNA, 119 bp, Homo sapiens
  chr15:35014151-35014270
  hyper
ccagcactcggcgggcgcaggctgagctggtgacccgggcaggaccggagccaaaggattaatccatcacaatgagacgttctattctgggcaggcggcgcgagcagatgctgggcgcc

SEQ ID NO: 77551 - DNA, 16 bp, Homo sapiens
  chr15:35014271-35014287
  hyper
gcggaggcagcgtgca

SEQ ID NO: 77552 - DNA, 279 bp, Homo sapiens
  chr15:35046870-35047149
  hyper
ggaaagaaatccaagcgcgtcccgaccgatggggcagttggcgcggtctagagagagggcacgaacctcgggcgccgtccggggttcgggtctggatcccgcggacgccgggacgaggggcggggcggggtggcagcctgcaggtcctccagcgctcgcccgcccaggagaagtctcagcgccgctctccgccgcaggttgggggccaggggagggtccgaacaccggctctgttcctgctacttcagcgggcacctggcgctccggcgcggcagcctg

SEQ ID NO: 77553 - DNA, 498 bp, Homo sapiens
  chr15:35047293-35047791
  hyper
cgtcggagcccgaggggccggggacgcgcgcggggggagaggggcaagagtcctggaggcccggcggggagcggggcgatttcgaaaggaaggactgcagcgcccctcggggcttctcggggagcccaggtaacctcacctgaccgccagacccaagcaggcggagggggagccgggagcggacgcgtgggtgagtggggaggggagtgagtaggtatcttctcttctctcggtgcatccctcaccttttcgctttttgcctcctggagacaactgaaattccttccctagatggagatgctggctgagggagggcgagtgggggcgaccacttttaaatctcccttaggggacagagtggctgagagtgcttctgcagagtggctgcggttcggtgcctctgtggatccgacagtgaagtgagaaaggcttgatgggaatccatttaggctgaagggtaaatgcaggtgtggagctgtctctcggtataggggtcag

SEQ ID NO: 77554 - DNA, 30 bp, Homo sapiens
  chr15:35084827-35084857
  hypo
agccacggcaaagcccgcttccaatcttgg

SEQ ID NO: 77555 - DNA, 192 bp, Homo sapiens
  chr15:35087595-35087787
  hyper
ggccttggctgaatgcgggccgggctggccaggtggcggcgcggggctggcgtccggcgcggcccgcggaccaggcgaggagtgaacgcggagggccgggcgctgactcaccgtcggcggggcgggtcggctcggctccggcggcagcgggctctgggtggctggctccaggagggccgctttatagaacgc

SEQ ID NO: 77556 - DNA, 17 bp, Homo sapiens
  chr15:35262895-35262912
  hypo
agcgagactagcctcaa

SEQ ID NO: 77557 - DNA, 120 bp, Homo sapiens
  chr15:35310610-35310730
  hypo
aatgctgggattacaggcgtgagccactgcacccagcgtttaaagggaattctgatgtttgtttccatagacagtttttttcttagtaaggaatggatgtaggcacggtgcggtagctca

SEQ ID NO: 77558 - DNA, 39 bp, Homo sapiens
  chr15:35970597-35970636
  hypo
attacaggcgtgagccacagcgcccggttgacattttta

SEQ ID NO: 77559 - DNA, 258 bp, Homo sapiens
  chr15:37175038-37175296
  hyper
aagagtggaggttggcggtgcaggcggtgcggctgccagcctgagattgttccggctctcgttacctgtgcgccctcgcgttacatggtgctcataaatcccgcggcagattaactgggaaaccaagaaaatgcctctatgcaccgaaccgttgaaaaagaaccaaaattctctcaaatagtagcagtctcacaccttgcattggacgtgaaacactatagtaagatcaaatgtcaaagacatcggttattttggtgc

SEQ ID NO: 77560 - DNA, 35 bp, Homo sapiens
  chr15:37180103-37180138
  hyper
cacctcctcacccagcgcctcggattatgagataa

SEQ ID NO: 77561 - DNA, 291 bp, Homo sapiens; identical to SEQ ID NO: 1200
  chr15:37180507-37180798
  hyper

SEQ ID NO: 77562 - DNA, 337 bp, Homo sapiens
  chr15:37394400-37394737
  hyper
ttcactgtaagctttcgagcaacagaaactaggctaagattgcagcctgcagagactccaagcggagtcggagaaatttggcctcgttttaatagggctgaggaatgaactccggaggtcaataaagccctccaaaaatgatgaatgattgagcacctgtgatgatgatagtgattaccagagcaattaaacagtttgattaaatgagccatcataacaatgatgtctgcgggaaatcggccctcacatataaagaaagatagtgcgaaggggctggcagaggcgcggatagcgcgacgccagggagaggggctgcgggccgcgaggtttctgccca

SEQ ID NO: 77563 - DNA, 90 bp, Homo sapiens
  chr15:37402997-37403087
  hyper
aactcaatctcagggcggggtgtgagagctgggggtgagctggctcgggccgggacagaggtctctctgcgtacgccccgctccgcccgg

SEQ ID NO: 77564 - DNA, 221 bp, Homo sapiens
  chr15:37403115-37403336
  hyper
cgagttctgagaccttggcaaacttccctcccccaaccgccggcgtgacttctgagttgtcactaatccgaacctgatattcaccagagctccttcggtcaccgacaacgctccccgctgctgccgcggcctcccgcccgccctcctcggcgtgttttcatttctaagtctacgggcagggattgccccgacccagtgtgtgtgtgcgtgtgtgtgtgtgc

SEQ ID NO: 77565 - DNA, 163 bp, Homo sapiens; identical to SEQ ID NO: 44239
  chr15:38218484-38218647
  hypo

SEQ ID NO: 77566 - DNA, 30 bp, Homo sapiens
  chr15:38330892-38330922
  hypo
cacaacacccggcctcggaagatgaaaatt

SEQ ID NO: 77567 - DNA, 178 bp, Homo sapiens
  chr15:39110605-39110783
  hypo
tgctctggtgcatggcgtttccttgtgctgtgtctggtaatttgctggctccgctgccacccaacaggccgggcattggtggctcagctgcaggcagcctctacgggctccgtggaggtggcccctgcctgtgaagtgggcaagtctaacagcacctcccaatcgggatgccgcagat

SEQ ID NO: 77568 - DNA, 30 bp, Homo sapiens
  chr15:39416451-39416481
  hypo
tctgacttggtgactcgtctttgctctgca

SEQ ID NO: 77569 - DNA, 180 bp, Homo sapiens
  chr15:39873123-39873303
  hyper
ctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctg

SEQ ID NO: 77570 - DNA, 136 bp, Homo sapiens
  chr15:39873365-39873501
  hyper
cgcgcccctccagccctcgccgccctcgccaccgctcccggccgccgcgctccggtacacacaggtaagtcgcccccggcggccgccgaggaccaaagctgcccgggacatccacctggagcgctgaggcttcagt

SEQ ID NO: 77571 - DNA, 691 bp, Homo sapiens
  chr15:40211553-40212244
  hyper
tgttccgaagaagcacgcagtaaaacacgcacaaaataagggtctatcaaaataattgtatatattattatttcgagatatatatggaaagatgggatcgcaaaacatctttaacagaatgggtaacattccgttcaattatcagtaacaaattcccacagaatctttattcctcgctatttgtaaacaagagctgaagccagccgggcacccaggagcattccgccggggccatctgaggagggggactcccgcctggatcccgctccatcctcgggccacgagaaagccctatttgaactcttctgctcccgcgtgggggctggagtccaccgtccctgcttaactacactgcagctacccgggatccttaagcttccttcaactctctgcactttgccaggcacccgaaacccacggcggctgggcggccctgctcccggctctccgagcctgtaccctcggggaggcccggtccggaggcgccccgcgggaggcttaccgagcagcgagcctatgaagatgacgacctgcacggtggtggtgaactggcggtacagctgcgcctcgccgaactccccgagcgcgctgcggttcacacccgcagcctcggcgccggacgcgttgtgcggctcgctggcatttggagagatccagctcccgttatgtcccatggcgaggctgggactcc

SEQ ID NO: 77572 - DNA, 353 bp, Homo sapiens
  chr15:40212601-40212954
  hyper
gctgcctccttcaaccgcgggtcctccgcccctcgagggctagggcatccctctccagtcccctcgggctgacgcactcgacccctctccttagcgggaggagaacgtttggccgaagctatttttcagtcctgttggcttcgaggctggatggcgatgtgaagccaacgtaatgcccacgccgagtggccggagccacgaggggacccccgagtgcccgacagcgcccatggcttgggtggaaagccctgagcgtccccagcagcctggccctgcgcccggccgcctgccaagacgcccgtgctgggtcctgcttcccagcccctcacttgtggctccgacctcctgcctca

SEQ ID NO: 77573 - DNA, 17 bp, Homo sapiens
  chr15:40228636-40228653
  hypo
ggagtttctctctgtcg

SEQ ID NO: 77574 - DNA, 47 bp, Homo sapiens
  chr15:40368182-40368229
  hypo
tcagcctcagagctgcggtcagtgcgtggagccggctacctgttggg

SEQ ID NO: 77575 - DNA, 30 bp, Homo sapiens
  chr15:40420189-40420219
  hypo
ctaacatccagggggcgaaggatgatatta

SEQ ID NO: 77576 - DNA, 84 bp, Homo sapiens
  chr15:40420940-40421024
  hypo
tttccaaacatgcagcggggtacatattaataatacccccaatatggaaagcagacaccccccgcgatgcggggagtaatatcc

SEQ ID NO: 77577 - DNA, 101 bp, Homo sapiens
  chr15:40423345-40423446
  hypo
gagaagacgatattaatcccaatattgcagaaggtgtagacctcccctgatattcaggggaaagagcacgatattgctcccaatatcgcagtctgtgtacg

SEQ ID NO: 77578 - DNA, 189 bp, Homo sapiens
  chr15:40532032-40532221
  hypo
acgtgtgtgtgagtgcgagagtgtgtaagccagtgtgtgtgccgtccccctgctggggacagcagctgggtccagcagagagctggctgggggcttgacaggagtttatcctaactgatgctgggtgggcgcaggccctgagatgggcgtcagggagaggggacgccagacacacggcctgagcagggt

SEQ ID NO: 77579 - DNA, 30 bp, Homo sapiens; identical to SEQ ID NO: 44244
  chr15:40532791-40532821
  hypo

SEQ ID NO: 77580 - DNA, 779 bp, Homo sapiens
  chr15:40544663-40545442
  hyper
tggccaaggccccagcgacacttggcaacttctcccgcgctctgggttcgccgccgcgtcctacctgaggccacaccctgaaatcaaaatcgcggtcaggtgaagccggcgctgcaccaacgtgtaagcgcggcccctcctcggcgttcccgcgccgaggtccctcccgcggagggcgggcccggctcccacgacctcttcgagcgttcctgggcttcccgctccgcaggtgggttccccggctgccccggaggttcgcggcgagaggacgggcctcccaacacgcgcagcccccttcctgggtgcccatgccccgaagttcgggaccagccggcgccaggcgaggggccttgggcgcaggcatctggagctccgcgtccctggagcgggacctccctccgcgggcgcccgcccggcgcggggcattcgcgtccccgagagggcgcagcagtggggcctgcgagctggggccgggtggccgcgccgggtcggagtgtggctggagaggggccgccccggaagcggtgctgcgcccaacgtccccttctccccgtaagccccgcaaggagcctgccgcctcttgcacctgagccaggagttcagtcgggaggcgggcgcggagcggttcccagcgcctggacgtcagccagtcgcaacacccgcgggaacacttgctacatttgccataatgcatttctgatctgtttccgcgcaggcctgcggaggactggcccagcaaggtcccaggtcttccctctcctcagcgcctaagagagagg

SEQ ID NO: 77581 - DNA, 56 bp, Homo sapiens; identical to SEQ ID NO: 44245
  chr15:40545776-40545832
  hypo

SEQ ID NO: 77582 - DNA, 30 bp, Homo sapiens; identical to SEQ ID NO: 44246
  chr15:40546043-40546073
  hypo

SEQ ID NO: 77583 - DNA, 43 bp, Homo sapiens
  chr15:40574169-40574212
  hyper
atgctcggggctggccgcgggggccgggcggccagggggacta

SEQ ID NO: 77584 - DNA, 308 bp, Homo sapiens
  chr15:40575513-40575821
  hyper
gagcggttcctcctccgcgctcccctgggaatgcggcggcggttgcggggcgggggcgggggctgctcgccgggggccacatgcacccaaccgggccaatcccaaagtcgcagtcttctctccccgccctccgcccccaaccgagtcggtgccctcggctccttagaaactggcgggacctcggcctcgtcggggaagactgaaagctgcccccatcggtccagggtgaaaggaattgggaccccatgagcgcagaactggaccacgcgcgagctaggggtggcagcgaaaggcggatgaggagtaat

SEQ ID NO: 77585 - DNA, 169 bp, Homo sapiens
  chr15:40639225-40639394
  hypo
gaggcaggggagtggcggtggcttttacctgcaagaggacattaggttaggaaggtacagaccagactggggaggcactggaaggtagactgaggaggtggagtcatgcagaggggctgaaagttttacagcagctgctgatgaggccaccccacggtttaggaagctg

SEQ ID NO: 77586 - DNA, 31 bp, Homo sapiens
  chr15:40676552-40676583
  hypo
cgacagagcgagactccgtctcaaaaaaaaa

SEQ ID NO: 77587 - DNA, 26 bp, Homo sapiens
  chr15:40729159-40729185
  hyper
ggcagactgcaaagacgtcccctggc

SEQ ID NO: 77588 - DNA, 27 bp, Homo sapiens
  chr15:40856301-40856328
  hypo
agccaccgcgcccggcccctaaattct

SEQ ID NO: 77589 - DNA, 30 bp, Homo sapiens
  chr15:41056770-41056800
  hyper
caggggaaaaaagggcgaataacctgagag

SEQ ID NO: 77590 - DNA, 30 bp, Homo sapiens
  chr15:41059436-41059466
  hypo
gtcgatgaccctccccgcatagtcctggac

SEQ ID NO: 77591 - DNA, 87 bp, Homo sapiens
  chr15:41078532-41078619
  hypo
gaaagccaggtatcccgggttggaagctcctccagaaactgactctggcccaggtccagtggctcacgcctgtaatcccagcatttt

SEQ ID NO: 77592 - DNA, 30 bp, Homo sapiens; identical to SEQ ID NO: 71306
  chr15:41091139-41091169
  hypo

SEQ ID NO: 77593 - DNA, 30 bp, Homo sapiens
  chr15:41137117-41137147
  hyper
ctacgagcagaacttcgtgtgcaagttcgc

SEQ ID NO: 77594 - DNA, 30 bp, Homo sapiens
  chr15:41158108-41158138
  hypo
atgggaggcagcctccgcattactgcatgc

SEQ ID NO: 77595 - DNA, 93 bp, Homo sapiens
  chr15:41164710-41164803
  hypo
ctctctcctcctcctcgtcatcttctttccaggccttatccaccatcagtcccaggctccaagacctcttttcctgctcgctctctcaatctc

SEQ ID NO: 77596 - DNA, 412 bp, Homo sapiens
  chr15:41165245-41165657
  hypo
ccatagctgctcaaacgaagcagaagaacttcttccagcggcagcgggagagggtgcgcacacctttggcattcagtttcttctccagccgggctttgtgctcaatggcactgagaatagccgagtcaaatacttccttcaagttcttctgcgtcaaggctgagcactcaaggtagcagcaggctcggatcttctcggccagaccctgagcctggggttggggcacggggccctcccggcccccctggtccagctgaattagtacgttgacatcgtccctcaggtcggcctgggtgcccaccagcagcacaggcgcctgggggttgtgcgtgcggatctcgggcagccatttctctgtgatgttttgaaaggagctgggctgcaccacgctgaagcacgccaggaagacatc

SEQ ID NO: 77597 - DNA, 58 bp, Homo sapiens
  chr15:41291802-41291860
  hypo
caaaggttaatatttcgtaattgtatttatttaattcataaaacgccatctttatgat

SEQ ID NO: 77598 - DNA, 30 bp, Homo sapiens
  chr15:41409360-41409390
  hypo
tcacctcaggccaaacgtctcagagcagtc

SEQ ID NO: 77599 - DNA, 45 bp, Homo sapiens
  chr15:41456235-41456280
  hypo
tgaatttatcacaatcgaaatgttatttcacggcaaagctttaga

SEQ ID NO: 77600 - DNA, 36 bp, Homo sapiens
  chr15:41495761-41495797
  hypo
cattctccctgaaggcgatcacggaaaccagaaccc

SEQ ID NO: 77601 - DNA, 737 bp, Homo sapiens
  chr15:41786804-41787541
  hyper
gctccgccggcgggtcgtggcgctggccctggggcgtctaagaagcggggcgaggagcaggcgacccgccgcggggactgggcgaagcgggggtagcggaccttgttggctgtgggttaggacaggagggatcggaggggctgagccttgccgggtgaaccctcggaaggagagaggcgaaggagagtttcccttaccccccgccccctctccggtgccgcggccgcacccccgccgttgccacggtttccctctcctgagtgggagtggagcggcgctccaggctctgctcgggagccgctgccgtctgctcccagcgcccgcacgaggcgtggacgcaggggagggaggggcgtgggcctgggagctctggctgggagcggaacgcagcccacccagtgcgcgccctgcctcccatcttcccggctcgccgctcctgagcgcggcagagaggggcggtaaactgaggctgcaagggggcaggatcactctgctagtctctgcctctgatagcctgggtgttctgggaccaggtctgaccctcggaaaacacagccctgggcactgttaagtcattcctgacgcccgccacttagggatgtgcggctcccgggacaccctccttgttcccctcgttttaaccaaggccaaataccttgaataactgtccgtggtcagcgcgaaggactttctttagatccacgtttcgcaagtgtccctgaggccgaggaagaggc

SEQ ID NO: 77602 - DNA, 53 bp, Homo sapiens
  chr15:41788173-41788226
  hyper
cgccgccctccgagccgtcgggagccggtgcaaatcgccgctgagggcccttc

SEQ ID NO: 77603 - DNA, 1221 bp, Homo sapiens
  chr15:41804641-41805862
  hyper
tatttcaggagggttcgtggaaatgtggggaggctcaagcaccccttggcgccgccctggttgggggccttccgctcggtgtaagaggttccgggtaagggctaactcggtggcgactactgccaccttgaagggcactcaaggtggacctccccgcggaatagtccaagacgcaagtcggtgcgcacgtggacttcgttaccctgagggtgaaacctccaactagcaggtcactgtccaccctacctccgccgtgcacttacagatactggccagggcccggcacgcgccacagctgcacgcctctcagctgcccggcggcccccacggtcaccaccacgctggtccccgcgtacgccccgtcacattgtgtctgtgtgggcccatgccggccgctggccccgcaggtagaaaacagccaagacccctcggtgcctgagagcaaggagcgaggcaagggtcgtcgagcccctggctgggccagaggggtctggtatggtgagcgaaagaggaaggaggcgtctaaagctcacccggagaattcagcggggaggctggctccaagatactaggcggggcgctgactttcgggtcccgggggctgggacttgccagcggcaggggcgaggaccgcagaaaagtctcctgggaccccgggctagagcagagaatggcgcctgaaaggtgttgggagaaggcgcaggacgttaaggcgggtggaaataggatatgaaagaaagagagaaccccgcaacagctgcccttgcggtcgcggccacacccgtcacccggcccagccgcgctctcagcctggaagccactacccgactccggtcgcagaagccccgcgggtgcgcgctgataggtctgccagtttctctcctcgagcgcctttcccagtgaataacttaggggccgcaatgaatttggtcctgcagcctccccaatgctttcctcaacttagattggtggccccgccccaaggcggtgctgagaccccaaagaatgttcctccttcccaagctgcgtgatccagactctgggattcgcacgcacttggcgcttctcggcccgcactccagaagcacggaccggagaaatttggctgtgagagttcgaggcctctggaggaaccactgacacctggcctgttgaccggccacccccaagcctaggaaagtgcctcaggctggacggtcccctgaccgccagatagcactt

SEQ ID NO: 77604 - DNA, 30 bp, Homo sapiens
  chr15:41806074-41806104
  hyper
cctcagaccccaggacgccagaggaggaaa

SEQ ID NO: 77605 - DNA, 95 bp, Homo sapiens
  chr15:41835731-41835826
  hypo
tttccacaactgtaaaatgtgagtaacaggtcctatataataggaaatgtgtgaggatttaaatgactatacacgcaaaacgcctagcccagtgc

SEQ ID NO: 77606 - DNA, 103 bp, Homo sapiens
  chr15:41877608-41877711
  hyper
aaggcttggcctggccggcgggacaccagcgcctttgtccgcggcgcagaagggccccagctgcggacagagccggcgccctgcaggccgcggggaggagcgc

SEQ ID NO: 77607 - DNA, 30 bp, Homo sapiens; identical to SEQ ID NO: 44250
  chr15:41878349-41878379
  hypo

SEQ ID NO: 77608 - DNA, 45 bp, Homo sapiens; identical to SEQ ID NO: 35664
  chr15:41913327-41913372
  hyper

SEQ ID NO: 77609 - DNA, 224 bp, Homo sapiens
  chr15:41913733-41913957
  hyper
tccgggacccgcgagcggagcggcgcgtgggtcggttgcggtcggccccggcaggtatgcgcaggcgccttgcttgccacgcgctacgcccgtccccacgcgcctggtggcgtgttcttggcgcgaagtgttaagagtctgggtgtttttgtgcgttggggggaaggagagggtggcgggggcgggggggcgctgaggcgtcacgtggacgccacagccaatct

SEQ ID NO: 77610 - DNA, 73 bp, Homo sapiens
  chr15:41914167-41914240
  hyper
ggggagtgctggggccgcgtgaaggtcacatgacgaggttggcagcgcgtgctgctggcgcggggtaggggga

SEQ ID NO: 77611 - DNA, 973 bp, Homo sapiens
  chr15:41952201-41953174
  hyper
gggtctgcggagccccgtgtgggtggggctgggcgcggccggggcggagccggcgaggagccctagggaaagggtgaaaggcacagttgagaaaggcccgccgggcattggtttcacagtttccacgaaggcttcgtgtgcaagcctgaggagtttaggtgcctccctcctgcctcgcctttcttggttctagaaccttcagtaggcttttctgggttgcagggacccggaaaagcagcggcttccactcggggggcgggtcccaagggtcttgctgctgctctggggccgtttggactcctggtgttgggggaggggtcagggaggtgctgctcgcgtctccttttgcgcctgcgcggcgggctccgagcgggtaggagcgcgtgcgcggtgacgtggacgtccggtgcgcgcgcgcaggctcttcagctggagcggacacacggtgtgcgaaccgaacagaataacccgcccccagcgggatgtgaaggactccgggtgaggccggccacgccccgcacggtaactctcgggcctgggtggagggcatcgcttagtactggcccgattggagtttttcgagagtttgaagctcttgtgtatttgaacggcgtgagaaacgttccgctgagagagcttcgcacgccctcgccaggccgggccttgcgcagggccgcctttggcgcgcccctgtggtccctgagcgaggctgcgcatgtcacctcgcgcgcgtccccggcctcacttccgcgtcgctcagctacctaactgggaacatcgacgccagagagagcggccacgaggcgggaggggtgagaagcgcccatggctcggccctgccctcgcgtgtgtggggtgccgctccgcgtggtacggtccgcgtgacgacttctcgcccggcgccgggctctaggtcgagagccacgcttacgcgcttttcagtttagagcctaggtctcgtggttctagaact

SEQ ID NO: 77612 - DNA, 62 bp, Homo sapiens
  chr15:41954254-41954316
  hyper
ggaaggcagtgagaccgagccttttactttcctgcgtatcggaacagcgctagtgtttcttg

SEQ ID NO: 77613 - DNA, 49 bp, Homo sapiens
  chr15:42151201-42151250
  hypo
gcctggagccacccccggggccaggtggggtgcccgtccagcctaggct

SEQ ID NO: 77614 - DNA, 30 bp, Homo sapiens
  chr15:42159399-42159429
  hypo
tttctttgagggccccggagccctttcctc

SEQ ID NO: 77615 - DNA, 77 bp, Homo sapiens
  chr15:42448018-42448095
  hypo
gactcactgaactaacgatggctgtcacgcaccacacacctgcagctcccctcagacgctcgcgcccccactctagc

SEQ ID NO: 77616 - DNA, 91 bp, Homo sapiens
  chr15:42562561-42562652
  hypo
cgtctcaaaaaacaacaacaaaaaataaagtgcctcaaatcctccaaaaacaatgaaatataaacacttcaaaatacgcagttagggctgg

SEQ ID NO: 77617 - DNA, 399 bp, Homo sapiens
  chr15:42684673-42685072
  hypo
gggccactgaaggtccgttcgtggtcgtgaggcacactttcagggagcagagtggtctgtgtcttcacagagcccggaaaatgaactagtatgaactttgcctccaagcagcagaacttctgttcccccgcccctaatgggttctctggttactgctctacagacaatcattccggttcagtatgagacaagaatggcctgcgggctggtcagaggtcacgcctactctgtcacggggctggatgaggtaagcctggtggggcttggtggggcaagggcaccctcctgggttaacctcatgaagtcaggacttagctgttggggccccttccctgtctgcagagcttgcctccaatcaggacattcagttcaaggtccaagccacgcctgggagcagag

SEQ ID NO: 77618 - DNA, 41 bp, Homo sapiens
  chr15:42748507-42748548
  hypo
actggaaaatttaaacgccaaataaaaacttattggtattc

SEQ ID NO: 77619 - DNA, 40 bp, Homo sapiens; identical to SEQ ID NO: 44254
  chr15:42784374-42784414
  hypo

SEQ ID NO: 77620 - DNA, 79 bp, Homo sapiens
  chr15:42868395-42868474
  hyper
agcagaaggtgagggcgtgagggggaaattgaggccgacacaggtcgcggtttctttctatgctcgacagctgatttaa

SEQ ID NO: 77621 - DNA, 141 bp, Homo sapiens; identical to SEQ ID NO: 44255
  chr15:43020219-43020360
  hypo

SEQ ID NO: 77622 - DNA, 30 bp, Homo sapiens
  chr15:43213577-43213607
  hyper
cgccgtccccagaaccgcctaacgtgaagc

SEQ ID NO: 77623 - DNA, 198 bp, Homo sapiens
  chr15:43467727-43467925
  hypo
actgtagactgtggccgcagaatggagcttctctgagtcaagcccttacacttgggctttttggcactgtattttaaaagcacgttaatttggaaagtttagggaagcctttcagttggagtaagaggttagctgtgcgttaagaactgtagaaatagggaaagcgctggcagccaagatggccgaacaggaacagct

SEQ ID NO: 77624 - DNA, 30 bp, Homo sapiens
  chr15:43502442-43502472
  hypo
gggtttctgaggccacggtggtggggcagg

SEQ ID NO: 77625 - DNA, 30 bp, Homo sapiens
  chr15:43508293-43508323
  hypo
ccaggcacataatctcgtggcaccctcatg

SEQ ID NO: 77626 - DNA, 16 bp, Homo sapiens
  chr15:43511842-43511858
  hypo
acagaataaaaagaac

SEQ ID NO: 77627 - DNA, 30 bp, Homo sapiens
  chr15:43519643-43519673
  hypo
gatggtggtctactccggggggtgttagta

SEQ ID NO: 77628 - DNA, 30 bp, Homo sapiens
  chr15:43527822-43527852
  hypo
ccatgttgggcgggtcgagcagcttgaatt

SEQ ID NO: 77629 - DNA, 35 bp, Homo sapiens
  chr15:43622105-43622140
  hyper
gaggtaggtcagcaccgcctcggccaggagcagag

SEQ ID NO: 77630 - DNA, 101 bp, Homo sapiens
  chr15:43661891-43661992
  hypo
tctccccaggtaagacggtcaggaactgctctagcaccaacagttctacaatctgctccttggtgcgcacctccggccttagccaccgacagcaaagttcc

SEQ ID NO: 77631 - DNA, 342 bp, Homo sapiens
  chr15:43810570-43810912
  hyper
ccctgcatttccagtcgtgtcaaccccacaggttcccagtctcagccctacccccacctcatctctgcttctcttcccaagatgggggctcttgaacagaggagccagtttcttctctctctctgcatccccccatccccaccccccatgcagaagcagccaagaaaatgacttgtcatgctggggtggggggtgggggcggagctggagccggagctcagcgcgcacactcacacactgcggcaaactgcagctgcccaaacggtccccctccccttctgcctcactgcggagacacctgccctcctgcctgctcagcctctgcaccgcagcccacccccc

SEQ ID NO: 77632 - DNA, 160 bp, Homo sapiens; identical to SEQ ID NO: 44258
  chr15:44037474-44037634
  hypo

SEQ ID NO: 77633 - DNA, 23 bp, Homo sapiens
  chr15:44090533-44090556
  hypo
actgcacccggccattactcctc

SEQ ID NO: 77634 - DNA, 274 bp, Homo sapiens
  chr15:44092138-44092412
  hypo
ggcccagggaggtgccggggctggggccggccttggcacccaccatccttgtcccagggattaggcttaggtccaccagatggaaggcagatgagagcagcagttgcttctgtcctcagcccattggactgccactgtgttggggctgagcacccggtcccgggcagaatggagacgtccggaagagaacactgacctccaggttgcggtaaatgcaaatgccctgtgaaggagctttgtccttagggcctcaacactgcggccactcaggctg

SEQ ID NO: 77635 - DNA, 208 bp, Homo sapiens
  chr15:44115848-44116056
  hypo
atgggcataagacaccgtgcctggccgcagcacttttttgaacaaggggacaaccacctgcctctcagtagggaataaagtgtggattacagtttattttatacaatggaattcataagctgttaagatgaatgaattagatgtatagggatccaaagataattctcaaaagccatgttgagactagatacggcggcatctactcggg

SEQ ID NO: 77636 - DNA, 170 bp, Homo sapiens; identical to SEQ ID NO: 35669
  chr15:44486726-44486896
  hyper

SEQ ID NO: 77637 - DNA, 24 bp, Homo sapiens
  chr15:44827765-44827789
  hypo
tttttttttttgagacgggtctaa

SEQ ID NO: 77638 - DNA, 27 bp, Homo sapiens
  chr15:45046196-45046223
  hypo
agccgcagtgcccggctgcttcaaaca

SEQ ID NO: 77639 - DNA, 30 bp, Homo sapiens
  chr15:45389393-45389423
  hypo
ggcctctgtcgctcccgacccaggtcaggc

SEQ ID NO: 77640 - DNA, 88 bp, Homo sapiens
  chr15:45403593-45403681
  hyper
ggggcccgttctgcccggtggcggggtcgggcgccgcccacatgagcagggggttctgcgagtctcgggggaaagcggggtcgggccc

SEQ ID NO: 77641 - DNA, 202 bp, Homo sapiens; identical to SEQ ID NO: 1202
  chr15:45403798-45404000
  hyper

SEQ ID NO: 77642 - DNA, 88 bp, Homo sapiens
  chr15:45404102-45404190
  hyper
cggggcaaccgggcgtttccacgctcaccacgtcggaaagaacatggtagcctgcgggcatggggcgccaatacgtgacaaaccgtcc

SEQ ID NO: 77643 - DNA, 249 bp, Homo sapiens
  chr15:45404917-45405166
  hyper
tgcggaggcagggagcggggctctgtctaagcactccatcccctaggatcccccaaacctctccctaagcctccctcaacccccatcccacttcactgacagaaccttccctcaagggtctcttggccccgggagcgcataagattgcgctgtgtaggcagcggagctgctgggcgcgtgttccccgcagattccccgctcagggcctttcgcgccccggcccttcgcgagccacggccccagcacgcc

SEQ ID NO: 77644 - DNA, 139 bp, Homo sapiens
  chr15:45405416-45405555
  hyper
tcccgctgagctgcacggcgaaatgaccttccagtctcagggagccgcttgccgcacctctccccgccccacctcccagggatcctggggaacaccccgccgctagaggagcctgatacttgcccgatggacccaggga

SEQ ID NO: 77645 - DNA, 414 bp, Homo sapiens
  chr15:45406452-45406866
  hyper
ctgggctgggacacccgtgtggcacgtcgcccacgctgctataaaaggggtcccgcgcgacttccaaactcagcgccaacccgcagaaccaggaaagtaacggctacagacagtgagaaatagtttcgctcgccggctagaaaaactctgtcggtaccaaccccagagcgttgagagcagcccacctccacgcttccttaacggagaggtgcaggactcagacttcaccagcccactcggtcccagccttgtacgcaaagagacgccaaggacgcgctctcccgcgtccaggcagccccagcttgctggcttgcctgcccgcctgcgtgcagcactcggccggcgtgcagcatgaccctgtggaacggcgtactgcctttttacccccagccccggcatgccgcaggcttcagc

SEQ ID NO: 77646 - DNA, 28 bp, Homo sapiens
  chr15:45406867-45406895
  hyper
ttccactgctcatcgttattctagtgtt

SEQ ID NO: 77647 - DNA, 57 bp, Homo sapiens
  chr15:45409154-45409211
  hyper
ggaattcccctgcaccgctgccatcccagtccctggctttgacgctggggtagggat

SEQ ID NO: 77648 - DNA, 413 bp, Homo sapiens
  chr15:45421268-45421681
  hyper
ccgtggaacctcacacgaagcgcccccgggggtgtgattaaagagggaaccaggtcccgacgttctgtgaacaaacgcgcgcccttactctcagtggggctcccgtccgacccccactcctctcctaactcacgtaaggacccggctgtgaccggacaaaccgggtctggggtgcttccagtcactcttcaagtcactcccaaacttctcagactgcacccgaggctctgcggcgccgcctccctctcccggcctggtacagagaagggctgggtgcgccaggacagtagtaccggggtctgccagctccgcagaggtccctccaatcccccctcctcctctgcgcccccccacccatgcccagcaatcccagcagctccagcgcaaacctagcgacgcagttccgggtctgg

SEQ ID NO: 77649 - DNA, 140 bp, Homo sapiens; identical to SEQ ID NO: 35678
  chr15:45421706-45421846
  hyper

SEQ ID NO: 77650 - DNA, 6 bp, Homo sapiens
  chr15:45427335-45427341
  hyper
aactcc

SEQ ID NO: 77651 - DNA, 351 bp, Homo sapiens; identical to SEQ ID NO: 35679
  chr15:45427369-45427720
  hyper

SEQ ID NO: 77652 - DNA, 88 bp, Homo sapiens
  chr15:45427771-45427859
  hyper
cggggcccgaccccgcttttccccgagactcgcagaaccccctgctcatgtgggcggcgcccgaccccgccaccgggcagaacgggcc

SEQ ID NO: 77653 - DNA, 290 bp, Homo sapiens
  chr15:45471645-45471935
  hypo
gcccttcacttcctacgctgcccctttctcccacacaagtgggctcacggccactcctctatgcctgctgccattcatcgcacagtgaactgcaaaccacacactccgaagaggcactcaaggtgctcagggcggggcgcagctgaggacaatagaacctttctccaagctgggcttgggcttctcctgatggggcgctggctgaggcagagactgagcccggttcacccagggctgccagcaccccaggagcactgcaccactgggttgacaggcgatgacaggaggtg

SEQ ID NO: 77654 - DNA, 71 bp, Homo sapiens; identical to SEQ ID NO: 1203
  chr15:45479446-45479517
  hyper

SEQ ID NO: 77655 - DNA, 59 bp, Homo sapiens; identical to SEQ ID NO: 35682
  chr15:45479774-45479833
  hyper

SEQ ID NO: 77656 - DNA, 30 bp, Homo sapiens
  chr15:45480705-45480735
  hyper
cgcactgcacatacccgaacctacgttact

SEQ ID NO: 77657 - DNA, 26 bp, Homo sapiens
  chr15:45544198-45544224
  hypo
tctcggcctcccgaagtgctgggatt

SEQ ID NO: 77658 - DNA, 251 bp, Homo sapiens
  chr15:45670588-45670839
  hyper
tccgatgtagtgcaccgcctcggcgccgcggctcccgccgcgcagacaccgcacccgcagcatcgccctggcccggctggtccacgcgcggaatgttcctggcctctgggccgcgtcggtccaagccttcccgagagcgcgcccggagcggggtgggcgggcgcgcggggcccgaggccttttgtagccgcgctccgccccggccgccccccgcggccccattggctgccgggaacaggtggtggggccgg

SEQ ID NO: 77659 - DNA, 83 bp, Homo sapiens
  chr15:45670932-45671015
  hyper
cggcttctgttgcacgtccggacccggacccagacccgagcgtcgcaagaaggcccgttggagtctcgcgcaactgggcagga

SEQ ID NO: 77660 - DNA, 30 bp, Homo sapiens
  chr15:45742581-45742611
  hypo
aggggctccggctgacgacaggcaggggac

SEQ ID NO: 77661 - DNA, 58 bp, Homo sapiens
  chr15:45996505-45996563
  hyper
gtgcaagtaatggtacgcggagagggcgcgcgaaagcgcctggctcgttcctggagcc

SEQ ID NO: 77662 - DNA, 91 bp, Homo sapiens
  chr15:47476715-47476806
  hyper
ggggagctctggcggcgtccaggatgctccagcctcccggcgcgccgcggccggcgcagagacccgaccgcgaggcccgccgcccggttcc

SEQ ID NO: 77663 - DNA, 105 bp, Homo sapiens
  chr15:47476876-47476981
  hyper
cgatcccggagctgtgccaggccggggggagggagcggaagccactttatggctcgtggccccacctcttgcccccaccccaaatcctccgggatttcaaaatgc

SEQ ID NO: 77664 - DNA, 253 bp, Homo sapiens; identical to SEQ ID NO: 35685
  chr15:47477012-47477265
  hyper

SEQ ID NO: 77665 - DNA, 158 bp, Homo sapiens; identical to SEQ ID NO: 35686
  chr15:47477354-47477512
  hyper

SEQ ID NO: 77666 - DNA, 35 bp, Homo sapiens
  chr15:48003206-48003241
  hypo
gtaaaaatgtataggcgtggccgggcgcggtggct

SEQ ID NO: 77667 - DNA, 146 bp, Homo sapiens; identical to SEQ ID NO: 35687
  chr15:48009524-48009670
  hyper

SEQ ID NO: 77668 - DNA, 88 bp, Homo sapiens
  chr15:48009881-48009969
  hyper
ccaatgaggtaagaccgttttcaacaatttgctaatgctcttgtggcgcccggtgggggtcggaacctgagatcccgaatcgctgtgt

SEQ ID NO: 77669 - DNA, 808 bp, Homo sapiens
  chr15:48010089-48010897
  hyper
ttgatttattttccaagctgctctctctgcctgccgtgcaagggacgcgcaaagggctagagaggtttggcggacgcgtcaaaactggcaaagctggcggcttagggggaggggcaagtggacttggaggccctcctccactgtgcacccccttggaaaaaaagcggagggggcatcaagtaaaagtttcttgccaggcagagccagctcggcgtcccccgcacatagctggggttagcaggggttgcttctctgccgggcacagcgtctccaggagccagccggggagagctgagccaaggccgaaggagccgcctgcgggcttagccgccccctcccgcccgttggccccagagcggacgctgggacgcccggggtctggcagctctgcgcccggctaggagcgggcgggcgagcattagcctgcgtcctggagaaggggcgcagcgccgcagttgaggccggagcagcccctcgcgggcgtaggatacctgtcagtgagcgcccggattgcacggcccccgggtagtgcctgccggcgaggggcgggagctcgggtgacttggccatccccatccccggcccaggcccggagggcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaaga

SEQ ID NO: 77670 - DNA, 232 bp, Homo sapiens
  chr15:48011225-48011457
  hyper
acttggaagtgtgcacgagaattgggtttgaaaaatttgtgctccatccactcttgggaccattgctgtcaggtgattgtttaaatcctgaacttgttaaaaggcgaaatgtcagggagctggcgggggtgggggtgtggagggggattgaagtcccggtatgaatcgcagcgtttgaggaacttagggcagtactccctgttctggggtgaccattcggtaactgatgttc

SEQ ID NO: 77671 - DNA, 30 bp, Homo sapiens
  chr15:48470064-48470094
  hyper
ctcccagaccacaggcggccaggcctgggg

SEQ ID NO: 77672 - DNA, 143 bp, Homo sapiens; identical to SEQ ID NO: 35691
  chr15:48470373-48470516
  hyper

SEQ ID NO: 77673 - DNA, 109 bp, Homo sapiens
  chr15:48470517-48470626
  hyper
gatcccgatttgaaaaggccccgagcgctcagtaacccggatctcgcgagaaccggtcgagactgggtgactgggagatggtgtgtgccgggtgcggggggtgggagtg

SEQ ID NO: 77674 - DNA, 30 bp, Homo sapiens
  chr15:48666415-48666445
  hypo
cgcgacccaccctttcggcatccagtcctc

SEQ ID NO: 77675 - DNA, 20 bp, Homo sapiens
  chr15:48906097-48906117
  hypo
ctgggcgacagagtgagact

SEQ ID NO: 77676 - DNA, 87 bp, Homo sapiens
  chr15:48911244-48911331
  hypo
atgagcttgaatcatcctgaaaccatccccccatcccccagcacccttggtccgtggaaaagttatgttccacgaaaccagtccctg

SEQ ID NO: 77677 - DNA, 487 bp, Homo sapiens; identical to SEQ ID NO: 35693
  chr15:48936726-48937213
  hyper

SEQ ID NO: 77678 - DNA, 432 bp, Homo sapiens; identical to SEQ ID NO: 1206
  chr15:48937214-48937646
  hyper

SEQ ID NO: 77679 - DNA, 638 bp, Homo sapiens; identical to SEQ ID NO: 1207
  chr15:48937709-48938347
  hyper

SEQ ID NO: 77680 - DNA, 242 bp, Homo sapiens; identical to SEQ ID NO: 35696
  chr15:48938348-48938590
  hyper

SEQ ID NO: 77681 - DNA, 204 bp, Homo sapiens; identical to SEQ ID NO: 44264
  chr15:49182759-49182963
  hypo

SEQ ID NO: 77682 - DNA, 78 bp, Homo sapiens
  chr15:49255775-49255853
  hyper
ccttttgcctgggttcgttgattccaaaggctgccctctcttggaagatcttgtcttgcatcccgttctgggccacca

SEQ ID NO: 77683 - DNA, 139 bp, Homo sapiens
  chr15:49572508-49572647
  hypo
gtggtgcaggttccacggcaaggtgctgcttgaattgttgactagttgggaatgcggtggggagtattgagtgaagagaatggaaaatcatatttgtaaagacaatgagatgtgaaagagcctgcggtagtaaagaaca

SEQ ID NO: 77684 - DNA, 157 bp, Homo sapiens
  chr15:50124618-50124775
  hypo
tgttgtgtaggagatcggtcagagtggtaggagaagctataaggaaagacgcaaaccttcttgaaaggtgggaaggtcttgcaaaagcttccggagagaataaagctgaaggcagctaattctctcaccctgacgctaagggcgaggactccgtaac

SEQ ID NO: 77685 - DNA, 19 bp, Homo sapiens
  chr15:50716090-50716109
  hypo
ccaccgtgcccagcctcgc

SEQ ID NO: 77686 - DNA, 102 bp, Homo sapiens
  chr15:51202472-51202574
  hypo
ccgggcccccacaggcgctcgatggttgcacggattgtgtagtataccgattcacagctacaaggagtttatatcttaaaaagagcacgtgttaatgtcatt

SEQ ID NO: 77687 - DNA, 422 bp, Homo sapiens
  chr15:51385846-51386268
  hyper
tcagagctgcacaagcgccgggagctgtgggcacgtgaggagggcgagcgggtcctaggtgcgtagacccgtgggtggggggcggagcggaccggtggaggtgggcagagaccggcggcaagtcgacccacggctgtgggtggcttcctcctgttgctcagtatcagggagaggcgggggaggacattcattttttttcttccctaagtaagcatccacctattgctttaataactatcgattgtgaaaagccggcggggcctcttaaaggcgaagtcgggaggcgcgcgcccctgcgtctgtgttcggggaccagtccgcggggaccttctggaccttctccgccggctgcgcggcagcgatggaccctgtgcatgggctctcctagcagcctcgggaaccgcggccgcaagctgtggttt

SEQ ID NO: 77688 - DNA, 417 bp, Homo sapiens
  chr15:51559380-51559797
  hyper
gcaaaaccagctcctcgtattgtgtcccattcacagctggagcagctcgggcactaggcgaggcagggggtgcggcgagcggtctccagccggctgcctgcggtcggtgccgcccgcagaatctgcgcggcccagtgcaaaataaaaacgcggggccccgcgttcaaaaagcaggaaaaagcctttccctttctcccgtggtctttctgtccacctgtctcggcagggtttatttgctagttaagttgcgctggcttgagcacagggacgctggcgggccaaaggccgaccctcacaggcgacccagcgtggcggcgaggtcccttggctgtacgccgaggtctgcgccgcccccacgtccgtggccggccactgcccagggcggagggcagcggtgttcgccgggtgggggcccag

SEQ ID NO: 77689 - DNA, 185 bp, Homo sapiens
  chr15:51633966-51634151
  hyper
tcaacgctgcgggcacggtgttcgcgctgtgccagtggcgcgggctgagctcggcgctgcgggctttggaggcgcagcggggccgggagcagcgcgaggacagtgccctgcgctccttcctggccgagttgagccgcgcgccgcgcggggcgtccgcaccaccccaagacccggccagctcagct

SEQ ID NO: 77690 - DNA, 1 bp, Homo sapiens
  chr15:51634174-51634175
  hyper
c

SEQ ID NO: 77691 - DNA, 320 bp, Homo sapiens
  chr15:51973774-51974094
  hyper
tgcttatcccttgaccgtcgagtgtcagagatcctgcagccgcccagtcccggcccctctcccgccccacacccaccctcctggctcttcctgtttttactcctccttttcattcataacaaaagctacagctccaggagcccagcgccgggctgtgacccaagccgagcgtggaagaatggggttcctcgggaccggcacttggattctggtgttagtgctcccgattcaagctttccccaaacctggaggaagccaaggtatgtgaacacttttcttcttcctaccttccttttatttcgccacgaaaaggtaaagtt

SEQ ID NO: 77692 - DNA, 26 bp, Homo sapiens
  chr15:52000764-52000790
  hypo
ctgccttgccgggcgcggaggctcac

SEQ ID NO: 77693 - DNA, 41 bp, Homo sapiens
  chr15:52967811-52967852
  hypo
aacttagtgttaggccgggcgcggtggctcacgcctgtaat

SEQ ID NO: 77694 - DNA, 257 bp, Homo sapiens
  chr15:53075403-53075660
  hyper
tcacacccacagggacgcgaattccgattttataagcaggtgtgcacgtgcactcagatactcacacaaagccgcgtggagggacgaaaagatcaaccacccgatcgacgaggataggtttgatcttttcgattacctcagtgtgccagtgtatattcccggctgggcctagcgccctaagaaacttcggaactttagctgttaatttttgttttcttactatgacttcccaaagacattctatctgcctaccgggg

SEQ ID NO: 77695 - DNA, 126 bp, Homo sapiens; identical to SEQ ID NO: 35700
  chr15:53075739-53075865
  hyper

SEQ ID NO: 77696 - DNA, 1016 bp, Homo sapiens; identical to SEQ ID NO: 1210
  chr15:53075985-53077001
  hyper

SEQ ID NO: 77697 - DNA, 1171 bp, Homo sapiens
  chr15:53077065-53078236
  hyper
cgctcccagctggcggcgcccctcgccccgggctcagaggcggacacggtcggtcgcgccctgctggccctttgttcgcgccgcagcgggctgggagcagctgcgcgacaccagacccacagcgccaagacgcgaagcgcgaggaaaccgctgcgcttgactccttctcccccaactcttggacccaggaacgcttccagctcctgcgtcccacacgcccagtcctggcttctctcccggcccagaagtcttcaaggattgaagggctctgcctagggccccgcactcctgcctgactcccatggcccagaaaagcagggggacatttgaaatgtcaccccgggataaatattaacaaaaaagcaaatggacttgtgcaggggccagttatcaatcaaccaggccgcaaggccactcagggcaaacacagcccaggttgggctgggcgagactttctcatggccgccccccgaccgaacccctccccccttggctcaggtccttcttaggtcgttctggggcaaacaccggacgggaagggggcgccgccaactcccccgcggggtttggaggtttcctcgcctccaagtcccgcagggcagggtcggagtgcccaacacccacccccgcccgaacctcgggcctgcgcgccgccttcccctgggtccgcggtgctgcgcttgctgttgggtgtgtgtcgctgtctctttccgagccggcagctcctgctgtgtggccgaagccctctggaatctttaattggaaactaatcttggtcttgatagacgcccacgtcagaggcgcgccacccacccacaccccccgcctcatcccggaggagacgcggcgagaaccctgtcgctctgctctttaatggggcagcagcaagtagtacatggagggaacatatattgatttttaaaaggtagttaatttggtgggaatttcctcctgtcgcccttcttccaccagccgctgttatttcgtgaccggaaggcgcctccccaaacacagcgccacgtgcaagagggttttgaccctctgcaacaggctgccggcaactggaggacagaggggcgtggagaagccaccactctcccgctgcggagcgaaggaaccgagctcagtgagccctgacctcgcaaggtggttggaacgagactggggaggg

SEQ ID NO: 77698 - DNA, 251 bp, Homo sapiens; identical to SEQ ID NO: 35704
  chr15:53078741-53078992
  hyper

SEQ ID NO: 77699 - DNA, 459 bp, Homo sapiens
  chr15:53079219-53079678
  hyper
acggagcagtcaggacgaggagcagccccttcgcccactccctccggaacctcagttgctcgcgggcagcccacgggtggagatatggtgccggtagcacaagagctagagagtggaaaaccgggggccagcgattcgctggggcgcccagcgagcctcttctcccctgactggttcccgggcgcaggctgcaggaacctgcatgaggactttgcctggggcgaacgaaggcagagctgggctggaaaacctggcagggcagagtctcagccagcgcggtgctttgggaccggtggcctgcagcgcccaaacccaaagaacgctttgggtcgcttcggggcacgaatcgcaggctggtcggcacctgccacccccagcttctcattggcaggcacgagttggaggagggggctttggcctcacgctttgattttagactgtgaaacggctcagtgcccc

SEQ ID NO: 77700 - DNA, 175 bp, Homo sapiens; identical to SEQ ID NO: 4225
  chr15:53079717-53079892
  hyper

SEQ ID NO: 77701 - DNA, 112 bp, Homo sapiens
  chr15:53079970-53080082
  hyper
cgaatcctcctgaaatccccggtggggttcgggctgggctcagctttcttctctgcctatccgcggtctcggggagccaggcgcggtgtctgcgctgcgccaaggagagctt

SEQ ID NO: 77702 - DNA, 321 bp, Homo sapiens
  chr15:53080299-53080620
  hyper
actgggaccttgggacggtcagcctccctctcctttccacagccaattccatgcgcagagagcgtcctaacccttacaactcgtctgtgctacacacccaccgcccaatggctctgaaactttttgcccatactcttagattgaggtcaccccagccagcgccaaaagaatgagcgcgggagggggtcacagcagccagttcggccaaacatcgacgctgctccggcacgctccagcccagcgcctgggatgtgtcagaggtacctgcgaggaacatttgcgtgcgattccacgcacgcgttgcatccctcttcccaaacc

SEQ ID NO: 77703 - DNA, 255 bp, Homo sapiens
  chr15:53080736-53080991
  hyper
cgccgaggcccggccgcttagctctcggagccttccacagcccaacaccctgagccctggagtaggcaatttgctcccacagccctgtgctggcccttccaggcacagggagtcccccttctaggggtaggggcgggcgggatgaagcgcacccagccctctctcctacccttcctcctttggtcccttcggctttcgtgtaccttatctcccgcgcgcccagctccttggccggctcacctgctaagcggagcg

SEQ ID NO: 77704 - DNA, 243 bp, Homo sapiens; identical to SEQ ID NO: 4229
  chr15:53081054-53081297
  hyper

SEQ ID NO: 77705 - DNA, 622 bp, Homo sapiens; identical to SEQ ID NO: 35711
  chr15:53081398-53082020
  hyper

SEQ ID NO: 77706 - DNA, 740 bp, Homo sapiens
  chr15:53082303-53083043
  hyper
ccaccttcccctctgcgtcctcggcttttttttttttaatattaatttccaaagaggatccgcgccgttgggagagcgcagtgccccagcccgcccgcctcggccacctctcgcccctctctttcttaaaattctgaggtctccggctcccctgccgcggcccgcgcgcctgccgcgtctgctgcctgcccgccccgctggccagcttgagccatggctctgttactgttacagactctgtggccgcggttcggtagccgccgccgccgccgccgcagcggcccgccctcacgcccgccaggcgcagcgcgcatgcgcgaggcccgcccccgccccctaggtcgcggcgcgccaggcccttggcgtcccggtacaaatgaaggagggggcccagcgccttccctgcggcgctggatggccagggagctgcgggcacgtgcgaaagattggcgcagagcgcgacctggggccgccgctgcaatcccaggagactcgcgcctggctcgctcgcctcccttgcttgagtgggctctgtcctcccagcccggggacgctcgtgtcgggcttctagcggctggagtgctgtgcttggagacatcgcccctctctctccagttgctgcttcccggtgcagcttgcccggggagctggggactgtgtcatcaccccttcggctctagcccactaagctttatttcccggggggctgctgggagtgcgctttcccacccttgaattca

SEQ ID NO: 77707 - DNA, 19 bp, Homo sapiens
  chr15:53083116-53083135
  hyper
cgttgacccggcacccttc

SEQ ID NO: 77708 - DNA, 13 bp, Homo sapiens
  chr15:53083136-53083149
  hyper
tcctcccagatac

SEQ ID NO: 77709 - DNA, 30 bp, Homo sapiens
  chr15:53089890-53089920
  hyper
agcgctccactgagccggttgcagctttaa

SEQ ID NO: 77710 - DNA, 21 bp, Homo sapiens
  chr15:53091057-53091078
  hyper
caggcccgagttcccatcccc

SEQ ID NO: 77711 - DNA, 1941 bp, Homo sapiens
  chr15:53095628-53097569
  hyper
aacgaaaaagctcaccgccagacagcttccagcactcgaaccaatacaagtaaagcacatttgcaaatgtgtttgactgtttttgtaggtttaagaagactacgtttttctgaccacttcaaaaaaacaaacacgaattcagccgctgctttaataacctctgaccagaggagctgattttgccaccgagttatcggtcagtgctgcgaggtcagtggcctgtgatcatgtttatagcaggtttggcttggatttggtgacacagccagcaaacctgggagattatgaaaccgtgaaccagcccagggaagtgtagtcaagtttcagtttgggcatttctccgggtgagggaatccggtgggctccatttctacaaggctcacaaacgcaggtgcagttcggccgccgcacgctgcctggcgggagaaacgcgcacaaaccgcagacgcgtgctcctgtagttgccactagctcggggcacgcccgtgttatttacaccctgctcgggggcccccctctcatttgttactttaaactcatggggaggaactgttagctgccgtggcgggactggcaggctgggaggggggcgcccccgctcggctcccgggccgtgacgcggccgctgccctccgcccctggcttccaccctgtttgcatggccacaagctcagcggtggaccagcgtggccaggcccccggagcccttgccccggcctaccgcccctacttcttccccctcaccaccccccccaaacgcttgtgagactggcttaccctggtgggcgagtcgcagcgcattagcggatttcatggcaagttgcttctgtgacatgagatcaggttcgcgttcgaggatttgccccctaggagggaaggaaaggagagtcaatctgcataatttcaaatgagaaataaatagggaaacagggaactgaatttcaagccccctaattcctccctccccccgaacctgtgagccaccccgcaccccccacaacacgccccgtgcacaggtaaaaaaaaaaaaaaaaagtaatcagcacacgtcgcaggtgataccttttattgtgctcattttaaagacaggaacaggatggcctcctgcccgaagactttctctgcagccaggcccggggcaggagggtcagctgggcagcatccgggcccgcggattcctgcaaggtcgcgaggtgagaggtgcggggaggatagacctcgggctcggcgcacagggtctgggccagacgcacaagcccaaattccctccagcttcttcggctccatctttaagtccaggcaaagatcaattccctctctctcttgaacacacacatttgcagccataaataaacagctcccagctaaatcaggaaccggagaggagaaagggaaaaagaaaggagaaaagagaaggattgagaacccaagcgcgagtctcgcctcttccgggcgccgactggctctttttggtcaggccagcctcgcatttggggatgcaacttgcatttgaatagctgcctgggcttgttatggacccgggaaagctctgaaagggaatcactatgcaaattgtcccagttacaatcgaaaggttcgatctccaggagctgcctgacggaagttgatgtcagctatctatgcattagggttgcattaccgccttcgtcggcctcctcgccacccccgctcgcgcctgcaggggaggctttttttttttttgcttatgtttatattttccctcagtaattaaaaaaaaataaaaaaagaaaataaaaggctgaaggtggtggcatagctggctagggcctgggaggcccacgggctgagaggggaggaggtgcggaagggcggggttgggtggcggggggggtcgttcttttgcagcaggtgttgatggtgcgtttgaaatcaaacatttagatttttttttcgctttgc

SEQ ID NO: 77712 - DNA, 130 bp, Homo sapiens; identical to SEQ ID NO: 35716
  chr15:53097777-53097907
  hyper

SEQ ID NO: 77713 - DNA, 309 bp, Homo sapiens; identical to SEQ ID NO: 35717
  chr15:53098381-53098690
  hyper

SEQ ID NO: 77714 - DNA, 145 bp, Homo sapiens; identical to SEQ ID NO: 15900
  chr15:53976280-53976425
  hypo

SEQ ID NO: 77715 - DNA, 311 bp, Homo sapiens
  chr15:54051665-54051976
  hyper
gcccaccctctttcccggcccagctgtatccaagcgcgggccgtcccctcctgcgccgtgctctgaaggcgggaaggcgtgcggctgcaccagccaggggcagacgaagaccaccagcctgggacccggcagcccgacctgcgctctgggggtgcctgccttacctgagccgtggggcggaggagcggcagaggccaggcaggctggcgggtctcgcccttagggtcacgggtaccggccccgcccgcctcgccccgccccgccccgccccggtcctgcccccgcagcgcgcggaccgggctagctctggc

SEQ ID NO: 77716 - DNA, 465 bp, Homo sapiens
  chr15:54270462-54270927
  hyper
agttagttgtcagtgcggtggtgaaggccacacctggcagtggctacagtgcgtctcctgtgagcaggggctgtagctcaccctctcggagctacgccgtgctacggcggcaggagagggagcccgggcgctctcggtggaggaggctggggatcgcagtgccggtgctgcattcagaaaagactcagccgcagccggcgatgtgtgaagttcccagcacgcactcagcccggctgctcctcaccctcaaatgttgatgagcctgggcgctcctcaacacacgggagagatcccattttgctttctgggagaaagagatgagaaatgagccgcggaaggtatttggcaatgagaagagtgaaaggcagtttcttgccagcagctaagttgtagaattgcttcggaggctacccgggagtgcgatagaattgacaagaaaagaacagacaccgttgcagaccaagg

SEQ ID NO: 77717 - DNA, 30 bp, Homo sapiens
  chr15:54633940-54633970
  hypo
gaggcaggtagatcacgaggtcaggagatc

SEQ ID NO: 77718 - DNA, 22 bp, Homo sapiens
  chr15:55452971-55452993
  hypo
gagccaccgcacccagccaaca

SEQ ID NO: 77719 - DNA, 43 bp, Homo sapiens; identical to SEQ ID NO: 44269
  chr15:55689108-55689151
  hypo

SEQ ID NO: 77720 - DNA, 86 bp, Homo sapiens
  chr15:55699080-55699166
  hypo
ttttgactgaaattccgccctcagcgtaaaaggttaaaaattatgaattaacgcccgcgcggtgggtcacgcctgtaatcccagca

SEQ ID NO: 77721 - DNA, 92 bp, Homo sapiens; identical to SEQ ID NO: 44271
  chr15:55806620-55806712
  hypo

SEQ ID NO: 77722 - DNA, 971 bp, Homo sapiens
  chr15:55879812-55880783
  hyper
cacaaagtcgggaggcgagggatccgcgcggatgtctcgggggccagcgggcgcccgggccgcgcgctcggatcgcagcctcggccccggggtgccggcgggacgcgggctgcgcggacttaggcccggacagagccccatggcctcccggcggccgggcacggggccccgcgcacctcactcaccccggttcccccaatccggcacccttctcggttacctcgaactctcttcagcgaaatgggatccttctcctgttctgctgacattacagaccgcaaagcatgactcccccccaggccgcgggaattcggtctctttgatgctgcggcggcggctcctcctcctcgcggggccgctgcggctgcgaggcaagcctcggagccgaggcacggccgagggcggtggggacgcgggccgactttgcaaagtttgggaggaggacgaggcctcggggcggcggggcggcggggcggcgtgcgggcaccggcggggctcagcggcggtggccgggagcgcggcctgggggcggccccccacccggggccggcatgtgctgagggcgagtgcgccgccgccgccgccgcctcctcccactccttcttcttcgccgccgcctcaggagccgctgacaggggaagcaggaggctcgcggcccggccctggcggcacactcacagcgccctctgaggaggaggtctgctctctcgccgctcccgagtcgcagacacaaaagcccccagactggagccgcctgtaaaacccgctctggggcgggcgagggacgtggcgcggccccgcggcttccccgccctgagctccccagccccgcgcggggacgggcttcggggggcgggggccgctgcctcgtcccgcggcgcctcccgccaccgccgccgcctcgcgctccgcctcggcccagcccccacggcccgcgcgcgcctcttgctccaagccggggctcgcgggcc

SEQ ID NO: 77723 - DNA, 154 bp, Homo sapiens
  chr15:55880890-55881044
  hyper
cgacgctaccgggcccagctttcgcaaggaaagggcatctccgaacttcgtcggaggccacagcagcaggcgtctcggcctcgcagctagggatcggaaagatgaacgtaccatgcgaggaaactttgtaagcgggagctggagagttctcggc

SEQ ID NO: 77724 - DNA, 131 bp, Homo sapiens
  chr15:55881045-55881176
  hyper
ggcatgtggggatccagattccccgactccgtgtccgcgtggccgtggtgtggacacctgtctgtagaatgcctccacttggtattttaacgacttgactcttcaagaaagagcgacgtagaataaatacc

SEQ ID NO: 77725 - DNA, 20 bp, Homo sapiens
  chr15:55933134-55933154
  hypo
gaacccgggaggcaacaaac

SEQ ID NO: 77726 - DNA, 336 bp, Homo sapiens
  chr15:56034387-56034723
  hyper
ttcccccctcctttccggggcacaaatcggccacttcacttccaaccctgccaattccaccctcccatctcctcctggctggatccagatccggcaagctggtgccgattggggttatgagttcacctattccctctcgcagccctaaaaagtgggggaactcccacaacagacacgggaagccgcgaggaaccgcggcgccccctgcacggcgaggctgccactaaggaaacaatataaataaagccacgtgcagccgcggcggccccggcgggctggcgacccggagtccggccggtcgcggaggcgcggacgcggccggagccgggacaatgg

SEQ ID NO: 77727 - DNA, 375 bp, Homo sapiens; identical to SEQ ID NO: 35725
  chr15:56034885-56035260
  hyper

SEQ ID NO: 77728 - DNA, 206 bp, Homo sapiens; identical to SEQ ID NO: 35726
  chr15:56035304-56035510
  hyper

SEQ ID NO: 77729 - DNA, 84 bp, Homo sapiens
  chr15:57618488-57618572
  hypo
ctctataaactctcacgagggtcgccggtcggtccactaggaggtcgaaggccttcatcaggtagacgacggggttgggcagcc

SEQ ID NO: 77730 - DNA, 30 bp, Homo sapiens
  chr15:57967966-57967996
  hypo
ctaactcaccattcccgggtgctcacaact

SEQ ID NO: 77731 - DNA, 71 bp, Homo sapiens
  chr15:58357149-58357220
  hyper
aaaattcacatgaaacgctgacgttggagttactgtacttatcagtcaggtttccgtgaaatttgtcaaac

SEQ ID NO: 77732 - DNA, 21 bp, Homo sapiens
  chr15:58357799-58357820
  hyper
cggggtcggccttcacctcgc

SEQ ID NO: 77733 - DNA, 260 bp, Homo sapiens
  chr15:58358503-58358763
  hyper
cgccctctcccccgaccccccgactcccctcagccgggccgaggtgcatggtggccagagggtcagggagaggtggcagtgggtgcgagtccccctcgcctcgggctcagaatgaggatccctgcgagcgggtcagcgcggggcggcccttgccaggcgtcgcccgcccagttgctgccctctgccggccgggaccgcccgggcggcttgcgctgtggcgggaggatatgggcagtgatcatccccggctcctccgagga

SEQ ID NO: 77734 - DNA, 101 bp, Homo sapiens
  chr15:59158436-59158537
  hypo
gggattacaggtgtgagccaccgcgcccggccccaggtttggattctttcacacagcaggtatgggccgactcactgtctggggcccgcccagcccagccc

SEQ ID NO: 77735 - DNA, 30 bp, Homo sapiens; identical to SEQ ID NO: 44273
  chr15:59243729-59243759
  hypo

SEQ ID NO: 77736 - DNA, 24 bp, Homo sapiens
  chr15:59279029-59279053
  hypo
tgaatgatacggaaaatatgagtg

SEQ ID NO: 77737 - DNA, 30 bp, Homo sapiens
  chr15:59445742-59445772
  hypo
ggagatggagcttgccggcttcatccagag

SEQ ID NO: 77738 - DNA, 64 bp, Homo sapiens
  chr15:59453450-59453514
  hypo
taacaggtcgaaggacgcagtgagaaaacggtgctcagagatcccgccacggagttctgctgct

SEQ ID NO: 77739 - DNA, 159 bp, Homo sapiens; identical to SEQ ID NO: 35730
  chr15:59729656-59729815
  hyper

SEQ ID NO: 77740 - DNA, 30 bp, Homo sapiens
  chr15:59846186-59846216
  hypo
tgatgcacatgggtgcggggcctgtgcagc

SEQ ID NO: 77741 - DNA, 21 bp, Homo sapiens
  chr15:59950342-59950363
  hypo
aaactccgtctcaaaaaaaaa

SEQ ID NO: 77742 - DNA, 23 bp, Homo sapiens
  chr15:60085007-60085030
  hypo
tcattatccggatgaaaagtata

SEQ ID NO: 77743 - DNA, 18 bp, Homo sapiens
  chr15:60121321-60121339
  hypo
actgactcacggccccgg

SEQ ID NO: 77744 - DNA, 80 bp, Homo sapiens
  chr15:60286430-60286510
  hyper
ttatttatttatttgcgccctgaaggacgactcggatttccaggccagccggaagaggcagaaagcgaacaggctgctca

SEQ ID NO: 77745 - DNA, 782 bp, Homo sapiens
  chr15:60286804-60287586
  hyper
tattcactaatccagcgcattgccaaatacccccttaattctgcttaacactaaaagggttttgagcaccataatgagattcttctgtctgctaattaattgacacgctcctgaatattcatatgagctagcaccaatacgttcctaattgcaccgtggaatagatctcagaggaaagtaaatcgccatagacttaattaaaataatgtattccagatccagcacggggaaagatgagacatttgccttcgagctcgctaagaaagtggcacctggttggtggaggggagagataccaaatgtcggcgcccagcctgaaataagtggcatgggacgcgcagggagggcgttcagcttcagaaagcagcggctacgctgggtccaaacccggcggctcgggaggccatagctcctaggtgcgtccgagctcctgctaccctgcgcggtgttgtcctaccggaggaagtggctgatgggcagtctaggatcccggcccctgacccagggccctctcctccctgcggtcctggtccgggtcatggtcccggggctggtctgaagtgctgtctacagagggcacttggggaaacatcgtaggtccggaaattcccagggaaagtttttgcaggagttgtggacgccgcagcagccccaactctcccaacccagcttgcgacccgagagaagtcgctcacacttctctttgggggagggcgacagttccggggaggacgcttggatcccgaaaatgacgggatccaggtcccacaaccctcaggaag

SEQ ID NO: 77746 - DNA, 33 bp, Homo sapiens; identical to SEQ ID NO: 1213
  chr15:60287643-60287676
  hyper

SEQ ID NO: 77747 - DNA, 30 bp, Homo sapiens
  chr15:60288131-60288161
  hyper
aatctgggaaacctacgaggcccacagttc

SEQ ID NO: 77748 - DNA, 171 bp, Homo sapiens
  chr15:60288412-60288583
  hyper
ttcctttactgccggcgagggaagaaaagacagcctaccttggctaagggaggccaccggctccaccaatcaaatcgctatggctatgaacaaatggttatccgctccaaagaaaatcacttgctggatcagccttcttggaattattaaatccttcgtggttctagattt

SEQ ID NO: 77749 - DNA, 132 bp, Homo sapiens
  chr15:60288786-60288918
  hyper
aagtggcaaagttttcgaaaaacctcgccgatcctctgaagatcgggttaatgatttaccccactcgccaaccacctgatgtagcctaccgctacgccgcggaggtgtgccaggatgcgctgcaggggggga

SEQ ID NO: 77750 - DNA, 316 bp, Homo sapiens; identical to SEQ ID NO: 35735
  chr15:60289310-60289626
  hyper

SEQ ID NO: 77751 - DNA, 30 bp, Homo sapiens; identical to SEQ ID NO: 35736
  chr15:60289876-60289906
  hyper

SEQ ID NO: 77752 - DNA, 48 bp, Homo sapiens
  chr15:60292201-60292249
  hyper
tcccgaaatccagcacgttaaagccaggccttgcggtgctggggggct

SEQ ID NO: 77753 - DNA, 701 bp, Homo sapiens
  chr15:60295917-60296618
  hyper
agtcaagtcaaatttcgacctaactctccggggactggggggcaagggtgtgttttcattattataacccatgcaaccaaccccgggtagtgctaagcgcaggaaaagggtcggcttcaggggaaagccgtgcctaaagttacctaacgatacaaaccggatacaacgcagaggaaacagaataccccagccaagcaatttccatgtcaaacatcatccgcgcggctgctccatctgtgaacgtgagtggtcgcctggctccctcttccgcggcggccgcttcctcataccttcacacggcgcacaccggccggcgcgtccagctgcctgcccagtggccgaggctcttccccctcgcccagtcttgagctggaagtgattcctattggccaaggtgtccatgtaaataggtgtgaaagaaaccagagctggccgggctctcccttctcgctcagtcccctccctctgcagcccccgctccccctcctcttcctcctcctcccaaggcgattgtcatatgatagctaagaagtggcacattaatgaagcgccgctacaggggtcttttctgctcctgtcaccgcttaaaactatcagatggttcgagggaggacatggaggcagccacctagctcagcggagacgcggagcccacagcagcgccctccggagccctaacacgtcgctgccaccatccgcgc

SEQ ID NO: 77754 - DNA, 64 bp, Homo sapiens; identical to SEQ ID NO: 35740
  chr15:60296860-60296924
  hyper

SEQ ID NO: 77755 - DNA, 676 bp, Homo sapiens; identical to SEQ ID NO: 35741
  chr15:60297151-60297827
  hyper

SEQ ID NO: 77756 - DNA, 238 bp, Homo sapiens; identical to SEQ ID NO: 35742
  chr15:60297941-60298179
  hyper

SEQ ID NO: 77757 - DNA, 30 bp, Homo sapiens
  chr15:60615951-60615981
  hypo
gagtctcagtgtcttcgacagaatttgact

SEQ ID NO: 77758 - DNA, 30 bp, Homo sapiens
  chr15:60789762-60789792
  hypo
agcttttctgtatgtcgtccacataaggct

SEQ ID NO: 77759 - DNA, 321 bp, Homo sapiens
  chr15:60883283-60883604
  hyper
ccccaaactagcaaacgtttaacaggcgcttggcacccgcaccggtggctaggacccgcaggacagtctgggtctgcacaattgctgcgcattagggaagccgcgtccgccgcaaacagatggggctctaaatccccaagcctggcggccgggcctgcgaagcagctcgggcagattatccacggcgaggaacctgcgggcgcacaagcgggcggcgggcggcgggcggcgtgctgcgggctgagtttctccggagctgtttgcaaccgtcccaagagcgagtctcggtttctccggcagcacgggcgacttcctgaacac

SEQ ID NO: 77760 - DNA, 32 bp, Homo sapiens
  chr15:60896339-60896371
  hypo
aaaaaaaaaaaaaagcacgaacattagaaaaa

SEQ ID NO: 77761 - DNA, 30 bp, Homo sapiens; identical to SEQ ID NO: 44275
  chr15:60915264-60915294
  hypo

SEQ ID NO: 77762 - DNA, 30 bp, Homo sapiens
  chr15:60924136-60924166
  hypo
cgctttactcttctccgggtttaatagaag

SEQ ID NO: 77763 - DNA, 30 bp, Homo sapiens
  chr15:61065077-61065107
  hypo
acattaaaatgtctccgattaagccctgga

SEQ ID NO: 77764 - DNA, 127 bp, Homo sapiens
  chr15:61113449-61113576
  hypo
gccatagcctctttccgtctccctgctgtgtgctgttccctttcagtgctgactcttgtccccttggctgtttggatccggggcttctagcccctacgctctgcactgggtccgctccatctgctgc

SEQ ID NO: 77765 - DNA, 30 bp, Homo sapiens; identical to SEQ ID NO: 44276
  chr15:61305596-61305626
  hypo

SEQ ID NO: 77766 - DNA, 250 bp, Homo sapiens
  chr15:61519861-61520111
  hyper
cctggggcccccattcgcctctacccagccctccccaaccgccgccagaagccgagtgcaagaggagggggcgcgctgggccggtacccaagccggggctggagaaatcctctccgtccccagctccaggcggctcgcgcgagcacgcttcctccggagtgacaggcgcgatttatacattatttacaacagtaattaaagctgtagcttcctcctgttctttgcaaactccaggcgcattcaaataaat

SEQ ID NO: 77767 - DNA, 89 bp, Homo sapiens
  chr15:61520408-61520497
  hyper
gcttgcttttgtagacgctccctccggatgcgcgtggagcgccccacaggaccgccgccctctgcgcgttggcgcgcacacgccccccg

SEQ ID NO: 77768 - DNA, 540 bp, Homo sapiens
  chr15:61520754-61521294
  hyper
ccgaaaacacacccccgactcgggcagccagggccgaaactgtcaagaggagaaaaggtaaagcggaaggagggtggccataaacagatttttttgccccttcttaaaaggacactgccgctttaaaagtttctttcccgggcccccactccccgcatctccgtattttgggggagcgtatttaattgaggcaacgcagctttcctccagtgtttgcagaaaaatcaaagccaggggggtgagcccgccggctgtcaaccttcccgccgcctcccccgccccactctgctcccgcaagccgagaacgggctgcaaaagtttgcaacatttctggggggcggaggggggaggggaggggggtcctccgggctcggggcgccgccgcaggctcgcgcgcggccgccggaccccgcgccccgggcgcccgctcccggccgccccccgctccgcgcccgggctcccgccgccccctccccagcccctctccagcctcctacctctgctggtgctggaatagctctgtctgcgcaccggggcagg

SEQ ID NO: 77769 - DNA, 185 bp, Homo sapiens
  chr15:61521311-61521496
  hyper
cggattcctggttcagcggggtctccctggagccggcggccgcgtccgcgccgctgctgcctggctcgctggcggcggggtcgggggctgccggagctgactccatgttttttcccaatgtagagatcgctggagatggcgagctccgagactccctctatcttctgttttcagagcaactctat

SEQ ID NO: 77770 - DNA, 22 bp, Homo sapiens
  chr15:61521556-61521578
  hyper
cgaccggcgaaagcaggaggga

SEQ ID NO: 77771 - DNA, 165 bp, Homo sapiens
  chr15:61521809-61521974
  hyper
gagaacagagcctcccgcgccccaatcctcccctctccccagcccagggacagaaattaaaatcggtgagatgattccgtgcctacttctgagactctctcgggaacagaactcgtccccatccgctgccagcttgggtagagacaaatccgattgtccacgtcc

SEQ ID NO: 77772 - DNA, 139 bp, Homo sapiens
  chr15:61739721-61739860
  hypo
ggtcaaaaaagtagttgttttttttttaaccatgtgcccacattactctttaaaaaacttcattaagtataatgtagacaagaaaagtgcacgtaagtgtaccgtttgataaattttcacacaccgatgtaactaacat

SEQ ID NO: 77773 - DNA, 37 bp, Homo sapiens
  chr15:62068181-62068218
  hypo
ctcatggacataaagatggcaacgatagacactgggg

SEQ ID NO: 77774 - DNA, 30 bp, Homo sapiens; identical to SEQ ID NO: 44277
  chr15:62361320-62361350
  hypo

SEQ ID NO: 77775 - DNA, 44 bp, Homo sapiens; identical to SEQ ID NO: 44278
  chr15:62367703-62367747
  hypo

SEQ ID NO: 77776 - DNA, 159 bp, Homo sapiens
  chr15:62456236-62456395
  hyper
tcaaaggaggccttgcggctgcgccccaccacagcgctgcattgccaacgcgcagtgcccggcggccgcaggacgaggctgaggcggcagcggacggcgcggggcccgggggcgcctccgaacaggctctccgcgcggagcagccggaggcggagacgc

SEQ ID NO: 77777 - DNA, 245 bp, Homo sapiens
  chr15:62456686-62456931
  hyper
gcgtcctggggcaggcggggaccgccgggggccgcgggggtggccgggcccggacctcgcgggccgcacagggtccccaggggggcgtccgggcctccgccgccgccgcagctgtgggcccggggccggggcgcgggcgggcccccgagcaggagcgactccttgcggcgcgtgtgcgggctctcgagcagcgcgcagaagccgtaggtggtgcgcacacggggcaggtgcggcagtgacagcgc

SEQ ID NO: 77778 - DNA, 158 bp, Homo sapiens
  chr15:62457138-62457296
  hyper
ggagctgcctgcggccgaggaacagagtttctcgaggagccgcatccttggaggctggggctaggagtggcgggaagaggtgcgcctgcgggggagagaagctgctgagtttgggcgcctggagctgctgcagcccctcgacgcggctggatccctcc

SEQ ID NO: 77779 - DNA, 80 bp, Homo sapiens
  chr15:62684233-62684313
  hyper
ggcctgtggtcgccccgaggccgccgaacagcctgagcttccagtcgcctctttggctttagcggcgacagcagtagcgc

SEQ ID NO: 77780 - DNA, 91 bp, Homo sapiens
  chr15:62821527-62821618
  hypo
ggcaatcttcccaccttggccttgtgttggtattacacgtgtgagccactgcgcccagcctttttagggcttttatcgtctactgtaaagt

SEQ ID NO: 77781 - DNA, 243 bp, Homo sapiens
  chr15:63334477-63334720
  hyper
aagcgcgccgggggacggcacaggggggcgacgcgcatccaccacctggtccgcgctctcccggcctccggcagctcagggcgggctcggttggggaccctaatggctgggtgccggccctgggagaagggcacgcggagggcggagggttgcgcctcggccccggctcggccccaacgccctctccctggcgcgcaggtttagaaacagggcggcctctccggccgccgcctcggcggctcg

SEQ ID NO: 77782 - DNA, 74 bp, Homo sapiens
  chr15:63334921-63334995
  hyper
tctgggagaagcaggcggctccgcgctcgcactcccgctcctccgcccgaccgcgcgctcgccccgccgctcct

SEQ ID NO: 77783 - DNA, 72 bp, Homo sapiens
  chr15:63335932-63336004
  hyper
agttgctgcgggtgtcggaggacgagcgggaccgggtgctggaggagctgcacaaggcggaggacagcctcc

SEQ ID NO: 77784 - DNA, 35 bp, Homo sapiens
  chr15:63390437-63390472
  hypo
gaaaagagtgaaattcgtccctctccctctccctc

SEQ ID NO: 77785 - DNA, 501 bp, Homo sapiens
  chr15:63673771-63674272
  hyper
ccttcagcccaggggcggctgagcgctcaggagtgttaggaaagaagcaggcggaaactttaccgttcactggggccgggctggaaggctgttcctttaagatcaccagcaggagcacggccgccgcgtgcaggctgcgccggggcatcttcgcgggctcctgcggggcgggcgcgggctgtgccgggggctcccggtggccgctcgctctccagctgcacaccgggaccgcgtgcgcgcagcctgggtgccgtggcgagtacgtccgcccttcgctctcctggcttccccgggcagcttttatggagcaactcaacgccaaacacttgatgtcatcgtgcggggagggggtgggggaggagaacgccctgcccaccggagggctggcgccccagatcctaggtgagttgtagccttgacttcagcagcactctgcgggtccccggcgctcctctgggccagggctgacccaggaacacagttctccgaggagctgctggc

SEQ ID NO: 77786 - DNA, 249 bp, Homo sapiens
  chr15:63753342-63753591
  hypo
aaaagaatgttactgcggggcctccctaaaagacaagggaggaatcaagagaattccaagaaaggcgtccgagcaggaggtaagacagtagatttgaaagcaggactgagggagcaggaatgggaagaggggcccagccccagcgggtcaggggccggactaggctagcgaggcccaagtgcggtggccccatgcagagatcctggctcggtgcaaaggagatgccgctcccaccgtctgcaggaggca

SEQ ID NO: 77787 - DNA, 30 bp, Homo sapiens
  chr15:63756300-63756330
  hypo
catagctgtgggagccgatcaagttcccta

SEQ ID NO: 77788 - DNA, 82 bp, Homo sapiens
  chr15:63779643-63779725
  hyper
ctctcactgggagcccggactcacgcagcaccacctgtgtcccctagggggcgagctggggagagaccggagtccctgggag

SEQ ID NO: 77789 - DNA, 30 bp, Homo sapiens
  chr15:63795471-63795501
  hyper
gtaagaagtgattgacggggcgtccctggc

SEQ ID NO: 77790 - DNA, 43 bp, Homo sapiens
  chr15:63795851-63795894
  hyper
aacaagttacagactcggtttccccctgcggtaaaaaggggat

SEQ ID NO: 77791 - DNA, 30 bp, Homo sapiens
  chr15:64210208-64210238
  hypo
tcagtgtttgttcaacgggactggaccctt

SEQ ID NO: 77792 - DNA, 30 bp, Homo sapiens; identical to SEQ ID NO: 44280
  chr15:64440388-64440418
  hypo

SEQ ID NO: 77793 - DNA, 91 bp, Homo sapiens
  chr15:64443195-64443286
  hypo
cggccaaatcatctcactttatacacttgcctgaaggagccacgttatccctattttgcagatgagcaaaggtctacggagctcctgaaat

SEQ ID NO: 77794 - DNA, 38 bp, Homo sapiens
  chr15:64649878-64649916
  hypo
accttcaaaataaactttcataccgacactatggataa

SEQ ID NO: 77795 - DNA, 30 bp, Homo sapiens
  chr15:65036371-65036401
  hypo
gaagcctcacttatccgaaattaaaacatt

SEQ ID NO: 77796 - DNA, 152 bp, Homo sapiens; identical to SEQ ID NO: 44282
  chr15:65043526-65043678
  hypo

SEQ ID NO: 77797 - DNA, 50 bp, Homo sapiens
  chr15:65068204-65068254
  hyper
ctgcccgggcggcctcgcgcttagggcacccgcagcgaggtttccgggcc

SEQ ID NO: 77798 - DNA, 30 bp, Homo sapiens
  chr15:65118647-65118677
  hypo
tagggctcactctgtcgcccaggctgtagt

SEQ ID NO: 77799 - DNA, 35 bp, Homo sapiens
  chr15:65119226-65119261
  hypo
ctcccagtctgttagcggtagagggtgatgactga

SEQ ID NO: 77800 - DNA, 29 bp, Homo sapiens
  chr15:65127732-65127761
  hypo
tgagccaccgcgcccggcctggatttatg

SEQ ID NO: 77801 - DNA, 48 bp, Homo sapiens
  chr15:65204187-65204235
  hyper
ggggcgggccgaggccgagaggacccccgcatccgtttggggagtgcc

SEQ ID NO: 77802 - DNA, 30 bp, Homo sapiens
  chr15:65214117-65214147
  hypo
agtttgggatgaatgcgcttctcctgtctg

SEQ ID NO: 77803 - DNA, 37 bp, Homo sapiens
  chr15:65322459-65322496
  hypo
gataagtcttttggtaacaaatcgtgcatgttttcag

SEQ ID NO: 77804 - DNA, 121 bp, Homo sapiens; identical to SEQ ID NO: 35757
  chr15:65360172-65360293
  hyper

SEQ ID NO: 77805 - DNA, 76 bp, Homo sapiens; identical to SEQ ID NO: 35758
  chr15:65360323-65360399
  hyper

SEQ ID NO: 77806 - DNA, 50 bp, Homo sapiens
  chr15:65622968-65623018
  hypo
aaaacagcttgaagccgccctcgtgctgggccagccggggccaaggctcc

SEQ ID NO: 77807 - DNA, 197 bp, Homo sapiens
  chr15:65625104-65625301
  hypo
gaaggaccaggttagcggcagggccccgccccacgggaggggaggcagctctgcctgcgcagtgaggctgccggcgacagagtgaaaatgacaagcaggcccggagtgcacaggcaggcaggtgtgagcgtggagatgccacacgtgtgaatgaaaacagcacgtgggaagacacgtgtgagcgacacaggtgggga

SEQ ID NO: 77808 - DNA, 236 bp, Homo sapiens
  chr15:65647864-65648100
  hyper
cggcgggccccttcccggcggccgggcccgaggcgggggccggttcccacagccgaccgggccgcgcgccgcctttgaagtggccgcagctgcgccccggcccgcggctaatccccgccgacgcgggcgtcccgcccccccgcccctcccgcatagcaatagtgtccgcgctgaatggcgctggctaattacctcgctcgcaccaccgcgggtgaatgagagaatccggcattgtg

SEQ ID NO: 77809 - DNA, 15 bp, Homo sapiens
  chr15:65648136-65648151
  hyper
cgcacgccaaacgag

SEQ ID NO: 77810 - DNA, 1174 bp, Homo sapiens
  chr15:65669070-65670244
  hyper
ccctggtatagctgtcgggaataaagtttttccttgatgcggacgcgagcttctacttcttgggagaggagtggagagagaatagcccagatgagtgtctgtggggaacttgaggtgggagggttaagggactagatttgcactctcctcccgggagatgggaccattgcagccactaaagggaacagagtggtggtgaccgagctccaggcagcagagccgagctccaggcagcagaaccggcggaccgcgagagccagggcaaggtctccgcgtgtgcacacttcggggaagggcaggggcacgtgagcatccccgcggctcgctcgctctcgctttcggtggcttctcctctccttcttggctcacgggctctgtcccgggtcgctccctagccacgcgccgccctccaggaatctccctcgtcttctcctgtctctcccgcgcactcctcagcccagtaccagctccaaatgcaggtcgtgccatctccgcccagtgcagccgtcagagtcccggtctccgctccccaggctgctgtcccctgtcttggctgcctcgggctatgtccacggccgggcacccagcaccccagctcgtccgcctcggtcagcgcttagccttgcggtctcccctggctcgtttccctcggtctccacgccagcccgccccgcttgctcccgcttcgctgcactccttgctcctcagtctgggctccgggtcctgccccagtcttcctccggggggttccgtcctcaacacgcccctagggcccccagcagtccggccttggtaccctctccccgtccggatccgcagggtcccccccgcgcggggtccgccctcaggtccgcgccgctctccccgggtccgcccctcgcgcccgctccctccctgctcgcccttcccctggctccgtccgcaaccgcccggtccggggcgctttcactcaccctcgctcggcgcgggcagcagcagcaacagcagcggcagcaggagccggggccagagcggggcgggcgggcggcgcggagacgcggcgcgctgcacagccatggggctctcggtcagctcggctcggcgacgcgcggctcccgggcctctcgcggctcacagcgtcccgcggggccggcgccggggccggggctggggctccggccggggccgagcccag

SEQ ID NO: 77811 - DNA, 151 bp, Homo sapiens; identical to SEQ ID NO: 35762
  chr15:65670634-65670785
  hyper

SEQ ID NO: 77812 - DNA, 564 bp, Homo sapiens
  chr15:65713759-65714323
  hyper
ctctggcccagcagccgagacccagcctcgcggcggcctccagcttaatccgctgttggggctggaaaggggcgtgtctttgtagggacagaaggggtccgaggagttcccggcactttcccacccgctgtttggttttcctggagatgggcctggggctggccaggcggaggctccttccccccgcctccctcccacgtggcctggctgagtctctctggaaagccgcagcagctggagagaaatccccctccccacccccacctccaagtccctccccgactctccccggacacatcctcagctcccccctccgcggggaaggcaagaactaggcgaacaaagcggccagcccatccccctcccagccctgccacctacactccccatgagccgcccccaaacgcacaccggacaggaagcgacagagctgtgggtggaagccgcagccctagacacacacccttggggacttcgctatcccctccccagccctttctccagcttggacaactctgacttaccccgtacccactccgcactgggctgcggactggatgaggc

SEQ ID NO: 77813 - DNA, 84 bp, Homo sapiens
  chr15:65714747-65714831
  hyper
aggcaaggcagagcccgccccgcgaaagccaccgacaccgcagctacccgccccgccgatgccacgccgcgaccatggcacgca

SEQ ID NO: 77814 - DNA, 395 bp, Homo sapiens
  chr15:65715098-65715493
  hyper
tcgctcctgcctctccgggcgcccgcccttaccgcgcgcggccaacaggcagaaggtcaacgcgaggagcccgcggccgcggccggcgtccccccgcgccatggggctgggctcgggccgccgccgccgccgccgcctccccgtgcttcggccgccgccgcggggggagagcgcgccgggcgtcagtggcccggggaggcgcggcgccgcgggcgggggcgcggcctcgggggcccgggcccgagctggggccggcgcgggggccagggccgctgccgcctcacccgcccctccatcgccatcttgggcgagcggcccgggagggggcgcccggcgagtgtggccaccctggccccgccggggaccctgcgcccgcgcgccacggccctgcgcct

SEQ ID NO: 77815 - DNA, 165 bp, Homo sapiens
  chr15:65715513-65715678
  hyper
cgggtctgtgtcccggtgcctcgccctctccgggtcgccgcgggcccccgtgaggccgcctgttgctgggtctgtctcttagtctccccgtctctgagtcttctggtctctctgcctcagcgtctctatttcttctccctgttgctgcctcggggtctccacctc

SEQ ID NO: 77816 - DNA, 95 bp, Homo sapiens
  chr15:65826384-65826479
  hypo
tctcaaaaaaaaaaaaaaagaaaagaaaccagtggttctggctctggatgaagcacttcatttatttgttcagtaaaaatcgtttatggagtacc

SEQ ID NO: 77817 - DNA, 103 bp, Homo sapiens; identical to SEQ ID NO: 44285
  chr15:65862091-65862194
  hypo

SEQ ID NO: 77818 - DNA, 30 bp, Homo sapiens
  chr15:65946844-65946874
  hypo
tctgccccaaacacacgctgcaattttgtc

SEQ ID NO: 77819 - DNA, 83 bp, Homo sapiens
  chr15:66017661-66017744
  hypo
tgccctttgataaatcgcttaaaaatctaagctttggtttccttgtcagaagggttaataagaactacctcggctgggcgcgg

SEQ ID NO: 77820 - DNA, 33 bp, Homo sapiens; identical to SEQ ID NO: 44286
  chr15:66147762-66147795
  hypo

SEQ ID NO: 77821 - DNA, 30 bp, Homo sapiens
  chr15:66198204-66198234
  hypo
aggtgcaactgaaatcgaaagatgaattca

SEQ ID NO: 77822 - DNA, 41 bp, Homo sapiens
  chr15:66596944-66596985
  hypo
aagatattttatggccgggcgtgacggcttatgcctataat

SEQ ID NO: 77823 - DNA, 192 bp, Homo sapiens; identical to SEQ ID NO: 44287
  chr15:66598802-66598994
  hypo

SEQ ID NO: 77824 - DNA, 104 bp, Homo sapiens
  chr15:66647729-66647833
  hypo
caaattggagttagacgatctttaaaatctcactaattctaaatttcggttaccataaatataaaagcaaagcatcggctgggcgcggtggctcacgccggtaa

SEQ ID NO: 77825 - DNA, 97 bp, Homo sapiens
  chr15:66649671-66649768
  hypo
catagcagaatgcttcgaactcagagttttatgaattgtttattgaataataagctgagaaaagaggtggtaaagagaggaaaaatagggctgaaca

SEQ ID NO: 77826 - DNA, 30 bp, Homo sapiens; identical to SEQ ID NO: 44288
  chr15:66788210-66788240
  hypo

SEQ ID NO: 77827 - DNA, 30 bp, Homo sapiens
  chr15:66789348-66789378
  hypo
tctcactatattgcccgggctgaggggctg

SEQ ID NO: 77828 - DNA, 26 bp, Homo sapiens
  chr15:66798718-66798744
  hypo
agataaggccgggcgcgatggttcac

SEQ ID NO: 77829 - DNA, 185 bp, Homo sapiens
  chr15:66963175-66963360
  hypo
cagggttgtgaaatgcgtgagtgtatgtgaagcgctgagacagtgcctggcacattagtaagtgctggacgtgtttgctccttctaggtctacatttttagcagagggaatagcaagggcaaaggccctgaggtgggaaacacgttccaggaatgggaagaaggttaggacgacacaaggggagt

SEQ ID NO: 77830 - DNA, 62 bp, Homo sapiens
  chr15:66963672-66963734
  hypo
ccagcctgaggtgcccgcctcccaccgcaccgcctgctgtgatcagccggagccttccatct

SEQ ID NO: 77831 - DNA, 72 bp, Homo sapiens; identical to SEQ ID NO: 44292
  chr15:66964011-66964083
  hypo

SEQ ID NO: 77832 - DNA, 33 bp, Homo sapiens
  chr15:66995234-66995267
  hyper
caacttttgaaggctcgccggcccatgtggggt

SEQ ID NO: 77833 - DNA, 30 bp, Homo sapiens
  chr15:67322314-67322344
  hypo
aagatgagctcaattcgggagatgcccaat

SEQ ID NO: 77834 - DNA, 39 bp, Homo sapiens; identical to SEQ ID NO: 44293
  chr15:67457364-67457403
  hypo

SEQ ID NO: 77835 - DNA, 81 bp, Homo sapiens; identical to SEQ ID NO: 15907
  chr15:67545405-67545486
  hypo

SEQ ID NO: 77836 - DNA, 30 bp, Homo sapiens
  chr15:68074740-68074770
  hypo
agggcaccgaggaatcgatttttgtcttgt

SEQ ID NO: 77837 - DNA, 141 bp, Homo sapiens
  chr15:68112086-68112227
  hyper
cggcctcccaccaaatccggaccctctccagcctcagtctctggtccgcaacaggagtgaggtgggcccggagctctgagcaccttctcaccggctccaaggcccccgccttctcctcacttttggtctcgggttggggcc

SEQ ID NO: 77838 - DNA, 164 bp, Homo sapiens
  chr15:68112276-68112440
  hyper
cgcgccgggctctgccctatgtggccgttggattaatatccagatattaagtaaacactaaattagcaaaactacaagaaaattttacagccctttgcatttggcaatcattgagtgttaattagaaattcattacaattaaaaccctgcctaaacagggcctg

SEQ ID NO: 77839 - DNA, 176 bp, Homo sapiens
  chr15:68112498-68112674
  hyper
cgtaccccgtgattatccccaatcctctttatactgtactaattatgtaaattaaacctaattaactgacgaaaactgccgttaattcaactagtaaaagatatgtgcttgcggaggaggcgcgtccgcgcagcctcagcccaagccggagcccaaatggacgccaaacccggggc

SEQ ID NO: 77840 - DNA, 30 bp, Homo sapiens
  chr15:68112976-68113006
  hyper
cttcctcctctacatcgtctaatgagggcg

SEQ ID NO: 77841 - DNA, 1295 bp, Homo sapiens
  chr15:68113226-68114521
  hyper
gcccttgttgagaatcggctctgcaatcggtaaagtgcggtccgcggtgatattaacccgccggacgccggcccatagtagagccccagctcctacccccacgacctgctccccggtgcccagccctgagcagcggggcttccccagcctctgtccacgcgcctttctccagctcagaccagggacaggagctgggtgggtctcctggcactggccagagcgcggggagctgtccgtagcttggtgctgaacggggacgcagagtcgacgctgcacaccccctggtgcggggcggtaccctttgtctaagaggtcctgggggccccccgcggccgggctgctggaaacggaggcgtctttggccctcgctgtacaacagaggcaggacaggcaggtcctgctcagggggacccagcccatcctctctttcctcccaccccccggcaccctgggggcgtcctggctccaggatcgttgtcaccaccaggccgaattctgagatgccttttaaaaaatcattaggaggctaagaataattaccgaacgagattgtaattatggggtgggggagcctgggccgagggagagggaatgagctggcggggacttgggggcagctctcggactgggaaggaaaataggttcctgtgttctccccggggaaggtgtgggaggaaagacagcgggatagttggagcgggacagaggcacagcctgggaaagacacccgaatggaggggccagaggcagaaagaaaggggccgagcgggttccaggactcccctgggagaaaagggaaaggcagggagatccgagacagaaagaccggaaccgaggagggggaagagggcaagaacgcgatctaaaagagaccctcagaggagacagagcccacaaacttgggagaggttttcggggcctaggagaacggtaacctacgtcagccagggtagccgggaagaaggcaaaggagtctgtgggctgggcctgccctctcctcagtcccttcaccaggcctgagctatcggttcgcgcttccagagtcccttcccagggtctctgcgagccaggagggaaaggaagagaggggagaagtggaggaaaaggggagacacgccccagaggagttggaacgcaggagggaaaggggaccatacccggtagcccgagggaaaaacgaggcgagaggggagaaggcgaccccgcgctgctacccgcggaagatttatggcgcctcccgggttccaaggacaggctgcgttcgtcgctgctgccaccgccggtagtcgccgtgg

SEQ ID NO: 77842 - DNA, 192 bp, Homo sapiens
  chr15:68114819-68115011
  hyper
aaagaatggtgaagacggagagaccgactgagacaggaaagggatggagagaaacggagctttgaggagagagaggaggtacccaggggcgtctgtagcatcagaggactggacctcccccttggggaaactggcttagcagcgttgagagcgtagttaacctcagatcactcccaacgatgacttggctcc

SEQ ID NO: 77843 - DNA, 1371 bp, Homo sapiens
  chr15:68115216-68116587
  hyper
cccaggtccctgtcccggtctctggtgaccctactggttcccgagggccactctaggctccaccaccctggccctcgcctgcggccggaaagtgaagtactcctccctgcgcccgttcctcttgagtcccccttagccccatcacccggttttggcccagaccaaaactggctccttggccgggagcactgggccctccccacttcgttcttggggacaaactttatggccccagggcctttcctccctcctggcctctccagctagagcgggacgcaggtgcagggtgctggacgcaggtgtgcggccgcttacctggggcgtgcaggccttgggctgcggggaggcggcgggcgccgcgcgtggcccgcgggcgggcggacccggggagggcgctagcgactgcgcgggcggtgggtgtggcgccccggctctcagctgtcaggcgcgcctgccccgccactcgggctgtgaccgcgccgtccccgccgccgcgccatgcgctccaggcttcggcctcttcttccggccagtccccggcctcggggtcaacggctcagggttcgcatctccgcgcccggggtcccggcgccccgtgcccgctgagagcgggaggggccgcgggtgggagcgcggagaaccagggagcacggctgtgcgcgcgcgcggggaggggccgcgccgtcacccggagagcccggcggatcccggactcccgcccgccgctcctcccgccgcgcacctccgctcaccgctcgcccggctccagccgccgccgcactgtgagtacccacgtccggtagcccgccgcccccgcgctctgctcctgcagcttttttttcgtttagttctgatttgggctcctgtggctgttgtttttatgattatacctaaagacaccaccgcctcgctcccaccactgccagtctcccgcttcgctgccctccccaagctcgtccatctagctccgggagccgacgggggttcctcaagctgctctggctgctgctccttgtcgctgcatatggctcttcgcctgtgctttccgctttggcccccgaaattccgttcctttcctagggacccccttcttctgactccgggcccggacccccctcctctcactcagggaaaaccgcgcagggacccaggaccctcaactggggtacgctctcggctcgggcgctgtcttcactgtatgcgggccaggcatagttgccgatttcgagaaaccgagaagctgtcatttcccagcgctgcgcgccctccagccacctccaggagggcgcgaggcttgtcagccggggagttaggacagtgtttttgcctcctacaatgatataaaggacttcaacgcgaaataagggtcaa

SEQ ID NO: 77844 - DNA, 30 bp, Homo sapiens
  chr15:68116962-68116992
  hyper
tgtggctgggtcaggcgacctagagggccc

SEQ ID NO: 77845 - DNA, 1481 bp, Homo sapiens
  chr15:68117203-68118684
  hyper
ggaagcccagagccccgaatcctgcagttggcccgagtgggaaacgtatatctgaaggaggaaagctcaaggagtgggcgactggaagctaagaagtggatcccaacaaagttccttgagaacctctctgtcccacacgttgacctcggtggaaaccagctttggtctggaatacagctaaaaatgcagaaaatgtggttagaactgcaggatcctggtctcactaatagctggaaagaaaacggtttatatatccagccgaaatctttctgctcaacgaacgcgggcgccagccgtgagaggagaagctcgggtttgtggaaactggcaatgttgtcccctgaagccggctcgggcaccaagctgggtgcggtgggggccgcgctaggtccgggtgcgcaccgagcgctttggagagggtcaggttcagcaccgcgaacagcggtagcctccgcctctctccttccctggcagacacggttccctcctccttctcctcacccccctccttctcttcacccccctctaccccctgctgtctggagatgggcagtgaccgcccctcccccctccccacccctccttgcactgcccccgcccgcccgcgtgcatgcgcgactgagcagaggggcggccgatccccgaagtccgggcttcaggacccgggccggcagcaccggctgcgagggttgccgaaggcgcacggatctgggcgctgaaaaagccaggatttggcaatggctttgctgtgtggccttgggcaagtcactctgcgtatctgggtttcacttccttcccaatccgaaaacgggattgggttccttgcagcccgggcattcctgaggtctcctttaccccttctcctcccccaagccccgggggctgttgttaacggcgccaacatgggtctgagtaacaaaagacgcctgtccagggggtgaatgagtttggactccccactgccaagtatcccccgcgcgcccaactcggagcgccctgctgggcgggcccgagcctcggcggcggcgctgaaaatggctcatctgctctctgctttctctatttcgcaggagcggcggcatggaggctctcaccactcagctggggccggggcgcgagggcagttcctcgcccaactccaagcaggagctgcagccgtactcgggctccagcgctctcaaacccaaccaggtgggcgagacgtcgctgtacggggtgcccattgtgtcgctggtcatcgacggccaggagcgcctatgcctggcgcagatctccaacaccctcctcaagaactacagctataatgagatccacaaccgccgcgtggccctgggcatcacgtgcgtgcagtgcacgccggtacagctggagattctgcgtcgggccggggccatgcccatctcgtcgcgccgctgcggcatgatcactaagcgagaggccgaacgcctgtgcaagtcgttcctgggcgagcacaaaccacc

SEQ ID NO: 77846 - DNA, 246 bp, Homo sapiens
  chr15:68118929-68119175
  hyper
cggccacagacgaactgagccatgcttgggaggacgtcaaggccatgtttaatggcggcacgcgcaagcggaccttctccctacaaggaggcggcggaggcggtgccaatggcgggtcgggtgggcaggggaagggtggtgctggcggcggtggcggcggtggcccagggtgcggtgcagagatggccccaggcccgccgccccacaaaagcctgcgctgtggcgaagatgaggctgccgggcctc

SEQ ID NO: 77847 - DNA, 775 bp, Homo sapiens; identical to SEQ ID NO: 35774
  chr15:68119578-68120353
  hyper

SEQ ID NO: 77848 - DNA, 329 bp, Homo sapiens
  chr15:68120630-68120959
  hyper
cgcgctgcgaaactgggcccacccgcaccctccagtgagggtttcgaagggaagggaagctgggggcggcgggaggactggggaacttgtgtgctttgtttttgttgatgggaatggggaggagaccggctgagactgccagacacagagacagaaaaggggtgtggagaaagaaagaggaggtaagaaaggaacccagagccagagaaaagcgctcgcccgggtgggcatcagagccccaaggaagaggagaagagaggacagtgtggcctctccctgagtcgggccccagcagtaccgggtccccggaatctcccaccaccccaact

SEQ ID NO: 77849 - DNA, 809 bp, Homo sapiens; identical to SEQ ID NO: 1217
  chr15:68121149-68121958
  hyper

SEQ ID NO: 77850 - DNA, 261 bp, Homo sapiens
  chr15:68122469-68122730
  hyper
ggcagtatccgggtcacggtttctttgcctctcttgaaattcggtttgttgccttcaagagccagataaggaagacaatcactcgcccgccgatgatttggaaacgaggaaatcctatccagaccaaaggagtatctcccagccaagtcctgcaaatacagacagaggtgagccagcccttgaacccatcgctctccaccgcacccaggagctgggacccaggtcgcccaggttcccagaggcttgcgagaaaggctttta

SEQ ID NO: 77851 - DNA, 1021 bp, Homo sapiens
  chr15:68125223-68126244
  hyper
gattgaacttcttatcgcggcaatttccatggtttctaaattaaaaatcgaggcgtaaaattacctgggaagtaatgcctaagtttgctttaattttggttagatccatctgcctttaagcgccatcccaggccatttccttcctccgccagtctgcagttaggagctccggtaccccctcccccatccctggagttgtttctgcgcggagcttagccctggggagaggaggaagcccgggctgtgaccccggcctttcggagggtggtctgcgtttcctcactggcccctccccttgtcttccagataccctgtgtaacgaactcgaccaggagcggaaggcgcgctatgccatccagcagaaattgaaaggtgcggaagccgggaaacaaagataggaggggtgctgggtgccggccgtgctgtcgactgaatgaatgaatagtgggactagtgaggaaggccacgatccacgtggatcaggatctgtgagggagaaaagtgggaactgattttaacgggaagattattctaggatggtgggggtaaaaagaaagagccccttgggctttggacgtcagaaaaatctgccttctattaccaattctggctttgagcaggttgactcctctcttactgtgcctcagtttccttttctgtaaaatggggctactgaaccagagcagtggttctgaatcaccagcttttgtcctaccctcctgcctcctcctgatccgctcggttgagattccctgaccccaaagggttggtaaggccggggaggggaaagggtggactgcgcggtgaggtgagcctggagaggcgcccagagtgaccctcgcgactgtctccccagaagcccacgacgccctgcaccatttctcctgcaagatgctgacgccccgccactgcactggcaactgctccttcaagccaccgctgttgccctagggccggcctggccgcacccctgcgccctcaagccatgctgctccttgtaaatacccgctgctgcggtggc

SEQ ID NO: 77852 - DNA, 100 bp, Homo sapiens
  chr15:68126468-68126568
  hyper
ggcgggaggggagagcgccccctcccattgtatagccttgaacccgattgtgaatacaatgtagcaacttcgctggcgcctgccccgcactccccgtccc

SEQ ID NO: 77853 - DNA, 224 bp, Homo sapiens
  chr15:68126905-68127129
  hyper
tcacttctggggctacggaggtgggagtgcaccggcggagcggggcggcggaacaccgtgcaacaggtgggggtgggagccgccccgcgggttctggggctcccagggtcagaatcgggcctgctcaagtgggcagcagcgagcactcaacctctccactgtgccctccagacacactcagttttcccccacagggcactccctctccgcgtttaggaccctcc

SEQ ID NO: 77854 - DNA, 1010 bp, Homo sapiens
  chr15:68127492-68128502
  hyper
ggagggagccccgtccgcattttctgttcggtccattttagttcgagaggggctaaggactcgccgggcctcggctggggcgtccgacgtccgggtcacggttggcaaggcctcccagcggcctcagtttccacagcgcacctcctgcttgggctacagacgacgctgcaaattgcagaacactctttgcagggaggagagtgtggatggagtgggagagagctcacggcacagggaatcattcagccttggctttcatttctcgccctcggctggctagtgggggtcccgggttgagcccttcttttatctttcctgggtctccgtttcggcctctatgaaataacacgcaggcctccgtccatgcggctcgtagaaggcgggcggcaggccccgcgccaccggccagcagctcgggaccgggagccctgggctgagggggccgggaagtttcgtggcgggttgtcttggtgggccttggacggagccggctagtaggggcgtgctctgggcctccccgaagctgtgcagacgaggagtcccgctgcgcggtacagccaggaagccagtccctagagtcctttgcgctgggggtcggagccttggagtcccaggatgttccgacggctaagaccagagcggacacaaaggagataacaatgaagagggcgccggcaaatggcgaagcatcgcctccggacaggccatctccgggcagggcccctctagggagcgggaacgtttcatatgcatgggacccaccagatccgctttccgctggaccggtggcgaaactgaggtccagagaggaagagactggagtctccaggccgcgccagggcccgcggaactgcgacggggcgggacagcgcgggtgtgggagtttgccggcccctttccccaccgcggattgcacctttggaagctgcacttttcttctctgtaaaatgggcatcaccattaccacccaggcaggaagttccgtggctgcggctcgacagaggagccag

SEQ ID NO: 77855 - DNA, 250 bp, Homo sapiens
  chr15:68260400-68260650
  hyper
ccaaagctctgcatacgttgccctggcaaggtcagaccctttggctgcaacacgtccgtcaagaagccaggcaaatctagcatgcaaactaggatcattttcgggcgttggggcccccccgcttgaaatctggtttccatgttcacaaaacgcagcccgactggtggaactcgcgactccagacgcagagaagctgtgggcagaggcggaggcagagggtgggaatgcagcctggcgttggagtggggag

SEQ ID NO: 77856 - DNA, 241 bp, Homo sapiens
  chr15:68549380-68549621
  hyper
ctgcctggtgccatgcggttgggccgcgggcccaagggaaagagagacacctggcctgacttctgcaggcctctccccgccagcgagcgcacggcagcggtgcccaggggctggaggcagcggaacgcacgcgcccggcgtcgctgagggcttgcgccagccccagagtacccgcgtgcccgagggagcgcgcccgcctctggctccgagcttgggggaggggcggcgtgagggagggagg

SEQ ID NO: 77857 - DNA, 65 bp, Homo sapiens; identical to SEQ ID NO: 35785
  chr15:68569420-68569485
  hyper

SEQ ID NO: 77858 - DNA, 80 bp, Homo sapiens
  chr15:68569712-68569792
  hyper
agccctcccacatttcgggaactcagaaacgccgcccttttcctgaaatggaccctccgagtacgcgcaaccccttccct

SEQ ID NO: 77859 - DNA, 30 bp, Homo sapiens
  chr15:68631675-68631705
  hypo
gagaggaaatgcccccggggatgctcttca

SEQ ID NO: 77860 - DNA, 810 bp, Homo sapiens
  chr15:68723523-68724333
  hyper
tcagggctggcttcccgctcccagccgcgcgcccctcgggccggaggttcctgccgcgccccgacacctggagtgcattaggcggcggcgcgcgtctaggcgacggcggctttccccagattattgaataattgcataattccgagcgcgggttgggaggcaatgccgggtccctaccccgggtgtcaggtaacgtttcgggggtcctgcgctgcgcgactgtgtcccgccgctgctggccgggcagacgagagctagcccccgcctaccggccatcgccccggggctttgctctgtctttggccggaggcactctgcgcagccctcacccccacccttcagccctccggggccgccgcgcccggctctccaaactttgagatgcttccccggagccaggcaggagggcagccagggcacactctcttggcgctgattcccttccccagccggggccgtgcgccctcggcgctcccgggacacccgagtgcccctggcagccgtgcgggaaccccggcatgggccttggaggcacctaaggcgcccaggagggccaccagatctgggagcttttcaactcaagcctcttcaactcttcccaaacacaccaaagagtcccggctttcaatagccttcgcacctccctctttagcgaaacttgactgaaccgctagactggggccagtccctgggggacccacgtccccaagagcagctgaggtctgaccctgggaggagggtcgcgtcccgatcctggccgctggatccaagccccgagggcccagggagggactccgagaggcaagggga

SEQ ID NO: 77861 - DNA, 49 bp, Homo sapiens
  chr15:68851848-68851897
  hyper
gtggtgagggggtagcggggagggcgaagttgaccgtgccaagccggcc

SEQ ID NO: 77862 - DNA, 53 bp, Homo sapiens
  chr15:68870354-68870407
  hyper
cccctccaccctctccgcggttctgtatctgcggaaaccggttctgctcaggt

SEQ ID NO: 77863 - DNA, 265 bp, Homo sapiens; identical to SEQ ID NO: 35787
  chr15:68870820-68871085
  hyper

SEQ ID NO: 77864 - DNA, 134 bp, Homo sapiens
  chr15:68871386-68871520
  hyper
cggggctgacatcagcgacgagcggcgggcgagcgccgacgagcggtccctgcgcgctgcccgcccggagcgcagcccccaggctcggccgagccgccggcggggcgcggggagcgagccgggagctgccggac

SEQ ID NO: 77865 - DNA, 87 bp, Homo sapiens
  chr15:68871739-68871826
  hyper
cgcctctcttgctgccggatccgctcgagtcactccggcccccaaggactgcggaggccagggggaggatgccgctctggcagcccc

SEQ ID NO: 77866 - DNA, 30 bp, Homo sapiens
  chr15:69109310-69109340
  hyper
ctggaaaacatcatgcgatgtattccaaag

SEQ ID NO: 77867 - DNA, 198 bp, Homo sapiens
  chr15:69136224-69136422
  hyper
acatacacacacacacgtgtgtgtgtttcggggctgctcaggaggacaggcggctctgcgctgcggctgtggtgggctccgtgcacaccgcgctaggctcatagggcggctggcaggtccagagagcggcgtgggagcagctgctgccacggtggcagcggagatgaaggtgtcagcctgacgcgggcggctcctgag

SEQ ID NO: 77868 - DNA, 30 bp, Homo sapiens
  chr15:69265691-69265721
  hypo
agtaccctggacctgcgacagaatccttgc

SEQ ID NO: 77869 - DNA, 17 bp, Homo sapiens
  chr15:69324757-69324774
  hypo
tttttttttctgagacg

SEQ ID NO: 77870 - DNA, 192 bp, Homo sapiens
  chr15:69366538-69366730
  hyper
tctcgctgcccggggcgctctgcgctgcgcgcccagtggggacagcacgccgccccgggagtctccaggcgcgggaggtcccagcagattttgcataaagggaggaatcgagtccagagaacaaacaagatactggaggtggtggcacggagaggattgattcggtttgcaaccctacgaggtcgtggccgc

SEQ ID NO: 77871 - DNA, 36 bp, Homo sapiens
  chr15:69367021-69367057
  hyper
aaagagaaaggagggcgttttcgccaccctcttgct

SEQ ID NO: 77872 - DNA, 152 bp, Homo sapiens
  chr15:69591361-69591513
  hyper
tgtccactggactcccgagacccttggaacccaggtaacccggggcgggactccccgccgcgcgccgcctccccacctcccggtccacgcgcacccgccctccgcggcagccccagccgccctgcgcccgtggagcccgttgagcctgggtg

SEQ ID NO: 77873 - DNA, 93 bp, Homo sapiens
  chr15:69754330-69754423
  hypo
tttactttcacagcacgcaccttccaggctcctccgcacaggtacaggtttgaggcgggaaccagatgaggacgaaggcggagatgctgttgg

SEQ ID NO: 77874 - DNA, 30 bp, Homo sapiens; identical to SEQ ID NO: 15908
  chr15:70075720-70075750
  hypo

SEQ ID NO: 77875 - DNA, 38 bp, Homo sapiens
  chr15:70347537-70347575
  hypo
ctgccgggcgtgcctcgggatgccggggcctgccaggg

SEQ ID NO: 77876 - DNA, 120 bp, Homo sapiens
  chr15:70617030-70617150
  hypo
gaagatcccactctccggctccagggatgagcatgtgcctcaggcctggtccatcggggccttgcatcccgcccgtggccttggtgattggttcagagatgggaacgagatcacatctgg

SEQ ID NO: 77877 - DNA, 30 bp, Homo sapiens
  chr15:70708037-70708067
  hypo
tatgtcttgaagccccggtttctcccagca

SEQ ID NO: 77878 - DNA, 217 bp, Homo sapiens
  chr15:70877477-70877694
  hyper
gcaaagacagagcagcgggacccgggcgaatccgcgcccgtccctgcccaggctgcccgggttccgccgctgggcgaccccagcatttcctttgaagtctgaagctctcttatccccgggcccctgcctcccggtaccgccgatgcgcagcgattgccaggcaggtctccgccgggctgggagagccgccgccgaccctgtgcgggcccctcccctt

SEQ ID NO: 77879 - DNA, 46 bp, Homo sapiens
  chr15:71054883-71054929
  hyper
caactaaagaggccccgactactccttggcgcgcacactgaggccg

SEQ ID NO: 77880 - DNA, 43 bp, Homo sapiens; identical to SEQ ID NO: 35791
  chr15:71055227-71055270
  hyper

SEQ ID NO: 77881 - DNA, 123 bp, Homo sapiens
  chr15:71055857-71055980
  hyper
cctgcctgccacctgcgggccccgggcagcagacgtcgacaggcctgaggcggggctcccctcccgtagccaattgacccgctgccctggcgggggcgtggcaaaccgcgaccaatcggaatg

SEQ ID NO: 77882 - DNA, 18 bp, Homo sapiens
  chr15:71117912-71117930
  hypo
tttttttttttgagacgg

SEQ ID NO: 77883 - DNA, 219 bp, Homo sapiens
  chr15:71145980-71146199
  hyper
aggcccctcagatcccggccgccagccctgggagcctcggttgggcgacgaagctgcgggctggggcaccggctgcctccacgggccggttctgactcaggggctcggcccggagctgcttccccggcggcggggctgactcaaccccctctgcccgaggagttgtcgcgcgcagtcagcgccccgaactcgcgcgcggcccggcgccccctcggggcc

SEQ ID NO: 77884 - DNA, 328 bp, Homo sapiens
  chr15:71146426-71146754
  hyper
tggctcgcgggactgcggcgccgccggggtcctcacgccgcaaggcccagccagccggtcggcagcgactgcgacgagggggcgggggcggtgcgagcgcgcctgccgctcggcccaggggagggacaggggtcgcggcgccccgccccgcgccgccgccgccgccgccgccgccgccaccaccccgaccgctagtggagcgcccgcgcaggcggggcctcggaggtggagggcggctttccggagctcctccgacggaggcccgtcccggaaggatccccgcgacccccgatcactccctccgtcttttcgccgctgtggggcccca

SEQ ID NO: 77885 - DNA, 30 bp, Homo sapiens
  chr15:71184469-71184499
  hyper
tgcctccgtaccagtcggcgcggcaacccc

SEQ ID NO: 77886 - DNA, 30 bp, Homo sapiens
  chr15:71185265-71185295
  hyper
ccgggctgcgaacaacgtaagttgggcctt

SEQ ID NO: 77887 - DNA, 442 bp, Homo sapiens
  chr15:71408156-71408598
  hyper
cccagtgggtgtgtccggggcgccgcgggctgcgccgctccgggctcggggagccagcgcgcgcctggtccgtgcggacggctgcgcctccttctctggttctcttccttgctgggagtcttgctctgtgctggcgccggcgctcatccctccaccctcgactctagggacagtcttaaactctagggacaatccacctcagtcgtccccgggtcggggccccgtgctccccgggtcgggtcggaggggaccggcgagtgcacacccagcccgtgcgccccccacctcagcctcgcctccctcccgcctggggcccgagagccgggcaagtctcggtcagcgctccttgagtcctggcctggggcctcggatctgtgtgtctgtctgtctcagtttagttgctgcaacccagcgagcgcctggagcccgagtggatgggttg

SEQ ID NO: 77888 - DNA, 30 bp, Homo sapiens
  chr15:72040931-72040961
  hypo
gggtgagtgtgatggcgggcagagcgccgg

SEQ ID NO: 77889 - DNA, 225 bp, Homo sapiens
  chr15:72102723-72102948
  hypo
agggcaggagggccccgggggaccttgggcagcccgggaaccagcatggggtagcaggactgaccggctcccggggcaccttggtaatgctgcaggtgtggccagttgatcccctgtggagacagtaaagattaagaggatcataaactgcgtccagcggctgccccgggagaaatctcctcaagccagagcctgtgctgtgaggggcttcgggaccttggggca

SEQ ID NO: 77890 - DNA, 17 bp, Homo sapiens
  chr15:72411795-72411812
  hypo
tggaggtcatttagccg

SEQ ID NO: 77891 - DNA, 197 bp, Homo sapiens; identical to SEQ ID NO: 44301
  chr15:72412112-72412309
  hypo

SEQ ID NO: 77892 - DNA, 30 bp, Homo sapiens; identical to SEQ ID NO: 44302
  chr15:72462639-72462669
  hypo

SEQ ID NO: 77893 - DNA, 249 bp, Homo sapiens
  chr15:72476661-72476910
  hyper
tcagtggctccaaagcggcgcccgcggcggcactgatcccgcccggctggccccagctgaccctttgcaggaggctggtggtcacagccagagcttgcgcaggccggggagctgccaggagtgccgcagccgtgcccccacctgctgggctcccgggaaaaggagcgcgcgcccctctgagccccttcctggtgcagtgcgtgtaccaagcgtggtaactggcctggctgaggacgcccgcgtggggac

SEQ ID NO: 77894 - DNA, 147 bp, Homo sapiens
  chr15:72490031-72490178
  hyper
cggaacccccgagaccggcccccgggccgcaaccccttacccgccctcctcggtggcctcgctccggcttaaagcggtcatcccggcgcctgcacccagcgccccgaccgcgcgccgggacccagcgcccgccggaccccgcccgcc

SEQ ID NO: 77895 - DNA, 766 bp, Homo sapiens
  chr15:72564641-72565407
  hyper
gggcccgatctatgccgcccggccgccgggcctgagtgaagcctgtccagcctaggaggggccctcagaacctcccggtccaagcctctcacttcgtccacccctgcggagacggggcgagccccgcacccttcccgtggcccggccgcaccgccctgtgcccgtggtggcggccacacaggccagcctggcgagtactcacggcgaccccgggccgcgcgcggccgcagccgacgggacgagcggcccgggacgccccgcgggggcggagcggcaggccaaggggcgggggccgggcctggcgggcgaggtcgcgcaccccacgcctcgtcgttccgtcacgggcgcgctcagccactctgcgcacgctcgcgcggtgacacgatggcacgtggcccgctcctgaccaacagcctgacggcctgctcctgggcgcgcctcagcagccgacgccagccttgagacgcctgcgcggcggtcgctagtcgggaaagggtgcggagtggggggtggcgcctgcgccgtgggtaggggaggcagtggagaaggaagagggactctgggggagtgcggggagccttccaaaggagaatacttgcatttagcgccccgagtggttgggaggaacaagcaggaagggcaacccaggttgcctgtaggccgggagggagtcccctcgccggaggttggggccggcaggtagagactgagggaagtcctgaggccttgctgactgcaggattctctggttcgacaatggaagtcg

SEQ ID NO: 77896 - DNA, 399 bp, Homo sapiens
  chr15:72581446-72581845
  hypo
tcggggggatttgggcggagcggggggcccacctggataaggggagagcccgttattgtagagcgtgtcggagcccggctggccattggtctggggggtcagagggccgaatccattgaccccgatgggcgccggaagacctgggagggtgccagggccgctgccaggcggggagttggctgctgatggcggaaaaggtctgagagtcaggccgccaccccgccccgcccggcccctcccaggcgcgccccagtccctgggggccgtacctgccgcgggcaacagaggcgcagctaccaggctaaaggccgccacgtgttgcatctgggccgccactgccgccaccgggcctaggcctgggccctgtgccgccgccagcagggccgcctggtgctgcag

SEQ ID NO: 77897 - DNA, 125 bp, Homo sapiens
  chr15:72743646-72743771
  hypo
gatatctgctgagggcgactccaaggcagcggagctgaccgccacctcactggccactgtggggacttgcctgatggagccatgccagccagaagccactggggataccacgtgccagctcttat

SEQ ID NO: 77898 - DNA, 29 bp, Homo sapiens
  chr15:72768983-72769012
  hypo
tcagccaccgtgcccggcctgtagaagat

SEQ ID NO: 77899 - DNA, 177 bp, Homo sapiens
  chr15:73611026-73611203
  hyper
actagctgtccttcccgcatcagggaacagaggagacagtgactgaggaccccgcagcgaatgccccacccacacaggcttcctctcagcggggcctgtccccactgcttccccacagccccagaggccaggcctcagccattcagacgcgggggaggtgatcgcagcacagggccg

SEQ ID NO: 77900 - DNA, 92 bp, Homo sapiens
  chr15:73615572-73615664
  hypo
agtcccaggcctccccgggccccgggtggcgcgggagatggctgggcagcctgcggggagcgggcgcctggctgcagcggggtgagcagggg

SEQ ID NO: 77901 - DNA, 121 bp, Homo sapiens
  chr15:73617637-73617758
  hypo
cctcccgcaggggctcgcttagctcgcccaggatgctctcctcgtcgaacatcttgccctggtagcggtgctcgtagtagtcgtggatgcgctgccgggtgtcgggcgggagcttgtgaaa

SEQ ID NO: 77902 - DNA, 30 bp, Homo sapiens
  chr15:73639194-73639224
  hyper
gcttgcacaggtctccgaaagccaggccct

SEQ ID NO: 77903 - DNA, 727 bp, Homo sapiens; identical to SEQ ID NO: 12210
  chr15:73659600-73660327
  hyper

SEQ ID NO: 77904 - DNA, 278 bp, Homo sapiens; identical to SEQ ID NO: 35801
  chr15:73660446-73660724
  hyper

SEQ ID NO: 77905 - DNA, 132 bp, Homo sapiens; identical to SEQ ID NO: 35802
  chr15:73660793-73660925
  hyper

SEQ ID NO: 77906 - DNA, 292 bp, Homo sapiens
  chr15:73661569-73661861
  hyper
accaagctctgggctcgcctttccctggcatttttgcccctcagctgggtctccgactttcctcttgggaggcgaccgggttcgtctggatgcagagtcccggccttcccgcaaccctcctggagagggggcttccggaaatgcgccgcgtcggggaggctcccacggttttcctgtgacatgggcagggtgcgaaccccgcgccagtctttcccctgcaaagcctcgcagcagccaggcaaggagggcgtggggaaacagggagacacgcacagggcgcgcgggtgggacc

SEQ ID NO: 77907 - DNA, 30 bp, Homo sapiens; identical to SEQ ID NO: 44306
  chr15:73919229-73919259
  hypo

SEQ ID NO: 77908 - DNA, 337 bp, Homo sapiens
  chr15:74044686-74045023
  hyper
ggggtcgggaatgagcgagggtccggcagatttggggctccgaggccacaggtgaccggggcgcggggaggccgaggagacgccgggcaggtcccagcgcgtgagccaaagtcggagggctgggagggcgccgggatcccctcagcccacgcccggcattccccgggctctgcaccgtccgggattcgctctgtccagtccagatcggccgggtccgtgttccgctggggtctgccctgccctaccccgcccggagtgagctggcaccgccgggcgcccgggacgcgctcagcccggacccagaacgtccgtgccccggcacccgcggcgtccggag

SEQ ID NO: 77909 - DNA, 169 bp, Homo sapiens
  chr15:74045074-74045243
  hyper
cgctcccacggctcagttcacgttccgaaaggtccggaatccaccgggtccccgaggaggggcgatgtcagccgcggggacccggtccccgccgggcccagccgagagcgcgcgaagccgggggccccggccgggctgggttcggcggcccgggcgcaggcgggagcag

SEQ ID NO: 77910 - DNA, 243 bp, Homo sapiens
  chr15:74045655-74045898
  hyper
tggctccgcttgcctcggcgctgtcagggaaggggccggcccgccgcgccgggagggagcttttaaagcgacacacacgcctcccaaccccgagggccaagcgtgcgagccaggggggtctcgccacccgggcgagggggaagggtctcgctggcggggctggaggcggactgaccggaccccacgccggctgacctggggcgcggagggacagcgttctggggacttcgttcctttcccacc

SEQ ID NO: 77911 - DNA, 137 bp, Homo sapiens
  chr15:74219483-74219620
  hyper
ctttggccaggtgcccgacaactggcgcgaggtggccgtcggggacagcacgggcatggcccgggcccgcacctccgtctcccagcaacggcacgggggctccgcctcctcggtctcggcttcggccttcgccagca

SEQ ID NO: 77912 - DNA, 38 bp, Homo sapiens
  chr15:74264561-74264599
  hypo
caggcgtgagccaccacgcccagcggacaatgctttct

SEQ ID NO: 77913 - DNA, 143 bp, Homo sapiens
  chr15:74392457-74392600
  hyper
cagacaacctcaacccgtttccggagccactggcgccccctcattcccgctccagcagcccatgcccgcttcacccctggtgcctcatacatcgcgcgaggaagccagggcccgggaatttctttttccggtcccgccaggtc

SEQ ID NO: 77914 - DNA, 293 bp, Homo sapiens
  chr15:74420441-74420734
  hyper
aactgtcattattaacgttataaacattagacccgcttctgcgcgccggacggcgccggacgaggtgcgcgcagtcttctagctgagctcggaggcagatccagaagtcgcggctcccaccccaggcctcggcggactctgcctggggcgactcgggctccagccctgcccgggcgggcactgggctctccagggtcgaaggcaggggtaaggggcgtctttcccccagggcagcctccgggaacaaaagcatttgctgtagagtgagctagagcctccgggcccgcgggagt

SEQ ID NO: 77915 - DNA, 940 bp, Homo sapiens
  chr15:74421979-74422919
  hyper
cgtcgctgaaagaaatgtcggggtttcatcagagctagggagcgacagtcgggaacagcgagtctgccgaagccggctgttgtgtgagggtgtgagacggcggggcggtgaggggccaccgcggcttgggggatagtgcgtgtggggttgaccgtgtgtctgcttgagaggctgtgaagatatggggggcagatatgggagaaatgctcgggcctgaagtccccagcccaccgtgctcaagagtagcggacgttttgccaccatccttgtctgtgctactgtctgctgcagcttccgtgccccgttctcctggagcaggcaagacctggagtgaggtgcttgggtgcgctcgagagagcttccccctgctccacctgtcccgcggtgcgcgcaggccaacgcgtcgggcagtgggcttcaagcgctggtttagccacaaaagaccagaagtaaagagttccggcttaagaggctgggcagggctgcggtgggctggggaggggggtgtcccttcccagcacgccctgcagggctgtgcgttctggtgtcgggttagactagcaggcggggcgggggggttggggcggcggggcgggggagactagggcttatatcagcccagatccaggcaaaaatggtagggagggtgcggcgctctgctaacactatcaattatgcatcatgttgaacgtggcttcggggaggaggcggctagcagcggggggtgcgggagggaagggtccgcgcgagctcggctgcgcgcagctcagcgggtcccgctcgaagtctgtcggtgccaccgcctgcatttgcaaaaagagtttaaaggcaaagacacgccttccccccccacttcagccgcgcgcctttccttcccccaaattcctcaaagatggtttgtctcacgtgttgcagggcgtaaaagcggcttgcattcaat

SEQ ID NO: 77916 - DNA, 86 bp, Homo sapiens
  chr15:74428149-74428235
  hyper
ccctttcaatccctactcccagaagccgggattcgtggcaacccctagtttttagttccaaagcctcctgccggcagggaaccaaa

SEQ ID NO: 77917 - DNA, 386 bp, Homo sapiens
  chr15:74428737-74429123
  hyper
gagcccctccgtcctcgcgtctcggtcctcgcgtcgccccgccccacccgcccctgcttcggcgggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtc

SEQ ID NO: 77918 - DNA, 307 bp, Homo sapiens
  chr15:74658090-74658397
  hyper
gtgagctcgggtgaacgcagcgagcgagggcagaggccagcagaggcgaggagtggatgctgcagggccgcaggccgggcagagaaacgcataccgggtcgctccctgcttcgccgccgcctcctggcagggccagcgaagccagtgctccagcgcccccgtaacacctcaaagcgcacggagtccgtgttggggaacttggcggcagagtgactgggacctaggacctgcggtggggccgccgccgcctccgcggggccgagcgcctggacctcgccctgaggtaaacgcgggtcgacccgggggg

SEQ ID NO: 77919 - DNA, 52 bp, Homo sapiens; identical to SEQ ID NO: 4248
  chr15:74658501-74658553
  hyper

SEQ ID NO: 77920 - DNA, 41 bp, Homo sapiens
  chr15:74658554-74658595
  hyper
ccaaacttgaccacgctgcgaccttttcactctgtgctctg

SEQ ID NO: 77921 - DNA, 157 bp, Homo sapiens
  chr15:74679719-74679876
  hypo
gagggctgggagcctcggggaagcggtggcttttcagctgagagagcgagaaacattggctgaagtggagttggtgccccactttccaggagggctgcccactgcccgcagggcccccggtcagggcgggagggctcggcaccgagaggtccaccga

SEQ ID NO: 77922 - DNA, 30 bp, Homo sapiens
  chr15:74686156-74686186
  hypo
tactttagctttccacggttctaacagatt

SEQ ID NO: 77923 - DNA, 104 bp, Homo sapiens
  chr15:74790274-74790378
  hypo
gcctacagaggagagcgagtacttatctttttagtactttttattctggtgagcctctcaccagcaaattctttctttttttttttgagtcagagtcttgctct

SEQ ID NO: 77924 - DNA, 17 bp, Homo sapiens
  chr15:74818772-74818789
  hypo
taataactcctttgccg

SEQ ID NO: 77925 - DNA, 46 bp, Homo sapiens
  chr15:74903896-74903942
  hypo
aggtccttctctgcccgcctccagtcccgctcgggggccctgttgg

SEQ ID NO: 77926 - DNA, 30 bp, Homo sapiens
  chr15:74911209-74911239
  hypo
tgtggtagtgttcaccgtccccacccaggg

SEQ ID NO: 77927 - DNA, 188 bp, Homo sapiens
  chr15:74911445-74911633
  hypo
ctcttcaggagcaaccgggaagccccagcagccccatggctggaggtggctggctgtgtgtttagcagggctctctgttcctcgtggcctagatgcatcactgtaagcgataccgctcccctgaaccagacccgtacctgagctaccgatggaagaggaggaggtcctacagtcgggaacatgaaggg

SEQ ID NO: 77928 - DNA, 30 bp, Homo sapiens
  chr15:74953756-74953786
  hypo
ataaagttttattggcgcacagtcatggtc

SEQ ID NO: 77929 - DNA, 35 bp, Homo sapiens
  chr15:75018960-75018995
  hyper
agggccagcctcgcgcgcggcgtggggttggggtg

SEQ ID NO: 77930 - DNA, 214 bp, Homo sapiens
  chr15:75118706-75118920
  hyper
cctctcccgggagagcgaccccaccaccgcaggccctaatcctctgtcagcagtgcccagcggagctcggcgttgaaggaggcacgtgggggaggcgggagtggggagcgggcacgtggtccagccttctcagccccgtgctgccccccgcccccagtgaggaggggtttggggaggtgggggcgggcccgggcgggggcgggcggcgggcggt

SEQ ID NO: 77931 - DNA, 171 bp, Homo sapiens
  chr15:75119374-75119545
  hyper
tgacacccaaaaccccgctccagcatcatgctccggccaagggggagtggggggaggggcgaccggacgagggaccgaccggagcctgggacgaggaagggggtgcacgtgcgtttctgacgaaacgataatcccttaatccgatctggtcccagccgcctatgtcttcca

SEQ ID NO: 77932 - DNA, 30 bp, Homo sapiens
  chr15:75134683-75134713
  hypo
gaggaggttctccaccgatgccttgttcag

SEQ ID NO: 77933 - DNA, 101 bp, Homo sapiens; identical to SEQ ID NO: 44311
  chr15:75143124-75143225
  hypo

SEQ ID NO: 77934 - DNA, 87 bp, Homo sapiens
  chr15:75205464-75205551
  hypo
gccgtctcaaacaaaacaaacaaaaaaaagttacccagcctcaggtatccctttacagcaacacactaaacccgtttaagacaaagg

SEQ ID NO: 77935 - DNA, 21 bp, Homo sapiens
  chr15:75248822-75248843
  hyper
gcccggcgccaggtctgcgaa

SEQ ID NO: 77936 - DNA, 30 bp, Homo sapiens; identical to SEQ ID NO: 35815
  chr15:75250808-75250838
  hyper

SEQ ID NO: 77937 - DNA, 369 bp, Homo sapiens
  chr15:75251045-75251414
  hyper
tcctgggagtggctgcggcgactggaccttggcaccgcaatgtgtgaatggctgaccccctccccgtctcctggtgggatcaggaaccctcggggtatgctccgaaccgggacttcggtctcggtccagtctccatgggccccacacagcggtgggggctggaggcacagcagccttgggaagaaacaaagactgtccgcagcgcgtagcggggcgtggagaaccgagggctgtgtaaggtcaggccctgagaaaaagcccccgaaaggctggaagttacgttggaacgggctggttgtggaaggagcgagctctccgtccccgggagtatgcaagtttgggctgcacgatcacttggaagggattggg

SEQ ID NO: 77938 - DNA, 333 bp, Homo sapiens; identical to SEQ ID NO: 35817
  chr15:75251478-75251811
  hyper

SEQ ID NO: 77939 - DNA, 30 bp, Homo sapiens
  chr15:75288351-75288381
  hyper
gcgttccctggaaaccggccttctggagat

SEQ ID NO: 77940 - DNA, 15 bp, Homo sapiens
  chr15:75470896-75470911
  hyper
ctgtggggggtgggg

SEQ ID NO: 77941 - DNA, 15 bp, Homo sapiens
  chr15:75471217-75471232
  hyper
cggtttccccatctg

SEQ ID NO: 77942 - DNA, 30 bp, Homo sapiens
  chr15:75516785-75516815
  hypo
ctgctgtctgaggcccgccatgctgggcca

SEQ ID NO: 77943 - DNA, 50 bp, Homo sapiens
  chr15:75990686-75990736
  hypo
ctgggggctgaatgccggctctgtgagagcatggacgggccaggtgtgct

SEQ ID NO: 77944 - DNA, 122 bp, Homo sapiens
  chr15:76005149-76005271
  hyper
gggagctgagtggagcgagcgcggctctgctcctgggcgcgggccggctccgggtgtccgcgcacttaactccgggggcggggcaggcgcagacccgcgcgcccgctcgggtttcaggcttg

SEQ ID NO: 77945 - DNA, 38 bp, Homo sapiens
  chr15:76012901-76012939
  hypo
cctaggaagtgatgccgtgcccttctcacgcagcctat

SEQ ID NO: 77946 - DNA, 56 bp, Homo sapiens
  chr15:76195506-76195562
  hypo
gccattttactcattcgaaactttaaacctgaagattacaacgagttaactaagtt

SEQ ID NO: 77947 - DNA, 86 bp, Homo sapiens
  chr15:76197435-76197521
  hypo
ttacaggcgtgagccaccgcgcccggcatgttgggccttttaagtatccacattttcactattaacaacaacgctgtgcagaacct

SEQ ID NO: 77948 - DNA, 100 bp, Homo sapiens
  chr15:76351669-76351769
  hyper
gaggtgttttcccctcggtggcctccaagcgcagcgggcactgcgtgccatccgctccctcaccgggcgccccgcgcggatgaaacggagcaactgggaa

SEQ ID NO: 77949 - DNA, 30 bp, Homo sapiens
  chr15:76372926-76372956
  hypo
attgagccctcctgccgtcctctcattagg

SEQ ID NO: 77950 - DNA, 30 bp, Homo sapiens; identical to SEQ ID NO: 15913
  chr15:76510088-76510118
  hypo

SEQ ID NO: 77951 - DNA, 23 bp, Homo sapiens
  chr15:76627514-76627537
  hyper
aggtggaggcggagctcaaaagc

SEQ ID NO: 77952 - DNA, 463 bp, Homo sapiens
  chr15:76627575-76628038
  hyper
cgcggggccggtgaggaacgttcaccgtggaccatggtcgaataatgttagcgtgcactcggggcctcgccctagccttctgcaaagcctcggcctgcgccctcggctgcatccgtttcgacgccaaccaacctcatgctcttagtagaacggcagtagcgaccgcgccctcaggcccacaagcccgaaggtctgggcagggtctggaatggcggtggagacactttatccgcaggcgtttcacctcgcgccccacccaggcgcacaccaagttcttggtactccttttaatgggaaaacaagaacagacaccatggttggataaatgttatttataattcatgggccggtctttgaaccctttcaaacaaaacccacagcgatttctttgaaagaatgcctggactgtgctcagagctctcagattttctcaggaccaacgagccgccgcctcgcagatacc

SEQ ID NO: 77953 - DNA, 699 bp, Homo sapiens
  chr15:76628327-76629026
  hyper
gaggggcagcagcagcggcagcagcagcaaggatggagtcaggacccgtcccagtcccgggtgagcgcttttggatctgggttctggctcaacccacgtaatgccccaatctaaagttttctacgtgtgtgtggataggaaagtctaaatagagtttatcagaacccaggtggtcattctctacactctctctagcttggacccgaagaacaaaggcacatgagaggagaaaggtgaccagctggacgatgacggtcacgtccaaacggatcccccttgtcctcggctctctcgtcctgagagtgggtttaatttttttttttttaatttatataagaagggagctcttaaaggagagccatctccaccctcaggtatccatcacccagctccagcgcgcctgggaaaaccgccccgaaagtccaagaggaagctcagagttgtaacggccgcggagccagctcggcggtgacgcaaggtccagtccagattgccaggcccggggcatgagagaggatccttgtaggtttcggaggtgggggggctgcactccattgttcactccgggccaatcagggttggcccacttcctcccagccaatctcccttcacccccagcctccaacccaacccaccccgcccatcagcccctggatccccatcacctcccccgcatccccggcagttctggggaagctt

SEQ ID NO: 77954 - DNA, 58 bp, Homo sapiens; identical to SEQ ID NO: 4253
  chr15:76629162-76629220
  hyper

SEQ ID NO: 77955 - DNA, 430 bp, Homo sapiens
  chr15:76629665-76630095
  hyper
gtctgagaggatgagcggggactgccgaaagacgatgtgtctgtgttgggataggaggcagccgctgtgagtgggagtgtgtgagcggaaatgccaggacagcaccgttaggtgttgatatccaggcgtccgcagtgcctgtgtatttactctcttcttagtttcgtgtttgcgtttagtttcaagacacgtcgacaaaacgactgtcattaatgaatgtaataacgaaatatttggggtgggggacagaagaaaccttcagcaatccacaagatactggtttttcgtttccaatgccctggacctttagagagctcatcatctttccttatggtcgcaagtcttgaaagaaagagcaagagagcgagcgggttgggttggggctggagtagccgaggccggcctgggtccgggcagtcaggcctgacgc

SEQ ID NO: 77956 - DNA, 29 bp, Homo sapiens
  chr15:76630096-76630125
  hyper
gccccgcgcccttccccggcagagaagcc

SEQ ID NO: 77957 - DNA, 490 bp, Homo sapiens; identical to SEQ ID NO: 35828
  chr15:76630519-76631009
  hyper

SEQ ID NO: 77958 - DNA, 15 bp, Homo sapiens
  chr15:76632131-76632146
  hyper
gccctcgtaggcccc

SEQ ID NO: 77959 - DNA, 286 bp, Homo sapiens
  chr15:76632517-76632803
  hyper
cgaaatcgggccccggggggctgggccacccggaggttgggctcggggcgggtgggtggcggcccctcgctaacctctggcctcaccctgtcctggcagacgctgggtcgggccggcagcccgcgttgcgcccgcacgtgcacaagcagacggagaagacgacccgcgtgcggactgtgctgaacgagaagcagctgcacactctgcggacctgctacgccgccaacccgcggcccgacgctctcatgaaggagcagctggtggagatgaccggcctgagcccgcg

SEQ ID NO: 77960 - DNA, 30 bp, Homo sapiens
  chr15:76633746-76633776
  hyper
gggtacagccctaggcggtgggggaggggg

SEQ ID NO: 77961 - DNA, 48 bp, Homo sapiens
  chr15:76634240-76634288
  hyper
aggccattccagttccgaaagctctctcgccttcgtaattattctatt

SEQ ID NO: 77962 - DNA, 159 bp, Homo sapiens; identical to SEQ ID NO: 35830
  chr15:76634951-76635110
  hyper

SEQ ID NO: 77963 - DNA, 161 bp, Homo sapiens
  chr15:76635575-76635736
  hyper
gaagtggagggggtcgggggtggcccgggtgggagggagctgggaatggcccctggatatgccgtgcccaggtcacttggtgtgacatttcaaacccctgcgacttgttttcttgaaaactggctttagtgatcgcaggaaataaccgagagatactgaat

SEQ ID NO: 77964 - DNA, 180 bp, Homo sapiens; identical to SEQ ID NO: 35831
  chr15:76638317-76638497
  hyper

SEQ ID NO: 77965 - DNA, 271 bp, Homo sapiens
  chr15:76638855-76639126
  hyper
gctgcggcccctcagcctctggagagccggggggcggccctcgccccggcagaaagcaacctgtggcggcactgcgtccccgcgagctacaaccagacgcggccgcgctcacctgggcgttgcgctcccccgagccccggagagtttagaagccgtaaaagcccggggagctggagcttaaatcgcccggaccgggccggggcgcccgaaagcagtgaactcgagacccccaggaaccgcgtgcgccgggaggcaccgggacgctcccggg

SEQ ID NO: 77966 - DNA, 30 bp, Homo sapiens
  chr15:77198053-77198083
  hyper
cacttgacaggagcacgctgggctgcgctg

SEQ ID NO: 77967 - DNA, 26 bp, Homo sapiens
  chr15:77448975-77449001
  hypo
atcttggctcccgaaataaaataatt

SEQ ID NO: 77968 - DNA, 78 bp, Homo sapiens
  chr15:77852833-77852911
  hypo
agggaggcagatggtggtattaatcctcatatcgcggggggtgtacaacctcctgttatggttcgtaacatttagggt

SEQ ID NO: 77969 - DNA, 247 bp, Homo sapiens
  chr15:77906751-77906998
  hypo
cgcgatgcacaggtacgtgccgttgtcctgtacctgggcgtagcgcacctccagcgtgccatcagggaagactgtgagccgcccattgctcttggctgagaccaggtgctttcggggtgagagccagaggatggcgggcggcgggtcgccatcggcccggcacacaaactgcaccgtgtggccctcgtccacaaacacctgctgggccttgcggtcccggatgcgggcgcggcggcaggtgaagtag

SEQ ID NO: 77970 - DNA, 39 bp, Homo sapiens
  chr15:77908085-77908124
  hypo
cagcgcggtcctgggcggagcactcgcagcggggcgggc

SEQ ID NO: 77971 - DNA, 444 bp, Homo sapiens
  chr15:77924553-77924997
  hyper
gcaaccccaggagggcgcagccagggccgatggcggcccccaggggcactcgccgcggggctgcccgctcggggctcggccgcggccgcctggctcacctgcatctcgggcgcgccttcggtccgctcggctcggtcaccaatcgcatgtctctccagccggcccgaccaggccccagcccctgcccagccccctcctccgtttcctcctcctccgacacctccgcccggcagtccgcgcgccctcgcggggctggctgtccgtctgtccgccccgcgcgggcgggagccgagccggagccggggccggggctcgggagtggggaggcgggaggccgcggccccggcgggcggatgggcgggcgcgctcaggccgcgggacaggggctgcgcgagcctgcttctgccccctgggccggcccggagccgccgccgccgcctctgc

SEQ ID NO: 77972 - DNA, 260 bp, Homo sapiens
  chr15:77925465-77925725
  hyper
tgcgcaggcgaggggcgcaccagccaggcgctccagctctgcacacggccgcgcccctccgggtccggggctctgggcgagtcccgggccagccgggtgtcggggagtccggcgtgcggtcctccctgggtgtatgcgcgcacaccgttgtgtgtgatttttgtgttgccacatgcgtgtgcatgtgagcgcgcgagtgtgtttacacgtgttaactgggctgtggacgaacacacgcacgaggacggacagggctccct

SEQ ID NO: 77973 - DNA, 258 bp, Homo sapiens
  chr15:77927171-77927429
  hyper
cccgacaggaatagacgctcgctggctcctgcgtaaaggctccgccaggcacccggcgggcgcgcagacccgctggggggcgggggcgggggcgagggctattcctggtgcggtgactgacgcaggcaaggcgcggccaccacatctctccgcccccgactcacctgctccctgcctcagtgatctcggcggagaaatgggggagagcccactcattccaccccgctaacccccaggtgctaccggaggaagctgggg

SEQ ID NO: 77974 - DNA, 442 bp, Homo sapiens
  chr15:78111427-78111869
  hyper
agccccaagcgtgcacgccccccacggacgcgcacccagcaccccacccccgccgctgcccccgaggctcccgcccaatcagaggccgcgcgcgccgcgccgccggcgggcagacacaccggctccccggcctgcgcccctgcggccctggccccgctgcagcgtcccggcccggccacactcaccgtcccgggcgcgccgtccgcgcgcggctccgctccgggccggcatcccccggctcggctgcctccggtccccgctccggcctcggttcccgctccgcagggctcggctccgcgatggtggccgcggcggcgagcgcggcagggagggcgtgtgtatgcgcgtgagagcgcgcagcgtgtgcatgtgcgtgtgcgcgggagggtcccggctcccctgcgcgtcccgctcctgcctcctgctcgccacgatgcgatgc

SEQ ID NO: 77975 - DNA, 461 bp, Homo sapiens
  chr15:78111916-78112377
  hyper
cgcacacacgcgcacacccaggcgcgcacacccggctccgcactcccgactcgccctcctggagcgctcacaaagaccccctgccgggacggccggagcctgcggagcgcggccctgggcccctccgggacccgccggccttaggtgccccgctgctccccgtagggaccccgcgggcggcccggctcccgcaccctgcctggccgggccgcggccgcgctcccagcccgaacctgggcccaggtgccgactcgggcttctcgcactcccgcgggaagcgccggccccctccgcggcgccgccgcccttctcccccccttccagtccggcctctccggcgcctccctgccttgtcccacctgcccagcccggtcctcgttctccccgctgctctccgtctgtctcgccgccgccctctcccgcgccccttcctccccaccgccctgcgctgcctctcacat

SEQ ID NO: 77976 - DNA, 408 bp, Homo sapiens
  chr15:78236748-78237156
  hyper
tcgggagcggagtagcggtggacttttctcacgcccgcacacactgtttgcggagaggccagggcagacaacctccacccgtttccggagccactggcgccccctcattcccgctccagcagcccatgcctcgcttcacccctggtgcctcatcatcgcaccaggaagccagggcccgggaatttctttttccggtccgacagggtcaactgagtcgacgatcacttgacttggactaacggcctctgggagggcggggcctgctcgagtgaggccgggagcggaccgcagcccgctggaggtgccgggggcgaaatgctggcgtctcctcctccgtctcccagaatccttccctggaaaaaaacagcatccaccgtcagtttaactgaggaccgaattaaggcatta

SEQ ID NO: 77977 - DNA, 30 bp, Homo sapiens; identical to SEQ ID NO: 44317
  chr15:78252931-78252961
  hypo

SEQ ID NO: 77978 - DNA, 48 bp, Homo sapiens
  chr15:78277490-78277538
  hypo
gggggcctctcctgccgggccatgctctgcatccgcagcatggggctg

SEQ ID NO: 77979 - DNA, 79 bp, Homo sapiens
  chr15:78327585-78327664
  hyper
aagaaaacctctttccggtggaggtctgcacagtttaaaatgtctaactaaaacagtaataactcgttcgacattcgtt

SEQ ID NO: 77980 - DNA, 30 bp, Homo sapiens
  chr15:78486343-78486373
  hypo
gggcctgcttcaggccgagctccaggtcaa

SEQ ID NO: 77981 - DNA, 166 bp, Homo sapiens
  chr15:78501776-78501942
  hypo
ctgaagagatggcaacgtgtgcttccggggcgaggcctcctgtgccgggcagacagaggcgtgtgaatgctgcagaactcgtcctactgactttggatccttggttacagctctctgggatagccaggtagaagctgcctccactttgggccgcaatgttaccaaa

SEQ ID NO: 77982 - DNA, 30 bp, Homo sapiens; identical to SEQ ID NO: 44320
  chr15:78503615-78503645
  hypo

SEQ ID NO: 77983 - DNA, 56 bp, Homo sapiens
  chr15:78506312-78506368
  hypo
gaacaggggtctccacggcctgctctgaagccaggatgctacgtacacaaggttta

SEQ ID NO: 77984 - DNA, 43 bp, Homo sapiens
  chr15:78556892-78556935
  hyper
ccggtggctctagtgcggtggagccaggcgtggaagtcggtcc

SEQ ID NO: 77985 - DNA, 168 bp, Homo sapiens
  chr15:78557205-78557373
  hyper
acccggacaagaacccggatgagggcgagaaggtgcggggcggcgcggggcacgggccgggctcccgaggggccaagggttattaagccaggagcattgaaggcgacgggaaacctgagccgcgtttgttggggaggctgtcgccaggcgcctcggggccaggccggg

SEQ ID NO: 77986 - DNA, 23 bp, Homo sapiens
  chr15:78571000-78571023
  hypo
cttttttttttgagacggagtct

SEQ ID NO: 77987 - DNA, 214 bp, Homo sapiens
  chr15:78596058-78596272
  hypo
ccaccgcgcccggccactgtttacactattgttgcagtagctgctgccatcaccgggctgcggcagggaggcacagctggggctgcatgctggtggatgcctcccccttctgagttggggagagctccccaggtgctgctgcagccgcccaaacagcagttgcagatccaggcctcctgctttacggagcaggcagggtcgccaccctcctggg

SEQ ID NO: 77988 - DNA, 167 bp, Homo sapiens
  chr15:78609740-78609907
  hypo
tctggacactcacagcgtgctgctccgagcactgccatgccaggtgacttcactctcctgattttgaagatccctgtttccatgcctctccttcggtgaatcatatgttctgggcctgacctggatccccagtcctgacacccagcccagcacgggagctcagtgaa

SEQ ID NO: 77989 - DNA, 30 bp, Homo sapiens
  chr15:78617409-78617439
  hypo
acacccaggggtctgcgcacacaatgttat

SEQ ID NO: 77990 - DNA, 163 bp, Homo sapiens
  chr15:78632506-78632669
  hyper
tccccagttggagagcgggtgcccgcacctctggaggctgaggcacaactgggctgggagttgagcgcataccgagtaggggctgcgggggagcgggggcagggccggcggggcggggccagaagcccggcggggttgggggcgctctcctagtgactcaagg

SEQ ID NO: 77991 - DNA, 711 bp, Homo sapiens
  chr15:78632683-78633394
  hyper
cgcaaagcgccagtctccgccttgcgagctcagagtgtgcccgctgcgccgccgctgtccgtacctgccgccgccgccaccgccaccatgcccaacttcgccggcacctggaagatgcgcagcagcgagaatttcgacgagctgctcaaggcactgggtaagctggtgcagagggcgcgccccgacggggagatgcggcccggaggtgccctggtcccggaagtgccccggtcctggagggggtggaagttggggagcccaggcaggagggagtccccggggcaatagatcgccttgtctcccaggcgcaccgggtctcggagaagctggtagagatcccggaacccacgcgttcagcgaacgtttgctgaatgtttggcgccctcctcgatggtgcggactttatctcgtgctagatcatagcgaggagagattactggagagcaaggaggatcagggacttaaatttggagactcaaatttgggaccaggctctgccacgaattcactgtgcaactcgaggaaagtcacttaccctctctgtgcctcagtctctcatctcgaaaacaagggcgagggcagggaaacgagtggatcaattttaaggcccctttctaaagttagggtatgaccagtgcccgaccggtcccgagactggcggcgaggccccgtgacccaagcctgtggtgcaccctgcgcaggtgtgaacgc

SEQ ID NO: 77992 - DNA, 141 bp, Homo sapiens; identical to SEQ ID NO: 35841
  chr15:78912231-78912372
  hyper

SEQ ID NO: 77993 - DNA, 587 bp, Homo sapiens
  chr15:78912441-78913028
  hyper
cggcttcccccagcaggctcctctggagagcgggaggaagacaggaggcgctctcccggtggagggtccctcagcgacgcagccaggagcgctaggaggctacaaccggaggagaggctggcgctccagctccagccccagtcccgaagcgactcccctcttcccgaggtggccttggccaagtcttcagccatctccgtcaaatgaggaggtgggcgggatgcagacggtggagcgggaggcttgggcgcgccagtttgggagccagtgcgcggggcagggcgacgggcagcgcggggacgcgaatccccaactcctgcgcccaagacgaaggacccggtctcgacctccccatcacccggcgcgtaccagcgcccgctcagtgactcccaggtttggtggtggctaggggtgggaggtgagccgaaagggaaaaagccaccccacccaagtcgccgccgggctggagccagtctgcgcgggttccgagtccccggcgacggcgccagccctctccgctcgcccgcgcggtgttctcgccggcagcccctccggaccccgcgccccttctcgggcgcccgtccctc

SEQ ID NO: 77994 - DNA, 376 bp, Homo sapiens
  chr15:78913094-78913470
  hyper
cggcgacagcgccaggggcagcgagagcgggccagagcccatggctggtggccgggctggccgcggacccggacggtcgggagcgggcgcggcggtcgcagagacggcctctccccgcgcggctccagcgcagaccccagacctggagccgtgcgggcggagacgcgcggggctcctctccgcttcgccgccgctgggtttccagcgccctcggacccgcgggaggacaggaaccatccggagtgaagctgcgccaggcgcgggcgggcgggcgggcgtgcgcggggcggggcgtacgtgcggtaggggaaggggctccaggtcccagtccccagcgccgggcgagctccttctccgccgggctgggtgctccggc

SEQ ID NO: 77995 - DNA, 212 bp, Homo sapiens
  chr15:78913480-78913692
  hyper
cgaccagatctgagcaggtgctgtcaccaccaccaggaaggagagggactcagtttctgtcccaggtttccggggcgtgtgcagctcccgcagggggttgggaccaccgggctaggcgggcgccgtaggagagacgctaacacaccctgggaaggacgccttgtgtatctcatgctattaaataattgttaaatattttagccgggagcagt

SEQ ID NO: 77996 - DNA, 312 bp, Homo sapiens
  chr15:78933373-78933685
  hyper
tcagcccaacccaggcgcccctccctccttccccgaaaagaactcaccgcgcccgcaaagggcgaccaggaagaaaaggaccagggaaggcgcgcgcctcatggccggcggggccgggtggcagccgccgcgagctccgctgtggggtcacagggcacccgtgagccgcgcggtcgagtgagcgccggtcctggcccccgaggtttgctggcggggcggcgctcactaggaccccgcggagagccccgccgagccccgcccactcagggatgtactgggcccgctgctccgccccgacgccccctgggtggt

SEQ ID NO: 77997 - DNA, 68 bp, Homo sapiens; identical to SEQ ID NO: 44323
  chr15:79055979-79056047
  hypo

SEQ ID NO: 77998 - DNA, 71 bp, Homo sapiens
  chr15:79057076-79057147
  hypo
ggcagatcccatccccgccaggcctccacagccaggaaactacccacctaggctagcgagacctcagcaag

SEQ ID NO: 77999 - DNA, 92 bp, Homo sapiens
  chr15:79059735-79059827
  hypo
cacagcccaggtggccggacagggtacatggcggttgcaaggggtttcagtagggggccggggaaggtgttcacaggcgggtggctccaggg

SEQ ID NO: 78000 - DNA, 102 bp, Homo sapiens
  chr15:79064055-79064157
  hypo
gaggaagtacttctccgggtcctcgctccgcagtgccaggaagttggcagcctcggcaacctcttggatgcggatctcgcgtgcgcccgctgggatcagccc

SEQ ID NO: 78001 - DNA, 41 bp, Homo sapiens
  chr15:79103265-79103306
  hyper
ccagaagcgcggcttcgctcccggcccggcccgaccccgac

SEQ ID NO: 78002 - DNA, 30 bp, Homo sapiens
  chr15:79104054-79104084
  hyper
ccggttgaggacccccggaaagaatctgga

SEQ ID NO: 78003 - DNA, 27 bp, Homo sapiens
  chr15:79163864-79163891
  hypo
agagggaaactccgtctcagaaagaaa

SEQ ID NO: 78004 - DNA, 900 bp, Homo sapiens; identical to SEQ ID NO: 1224
  chr15:79382098-79382998
  hyper

SEQ ID NO: 78005 - DNA, 269 bp, Homo sapiens; identical to SEQ ID NO: 35848
  chr15:79382999-79383268
  hyper

SEQ ID NO: 78006 - DNA, 56 bp, Homo sapiens; identical to SEQ ID NO: 35849
  chr15:79383328-79383384
  hyper

SEQ ID NO: 78007 - DNA, 708 bp, Homo sapiens; identical to SEQ ID NO: 35850
  chr15:79383438-79384146
  hyper

SEQ ID NO: 78008 - DNA, 243 bp, Homo sapiens
  chr15:79502049-79502292
  hyper
ggggcggggagggctcgccgggaaatcaaacgtccatttacatcttgtcctgcaaagcttcatcaaaacttctttgccggccagtcacgtccccttatcacttttccagcccagctttgtgactgtaagtgttggacggagaactgataagggtaggtgattgacactcacagcctccggaacccccgcgccgcctgcacttgcgtgatggggaaaacctggcgttcccgctctgggtgcccg

SEQ ID NO: 78009 - DNA, 720 bp, Homo sapiens; identical to SEQ ID NO: 35852
  chr15:79574779-79575499
  hyper

SEQ ID NO: 78010 - DNA, 481 bp, Homo sapiens
  chr15:79575852-79576333
  hyper
aaggggaagaaaggtcgtcagtttttgcagaaacctgtgaggaactggcggtgagaggttatgatcctgaaaatgtgcacgaaattgtaaaaagtaggcacctaagcatttctgagaaatgatgggagaagcacttaccgccctggtttcacctgacccccatgctcggccttctggaagatgcccacagacactggcaataatggacgctggcacactctgccggcgcggccggagccccggagttcagcacctcggacagagcccgagccccgccgcccgaggcgcacagtgagcgtggaacagcccggctccctagcccccggccaacgctgctctcagttcagggcagctacgtaacaccgcccctagctccgcgccagaaagggctctcgaatcgcaaaagcaaacgtgttcgatttctgatctgcttctaactgcttcccgtgactgcagaaggaagaggcggagtgtaaagata

SEQ ID NO: 78011 - DNA, 30 bp, Homo sapiens
  chr15:79672460-79672490
  hypo
ggaggggccggatcacgaggtcaggagttc

SEQ ID NO: 78012 - DNA, 69 bp, Homo sapiens
  chr15:79724051-79724120
  hyper
cttgccactgggggccgcagtcaccttcagcataggggagtggggagacgcgaaccccgcgggtggctc

SEQ ID NO: 78013 - DNA, 210 bp, Homo sapiens; identical to SEQ ID NO: 4263
  chr15:79724351-79724561
  hyper

SEQ ID NO: 78014 - DNA, 187 bp, Homo sapiens; identical to SEQ ID NO: 4264
  chr15:79724606-79724793
  hyper

SEQ ID NO: 78015 - DNA, 634 bp, Homo sapiens; identical to SEQ ID NO: 35857
  chr15:79724863-79725497
  hyper

SEQ ID NO: 78016 - DNA, 24 bp, Homo sapiens
  chr15:80217740-80217764
  hypo
gagccaccgcgcctggccagtgat

SEQ ID NO: 78017 - DNA, 30 bp, Homo sapiens
  chr15:80279955-80279985
  hypo
tggaacaagaatccacgctctaatatgcct

SEQ ID NO: 78018 - DNA, 30 bp, Homo sapiens
  chr15:80473548-80473578
  hypo
gcactgttctagctgcggggcgctcctacc

SEQ ID NO: 78019 - DNA, 30 bp, Homo sapiens
  chr15:80513587-80513617
  hypo
gaaaatcataatgcccgccaagaacagttt

SEQ ID NO: 78020 - DNA, 30 bp, Homo sapiens; identical to SEQ ID NO: 35858
  chr15:80543967-80543997
  hyper

SEQ ID NO: 78021 - DNA, 133 bp, Homo sapiens; identical to SEQ ID NO: 35859
  chr15:80544203-80544336
  hyper

SEQ ID NO: 78022 - DNA, 302 bp, Homo sapiens; identical to SEQ ID NO: 35860
  chr15:80544364-80544666
  hyper

SEQ ID NO: 78023 - DNA, 149 bp, Homo sapiens
  chr15:80624470-80624619
  hypo
gccctccagtaccaccgccccgtcccctccccaaccagttcccgcggggaccaacaggacagaagaagctggcagctgcggggggcaaggctggggactcagattccaggtgtttcaggttgtagctgcccagccggcaaggtaggcgc

SEQ ID NO: 78024 - DNA, 225 bp, Homo sapiens
  chr15:80696318-80696543
  hyper
ggcttctccctcacccgctccgccctggcctcctggcctgggcacggcgcccctgggtaaagcgcgcccggacacctggggcgtgggcgtgcgggggcagcccgggctaggcgagcgcgggagaggcgcctgcggtcccagcccggccaggcccgagcacctgcgcgagcccgagggagcgcccggccctctgcccccgccagtcgccggcgcccaacttggggg

SEQ ID NO: 78025 - DNA, 30 bp, Homo sapiens
  chr15:80697219-80697249
  hyper
tttctcttccggtcccggcttttgtggcat

SEQ ID NO: 78026 - DNA, 69 bp, Homo sapiens
  chr15:81072720-81072789
  hyper
tcgccgctctgggaacgaaggccagtgacattctggaatggaccccaagggatgcgtgtgctcatgaga

SEQ ID NO: 78027 - DNA, 115 bp, Homo sapiens
  chr15:81073160-81073275
  hyper
gtggccctgggtctccggggaagtcgtgcgctttcttcccagacccaaggcgttggggcgctgggaaagaggaaagggactgagagtccgctggggccctcggtattaccactca

SEQ ID NO: 78028 - DNA, 30 bp, Homo sapiens
  chr15:81198888-81198918
  hypo
gcacaccaggcatggcgatgagtaagcagc

SEQ ID NO: 78029 - DNA, 21 bp, Homo sapiens
  chr15:81282983-81283004
  hypo
aaaaaaaccaaaggccgcacg

SEQ ID NO: 78030 - DNA, 21 bp, Homo sapiens
  chr15:81283124-81283145
  hypo
aaaaaacgcttcattctttat

SEQ ID NO: 78031 - DNA, 30 bp, Homo sapiens
  chr15:81771801-81771831
  hypo
agctgacatctgccccggcagtgtctggta

SEQ ID NO: 78032 - DNA, 169 bp, Homo sapiens
  chr15:82042432-82042601
  hypo
gaggtccgaaagagccggccgaggtagagtggagaagaaggctgccttggctgggtgcaggcggcatcttctgcaccaggtggaggacaggcagctttgcacaactgaacatccctgagccagccggcctctgagcatcttgcgctggcagtgccgggcaaagctcccg

SEQ ID NO: 78033 - DNA, 19 bp, Homo sapiens
  chr15:82097045-82097064
  hypo
ttttttttttttagacgga

SEQ ID NO: 78034 - DNA, 19 bp, Homo sapiens
  chr15:82097326-82097345
  hypo
cgcccggcctggcttttat

SEQ ID NO: 78035 - DNA, 60 bp, Homo sapiens
  chr15:82156125-82156185
  hypo
gggagagagagggggcgggagagagagggggcgggggagagagagcgagctctcatgttt

SEQ ID NO: 78036 - DNA, 219 bp, Homo sapiens
  chr15:82205602-82205821
  hypo
ttatgcgaagccacacggaagaaattaagcagaactcaaagctgtctgactccagcgttcatgcttggaacactaactaccctctactagttcattagaggcaactgggtaaaagtggaactaggtgtgcccgtgataaagcctgtgattaagtagttaaaatgaggatggattccggtaagccaaacgtacacataaggtttacggcactacagcctc

SEQ ID NO: 78037 - DNA, 23 bp, Homo sapiens
  chr15:82231172-82231195
  hypo
tcttcataaccttggcgtaggcc

SEQ ID NO: 78038 - DNA, 82 bp, Homo sapiens
  chr15:82231255-82231337
  hypo
caaattgagcttcattaaatgaagactgtctatttatcaagacaccattaagagagtgaaaggcaagcgactgagtgggaga

SEQ ID NO: 78039 - DNA, 713 bp, Homo sapiens
  chr15:82336570-82337283
  hyper
cgttctctggcatgccggtcacctcgaacaccggctccttatcccggctgggcgtcacgatgtacgtgtgcgtctgctgctggatgcgcttgattgtggcgcctttgggccccaccacgagccccaccacgcggtagggtacccgcacttggatggtggtctgcccgggcaggttgggcggcccaggcaccgcgccgttgagtgccgtgttcttattccgggaggcgcggatcatggagaagtgctcggcagcagagatgatctccctccgagccatggccacatcctccttcctgcccgtcacaacaaagacaggctcctccccgcgaactggggtcttgatgtaagtattggtcttcgcccgcagcgctttgattttacaacctacgaaccagggtgcggaggagggagtgggagagagagacagacacgcccattatcctggggtaaccgcggggaccggggacagcccgcgtccaggacagcgagacggcaggacaagagatgggcggaaagggggcgtctccctcactgacctcgggccgcgccacgggctgggcagcggatcccacccgcgaggcgctcgaggaacagcccattggctgcctggccctcccccagtgactgcagtcgtcccgaaccaaacccgagaatcccagaaaagtcatctggggagatgccgctgggatccagctgggcgcgccgtcagctct

SEQ ID NO: 78040 - DNA, 329 bp, Homo sapiens
  chr15:82339878-82340207
  hyper
atcctcacagagggacgtcttcccaaaacaatgaggccatgcggccgcagccgcacacgggctgactggggagatctcgtggtgccgcggggcggtcccggggctcgaaggcagaggctcccctaggtgtgccctgcctgaccccggctacaggaacgagcgctgtgggcctcggtttctcacccgtaaaatgaagaaaataatccccgcctttaccacctcgtgggtcgttcggaagattaaatgcgacagtggatgggcgcgcgcttacaaatcagtagacagttccgcaagcgcctttacttttgagaacgcggtggtgcagctcc

SEQ ID NO: 78041 - DNA, 30 bp, Homo sapiens
  chr15:82396478-82396508
  hypo
tacaataatgcagaccgaaccctgcaactg

SEQ ID NO: 78042 - DNA, 438 bp, Homo sapiens; identical to SEQ ID NO: 35864
  chr15:83314955-83315393
  hyper

SEQ ID NO: 78043 - DNA, 5 bp, Homo sapiens
  chr15:83315985-83315990
  hyper
ctctc

SEQ ID NO: 78044 - DNA, 409 bp, Homo sapiens; identical to SEQ ID NO: 4268
  chr15:83316231-83316640
  hyper

SEQ ID NO: 78045 - DNA, 437 bp, Homo sapiens
  chr15:83316641-83317078
  hyper
gggctgacgggctgaccggccagccggcgggcgagagacgcgcacgcacgtgggcactatttttgcagcgggccgcgcgcagccccgcaccccggcagcttatgaagctcctacgagccgctcctcggagccgccccccggccggatgcggagcacctgtgtcggccccgcccgggccctcgcctccgccccctcgcgccccgcccctcctagcaggccgagccgaggagggctccgccgcccacccggaacccggcggggactgccgccgctgctagccacagctgccccctggggggccagagacctaagcctgagcgcgccatcacctaagtgacccttgccgagtcactgtctgccctgggcctcagtttccctcttaacgaaagagggcacgatttacaagcccctgcgagcggcggcgatcgcttcgtcag

SEQ ID NO: 78046 - DNA, 700 bp, Homo sapiens; identical to SEQ ID NO: 35867
  chr15:83348912-83349612
  hyper

SEQ ID NO: 78047 - DNA, 70 bp, Homo sapiens
  chr15:83349671-83349741
  hyper
cgatcagcaggttacagagtttccggtagtttttgtgaatcaggtcgatgcgctccgggcagacctcctc

SEQ ID NO: 78048 - DNA, 86 bp, Homo sapiens
  chr15:83378001-83378087
  hyper
ccaacccgcctagcacgaaaaaggaagggaacccctaacgcaacgccgcaaaccggagaaacacctggaaccggagggtttctcct

SEQ ID NO: 78049 - DNA, 754 bp, Homo sapiens
  chr15:83378288-83379042
  hyper
gcctcgcccggtccccggccccaaccctcccgcgagcttcctggcgggctccctcaccgcttgtagtcggaggagaagatgccgccgctcgcggggtcgtggccgtactcgggctccccggggccagcggagccgcccttgtcttcgctgtaggcgggggcggccgacatggggcggccagggagacttcgccgaggaggaggttgcggggccggaggccggctggagcggaggaagggaaggcgggccggtccggtccgggctggcgaaggcggcggcgcggcaggggttcagcagaggctgcagtgtgcagcggcggaggctgcgcgcggatttctcaatcagggccgcgcgctgaggtcttaaaggcaccggcgccagccgagcggagggcgtgtccgcgaggaggcgacaggggcggtgcgtcagggcctggccccgcccatccctaggaaatgccctcttcagggcgtcttctgccctttaaagcgacttggctcgtctccagatctaaaggtgggcgagtctgctggacggacgctgggaccgtcttgcaggggatgtggaatagctgcccccacccccgaccacctggcctcggcgggacgggcctctggggctccgctctccccagacgcacgcgcggatgctcacccacgccgtggagggaaagcgggaactggaaagaaggctgtgcccgcaggctgggggttctagagcgggaaggggtcaccgcacccgaggaccggcctca

SEQ ID NO: 78050 - DNA, 30 bp, Homo sapiens
  chr15:83390208-83390238
  hypo
aaccctgaactttctcgaccaatatctttt

SEQ ID NO: 78051 - DNA, 453 bp, Homo sapiens
  chr15:83620954-83621407
  hyper
caggggcgaagagaccgcggaatggccgaggcaggaggccggccagggcaccggtccccgtcaggtgcccccgtgcccgggctgtatgggaggggaagggccacgggctccgcgcccaggccagggtgcccctgctgggtgtccgcgtgccccggcggagggcgcgggtcaggtggccccagactcccgggcgcagagtgtgcgctcgctccggcttggggaggcgggggccggcccgccgggaggctccgagcccggttacgccagccgcggccccgcagtccctccggaggggcgcgcggagagcgcgcggcgcgggctcactcaccccatctccggcgctgctccggcggccgctccgacggggcctctcgcgctcgctctccgcccgctcggcagccgctccccgcgcggcacatgcggcggcccgtgcgcgcccggctcagccccggc

SEQ ID NO: 78052 - DNA, 29 bp, Homo sapiens
  chr15:83622331-83622360
  hypo
agtcaagggacaggtcgggcgcggtggct

SEQ ID NO: 78053 - DNA, 76 bp, Homo sapiens
  chr15:83655953-83656029
  hypo
ccaccgcgcctggccttagagcacttttactccaattctttccttgaataagactcttatgcgccaccctccccta

SEQ ID NO: 78054 - DNA, 28 bp, Homo sapiens
  chr15:83775821-83775849
  hyper
gccaggtttaaaaaccggatgccggctc

SEQ ID NO: 78055 - DNA, 112 bp, Homo sapiens; identical to SEQ ID NO: 35874
  chr15:83775890-83776002
  hyper

SEQ ID NO: 78056 - DNA, 116 bp, Homo sapiens; identical to SEQ ID NO: 4273
  chr15:83776022-83776138
  hyper

SEQ ID NO: 78057 - DNA, 112 bp, Homo sapiens; identical to SEQ ID NO: 4274
  chr15:83776157-83776269
  hyper

SEQ ID NO: 78058 - DNA, 37 bp, Homo sapiens; identical to SEQ ID NO: 4275
  chr15:83776270-83776307
  hyper

SEQ ID NO: 78059 - DNA, 385 bp, Homo sapiens; identical to SEQ ID NO: 4276
  chr15:83776332-83776717
  hyper

SEQ ID NO: 78060 - DNA, 187 bp, Homo sapiens
  chr15:83776768-83776955
  hyper
cgcgccaggtgcccggggtcacaggcgtcaatacggccatgcccctgccctggaggggcccaggggccggtggggagcggaacaaacacggacactacgaacctggccgtgtcagctcgtttgtgccttgttctttttgcatctcacgggaacgtttccatgtatggactttcgcatacttatcatt

SEQ ID NO: 78061 - DNA, 378 bp, Homo sapiens; identical to SEQ ID NO: 35880
  chr15:83875705-83876083
  hyper

SEQ ID NO: 78062 - DNA, 282 bp, Homo sapiens; identical to SEQ ID NO: 35881
  chr15:83876201-83876483
  hyper

SEQ ID NO: 78063 - DNA, 556 bp, Homo sapiens
  chr15:83876654-83877210
  hyper
cgctcccctccccttccctcccgcgcgggccggttaattcctaggtacacggccggctttcgcggagaaaccgagcgcgccagcccggcttctcggctggcgggcgggcggtgggcgcgtcctcccccagcaccgaagcccgcgccgggcgggcgggagtgcctactccggaggacgcccgccgcctgctctcttttgttcttggcccggagctgcctgccgcagcccagccaatcaccacccggccgcccccttcccctcccgtccgtgccactctgggggttctccccactcgcgccccccgctcccacgcccacctcccgctgactcgaccctctcctggctacccccagccagccacttccgcggctgctctctggtgagtgggggacaaaggcgctccaggcctgggggacggcggcgcgaggggaccctctgctgggcaccaagctgccggaaagagcaccgctccggagtcagcgaccttattggattcttgccccaggtctgcccttaacaatgcagtgtgacccacctagggcgagctatttaatcg

SEQ ID NO: 78064 - DNA, 332 bp, Homo sapiens
  chr15:83951781-83952113
  hyper
accaggggacgttaccgaacccccgagcgtctgatgccccccgccccccaaccacacacaacttcactcacacaattaaggctgggagatggcattccacttaactgtcagactcggagcggtggcagccccgcagccacaaagagatgccttaaatgagaagaacatgtttctacaccgcatttgtgaaagtttggctcggagctacgcgctgattaatatcagatctccttcactcgcctcgccacaatcttgtcacatctggctgacaaatcccgaggaactccggcaaagccaggcggcggcggggctccgggtctgggcggcggctc

SEQ ID NO: 78065 - DNA, 54 bp, Homo sapiens; identical to SEQ ID NO: 35884
  chr15:83952768-83952822
  hyper

SEQ ID NO: 78066 - DNA, 34 bp, Homo sapiens; identical to SEQ ID NO: 35885
  chr15:84034378-84034412
  hyper

SEQ ID NO: 78067 - DNA, 30 bp, Homo sapiens
  chr15:84063249-84063279
  hypo
tcatgtgggcaatcacgttttcacttattt

SEQ ID NO: 78068 - DNA, 98 bp, Homo sapiens; identical to SEQ ID NO: 35886
  chr15:84115713-84115811
  hyper

SEQ ID NO: 78069 - DNA, 42 bp, Homo sapiens; identical to SEQ ID NO: 1229
  chr15:84115812-84115854
  hyper

SEQ ID NO: 78070 - DNA, 408 bp, Homo sapiens
  chr15:84115931-84116339
  hyper
cgacccccaggacatccccacgcccagcttcccaggccggtcttctgcgcggctcaagtagcccaggtctccacgcaacaatgaagcgtgggcggccccagcagcttcatttgcatatcgccgcggcttggccaatgggctgcgcaggggctttggaacgcagtgttgccatcggcgtgcgcgcgtgtgtgcgagtgtgacagcggctgtggctgtggccgtggccgtgggaggcgggcccggcggagcccagccgcggggggaccggcccgggctcccgctccccgagcgcgtcgcggccgcgtggcccagccgagccttgagaccaccccgcccctgccggtcgcagtcgcgatgtcggtggccgggctgaagaagcagttccacaaagccagccaggtagggagg

SEQ ID NO: 78071 - DNA, 176 bp, Homo sapiens; identical to SEQ ID NO: 35889
  chr15:84116377-84116553
  hyper

SEQ ID NO: 78072 - DNA, 113 bp, Homo sapiens; identical to SEQ ID NO: 35890
  chr15:84116651-84116764
  hyper

SEQ ID NO: 78073 - DNA, 68 bp, Homo sapiens
  chr15:84116828-84116896
  hyper
cgaaatggccccgtctggactgtgcccggctccccggctggggctctctaccgcggtccttcccctcc

SEQ ID NO: 78074 - DNA, 92 bp, Homo sapiens
  chr15:84225557-84225649
  hypo
gctggtgtggttgatcgctgctgggctcactcacctgttgccggtcagctgccaggtgagctgagggcttgatggcccgaggttgctcaggt

SEQ ID NO: 78075 - DNA, 121 bp, Homo sapiens; identical to SEQ ID NO: 35892
  chr15:84322476-84322597
  hyper

SEQ ID NO: 78076 - DNA, 220 bp, Homo sapiens
  chr15:84322993-84323213
  hyper
ggggctgcacgtcccagatacttctgcggcgcaaggtgggtgcaccgagctcggcgcagggcggcccctcaggggtcgggggaaggcgctccccagagggagtaagacttggagcagtggcctctctaagcaagttgggggtctccaagcagagtcggggcgtgccacgcgggccccagggggcctcaggactggggtgctcctcactgctgggcacctc

SEQ ID NO: 78077 - DNA, 36 bp, Homo sapiens
  chr15:84543445-84543481
  hypo
tcccagccacaccaccgagaacgtgcagcaagacaa

SEQ ID NO: 78078 - DNA, 49 bp, Homo sapiens
  chr15:84582058-84582107
  hypo
ctgaggacagtgagacgacttacgactgggagtacgctgggttcacccc

SEQ ID NO: 78079 - DNA, 89 bp, Homo sapiens; identical to SEQ ID NO: 35894
  chr15:84748531-84748620
  hyper

SEQ ID NO: 78080 - DNA, 788 bp, Homo sapiens
  chr15:84748678-84749466
  hyper
cgtcccttcatctccgggggacggccactctcagggttcccgaggagcccgctccgtgcacctaggccctaggtcggctcccaagccctggcccgccgctacaccagcggtttcttacccgcaagtacaaatgtgacacagacaccagctcctcgtgctcttggctcccagggtttctttcaccgcgcctcagcacctgcagcttctccactcttacagcgcccgccgtcgtcaaggcaacagagggatgcccggtgacagactcggcgccggcttccggcgccgtaagagaagcgtccgcgcgggcgttctggacccgcagagttctcggcgtttccgaagctcttggtgtggccgggacccgggagaaggagcagggctggtggggctgctgcagccggtgagtgtgtgctggcgctgggggctggaacctcctaggccagtctctgggcggtgccgcaggaccctgctcgctgcggctctgaggcggaaacaggggctggggccgagcgcgggctggaagctttggtccctggagtgtcgcttccagtctggggccgaggcggtcgcctgtgtagacccgggatcctcaaatagaacgaatccgggaccctgcagaaatgaagggcatgtagtgtagaggtttttcctttttatttagaaaggaatgaaagaccgacagtgcacctgcttggatagtaagcacgtgacccaaaactttgttggggctctatgggcaggaataaagctgggtatttgacctcgcgcgaggacgagcgagaatgtca

SEQ ID NO: 78081 - DNA, 89 bp, Homo sapiens
  chr15:84950082-84950171
  hypo
gtgggggtgaacgtgcgtgccggcaccggcatggcagctaacaccccttcctccaggtgaacctgcaggagctgcggggcaggtgttgc

SEQ ID NO: 78082 - DNA, 196 bp, Homo sapiens
  chr15:85143051-85143247
  hypo
aaaaaaaaaagcagtcatttcattgcaggtgcctccagtaattgctcagtgcaaacatacataactattctatcacagaccattaagggtgtctctctccatttttagattttccgcttgagtttccaggtagtttctcacctgttttcaagcagggttggggcagccgtttcttcaacagcgccagccgtaaaac

SEQ ID NO: 78083 - DNA, 30 bp, Homo sapiens
  chr15:85200338-85200368
  hypo
ctcccatgcaggatccggggatggccccag

SEQ ID NO: 78084 - DNA, 30 bp, Homo sapiens
  chr15:85681092-85681122
  hypo
gacgaaatgaagctgcggaacctccgacca

SEQ ID NO: 78085 - DNA, 40 bp, Homo sapiens
  chr15:85728807-85728847
  hypo
gttttccacggtgttcatggatttccgtgacttgaaccta

SEQ ID NO: 78086 - DNA, 27 bp, Homo sapiens
  chr15:85886665-85886692
  hypo
gattttaacttgcgttagtgaactaat

SEQ ID NO: 78087 - DNA, 30 bp, Homo sapiens
  chr15:86251040-86251070
  hyper
aaaatcacatctgctcgtgtttttcctcct

SEQ ID NO: 78088 - DNA, 30 bp, Homo sapiens
  chr15:86606387-86606417
  hypo
gggtgaggagatattcgttgccactcctgg

SEQ ID NO: 78089 - DNA, 37 bp, Homo sapiens
  chr15:87115915-87115952
  hypo
cagggcacaggagtccgaccatcgccacagctgctcc

SEQ ID NO: 78090 - DNA, 30 bp, Homo sapiens
  chr15:88649077-88649107
  hypo
ctcaataccttctcacgtgagcaccattca

SEQ ID NO: 78091 - DNA, 38 bp, Homo sapiens
  chr15:88783191-88783229
  hypo
cagccctcggtgatgcgcatgcacgccaaagcttaata

SEQ ID NO: 78092 - DNA, 30 bp, Homo sapiens
  chr15:88798166-88798196
  hyper
ccagtccccagccctcgatctgtcctctcc

SEQ ID NO: 78093 - DNA, 90 bp, Homo sapiens
  chr15:88798564-88798654
  hyper
cgtccaaagtctccccgcgagcagccagctcgcaacttgtttacttgtcagcatgttttgctgtttccaaatggaaatagttaaacacct

SEQ ID NO: 78094 - DNA, 265 bp, Homo sapiens
  chr15:88798724-88798989
  hyper
cgctgccgcctctgccaaagaatcgaacctcgtctactttattccacttgagcgtggccaaactgttgctatttagtggggagcaaaaaaaaacaatttgcaccatcgaaacgagccagcaactggttgggaggcgggcggtagctgggccccgcgtgccctcggcggccggggtcctctccggggagaggcacacacacgcatagccggatcgcgcctcgccagggccggagtcacctggaatgcgcagccggagagcatctcc

SEQ ID NO: 78095 - DNA, 963 bp, Homo sapiens
  chr15:88799036-88799999
  hyper
cgagctggggcgggcggagggccggctcccggccgcgggtgggcaggagggagacgcagagcgcgggggaggcaggctggggagcggccgcctgacttacatggaagtgatattccttgagatgtccgtgatgttgatactggcgttcccattgctgttccctgaatcctgcccttccaggagggggaagaggttcccatcgtccggccgccggcaattgatctcagtcttgctgcagacacaatttgcagggcaagccagcacggagcccacatagtccagccagacgcttcccagcaagaaaatccgccagaaactacacttggctgggcaaagagagacatccatctccgatcgctgcttctaaaaaagaggaggaggagaggagaggggggtggggtggggggagtggggagagcagggggggaaggaaacaaagacggcgagggaggggggaagggggagggggggcctctgcctttgaaacgccgagcgatcagatgcaaaatccttcagcgtctgaaaccatcgcggacgccgccgccgccgccgccgccgccgggtgggagccgcgaggagcgcctagtggcgcggtctgccgggcatggtggccggctcggcgatcgctgactcgccgggtccgggggctctggaagcgaggcgcgctctccgactccgagactttgcagggttgcaacagacggtggggaggcaaaaaaaaaaaaggaaaaggaaaaaatggtgctaaagtcaccaagtcccacctactgggcagaattaaaacggacacaccacgcacctgcaaaacacacacactcactctcacacatacacacacccggagcccgaggaaaggaagagaaggaagatgcagtaggagctgcagcagccgccgcgaatggctcgccgcgcggctgcagaaatgtacaagtgctccgagccttacgaaacgcacgggttatc

SEQ ID NO: 78096 - DNA, 302 bp, Homo sapiens; identical to SEQ ID NO: 1234
  chr15:88800000-88800302
  hyper

SEQ ID NO: 78097 - DNA, 592 bp, Homo sapiens; identical to SEQ ID NO: 35898
  chr15:88800412-88801004
  hyper

SEQ ID NO: 78098 - DNA, 4 bp, Homo sapiens
  chr15:88801005-88801009
  hyper
gatt

SEQ ID NO: 78099 - DNA, 152 bp, Homo sapiens; identical to SEQ ID NO: 35900
  chr15:88801088-88801240
  hyper

SEQ ID NO: 78100 - DNA, 30 bp, Homo sapiens; identical to SEQ ID NO: 35901
  chr15:88801449-88801479
  hyper

SEQ ID NO: 78101 - DNA, 38 bp, Homo sapiens; identical to SEQ ID NO: 44336
  chr15:89142361-89142399
  hypo

SEQ ID NO: 78102 - DNA, 30 bp, Homo sapiens; identical to SEQ ID NO: 44337
  chr15:89145873-89145903
  hypo

SEQ ID NO: 78103 - DNA, 92 bp, Homo sapiens
  chr15:89147588-89147680
  hyper
agcccggggaggggacgggactggctctggtgtctcttctggtccgggcacaactggattcagcactaatgacggactctaccccagcggag

SEQ ID NO: 78104 - DNA, 1726 bp, Homo sapiens
  chr15:89147722-89149448
  hyper
cgcggaccggcaccccctcccccaaagctgttgccatggccacaggggacatttgatgtgaagcgcggctcccccctctccactcgctttctccgctcgccttcaggatgacgtcatgaacatccgtggccctgacaggccacccgtgggttggtctcagctttaaagcagctgttctcctctggcccggcagccgcggcgactgtgtttgcacccggcggaccatgccaggactacggacccggacaggactgatggcctcagagaggcaagtattcaaggggcacttcacaaacagcttcctcaaaccccaccccctcccccgcactgcgctgctacttgcactgcggctcctggggggaagcaaagtaccggcagctgggtggtgaggggctttcttccagaaagaaacggagagcaagtggtcttcctccctagccgcggcgacccatgccaggtaaaaatcccagccgaggtccccggtcccgtcccctcctccaggtcaagggctcgggactggagaagcagccaactggagctgatattcgggaagctaagcctgaggctgctctggagggccggagaagcgagcggccaggcttggcacccgccaaatgtgccttgccaaaatgaagaggaaggaaggcgactccggagcccagcaggtgagcgctcctacgggatgctgggcaggctagaggtgtgggggcgtctggttccagtacctgcccggggcgacgcggaaacccagcttgcagtttgtttcgctcggtcccgcgcccagtaggagaaagacggccccacagcctcgcgggagccggctctcgcaacccagccgccccaagcccgccgtcgcccctcctcccgcgcttctcgcccctgattctagatgcagctgacttgttgcatgcagaagagcagctgggttcggcgttccaagcctctcctctttgctttgcctgccaccagatctgagcgccaggctggccagcacccagagagcccagagccgcaggaaaaaatgtgaaaagtaccaggagaccactgggtaatcgccccagtgcaaagggcctttcttcctacccaccgcaattgcagcaaataactccagggaggggaatcagaggcgccggggattgcgccctgggagagccctatctgctgaaagagagcgcctaatgccgttacttcccagtgtagcctttccactcggcagaccaagcgcctctccttcgagtcgctacccgcttggagtcggctcagaatcaggctgctaaaggtccctggagcccctcccccagcgaatccgagcctgcagcttcagcaccagaggctggacagcgccccggccctagggtgcccatggtcggtgcctgcgcacggctcggcctcccagcccacgccacttgcgctcgcggcccctcagaccccacgcggaggaggtcaggaggtgacacaggttcgcggaagaaagcgggactcatcttcctcatttctccagggatttaggtgtgggattctaggagagcattctctctcgctctggccacgaccagtggaaaaacttggcgccaaatttaggcagtggtgcggggagcagaggcacgattgcaggcggtgagcaaaggggcaagcgggacagaggatctactgtgagccccaggctctggtgttccgtgaaaaatcgccacatttaaatcctgcgctcccccgtgctccctctcgc

SEQ ID NO: 78105 - DNA, 69 bp, Homo sapiens
  chr15:89195448-89195517
  hypo
gacaggctgttgtggcgtgaggccaagctggaccactgcaggcgtgtctccctgcgggtgctgagtgag

SEQ ID NO: 78106 - DNA, 606 bp, Homo sapiens
  chr15:89248377-89248983
  hyper
gggagccccctccaccgggcgtcggggccctggaccccacagcaggggcggggaggctgacgggggcgcagcttttcctcctgagtgttcgctgcccgggctggcggcgcggagccggcccgccgccgtctgcccctctgcccggcccttttttccagcagttctgccaagaggagcggggtgcggggcaggagatgaggaaggaggaggagaagaaaagggagaggagaggaggagacgcaaagggaagggaggggtgggaagggaagaggaggcaaagggtggggagaggaggggaggggaggagaggagaggggaggggagggactggatcgggcgccaatcccgcccgccgcgcgccgcccgggctccctcgggctctcatttaccccggccgctggcagcgggacccaggcgccttgccgcctcgctgcggccgcttggtccccacgccgccccctccgcaggcgacgaggcctgcagaccggactgggcagccactcgggcgcccgcggcggtgggcatcatcatgcttcccgggcaaacagcacttccagccagagggttcgcggggcctgcactgaactctctcgactctcactgtgg

SEQ ID NO: 78107 - DNA, 90 bp, Homo sapiens
  chr15:89312794-89312884
  hyper
cgggcctgtcccgagcctcctgtaagctgcttctgcgccctgaacgctgcctgttgtcccctccagagcgcctcgcggctcctcctcctc

SEQ ID NO: 78108 - DNA, 324 bp, Homo sapiens; identical to SEQ ID NO: 35905
  chr15:89346003-89346327
  hyper

SEQ ID NO: 78109 - DNA, 448 bp, Homo sapiens; identical to SEQ ID NO: 35906
  chr15:89346346-89346794
  hyper

SEQ ID NO: 78110 - DNA, 422 bp, Homo sapiens; identical to SEQ ID NO: 35907
  chr15:89346881-89347303
  hyper

SEQ ID NO: 78111 - DNA, 30 bp, Homo sapiens
  chr15:89383259-89383289
  hypo
agagccatctctacacgctacaccctcgac

SEQ ID NO: 78112 - DNA, 57 bp, Homo sapiens
  chr15:89390579-89390636
  hypo
gctccaggccgcctacgaagcaggctatgagcagtgtgacgccggctggctgcggga

SEQ ID NO: 78113 - DNA, 208 bp, Homo sapiens
  chr15:89422160-89422368
  hypo
ccaaacccacaggcccgcgcttggctattccactcacccttgagggcagtagcgaagcagaatacatcatagcggtgcaggcggcggtggcgggggccgtagcttcgcacgccaggtgccaggcccgggccaccgcagggctgccggggcaacatgatggggtactgcaccgtggcatcctgcagccagcccgcgttgcaccagtcca

SEQ ID NO: 78114 - DNA, 218 bp, Homo sapiens
  chr15:89437619-89437837
  hyper
tgccaggtgcatgtccgcactgggccttccgtgagtacaagtcccccaggtaccagcaggaggcagcatcgcccgcgaggtctgcacgagcgctgctcccagcgagaaatttgacatccctgtccctgtttgcacaaggcttgatctccgcctttgaaacctgcagcccccaggagaatgaaaaccggaggtgtttcccaatccgctggcccgggcgg

SEQ ID NO: 78115 - DNA, 91 bp, Homo sapiens
  chr15:89438330-89438421
  hyper
ccgaccctggacagacgacaggggagagagccaagcggaccctggcaggaagggggctggaggcggacggtggtctcggaggccacggggt

SEQ ID NO: 78116 - DNA, 84 bp, Homo sapiens
  chr15:89438779-89438863
  hyper
agggcagaaaggaagcggcagcagaaaaacccccgcgctcccgccagaccagccccttaaaggaacacgcgcacctttccctcc

SEQ ID NO: 78117 - DNA, 20 bp, Homo sapiens
  chr15:89448511-89448531
  hypo
taataaatcattcatcgggg

SEQ ID NO: 78118 - DNA, 39 bp, Homo sapiens
  chr15:89651830-89651869
  hypo
tctgctctgtttgttcgtgctttccgcactgtaagttgt

SEQ ID NO: 78119 - DNA, 30 bp, Homo sapiens
  chr15:89760580-89760610
  hypo
agttaaacttaggtgcgggtgaggggcagg

SEQ ID NO: 78120 - DNA, 449 bp, Homo sapiens
  chr15:89876378-89876827
  hypo
agcagacctccacgtcgaacaccagggcccgctcctcggggatggccacgggtacggcctccccctcggggccgtaccgggtccagccctccgcccaggcccaagccgggggcttcgggggcagctgggcctgcaacagcaagttggccgcctccaggtagggcaggctctgcttctgggccaggaggcggaagtgctggtccaggttgtccccgtagaggggcggcaggcgcagctccacgtcgggcaagggcacggctggctgcccccagagcccgtgcttctgcaggtgctcgacgctgcggcgcaccgcggcctcgccaggcatctcccctccttgcccgaagatttgctcgtgcagccctctcgagagcatctggatgtccaatgggttgtgccgcagctgcccgccctccgaggatagcacttgcggctgctgaggctgctgt

SEQ ID NO: 78121 - DNA, 208 bp, Homo sapiens
  chr15:89876887-89877095
  hypo
gacgcggggacggagctggagacccagcgccccggagctggaaccggccctggcccgacggtggcgccggccaccttcctccagagcaggcggctcatggttggtgcagggacccccacgctgggagtcagaacacctggctttgggctccagcttggcttcttttactggctggaagacgtggagagagacacgtcctgtctctgct

SEQ ID NO: 78122 - DNA, 498 bp, Homo sapiens
  chr15:89903388-89903886
  hyper
atttgggcagcaccccggaagaggcttgcaggataggacacagcccacaagaatcatccgaggctgcaccgtgaccagcccctcaagacagagcgagacccaaataacccccgcgggcggacccgcagcgttctgtgactccaccgcggagtccaaaaggcagctgagggtgggagcggaggggaagggaggggggccacaggcgctcgggcgagggaggcgcgtcaatgggccgcaggggccggatcggtggcctaatggattcaggcctgcacggcagaggcgcacccggcggcctgcccgcgctctcaatagcggacaatggagtcccggggtgacctgaacaaagaatttggaagtagttaaactgcagaacacgttctcggcctgggtgcctcctttcaaaaggagcgctgggagaagaaaagaaagcactggggggtgaagggagtgagaaaatgcccaggggaaaagttggtaggtcgccctagttgccgc

SEQ ID NO: 78123 - DNA, 107 bp, Homo sapiens
  chr15:89904905-89905012
  hyper
gcttctgtctcccttcgaccgatcgccccctatcctgaagctttccaatgtcatcttggagccccaaagtttcctggggcctccgcgttgtgcgtcccagaacccct

SEQ ID NO: 78124 - DNA, 145 bp, Homo sapiens
  chr15:89905745-89905890
  hyper
cagagaagcggcgcgcggccaggagcccccgctccgccactgccgtgcctgcctcccgcagctgtctgccatgcgctcgccggggcaggggcgcccggagggcggctagagctgggcctgagcccgggaacgcgcctgatcaggg

SEQ ID NO: 78125 - DNA, 145 bp, Homo sapiens; identical to SEQ ID NO: 35911
  chr15:89906124-89906269
  hyper

SEQ ID NO: 78126 - DNA, 194 bp, Homo sapiens
  chr15:89908822-89909016
  hyper
gcatctgaactgaatcgaaatcaggcttttaattctttctcccaaagccccaacccgccctaggcttgcaggccggcctccgcgcgcggttaccgcgagtctcgctgaggagccattttgtgcagcatcctgcttaaatcacactccgaggggctcgttcctcgctccctcttccccctcgcttcctctctttc

SEQ ID NO: 78127 - DNA, 30 bp, Homo sapiens; identical to SEQ ID NO: 12296
  chr15:89909322-89909352
  hyper

SEQ ID NO: 78128 - DNA, 1800 bp, Homo sapiens
  chr15:89910390-89912190
  hyper
ccgacctgcgctcaccgggacacttaattcttcctccaatccctggtctctgccgcgtgggctagatctactgcaagtgctgggcatggggaaaggaagagagaagttaaaggtgaaatggcttctgctctcggcctctccgtgagcgctctcggccctcctgtggagatcgccacgtcctatcacacgcgtccctaaaccttgtcactcgagcattcttgtctcccaaactctgatggtccgcagtgggtactgggctccctgggccctgggaggaagacggaggagtttgggtgaaagatcagacggtgcgcagccctgaggcttctgagggcagagggtgcgcttccttgccctcggggcggggaagccgtgaacgccgaggccattgtaaggctgggtggtgcggagcgcgggaagggggctgggatttgaatgggagcctgtgattggccgatccctggactgacgtcacttccccgcggggcgattagcctgcgagaggagggccggcggtccagtgcgctgggggcggccggggcgctcgaggctctctaagcgctccgcgcgggtgccctacgtgagccccgggacgccgtcgaggcaggccggcagcgccggtgccaggacgcacggaacggggagcaggggagaaatgcgccgggagggcgagggaggaagggaactgggcgggggctgcgggcctaggtggcgggagtcagcgtgtgcgtgtgtctgtccatcccctctggctctccgcgtgcgccccaggatccgggcacggcgtccgctcaggctcccgcgctcggcaggcagcagcacgtggagcccacggcgcggcagcggcactggctaagggaggcccgtttctctctttggttatctagctgtatgagtgccacagagccgtcataaagctagataaccgaaagtagaaatgattctcacaacttctgcgtgcgagcgcccgccccaccgaccgccccggcccggcccgcaagagccagaggagccgagaggagcccagcgccggcccagcggactccagctcgacggagcggccgcgccccgaccaggtacctgacctcggctctctctctggggacacttgcagtgccagctttcccccagtcctcctctttcctggtcccccacccctatcccccagcgccggagcaggaaccccaaagtggagcgggccggggagagggagggggttggggttgcagaggggtcgctggaaggggaaggcgccagccttcgccttcaccccataaatcaggctggaacaatccgctcccggagccgtggacggggattttgggatgcaaatgcgatgggagagagacagcggtcggtagggggtgggtggagggagtgaatggggtgggctgggggctgccctgccgctaacaatgcggcctttatcgaattattcgacgagtcagcccctgagcgccattagcatacggctggggggttgccggagcttcgcccctcggtgaggtcaagttcttgataatttgatcacttttcacgggctctggcagctgcctttgtgtgcagttggggggtctgtgtgcagcgtgaagcggagcagaactggcggggagtgcgctcaatggcaaggggccagggcaggggcctccctccccgacgggtcggccctgccctgcatacaaaccaagagccggcgggtgggcgggaggaaccgagctcagtctcccgctacctctacgccagccccgaccgggctgctcctgcccaagcctccccaacttcccgcgaggttaaggtgca

SEQ ID NO: 78129 - DNA, 30 bp, Homo sapiens
  chr15:89912514-89912544
  hyper
tcccaagctccccagcgagtggctgtagac

SEQ ID NO: 78130 - DNA, 699 bp, Homo sapiens
  chr15:89913180-89913879
  hyper
tcctactttggtccccggttctcctcagagataatcatgggcagaaggttttctgaatccctttgtaccccacctccattttgaaaggccagtttccctttttttctgacaggaggctggtgaagggtgactagagtgtttcgggattcacgaggctatgggctgcatcccttgggccgtccctcccttcccaatgcacctgggagcctgtgtgctgatggtgacctcatttcggaggaaaccggagcagcacttcctgcccccttgccctgcactccctgccttcctccctcaccggccaacgggtgtgggcaaaccctgggccccgggcttcgatcttcccctcccaccacccctacccgtttgctgtgttgcaagaactagtccttcacttgccagggtggctttgcagcttcccagcagtgtctacacagttcagatgagtgttgttgttaaacaccactgtcccataccatctgggcaggtctgaaacccgagttgagggtctgatgaaggaggagtctgtgcgggagggcaacgcggcattttcccgctttctacgaaaatctgttgatgcaaacctcccgcttcagagaaagatcgcggcagcagggctgcggagggcgatgagcatgccagttctaatctccaggagcccatcccacaccttccttaaacggccctcggagagaggccaga

SEQ ID NO: 78131 - DNA, 315 bp, Homo sapiens; identical to SEQ ID NO: 35916
  chr15:89914135-89914450
  hyper

SEQ ID NO: 78132 - DNA, 619 bp, Homo sapiens
  chr15:89914866-89915485
  hyper
cgagccggcctgttcgctggctcgggcgcccggttccgggctgggcaaggagcgcttggccatgagccgcgggacagcccaggcgggacggatgcgccctccagggcccaggcgaggccgcgcggtgcagaaccgccgggatttctccaacccgggtatgcgcacccacagcagcggcctttggaggccgcggcgccattttagtggccttccttcccccttggcatctgtcgtgtatggtgtggctgggtgtccccagctccccccatcccgctctgactttggctgccccctccgccagcctggatagagtgaccaatcagctctgacctagggtgggatgcgcgtcaccatggcgacggctagggcgccctggcagtgctgcccatcgcagagggcaagtcttcactccgcctagatgggtgtgaagggaaggtggggacaggtgggggggaggggcggatggagggaggccgtgatgcctcgtccgcattcccaccccattttgcctagggtcagttcagctgggtcaggcaggggacaaatggatggtgtggaaggggcctgggtaggggcctgggtttgtcctggggcggctcttccacgagtcctctcatcc

SEQ ID NO: 78133 - DNA, 132 bp, Homo sapiens
  chr15:89918751-89918883
  hyper
agccctgttctcacccgaggtctgttaatgagctggggacaggtgagcctcacacgttccaacttggctgccttcagcggcatccaggagcagtggtgagctattaatggaaggtgccggctttgtgctaat

SEQ ID NO: 78134 - DNA, 99 bp, Homo sapiens
  chr15:89921939-89922038
  hyper
ccaagattcacacctcgtctacaccagggcaccgcctgggcctacggccttccgaacccgaagcgcccgcagcccagagctggcatcaggccatcaggc

SEQ ID NO: 78135 - DNA, 269 bp, Homo sapiens
  chr15:89922499-89922768
  hyper
ggtaagagcccccctgactgggctgcccaccccgggcaggggcggaaacggccttccccgcgtggggaacaatggcgttattttggagtctgcaaccgcgagcgcttcaagctctttgattattttcgaggagtgttaggtgcgtggctaactcccgcgttttcttggaaccacgaagcccaaaatggcgagcgggccgtggccgccctcctggggctgagtgtggtccggagcgctgagagtggccagggagccgtgggcctccatcg

SEQ ID NO: 78136 - DNA, 1149 bp, Homo sapiens; identical to SEQ ID NO: 35920
  chr15:89942626-89943775
  hyper

SEQ ID NO: 78137 - DNA, 125 bp, Homo sapiens
  chr15:89945164-89945289
  hyper
ctgacctacctagtgcgtgtgtttagattcccgatgattcatcactgacacgctgatgtcagaggagcctgggaagatgtttacatctttttaaaaaagggaaagcgaaacgtttttctgcaaaa

SEQ ID NO: 78138 - DNA, 39 bp, Homo sapiens; identical to SEQ ID NO: 35922
  chr15:89949371-89949410
  hyper

SEQ ID NO: 78139 - DNA, 326 bp, Homo sapiens; identical to SEQ ID NO: 1240
  chr15:89949616-89949942
  hyper

SEQ ID NO: 78140 - DNA, 501 bp, Homo sapiens; identical to SEQ ID NO: 35924
  chr15:89950236-89950737
  hyper

SEQ ID NO: 78141 - DNA, 296 bp, Homo sapiens
  chr15:89951081-89951377
  hyper
ggatttaagtaccttggcgaggcagcgcaggcggctgttctaatcgccgtctccaagtacctgctcatgaataaacaccaaccccatttatcaggtacttagcgctcattgtgaaggggaaattggcccttttctgaaattgtctatccacaacccatctgcgcagttctggttgcagaattcccctcacccttgagacacacacacacacacacacacacacacacacacacacacacactcgcaacacgaggctcctccaagctaagataaactcgcttttcttccggtaagtg

SEQ ID NO: 78142 - DNA, 988 bp, Homo sapiens
  chr15:89951465-89952453
  hyper
cggaatgcagggccttaggaaagccctgtccggcgttccagccacaggggtcacacttgcatcaacatgcgggcacgctgccccttgggtaccccaaacattgagcaaaatattggaaaggtggaccgaggtgtctgtggtgcctgccagcattggtcgggtgggccccagctgtaccctgggttcccctactttcccccagttgggccccacatctgggtctggctcttaagtcttgggcatatgggatagagaatttaaggatccagatactttgcaatccccgggctagtaggaggaaaagtggctcctctgggaacccggatgggccgaacagcagcttccggcagaggccctcaggtttcagagttctccaagtggggagaagggcggcctgctcagcccgcgcacccgtggcagcaccacagagggaataaaagcagggtaaacaatttgaagatccccacgaaggcaagagagtaaatttacaaactcatttgcgtccggaatacttgcttctttttcactcatacattccttctaaaatgtgggctttctgtgtacatgggcgcgcattcccaggactcggttccctgggtggaattcacccaggaatacaatcgattttctgaacctgcgtaaggccacaggcagctctgaaaatgaaagcgtttgctaagtgggggagatctcaccgatcgaacgtttaaaaatggctttgtcttcattcagctctcccgatttattctgtgttttacaaatagaagctcagagcttctgtcgcccagtccttgcatgactcatggcggtggccacacgggtttcagggataacgggatgtttagaaaatcgctgcatatcggagtttcctagcacgttccatttatactgaacgcaggcggccgctgaaaatccagcctcgactcttgctaatgactgggtaggaccctcggggtcctgcgacggtgctggagggtgttcccggctc

SEQ ID NO: 78143 - DNA, 431 bp, Homo sapiens
  chr15:89952699-89953130
  hyper
cgctccaaacacagatgctcatttttggaatattctagaaaaataacaagatcttgtttgtcgttatgattcacgggaggtaactgatgggagggccatttacatgagggcagacactgtggggcgaaggtgacttctggacgtaggctttaaagtaggaacggctccaaattcccaatatctccggccttaccggttgcaaatcggacccctgcgggaaaaccagacacttctgtttcgtggctttcgggctgcctccagcccacgcaggctcgtttagtccccgtggagtcagccccgagccttcctagtcctggaacaagggctccaggtcgcggccgcgggaagccgccaagagggcggggagtagggattccctccagctccgcagggcatctcacaagcgccttcttctgcgccatctccccacc

SEQ ID NO: 78144 - DNA, 645 bp, Homo sapiens
  chr15:89954197-89954842
  hyper
gcttaactcccatgacgtcagatcaccacttagagcgtcttgatgcccaggctagaaggatctcggttgcaccagctttccccactgcagtttcaggttttgtcccgacagactttcagcaagcggcttagctcagccctggcgctgccttccaggaaagaggggcagcagcagcctcggctgagccgggtgcccttgtgggctatctggtgggggctcgcgggtccttgccttctctgcctggggtaggtgggaggtaggttcttgaacttcccggggcttctccctggcacactttggctgccacatcacggatggaaacgctgaggccaatgggctcaggttcgctagcagcaggcagccggccctggtgtgcccgctgtggcctgggtgctctgcatacccccgcgcgcgcttgctctgtgtggggggctggcagataggggtgttcctaggggccacgcggggggaagggggtggcggggccggtcttgcgcttcccacgctccatctgttcagttcactctggtggtctctgttccagtctggcctagggatccctggctccccacggccaagccgagaactagcgggcgcaggttgcattgtgcagactcccggggtcaggtcgcagggtcacgtgca

SEQ ID NO: 78145 - DNA, 184 bp, Homo sapiens; identical to SEQ ID NO: 35932
  chr15:89955001-89955185
  hyper

SEQ ID NO: 78146 - DNA, 54 bp, Homo sapiens; identical to SEQ ID NO: 35933
  chr15:89956300-89956354
  hyper

SEQ ID NO: 78147 - DNA, 151 bp, Homo sapiens; identical to SEQ ID NO: 35934
  chr15:89956422-89956573
  hyper

SEQ ID NO: 78148 - DNA, 221 bp, Homo sapiens
  chr15:89959838-89960059
  hyper
gtgcttttgaaccaacgcagacctacagggccgacttcctgagggcgaatgtcgctttgctgcagcggggcacgggtttggttcccggcggggcctggcctgggaagcgcggggctgagggcgatgcccggccgctatcccgagtcggtgcgtgcctatgctgcaggagggccaccaggagctctgcttctccgctgcacccggctcggagcaggcactca

SEQ ID NO: 78149 - DNA, 148 bp, Homo sapiens
  chr15:89962805-89962953
  hyper
aactcgggctgcctccgttggggtcaccgacagaggctcacttgttcaggcacttcctgggtcagcctttccgcctctgagacgggctctcccatctcagatgggagattctgcctggaagggaagtagtccacgccatcatcattcc

SEQ ID NO: 78150 - DNA, 629 bp, Homo sapiens
  chr15:90039431-90040060
  hyper
tctgacaatttcccacgcatgccctgcagaggccggcgagatgcggagtccgcggctgcagggtagatcccctcctctgcccagctctgggccgagcccttggccaggtggggaccggcgcggatatgcctccgctgggcctgcaggcggcgagacttacttgggtagcgatagtagaattcgttctccatgtcgctcaagttcttgtgcgtcctctctgaccaccagtgggcgtcggcctcgaagtcgtagcgcacgaacaccccgaagagaatcaccataatcacctgcaggagcaggcaggtgagcggcagccgccagcggaggttggtgttccaggccatgctgcaggggtgcctggccgggctggcagcgggcggttcggacgctcggaggccggcggggcttttgagacccgggcaggggggcggggcggccacgtggggcacggagcagctgactcgggcaccgcccgcgcgctcgcccaactggcaggggcccaacccaagccgagggccccaaaagattccccgcgtcgggctgggggacagcggcaggagcagaggctaaggcagtgggcaggaggatcagggtgccccaaattctgtgtgtcccgttgatactggggc

SEQ ID NO: 78151 - DNA, 329 bp, Homo sapiens
  chr15:90109270-90109599
  hypo
tttctcatcttaattaaaatatcttgagtttactagttggctgggacacaacactcgccacctcgccacacttgttttttgtttttttttttctggagcagtttagccaactgaaaacaatttcaatccaatcactgatgtaaaccgaaggtatgagagccataacccaggttcgatttttgcttttttacaaatatgcttttcaggggtagaaattccatgctattaggctgttcttaaacttttccattagaaaaatgccataggaatgcagaaaagggtgtggtaattccgcctggggaattcaggaagagcgagagagaagctac

SEQ ID NO: 78152 - DNA, 257 bp, Homo sapiens
  chr15:90198157-90198414
  hyper
acccctccgcgtgagcgttccgagcccggtgcagtcccggcttccgcgcgcccctgctctccgcacagcgctcccgctccgaaggtgctctgacaaccccgcaggcgctattcggagccggggcagggcagctggggctggaggcggcgggcgcgggacggagctccatgaaagttggaagaagtgattacaaatcgggacccgactctcgcagccttggcgctcgcccctccacgcaggcccgggatgccggcctc

SEQ ID NO: 78153 - DNA, 102 bp, Homo sapiens
  chr15:90293464-90293566
  hyper
ggagagacggaacagcgcagccctcaagcactggtggccttgtgcgggtgtccgcgctcgtgggctccactctcagggggcccctagcgaggggagacccag

SEQ ID NO: 78154 - DNA, 62 bp, Homo sapiens
  chr15:90304847-90304909
  hypo
gcctgggacctcatacgagctgcctggttcaggcccttggctagctccgggtgctccatctg

SEQ ID NO: 78155 - DNA, 158 bp, Homo sapiens; identical to SEQ ID NO: 35939
  chr15:90319855-90320013
  hyper

SEQ ID NO: 78156 - DNA, 25 bp, Homo sapiens
  chr15:90320089-90320114
  hyper
cgtggccccgcagaggcgcagacgc

SEQ ID NO: 78157 - DNA, 46 bp, Homo sapiens
  chr15:90349846-90349892
  hypo
aggccaggcagagaacggagcagccccaggccgggcttatatcccc

SEQ ID NO: 78158 - DNA, 177 bp, Homo sapiens; identical to SEQ ID NO: 12318
  chr15:90357883-90358060
  hyper

SEQ ID NO: 78159 - DNA, 348 bp, Homo sapiens
  chr15:90358102-90358450
  hyper
cgtctttttaaagggaagtaaccggacccgaccactactccacccgattcacccctagcgggccgcccgcccgcagctccgcccgggctcctcccccgtccgcccgcggcttcccgggagccccccagggctcctccgctcctccgacggcccggccttccccccggggcctgggatgcaccagggctcctgctgcccccgacggggtccctgtcgccgcagcccgcgggacccgccggccacatctggacggcatctgccgcgggggaggggctcagagcctcgccctgagtgtcccgcagggagccttgtgcatccggggcaggaagccagcgcatcccgtgcaga

SEQ ID NO: 78160 - DNA, 157 bp, Homo sapiens
  chr15:90455810-90455967
  hyper
caggggcgccgggagcggcggactggaggggcggactgaaggcggagaggcggctttggcaaccccagttttcccccacccgcatcccacccccccacccgatcctgttgcggggttcgagccggggcaggggaggccgacccgaggccgtgagccc

SEQ ID NO: 78161 - DNA, 30 bp, Homo sapiens; identical to SEQ ID NO: 44342
  chr15:90501049-90501079
  hypo

SEQ ID NO: 78162 - DNA, 149 bp, Homo sapiens
  chr15:90501280-90501429
  hypo
actcttctacctgtccggagggcctctctgccccttcctcccacatgctctaagcttggaggaggagttgctaagtgttaattgggtcctgtttggcagcggatggggtcactgtgttgaacatacctcatgcccgatgctccctaggc

SEQ ID NO: 78163 - DNA, 218 bp, Homo sapiens
  chr15:90541900-90542118
  hypo
ttggtgcttatgtaccggacaccatgctaggtgtggggtttgagcctcacaacaaactgtgaagcaggtatttttatccctattttacagaaaagttagagaggttgacttgcccaggaatatgcagcaggtaagcctgggcccttaaactaagacactgtctctgcaatccacaggtcttcttacctgcattttatatgtcccgaaattaagtcgaa

SEQ ID NO: 78164 - DNA, 58 bp, Homo sapiens
  chr15:90630550-90630608
  hypo
tccctccctgagcctcggagctgagccaaatgcactctaatagcgaccttcccagggt

SEQ ID NO: 78165 - DNA, 43 bp, Homo sapiens; identical to SEQ ID NO: 44345
  chr15:90667422-90667465
  hypo

SEQ ID NO: 78166 - DNA, 82 bp, Homo sapiens; identical to SEQ ID NO: 15920
  chr15:90703242-90703324
  hypo

SEQ ID NO: 78167 - DNA, 29 bp, Homo sapiens
  chr15:90741425-90741454
  hypo
ggcgtgagccaccgcgcctggctggtaaa

SEQ ID NO: 78168 - DNA, 30 bp, Homo sapiens
  chr15:90747910-90747940
  hypo
ttcccagcctggccacgtggggagaaacaa

SEQ ID NO: 78169 - DNA, 30 bp, Homo sapiens
  chr15:90753833-90753863
  hypo
tgacatgacttaatccgtttaaagggctga

SEQ ID NO: 78170 - DNA, 296 bp, Homo sapiens
  chr15:90755756-90756052
  hypo
actgaccccaaggtgcgccagcccctcgcaggaagtaaagtgcagaaacacctccacccctgcacaaagagcacctaggagtgagtgcgcaagcgtggacaagccctgcggtaccgtgtacacacacacacacacacacacaccacaggcaagctcaggcagggtccttcacagacgtctgcagtcactctggaggtgacccaagcacctgggcccttagacagtaacaccactcacaccgagcacagaccagctcgcgcccacaacacgagcctgtgacacgcaagtctctgttt

SEQ ID NO: 78171 - DNA, 30 bp, Homo sapiens
  chr15:90835095-90835125
  hypo
attctagtggggccccggttatgcctcttc

SEQ ID NO: 78172 - DNA, 158 bp, Homo sapiens
  chr15:90859564-90859722
  hypo
aactatgagatttaccgagccacatggcctggagatggaaacatcctcagggaatggtctggtgccagagactgttcccttaatgggcttttactgttcccttagtgggcttttactactgtgtgtttgattcgcttcatatacacacaggcaacttg

SEQ ID NO: 78173 - DNA, 80 bp, Homo sapiens
  chr15:90866273-90866353
  hypo
taaggaaaagaccaccgcagtggctcagtgctcttgctgacgtgccccactgcacttttctgcaacgttccttctttcta

SEQ ID NO: 78174 - DNA, 36 bp, Homo sapiens
  chr15:90891911-90891947
  hypo
gagcatgtgaaaatgcgttgacggtgtgtgcggtgt

SEQ ID NO: 78175 - DNA, 100 bp, Homo sapiens
  chr15:90896116-90896216
  hypo
tcccctcctcagtggcgctgtctccagcaagtgggccctgcagctgtgttttgtaatgaatgtagaaataaaaattatactcaaaactcttttttttttt

SEQ ID NO: 78176 - DNA, 98 bp, Homo sapiens
  chr15:91185735-91185833
  hypo
agaaccactgatctccgtccgcaccgaaggcgggcccggagtgggaggctcggcctggggcggcggcaccggagagggcacctcgatgcctgctctga

SEQ ID NO: 78177 - DNA, 132 bp, Homo sapiens
  chr15:91189343-91189475
  hypo
acctgggccagctcccgccgtgtcccagctgctccccattccgtcccatggcccgtcgcgccttccccagcgtccctatgccttacgaggtcctgtttccacgtcaacctgaccttccgcaaggacttgctg

SEQ ID NO: 78178 - DNA, 25 bp, Homo sapiens
  chr15:91313690-91313715
  hypo
ccaccgtgcccggccaatccccaca

SEQ ID NO: 78179 - DNA, 27 bp, Homo sapiens
  chr15:91366968-91366995
  hypo
atagaccctggccaacggatgaaatga

SEQ ID NO: 78180 - DNA, 214 bp, Homo sapiens
  chr15:91409404-91409618
  hypo
tcacatataactcatcgctatcacagcccctctccttgctcacccgcctcgctgaggggctcctgagaacctccgtagaggtctccatcagccaaaaagcatctgcaccgtcagagagggcccctcactgccgctcgcagtgctccctgctgccacgtgcagccccttgagcatgagcctgttgacacaggttggcacacggtgtctggcttct

SEQ ID NO: 78181 - DNA, 191 bp, Homo sapiens
  chr15:91427788-91427979
  hyper
ggggcctggaggagcggtgggagctgggggcgcggcaggcaggggcagagcaggcgttccgagggccagagacccacccaggtgggggtaggggccgcggaagggcggggatggccgcaggggcagggctcaggctgtgggcgcctgaggcttcagctggggcaggcttggcctgtcgaggacctgggcaa

SEQ ID NO: 78182 - DNA, 61 bp, Homo sapiens
  chr15:91500770-91500831
  hypo
gagaagcaagcggagcgggaccccttaatgcgactgtagctgacgacggtctcccttgctc

SEQ ID NO: 78183 - DNA, 30 bp, Homo sapiens
  chr15:91504803-91504833
  hypo
aagacccagtggagacgatggcaaaggggc

SEQ ID NO: 78184 - DNA, 863 bp, Homo sapiens
  chr15:91642936-91643799
  hyper
tcctgatgaggcaaacgagaacaaagcagtcgaacagcaccatgatcgacgatactttgggggcggcgtgatcagaggattccccttcccgggaacttgcgtctagtcctctgacgcatcctagttcggagtgggtggaagggcatgtggagtccacagcgccccctcgccctaggcggggtggagacagcgagacgacgcccatgatcagctggttacaaaactcgaggaataagaagtttaatatttattggtctgcaaatccggagaccttgcggcctcactggtcctccttccctctgagctatctccacacccagccttcgatcagaaggagatttagaagcagagctgcccgcagcgaatacttttaatgcccgggccgggaagaaagcgggttaggatctgatcccgctgagtagaggacccaggagcctcccgccccgcgtgctctgtagcgcgggggcgcgctgcgcgctgcgcctgggcggctggcgggggcggcgtgggcgcggtgatgcaggtgtgacacccgccggcgcctgcctccgcccggatcgcccagctccgcgttagccggagctgcacgcggggctgccggggcggacgctgctctgcctgcatccggaggcggccgccagcggatttgccacccaggtaggggactgcgttgctcgctgcggtgcaaccgacccagccggggcgcggaccccgcgtgcgccagggctcccagactcgcctgcctgggctgaaatatacacgctcgcacagctgagtgctgttcatagtaaatggcacaaaagatcggagagtcttgaaaaaccggcgcagaaaagcaaggacttgcccgctgcctggagctg

SEQ ID NO: 78185 - DNA, 201 bp, Homo sapiens
  chr15:92456345-92456546
  hypo
ttcgtttctgaacagcggcaaacacctggtgttttaaaagtaacagtctaatcacataactagggctgagtgatctgcaagctggccttgacttgtctagaaagcacaatagaaataggagttgggatcagaatgccagagatagagggtgtcacagatgtcataaccctgctctgcagagcttgccgaaggccagggctg

SEQ ID NO: 78186 - DNA, 361 bp, Homo sapiens
  chr15:92459330-92459691
  hypo
agctacttcggggcacgcgggcaccggccgcgcctgatcggctgcggcggcatcgtcatggcgctgggcgcgctgctgtcggcgctgcccgagttcctgacccaccagtacaagtacgaggcgggcgagatccgctggggcgccgagggccgcgacgtctgcgcagccaacggctcgggcggcgacgaggggcccgaccccgacctcatctgccgcaaccggacggctaccaacatgatgtacttgctgctcattggggcccaggtgctcctgggcatcggtgctacccctgtgcagcccctgggcgtctcctacatcgacgaccacgtgcggaggaaggactcctcgctctatataggta

SEQ ID NO: 78187 - DNA, 30 bp, Homo sapiens
  chr15:92687159-92687189
  hypo
cgatgtggggagccacgtggcctgcagcag

SEQ ID NO: 78188 - DNA, 221 bp, Homo sapiens
  chr15:92701704-92701925
  hypo
tggttatggaggggacgcataatggatgtggagcactctatacagtcctgggtagggggtagttaatgatactacttagcatgacagttgccagtcacactgtcacagtctcccatttgtctatggggaaccagctccttgcagggactgcctgagtttttgtttggtccaactgagtgacgaacatataaggatgtggggctgggcgtgaaaatgagtca

SEQ ID NO: 78189 - DNA, 30 bp, Homo sapiens
  chr15:92911893-92911923
  hypo
atcactccccaccttcgtcatctccctgca

SEQ ID NO: 78190 - DNA, 80 bp, Homo sapiens
  chr15:92936360-92936440
  hyper
acccggcgtcagcaccgcgagggcggagggaaggcgggcgctgagtctcccattggggttctagccgagggttccagcca

SEQ ID NO: 78191 - DNA, 992 bp, Homo sapiens
  chr15:92936662-92937654
  hyper
ctgcctggctgaaaccgccttctcgccgcgcgctgggggctgtccccaggtgttggtctttgtgtcgagaaaactttgcgaggaggcgagggagctggacaaagagcgggcgagggagggcgtttgccagcctgaggggtgcgccgggcggtgcgcgcacttccctgggctcagctccgtacccggtcgctcgcggtggccagagcccagtctctctaggccaggagtggcgtccggctgcatccccgcgccctcgggagctgaataaagccaggcgggagaagcaaaggctagcgcctggacgctggagttggtgggaggaggcgagcagaggcgcggagcaaagctgtcaaactgcgcgcggagccgggcgcggggcgggggaagggagaggagggagggaggggcaggcgggagccgggagggagcgagcgggctcgccgcgcctgagcaacccctgcctgtcgctgccgctgccgctgccgctgccgccgccggcccggactcgtccggagcgcagggtgtctgcccagctgcgcgcggcgcgcggaggctccggcgtccgccgctgcgccctccggcccctgctcctcgcgccggcccgcgtgggtcccggcgggcgcgaacccaccatgcagctgcagttccggagctggatgctggccgcgctcacgctgctcgtggtcttcctcatcttcgcagacatctcagagatcgaagaagaaatcgggtaaatagctgctcccaggcccgtgccacgagccctggcgggatctctccctccttctgtactctccaccctccgaccccctttgtgtgcgccgcgccccgctgtagctccgctggagagatggggacggtttggcagaaggtggcggcgacaggggcccgggacggtttggggagaggagggtgggggcgcggctgctgtggggtgtccccgggcggggttcacgggaagcccccagctggcccgcgtcgggaagcggact

SEQ ID NO: 78192 - DNA, 39 bp, Homo sapiens; identical to SEQ ID NO: 35949
  chr15:92937696-92937735
  hyper

SEQ ID NO: 78193 - DNA, 325 bp, Homo sapiens; identical to SEQ ID NO: 35950
  chr15:92937736-92938061
  hyper

SEQ ID NO: 78194 - DNA, 172 bp, Homo sapiens
  chr15:92938122-92938294
  hyper
cgccgcccggtgggcttctgggccctcaggcgggcgatctggcgctttttttctcccgacctcgccagaggtagggtgggaccgcgagcccggatcctcccggctccggacttcctggagtgcgcacttgaggcgcgggacgcaccggctgtgtgtcccaggggctgagact

SEQ ID NO: 78195 - DNA, 219 bp, Homo sapiens
  chr15:92938315-92938534
  hyper
cggctcgccgggccgggcccctctccggaacctccaaagggcggtagacgacaggtggggaggcagccggggttctgaggaggcccgaggagagcttcctggccctgggcaaggggaaggtgaggtctcaaagagggcagaaggtctcttcttctgtgggatttgtgctctgccaggcgctcttctcgagtcccgcgccgcgtgcgcccctcctttgtc

SEQ ID NO: 78196 - DNA, 193 bp, Homo sapiens
  chr15:93160460-93160653
  hypo
aattgtatatgtagacgtaaaaacagcatgcatgcccctccaccaccaagcctttttcatttccaagcttttctctaatcaccaggatccaaacacctccagcccagctcccatccccgccctcctcctcagccttgggcccacccacctctgtcttcacaaaaggtgccccgctggccggcaccacagaaaa

SEQ ID NO: 78197 - DNA, 649 bp, Homo sapiens
  chr15:93198390-93199039
  hyper
ccccacccactctcccgggcagggcaggaggcacacggctggctggggcgcaccagggcacctgtgcgtgcaggtggggcgggcgcgcggcgacagcaggttggcgatgccgccctgtcggccggcgggggaaggaagagggcgggagggcccacctgaagacgcgcagcagcaggcaggcgatgaggagggtggtaaaggcgaacgccacgatcacggctgccttgagggtgggtaggtcgcggaggaggatggaaatgcgggtcaccaaggcgtcgccactgctgttggagctggagctgccgctgccgcccgccgccccagacccaaaccgggtggtgttcccgggccccgggccgggcggtggccgcgactcgcgctcgggttcgggccacggcgcggagacggactcggctctgctggcgcgggcggcgggagcggccaggagcgcgagcagcagcagcggcaggagcggggcgggcagcggcacggcgcgcatagtgcggtgggtcggcacaggatcgggcagggcgcgcgcggctgagctccaggatccgcaccagcacggaggcctgcaccgggggatcctgcggcggaggcggctgcgcggtgcttggcaggaagctgcggcgcccggaagagcccgcgc

SEQ ID NO: 78198 - DNA, 346 bp, Homo sapiens
  chr15:93257518-93257864
  hyper
cagggccggggagagcggggagaggggagcgggagttatcatttcacggacgcgatgtttcgtcccctttgatgaagcgttctggagatgggcagtggcgacactcgcccatatacgcaacggctgagtgcactccatgccaccgaactggttaagatggtaaattttctgttgtgtgtattcaaccacaattttttaagccactttctccgttctttcattgagaactccggggatcaaagaagaacgccagctgcggtggaccgctgaggaatggccggagtccgggcgcgagcgccgcttcccctcgccctcctcctctcccttcccgcggcccctggaggcc

SEQ ID NO: 78199 - DNA, 160 bp, Homo sapiens
  chr15:93360190-93360350
  hypo
aggtaagattgataccgtattcatttttatgttcctaggatccattgcaaagtgatacacgtgcacatacacatttttttaagtcagttttaatctctttacattttttaagagttaatggatggatggccaggcgcggtggctcatgcctataatccca

SEQ ID NO: 78200 - DNA, 141 bp, Homo sapiens
  chr15:93364648-93364789
  hypo
tgtctcgggggaaaaaaaaaaaaaaaaacttacacctagatctgatcttatggcaccactataattattattagattataaattccttggggataggaactttgtttcttatccatctttgtatcccgaaagtggctctgc

SEQ ID NO: 78201 - DNA, 340 bp, Homo sapiens
  chr15:93594841-93595181
  hypo
tgaaaaccagcagcccgcagtggcctcgtggggccgctcagaatatgccaggttctggagtcacccgggcctggggcaaattctagctcagcattccagctgactacgcacttggggtgggaaggtcacttggcctcttagagcatcaggctccccatttgtgaagtggagctatgcctgccaggccgggctggctcgaggaaggagggaggaagctgagacccacccccttgggatgctcagggagggtgctcctgtgtccccgctccgctccgtcttcccccattcccaggcacccgaggccctctcagcctctcagtgtccacgcagggcagagaca

SEQ ID NO: 78202 - DNA, 98 bp, Homo sapiens
  chr15:93595410-93595508
  hypo
tgtgaaagctcttctcgtaatggcagatctcggggctgtccgagcgctcctggctgtctccggccggtgggagcgtgcgcaggcgtggctgcgaggtg

SEQ ID NO: 78203 - DNA, 589 bp, Homo sapiens
  chr15:93609289-93609878
  hypo
gcaactgagggaggccgggggatgaatcggcgaaacttacgtaggttgggggcataacagctgcccttcacgggcacctccccgggcccagttacattagcggcttctgcacccttctctccttccacgacatcaaattccacagtctcctcatctccaacgctgcgcagaaacttcctgggcttcttttaatagctgtctggtgaacaaagacatcttccttggcgtcattcctgtggatgaatccgtaaccattccggacgttgaaccatttgacagtgcccaggactcggagtgccagcagcaccagcttgttcgcgtgactccaggtgggggaaacggggggcgggggtttccaaggccgccgtcgttgccagggctgccgccgggttgccacgggtgcgggggccaggcaccaagggggtcccatcccagcagcggggcccgaggcgactccgcccctgccaccgccctccccgccacctgctttctggggcttccctgcgggcactggtaccaccaccgctaccaccccgggcatcgtcgccgtggggactgccgtcaccaccgccgccgcctccacctcgct

SEQ ID NO: 78204 - DNA, 84 bp, Homo sapiens
  chr15:93615607-93615691
  hyper
ccagctcatttgagccgagtccgtgggtgtccccgcgtggccaaatgggtggaaacgagacgaggtctccggggagggggctgt

SEQ ID NO: 78205 - DNA, 478 bp, Homo sapiens
  chr15:93615901-93616379
  hyper
tgcgccctccccacacggctccatctcacggcaactcgggcagggtgcccctctccgggtccccaagggcaggcatcgcacccacgacggggtgcgggagaaacaaaagacccgtggaaataggaggcggggtccggaggaggtccggagaacttgagcccggactcactcgcgcacatctggcccagcattgaggggcggcccagggacccggccccgcgcgcccggccggcagtgccttacctgcggggaagctgcagagaaggaaggcgagggtcggccagaatcccagggctgaacgtcctgcccctctccccatacccatccatccagctcggcctgttaccactagcctctccctggaagaagagttcagaaaaaaagaagaaaataaatcacgctgcgaagaaagggcagcctcgctccgccggcgggagcagcgagccgggaggctccgtccacctcggccgcgggcgcc

SEQ ID NO: 78206 - DNA, 357 bp, Homo sapiens
  chr15:93616396-93616753
  hyper
cgcgccgccccccgcgcgcccctccctcgccatccatcactcggttctccgccaatgtcgacgcggccccgcgccccagccgcctgcgcaccgccccctcgcgctcgggtttcagcgaggccggcgaggtagccggaggcggccgggcggggacccaggctgcccggccgcagcgctcgccgtgaggacctcggaaaaccacggccctagatcagagggcgcgccacgctccccgaccctcgcgccatctccagcccgcggctgtccttgcaaaccaggcccagcacccttgggaggccgcagggcatgaggcggggcaggacgcccccttaatcccctccacgaatatccaatcca

SEQ ID NO: 78207 - DNA, 1098 bp, Homo sapiens; identical to SEQ ID NO: 35956
  chr15:93631632-93632730
  hyper

SEQ ID NO: 78208 - DNA, 535 bp, Homo sapiens; identical to SEQ ID NO: 35957
  chr15:93632731-93633266
  hyper

SEQ ID NO: 78209 - DNA, 30 bp, Homo sapiens
  chr15:93689707-93689737
  hypo
actagctggctccgccgcctctccctgggg

SEQ ID NO: 78210 - DNA, 39 bp, Homo sapiens
  chr15:93792256-93792295
  hypo
aaaaaaaaaaaaaagtgagaacagcgacagtacatgcaa

SEQ ID NO: 78211 - DNA, 156 bp, Homo sapiens
  chr15:93798049-93798205
  hypo
tcacttttggagtgtcggagacactttacgtcggtgctcctctaagtatgttccatggaccagtgcttcctgagagctatttgttaatgggttggcaggagaagtacggagatagagtgcttaggaatttccatagcatctcgatattgccagacc

SEQ ID NO: 78212 - DNA, 185 bp, Homo sapiens
  chr15:93820319-93820504
  hypo
tcaatattccgccctcgaggaggtggagcgtaactcctctctcctttcatgtgggctgtgcatcgggacttccatccagagagtacagtgtggaaggaggaactccaaaggagtacggtggagacacctgacaaacaccacctcaatcaggtggtcaaggttaagagcaacgaaccatgctaact

SEQ ID NO: 78213 - DNA, 33 bp, Homo sapiens; identical to SEQ ID NO: 44362
  chr15:93902389-93902422
  hypo

SEQ ID NO: 78214 - DNA, 30 bp, Homo sapiens; identical to SEQ ID NO: 15927
  chr15:94347602-94347632
  hypo

SEQ ID NO: 78215 - DNA, 30 bp, Homo sapiens
  chr15:94347911-94347941
  hypo
atgtcccttggcatacgtagcactctgttt

SEQ ID NO: 78216 - DNA, 157 bp, Homo sapiens
  chr15:94443196-94443353
  hypo
agctaggcgcggagccgcaaggggtgtgtgggtgaacgagcgcagggaccggcaacagccatacataccggctgctgcagtggggctggcagctccaggcgccagcacagttgtggctctgcgtgaggctggaccagatggacggcatgtggattct

SEQ ID NO: 78217 - DNA, 40 bp, Homo sapiens; identical to SEQ ID NO: 44364
  chr15:94478454-94478494
  hypo

SEQ ID NO: 78218 - DNA, 197 bp, Homo sapiens
  chr15:94495950-94496147
  hypo
ataataagatgtatgcgaggttcactcatgcaacccactgtgccattgggaaatgcaggaatgggcatgcaggactttcatagctcagatatgctcaggagcaagtcatgcagcacaattgactagtaggaaacaaaagggagaggggatggtatcagtagaatgagagacggggaaaataccgactccaagggatg

SEQ ID NO: 78219 - DNA, 19 bp, Homo sapiens
  chr15:94557099-94557118
  hypo
tttttttttttgagacgga

SEQ ID NO: 78220 - DNA, 30 bp, Homo sapiens
  chr15:94736260-94736290
  hypo
gccattaagaaaatgcgtattaaagccaca

SEQ ID NO: 78221 - DNA, 33 bp, Homo sapiens
  chr15:94774077-94774110
  hyper
attacagcaggaaagcggcgtaaaaaaaagtag

SEQ ID NO: 78222 - DNA, 23 bp, Homo sapiens
  chr15:94778186-94778209
  hypo
agccctggtggtggtcgggcaca

SEQ ID NO: 78223 - DNA, 30 bp, Homo sapiens; identical to SEQ ID NO: 44365
  chr15:94925846-94925876
  hypo

SEQ ID NO: 78224 - DNA, 64 bp, Homo sapiens; identical to SEQ ID NO: 35958
  chr15:95388665-95388729
  hyper

SEQ ID NO: 78225 - DNA, 22 bp, Homo sapiens
  chr15:95507939-95507961
  hypo
ccgcgcccggccaagttctggt

SEQ ID NO: 78226 - DNA, 125 bp, Homo sapiens
  chr15:95634811-95634936
  hypo
aaatgtcaccacgttcgcctatttgcaatgcaaatctccaggctttggcatctgagattgatgtccctagtatgaatgtacttagttgctgggctggagctgagtggaaacgacacaggtctctt

SEQ ID NO: 78227 - DNA, 30 bp, Homo sapiens
  chr15:96663096-96663126
  hypo
tgttgttgttgttgtcgctgttgctgtttg

SEQ ID NO: 78228 - DNA, 105 bp, Homo sapiens
  chr15:96864500-96864605
  hyper
aaataaataaacaaacgtaggtagctatcagttgctttagggagcgcagatatttaggaaaaggccaggagcgggaaaaggaagaagaaacgaaaaagattctcc

SEQ ID NO: 78229 - DNA, 268 bp, Homo sapiens
  chr15:96864954-96865222
  hyper
gtcctggggcttcctcggtgcctgtcacccagccccctgccttcctcctcggcctcagatgtcgtcccacctgcccacgagcagggaacctggaacccactctcccggcagtccccagcgggttccgccacccggcggccgcccctgacaccgagtgggtgggaggaagaggcagctggcggggatgggccattgagacctcttgaaaaatattaaaagacaggatgggtagagatttctccgggagaaagttcgagggtgcatcggg

SEQ ID NO: 78230 - DNA, 30 bp, Homo sapiens
  chr15:96865796-96865826
  hyper
aaatcgttcgagccccggctatttgtgtgt

SEQ ID NO: 78231 - DNA, 75 bp, Homo sapiens
  chr15:96874258-96874333
  hyper
cctatgtgtgtgaggcggcggcggcagcagcagcagcagcggctccggcggcggcagcagcggcagcagcgactt

SEQ ID NO: 78232 - DNA, 84 bp, Homo sapiens
  chr15:96876537-96876621
  hyper
ttctttgtgtttctgcgagagcgactctcccggtccggagtcagataacagcctgggcccgagcctcgccggctttccccggcc

SEQ ID NO: 78233 - DNA, 30 bp, Homo sapiens
  chr15:96883798-96883828
  hyper
tctgtgtgaaattgacgagatctttaaaaa

SEQ ID NO: 78234 - DNA, 74 bp, Homo sapiens; identical to SEQ ID NO: 35961
  chr15:96884425-96884499
  hyper

SEQ ID NO: 78235 - DNA, 30 bp, Homo sapiens
  chr15:96889448-96889478
  hyper
tctggccaggcagttcggctgcaactttca

SEQ ID NO: 78236 - DNA, 295 bp, Homo sapiens
  chr15:96897310-96897605
  hyper
ctggtccctcccagccgatgtcctggagcccccattcacaaaacccctcctggaagaggacacacacccacccacccacacacacacacacacaccccacacacgcactacgagaaggggagtttgatcttgtctcattggcgtctcgggtctgaaaggaaaatcgtttgggtaaacagccaagcttccaggcttaacgcccggctcccgcccccgcccctccatcccctcctgcctcccccactcgccttcaaccccacccgccacccacactcggctccgcagccgggccccg

SEQ ID NO: 78237 - DNA, 240 bp, Homo sapiens
  chr15:96897853-96898093
  hyper
ccgtgcggctggctgcgcctaggagttccgccacgggtccgacggggcaccctgggtccccgcagcccgtcacaggcgtttgcacatttgtgtgcacgaccactggcgggggcgttgagcctctgctagccgcctcgggctccgcacacccttgggtgattacccggcccccacctccctccaagcgacctcggctccaggaaaaggctttaatctgctattaagcgttttccaaagttt

SEQ ID NO: 78238 - DNA, 43 bp, Homo sapiens
  chr15:96903332-96903375
  hyper
cgggcataggaggctcgagctctatcggcgtccagcccgccct

SEQ ID NO: 78239 - DNA, 326 bp, Homo sapiens; identical to SEQ ID NO: 35964
  chr15:96911366-96911692
  hyper

SEQ ID NO: 78240 - DNA, 241 bp, Homo sapiens
  chr15:96911763-96912004
  hyper
cgctgggatccatctcctcagccccggtttcccgctctgcgagcgggggaagaacctgggaactgcaggatccgccacctcggtttttcagacacagcctctggcctctttccttggcctgccaaacctttgttcacttctctcacccgttgtctgctctgctctatccctcagcagggttctcgtttggacaagagggcccaatcctttgctttgctactcctcgcgtcttgtagaccct

SEQ ID NO: 78241 - DNA, 490 bp, Homo sapiens
  chr15:96952609-96953099
  hyper
actttctcccgcaaccgcgccccggaccgcagtaatcccggcggggcagggccggggagctggggacggggtggtctttagggtggcggcttcccccgaccccggacccgggaaccggccgccggcgcggggcgcgatctgcactgccggtcccacaggagttaaaccccgaggcagacaaaagggaggccgccgcggctcctttgctcggctgtcagttgaaaagagaaccgccgccctctggacttcaactcccgacggaaaaggcattttattatgggttatgacaagttgcagagagacgcggacaactcagtaagaaggagcggcgagcggaatcaaaaatgctcgagatgtttgcaagacagagcgaacacggcttcaaatgacaggtgttagcaggactccagacgggatctgcgggatcggccgggtgggagccgcaccgcacggcgccgggtcggggagagaacccggcctggggaggccg

SEQ ID NO: 78242 - DNA, 158 bp, Homo sapiens
  chr15:96953131-96953289
  hyper
cgcgcggcccggagccgaccccgcctcctcttccgaaagtcctaagtcaggacagcggcagatcgtcccagaaaatcagcgccaactccctctgctcaaatttgctactttgtgttttagttccaggcgggaagtctacactgcgctccctcccagcc

SEQ ID NO: 78243 - DNA, 67 bp, Homo sapiens
  chr15:96959305-96959372
  hyper
atgaagccacagcctcgaccagccctgacagtaaaacggagtgagcatgtggcggccccggggcaag

SEQ ID NO: 78244 - DNA, 242 bp, Homo sapiens; identical to SEQ ID NO: 35969
  chr15:96959719-96959961
  hyper

SEQ ID NO: 78245 - DNA, 318 bp, Homo sapiens
  chr15:96960508-96960826
  hyper
gccgcggacgccaggcgcgagcgcaaggttaaagtcaaaagctctgcctgggccagcactcaagacggtcctggcaccaacgcctttcatttttgcctgtttgcaagcggggaaagtggagtcctcaatcatagcgaggagcttttcttaagccacaaagcacacgggcgcaaacatcctcgctgctaactcagggcaattgtcttcctattttctcgttcctgacccccaagtttcaccggtgggaagtcatcgaagatctcccttttaccaccagctctacggggtcgcttttctcttaagcgccctgtgagggtc

SEQ ID NO: 78246 - DNA, 180 bp, Homo sapiens; identical to SEQ ID NO: 44366
  chr15:97006353-97006533
  hypo

SEQ ID NO: 78247 - DNA, 30 bp, Homo sapiens
  chr15:97395096-97395126
  hypo
cattaagtattagaacgcagatcacagaac

SEQ ID NO: 78248 - DNA, 30 bp, Homo sapiens
  chr15:97894937-97894967
  hypo
aggccaaacttgtgacggttaaaaattcac

SEQ ID NO: 78249 - DNA, 30 bp, Homo sapiens; identical to SEQ ID NO: 44367
  chr15:98417575-98417605
  hypo

SEQ ID NO: 78250 - DNA, 24 bp, Homo sapiens
  chr15:98454971-98454995
  hypo
cacccggcccggcacatttatttt

SEQ ID NO: 78251 - DNA, 114 bp, Homo sapiens
  chr15:98504114-98504228
  hyper
ggcggccgtgggtgccgagggccgcgtgaagagcctgggtctggtgttcgaggacgagcgcaagggctgctattccagcggcgagacagtggccgggcacgtgctgctggaggc

SEQ ID NO: 78252 - DNA, 41 bp, Homo sapiens
  chr15:98776804-98776845
  hypo
ggattacaggcgtgagccaccgtgcccggcccagctgggtg

SEQ ID NO: 78253 - DNA, 372 bp, Homo sapiens; identical to SEQ ID NO: 35973
  chr15:98836021-98836393
  hyper

SEQ ID NO: 78254 - DNA, 114 bp, Homo sapiens
  chr15:98961307-98961421
  hypo
ggagtgttttcaaaacgatgtagcgaaaccaccgcggaggtaaaaggtcgattgttcccagccacagccgctctgtggggacgactttatagcgcagcccggccagtaccgaca

SEQ ID NO: 78255 - DNA, 109 bp, Homo sapiens; identical to SEQ ID NO: 35974
  chr15:98965273-98965382
  hyper

SEQ ID NO: 78256 - DNA, 302 bp, Homo sapiens
  chr15:98971690-98971992
  hyper
ctgggggcaccgactcggggctgcggacctcggagcgcgcccggcgggctttggtttgggcaaggctgccatcgtgtggccgccgtgggtatttccctcggaaagcggccgggcagcgagcaggcgcccgcgcctcttctttttacgggagtccgcgctctccgcaagtctgtcctgagatcgccgttttctcccaccagccagaatggggctcactgctgcaacccgggtctcagtcttctccagggcacctcctgggccgtgccccgagccttgactgcggcaggcggtgttttttcctc

SEQ ID NO: 78257 - DNA, 254 bp, Homo sapiens
  chr15:99091118-99091372
  hyper
ggctggtccctggggcgcacagagaagttgtgacagataattgacgtgatcgggaggggcgtccaggcagacctcatgtgacttctaaaaccaacccacaaatctgaagcgtggcttgcgtggtcagccgcctgcctggcacccggtgaacagtttctcccggactctctgcatctagccccaaagaatctaagattctttgtctagaaaagtgccctggtcttccctggcacccttcgcggtgggtttccttg

SEQ ID NO: 78258 - DNA, 55 bp, Homo sapiens
  chr15:99091608-99091663
  hyper
ggcccccgcctcctccgtcctccgcgattcggacatgacacggtcctccgcgaag

SEQ ID NO: 78259 - DNA, 30 bp, Homo sapiens
  chr15:99168900-99168930
  hypo
acctcagagtcctcacgtataaaatggggt

SEQ ID NO: 78260 - DNA, 90 bp, Homo sapiens; identical to SEQ ID NO: 44371
  chr15:99183400-99183490
  hypo

SEQ ID NO: 78261 - DNA, 39 bp, Homo sapiens
  chr15:99192902-99192941
  hyper
aagtgagtatgtgcccgccgcccgcggccactgcgggaa

SEQ ID NO: 78262 - DNA, 37 bp, Homo sapiens
  chr15:99193206-99193243
  hyper
aagttggtgccggggcgggctccgcggttcccgggcc

SEQ ID NO: 78263 - DNA, 138 bp, Homo sapiens; identical to SEQ ID NO: 35976
  chr15:99193529-99193667
  hyper

SEQ ID NO: 78264 - DNA, 95 bp, Homo sapiens; identical to SEQ ID NO: 35977
  chr15:99193974-99194069
  hyper

SEQ ID NO: 78265 - DNA, 260 bp, Homo sapiens
  chr15:99250288-99250548
  hypo
tacaagtcacagtgacggttctccagtgtagagtagattgattgccctgtgtccttcaggcagggtgcagtagtaagttattgatacttggctgctgagctgtcgttcaggccttggcaactgacgctctgcagaacggaccaggagtgtgcggtggtggagtccggctggcctgggttgcagatttaactttcgcctctgcctctgtgtgcctctgggctgtaagctttagtttgcacggttaacggggatggcctctc

SEQ ID NO: 78266 - DNA, 127 bp, Homo sapiens
  chr15:99254559-99254686
  hypo
gggtgtgtgtgaaatcgttgagcctactcgattttgtcgtgctgttgcgcggttttcacttggcactgtcctttaaactccttctgtgccgtgactctgcagtgtctggcagcgtagtagactctac

SEQ ID NO: 78267 - DNA, 18 bp, Homo sapiens
  chr15:99295597-99295615
  hypo
tagagtgtttattaacga

SEQ ID NO: 78268 - DNA, 30 bp, Homo sapiens
  chr15:99347955-99347985
  hypo
tttaagatggagtttcgctggagtgcaatt

SEQ ID NO: 78269 - DNA, 30 bp, Homo sapiens
  chr15:99428631-99428661
  hypo
tttccttctcctccccgtgttgtctcatgg

SEQ ID NO: 78270 - DNA, 47 bp, Homo sapiens
  chr15:99454637-99454684
  hypo
tctcatcagcttcaccgtttactacaaggaagcgtgagtttctgctt

SEQ ID NO: 78271 - DNA, 81 bp, Homo sapiens
  chr15:99456350-99456431
  hypo
cccgcccaacaaggacgtggagcccggcatcttactacatgggctgaagccctggactcagtacgccgtttacgtcaaggc

SEQ ID NO: 78272 - DNA, 54 bp, Homo sapiens
  chr15:99460214-99460268
  hypo
cagtagccactgagacggagccgaaaaagatgacaggttcggtgaagtgagtcc

SEQ ID NO: 78273 - DNA, 38 bp, Homo sapiens; identical to SEQ ID NO: 44377
  chr15:99484067-99484105
  hypo

SEQ ID NO: 78274 - DNA, 132 bp, Homo sapiens; identical to SEQ ID NO: 15933
  chr15:99484456-99484588
  hypo

SEQ ID NO: 78275 - DNA, 30 bp, Homo sapiens
  chr15:99501229-99501259
  hypo
ctgttaccattttaacgctgcctaattttg

SEQ ID NO: 78276 - DNA, 123 bp, Homo sapiens
  chr15:99503981-99504104
  hypo
ccctgatagaacacacgcaggagcagagtcccctccccctccaggctgccctctcaacttctccctcacctccttccctaggggtagacagagatgtaccaaaccttccggctggaaagccca

SEQ ID NO: 78277 - DNA, 30 bp, Homo sapiens; identical to SEQ ID NO: 44379
  chr15:99506147-99506177
  hypo

SEQ ID NO: 78278 - DNA, 30 bp, Homo sapiens
  chr15:99507385-99507415
  hypo
atggaatggatgcaccgcaaataatgcatt

SEQ ID NO: 78279 - DNA, 30 bp, Homo sapiens; identical to SEQ ID NO: 44380
  chr15:99974913-99974943
  hypo

SEQ ID NO: 78280 - DNA, 30 bp, Homo sapiens; identical to SEQ ID NO: 44381
  chr15:99981097-99981127
  hypo

SEQ ID NO: 78281 - DNA, 34 bp, Homo sapiens
  chr16:1009722-1009756
  hypo
tgggtggacaattctcgcacgtgcaccagggctg

SEQ ID NO: 78282 - DNA, 183 bp, Homo sapiens
  chr16:10133318-10133501
  hyper
tgtttgtttgaaaatcgagacgctaaactctaagtcttttgctgaagctcctctccctaggggcaggatgggagcaaggcttaccaaggctgccacctacagaacagagggcagcgaggactgcgcagcagcgggagggaccggtggcgttgggcgcggggagggtctgcgcggggagggtcc

SEQ ID NO: 78283 - DNA, 64 bp, Homo sapiens; identical to SEQ ID NO: 36065
  chr16:10133502-10133566
  hyper

SEQ ID NO: 78284 - DNA, 132 bp, Homo sapiens
  chr16:1018120-1018252
  hypo
ggcagcacatggaaacgcccaggcccgcggtgggaaggagccagccccaggacggatgcaaagtcaggttgaatgcagaggcctgtcgctggcagccggcctctccaggtctggcttcgaagcttccccgac

SEQ ID NO: 78285 - DNA, 42 bp, Homo sapiens
  chr16:1022772-1022814
  hypo
tgttccagcttccagcgctccgggctccggctctgcatttgc

SEQ ID NO: 78286 - DNA, 2534 bp, Homo sapiens
  chr16:10274265-10276799
  hyper
catagtcgccactgacggtccctgcaaggtgaagagtgagaggcagggccgcggtgagcaaggcgaccagaagaaagggattaccaacttggcttcctgctctaggagccaggcatggaactcagcagcaggataggctgctgggatcacggactccattccgagtccccgacgccatccacatccctcgatccatctctaactctatccacaactccaattcgagctaattctccatcccccagccccttctcgcatccagcttcctcatcccctgtctccaggcacttccccatccccatctctgtccatatcccccaccgcattccccaagttcgccgcgggccacagaccctaagcgccgcgcgtgttctgtaccccaccaagctcctaggtgcacagaataaaccctccatccaacccctcccacctgggatagagaggaccaagttatcaaccccgccccctgctggcgcggagcgaactacagaccccgcagggcgtgcggaggcggcacccagaccccgcgtcccagcttgagagctcagctagttggctgaccccgccccctacgagcccgtcgtgtgcaccacacactttgctctacgcccagccccaactacagacccggctcctctcagtcagagtacaccccaagtgcttgggagtgaggacgctgcctggtgggcccaggctccgctgtgcctggggaacttggggctcgccccacctcgagccaaggggccgtggagagtccttcacccctacacgcgcgcgtgcacacacacgtgcacacacacacgcacacacacatgttcacacacacacaccctctctcacgcgcgccgtgtgcaatgctgaattctggagagtaggcgcgtccccccgcgggccagcgcgtaggagctggcaaagaacgtgcgtagggggaaaggtaggctcccaagaagctcccagacggacgtggactgtacagcccctccctagcctttctactgcgggcgctgttgccaagtcctaggtgcacgtgggcagtgggccgcacacgctcataggcacgcgcgcttttctgcgcacttcctcagactgctgtagcggtgcccacggccagccggagtcctcacatgtcctcaggtggtgcacacgcatgaactgcggcaggtgcacagccctgcgtacctgcaaataccagcacggtcgtgcacgcgtgccctgacgcgcgcctctcgggacggacgctgctggagccgggggaagttgaggcgaactccaagaggcctcgacgttcctgggtaagcgccgcggagcgcggagccgcagcgccccctggtgcccctcctgcacttcgccgctgggctccctcccgctttccctctccctctctagcctgatccctctcccgctctccctccggtcgagtctccctcctccccggcccaaggagccctgatctccctctgggacgtacctgtagcccgagaaggtcgaggatgcagtggggcgcgctgcgcgcacgagcatctcggccgcctcagcagccaccgggtttagcgggttcccgcatgctgcggccccagcgcgctcccctggctgtcccgcgctgtccgcatcgcccccacggggggcggctatcccagccggaggctctgcagcagggctctaacggggcggaggagagaaggagaggcagggtcagcccaccaacgaggggagggagggttgaggggaaggctgcagtctgcagtgctcacaagcccccctatgcgcccaggggggctagacaagaggggggaagctgaagcccgatgcccacgacgcccccagtgcggatcctcagcccctgtggctgatagcgggagctccactccagggtgcacaggagaatgggagccccaggttggccacccacgagaagctaactgggcacctccacccgcaccccctaccacctccccagcgccggctgctgggagttgtgcgaccgggagctgctgagcgagggaggtagggagagaaagaggaggtaacgagggtgggggggcgctggctgagtttgtgacgagccagcagtaggagagggggagggaaggacgcgggctcccgcggtcccggttccccgagggaggtggatctttcccacgcagcgaccctcttgtgatcctgccgcttcctccctcttcaggcctcccacctccccccttcccaagggggcctcccaggcccggcgtcccgcgctagcactcaccgcagcctctctccacatagttctcagcagtggccgctcctggtcatctccagggctgatggctgcggccgcgattctcagcgctcacccggtcccatgatccggccaagccctaggagctcccctccaagatccctagctccgcttcctgccccactccggacggcaactgcccggtcctctgagcgcgccggagcaccctctccgcaacccagctccgggctggtgtgtttgagggcgagtgtgtgtgtgagtgtgggagcgcgctcgcgtgtggccggggatcccc

SEQ ID NO: 78287 - DNA, 251 bp, Homo sapiens; identical to SEQ ID NO: 4324
  chr16:10276800-10277051
  hyper

SEQ ID NO: 78288 - DNA, 340 bp, Homo sapiens
  chr16:10277071-10277411
  hyper
cgctcaagcccaagaggcttcgagctccggcgggcgaaagcgtctcctgcccgcagcctctctcctaggtgggtcgagacagaccccgcagtccctcggcggcgacgcggagcgcggccacccgttccgagagcgcacggcggcaaataaggccaggataggtggctggctggcgacgggggcgcctgcggcggcgcgcgctgctgtccgtggtgttggaaccacgctctccgcccgctcccgggcgtctggtgcggctgaagaatcaattattcagatctctgctaccgcttcctcctcccccagtgcctcgcgctgggtacagttatccccctccacg

SEQ ID NO: 78289 - DNA, 414 bp, Homo sapiens
  chr16:1030443-1030857
  hyper
cggaccagctccttctgccgaccgggccggggagaccgcgtggctcagtggctgcagcggccaccggcccgggcgtgggggctttgagggcaccggcgcggtaggtcacccgggtttcgcgggccgcaagctcggagacgcgcgtgtcccgcgttggctgcctgacccggaatggcgcagccccttcgcctccagcgcgctggttgaaaggatccgagccaccctcggggacggccgggccgaggccacctcgcggggcggccttgggcggggacccggacccgcggttggacgttcgcctcggggggggcaatgtcccctctccgaccccgcggtccccaccagggcggcacaccccgccctctccccgcctccgcaggcgcccagggctcacaggctcggagcggcctccgc

SEQ ID NO: 78290 - DNA, 199 bp, Homo sapiens
  chr16:1031067-1031266
  hyper
ctccacgctcgcactcgtatgggcagggcggcccggggtcccccagctccgagccgcggccccttgaagcgcgttacctggacgtgcgctgtccgcagactctggacgagctgggcctgggcgctgcgcggcggaaccgaccctgtcctggaccgcaggcagcagctgaccccgcgccaccggcctgcgggcgagacct

SEQ ID NO: 78291 - DNA, 138 bp, Homo sapiens
  chr16:1031386-1031524
  hyper
tgtgtcgggggaggggcccgaggacccgcttcctagctgagcgtcaggacggggggcggactctcaggagccgcgcggcgcccgcagaggagaggaagcgccggagacccccctgctcccacccggcctccctgcccc

SEQ ID NO: 78292 - DNA, 706 bp, Homo sapiens
  chr16:1031741-1032447
  hyper
taaagaaacttgttgcgggtcccgcagcgggacccgagcctcggcggcggcggcggcggcggcaggggcgagggtcggggccaccgcgcggcgacctcgggtcccggagcgaccgcagggcagccccgggcgccggccccggtgcgcgtctcctgtgcgcgcccctccgcgcgcggccccgatgctggacatgagcgaggcccgctcccagccgccctgcagcccgtccggcaccgccagctccatgtcgcacgtggaggactcggactcggacgcgccgccgtctcccgccggctccgagggcctgggccgcgcgggggtcgcggtggggggcgcccggggcgacccggcggaggcggcggacgagcgcttcccggcctgcatccgcgacgccgtgtcgcaggtgctcaagggctacgactggagtctggtgcccatgccggtgcgcggcggcggcggcggcgcgctcaaagccaagccgcatgtgaagcggcccatgaacgcattcatggtgtgggcgcaggcggcgcgccgcaagctggccgaccagtacccgcacctgcacaacgccgagctcagcaagacgctgggcaagctgtggcggtgagtgccggcgccccgggggcggggttcgggaccttggccgcccctggtctcggactgcgagcgggggcctggagggcgcagagctcgcggaggtggtggc

SEQ ID NO: 78293 - DNA, 30 bp, Homo sapiens
  chr16:1034635-1034665
  hypo
ctggccggccccacccgccccacagaaggg

SEQ ID NO: 78294 - DNA, 37 bp, Homo sapiens
  chr16:1035437-1035474
  hypo
ggcccagtgtgtgtgaccagggcgggaggggccccag

SEQ ID NO: 78295 - DNA, 30 bp, Homo sapiens
  chr16:1039445-1039475
  hypo
ggagatgcagcccagcgctgcccccaagct

SEQ ID NO: 78296 - DNA, 168 bp, Homo sapiens
  chr16:1040337-1040505
  hypo
tcaaagtgaaactggcgaagaaagggccggcctcacgagaccccggggactcagacccagtgagcgcacctcttgctgcctcctgctgtgtctggggcatccacaccgccaccccgcgggaaggcaggacgagctgcttgccaggtgacctcccgtgcctcagtttcc

SEQ ID NO: 78297 - DNA, 265 bp, Homo sapiens
  chr16:10479701-10479966
  hyper
gccccggtggctgaccggaagaagcgcccacggaggcgaaccccaggcgcccctcagcctacttccatttcccctcgcgacccttcgccccgcccactctagctggctgtgcctgactggctgggctgccgcatattcgcgctgccattggtccataatcagctgggggtgggcgtagggagacctacttcagcaggtcctggccggaccagcattgttaacggctgcggttcgaagtggctgtgggtattgctgcggctggtgc

SEQ ID NO: 78298 - DNA, 369 bp, Homo sapiens
  chr16:10479967-10480336
  hyper
tcgtcgctctaggtacgttggggccgggcgagtgtcctgcgagagcggcgattggcggggtggcggctctaggagcgtcggtcgcctctctgagggccggccccggaggcctcggagcgccgggcctaccggacgtttgcggcgaagctgccctgactgaaaagcgtccgcggggccgtctgacaggtccgggaagaggcccctgaggggcggacgggcgcgtctccaccgttttcgcagagggatactggtgaagcgggagtggtgtgcggcctcaggtccgggcggcactggggttagggactgcggagggaagtggtgcgtgttttttgtcctgaggggtaagtaaaagctcgctcttgtccggaa

SEQ ID NO: 78299 - DNA, 30 bp, Homo sapiens
  chr16:1050321-1050351
  hypo
gcacagcgcactccccgtggcctcggctgg

SEQ ID NO: 78300 - DNA, 30 bp, Homo sapiens
  chr16:1052148-1052178
  hypo
gccctcctggcccagcggaatgctggcacc

SEQ ID NO: 78301 - DNA, 372 bp, Homo sapiens
  chr16:1052442-1052814
  hypo
tctgatgtccctccccggtgaagggacccgcacatgtgcacctgccgcagccccgatgtccctccccgggtgaaggaacccacggacgtggctcatccataccgcggaacgtgagccatgaaaaggggcagcctcggctcagccaccgcagggaaggactcgacacacgccgagcagaagaggccaggcctgagaggccacctgcgattccatctgcggaaatgccagaaagggaggtccgcagacgcaagagctggactggggggacggccgaggggcgaggggtttccttccggatgaaattgccccagaacgacatgcagggcgtggggaggtggctgcaagatactgcggccccgctggatgccacag

SEQ ID NO: 78302 - DNA, 30 bp, Homo sapiens
  chr16:1053812-1053842
  hypo
cttagaggagggacacggggggctgcgacc

SEQ ID NO: 78303 - DNA, 94 bp, Homo sapiens
  chr16:1061426-1061520
  hypo
gcggcagggcagagacgcagggcaaagcggcagggcagagacgtagggcagagcggcagggcagagacacagggcagagcggcagggcagagat

SEQ ID NO: 78304 - DNA, 32 bp, Homo sapiens; identical to SEQ ID NO: 44449
  chr16:1062412-1062444
  hypo

SEQ ID NO: 78305 - DNA, 30 bp, Homo sapiens
  chr16:1062655-1062685
  hypo
gagtgctgtggagcacggggaagggccatg

SEQ ID NO: 78306 - DNA, 30 bp, Homo sapiens
  chr16:1067752-1067782
  hypo
gaggtggcctctcatcgtggctttgatttg

SEQ ID NO: 78307 - DNA, 112 bp, Homo sapiens
  chr16:1071854-1071966
  hypo
tccttccctagggagcgggagtcttcacacgtcccctgggggtctggcacctcaagtataagcaccccctgcgatcggcccctcccacaccccagcgcgggcccagctgctc

SEQ ID NO: 78308 - DNA, 153 bp, Homo sapiens
  chr16:10721492-10721645
  hypo
tgcacttctccttgtcgatgcagagggtgttggccttgatggcgagctcgtgctccagccggcacttggtcatgaccagcagctgcagcgtgtcctgtgtctcccgcagccgcagcttgagggtctgcagggtgtcgtcgatggtgaacacct

SEQ ID NO: 78309 - DNA, 136 bp, Homo sapiens
  chr16:1072992-1073128
  hypo
cccttcccgctcctccgagtcccagcacctacgtccgtgaagtgggcagagtagaaaccactactcgggcctcgcggagcagagtgggggcactgggtggggcggggggcacggggcgggccgggcctagggaggg

SEQ ID NO: 78310 - DNA, 42 bp, Homo sapiens; identical to SEQ ID NO: 44451
  chr16:1073516-1073558
  hypo

SEQ ID NO: 78311 - DNA, 30 bp, Homo sapiens
  chr16:1075075-1075105
  hypo
gcctgggtgttcacacggctccagctccac

SEQ ID NO: 78312 - DNA, 51 bp, Homo sapiens; identical to SEQ ID NO: 44452
  chr16:1076434-1076485
  hypo

SEQ ID NO: 78313 - DNA, 104 bp, Homo sapiens
  chr16:1077555-1077659
  hypo
tatttctgagatcaacgcctgcctcagggaacagttgttcccgtgctattttttacccccgtgggctgcgagttctggaacgttccaaacgacagtgacaacgg

SEQ ID NO: 78314 - DNA, 63 bp, Homo sapiens
  chr16:1077886-1077949
  hypo
gaaggccagagaccccggcatgccctcgggggaggagggaggtggggccggttggtctggggc

SEQ ID NO: 78315 - DNA, 85 bp, Homo sapiens
  chr16:10804580-10804665
  hypo
agtaatattatcctctccctccccgcctagatattaggaacaatgtctcaggaaagatgtacaccagttgcgatgttggaagtca

SEQ ID NO: 78316 - DNA, 217 bp, Homo sapiens; identical to SEQ ID NO: 15968
  chr16:1081773-1081990
  hypo

SEQ ID NO: 78317 - DNA, 42 bp, Homo sapiens
  chr16:1089124-1089166
  hypo
aatgtctgtcctctgcgtgtatcaggccgggttgagggggtg

SEQ ID NO: 78318 - DNA, 30 bp, Homo sapiens; identical to SEQ ID NO: 44455
  chr16:1089739-1089769
  hypo

SEQ ID NO: 78319 - DNA, 30 bp, Homo sapiens
  chr16:1090322-1090352
  hypo
cgccgaggtcccccccgaagttcccccctg

SEQ ID NO: 78320 - DNA, 103 bp, Homo sapiens
  chr16:1090678-1090781
  hypo
gtgtgattaggaaagcggggctttggctgtgggaccacagagccccagtaggagcccccgccccagcacagtgaacccaggacaacgtcggggctgcctgagt

SEQ ID NO: 78321 - DNA, 30 bp, Homo sapiens; identical to SEQ ID NO: 44456
  chr16:1092742-1092772
  hypo

SEQ ID NO: 78322 - DNA, 53 bp, Homo sapiens
  chr16:1096684-1096737
  hypo
tccccccaccgtgcccgcggtgccctcctccgcccgcgcggctggtggcaggg

SEQ ID NO: 78323 - DNA, 89 bp, Homo sapiens
  chr16:1101018-1101107
  hypo
cagatgaatcacctgcgcaaagccacttagcacttcgcaggggccccgaagcccggtgtcggcaaggtgtccgtcgctggagcaggggt

SEQ ID NO: 78324 - DNA, 81 bp, Homo sapiens
  chr16:1103110-1103191
  hypo
gggtgtgtgcccggccgtgcactttgggtctggtgagcgtggctgaggggcacagctgctcttggtcggggctgcagtgag

SEQ ID NO: 78325 - DNA, 23 bp, Homo sapiens
  chr16:11102871-11102894
  hypo
tacattcacgttgtataaccatc

SEQ ID NO: 78326 - DNA, 30 bp, Homo sapiens
  chr16:1111359-1111389
  hypo
ggctcccagagctgacgtgcaaataaattg

SEQ ID NO: 78327 - DNA, 30 bp, Homo sapiens
  chr16:11118524-11118554
  hypo
tctgtgtcctcagtgcgtggtgctggacca

SEQ ID NO: 78328 - DNA, 46 bp, Homo sapiens
  chr16:1111971-1112017
  hypo
agcccaggaacaccacgggtggctggcagtgcggagcggtagggcc

SEQ ID NO: 78329 - DNA, 72 bp, Homo sapiens
  chr16:1113889-1113961
  hypo
ccgtacgtcacccagcgccacgcttctgcacccacgcagagccacgccccacctgtgcgttcatgctgactt

SEQ ID NO: 78330 - DNA, 30 bp, Homo sapiens
  chr16:11140587-11140617
  hypo
caagactatgcccaccgtgctgttctgaag

SEQ ID NO: 78331 - DNA, 30 bp, Homo sapiens
  chr16:11167520-11167550
  hypo
cctgcctgcccttgtcgcccctgcctggat

SEQ ID NO: 78332 - DNA, 39 bp, Homo sapiens
  chr16:1116820-1116859
  hypo
actgggtagcaggggcggatttctcgtgaatggcttggc

SEQ ID NO: 78333 - DNA, 30 bp, Homo sapiens
  chr16:11178655-11178685
  hypo
cctgcccttgttcagcgcctctcgaagaca

SEQ ID NO: 78334 - DNA, 30 bp, Homo sapiens
  chr16:1118971-1119001
  hypo
gcgtgaagcacctcccgggatgaaccaggg

SEQ ID NO: 78335 - DNA, 45 bp, Homo sapiens
  chr16:11232618-11232663
  hypo
aggcgcaccctcattcgattttgactgctgcgatcatctggtcaa

SEQ ID NO: 78336 - DNA, 30 bp, Homo sapiens
  chr16:11245768-11245798
  hypo
gacgggtgaggaacccgggaagtgagagct

SEQ ID NO: 78337 - DNA, 30 bp, Homo sapiens
  chr16:1125274-1125304
  hypo
gcctgtggagcccctcgctgggctctgggc

SEQ ID NO: 78338 - DNA, 161 bp, Homo sapiens
  chr16:11283033-11283194
  hypo
ctagaaaggcaggaacgcagcgtgacggtgccatacccagagggcctgcctgggcagcccccagaggccttcaaagctacactggagagcttggccgagggaccaatggcaatggcacacactgaagtgttttacacaaaaaaaaccgcctggctggatgt

SEQ ID NO: 78339 - DNA, 420 bp, Homo sapiens
  chr16:1128947-1129367
  hypo
ggacgctggtggggccggcgccctcggcaggggcccgggcggtgctggtgcccgtgctgtacctgctggtgtgtgcggccgggctgggcgggaacacgctggtcatctacgtggtgctgcgcttcgccaagatgaagaccgtcaccaacatctacattctcaacctggcagtggccgacgtcctgtacatgctggggctgcctttcctggccacgcagaacgccgcgtccttctggcccttcggccccgtcctgtgccgcctggtcatgacgctggacggcgtcaaccagttcaccagtgtcttctgcctgacagtcatgagcgtggaccgctacctggcagtggtgcacccgctgagctcggcccgctggcgccgcccgcgtgtggccaagctggcgagcgccgcggcctgggtcctgt

SEQ ID NO: 78340 - DNA, 30 bp, Homo sapiens
  chr16:11354746-11354776
  hypo
ccttgggatctttgtcgtggcctattcact

SEQ ID NO: 78341 - DNA, 38 bp, Homo sapiens
  chr16:11407112-11407150
  hypo
gtatgtgtccaggtgcgccaggtcgtgcagagcatatc

SEQ ID NO: 78342 - DNA, 65 bp, Homo sapiens
  chr16:1142015-1142080
  hypo
gaatggcccctcggccgtgagggcgagtacctgggtgagcaaccgggctccgaccaccccatgag

SEQ ID NO: 78343 - DNA, 34 bp, Homo sapiens
  chr16:114441-114475
  hypo
agaggcaagagcatccgggcggtggagacagaga

SEQ ID NO: 78344 - DNA, 30 bp, Homo sapiens
  chr16:1148193-1148223
  hypo
cctcagcaagacccccgactccacccctct

SEQ ID NO: 78345 - DNA, 30 bp, Homo sapiens
  chr16:11484000-11484030
  hypo
agcctcttcagtgcccgtgagaacgtggcc

SEQ ID NO: 78346 - DNA, 198 bp, Homo sapiens
  chr16:1155071-1155269
  hypo
cacggtcatggtgtccgaggcatgacacagctgcggctccggggccagcagcaggcgggtctcagcggcggtgctaccacctcccactcaggctccaacttccagccgcgcgtgtcctacggctgccgcccaccctgtgtgtgtggagtccctttgtgtgcactgtgccgcggcctcggtctccgctgcccactgctg

SEQ ID NO: 78347 - DNA, 38 bp, Homo sapiens
  chr16:11568836-11568874
  hypo
acagataaaaggttaaatatttgcgcagctattctatg

SEQ ID NO: 78348 - DNA, 232 bp, Homo sapiens
  chr16:1157293-1157525
  hypo
gaattctgggctctgcgacctctcagcctctgcctccaggtgccctggggtgcggcgggggcactgccgcatcgagctcccaggctgacgggacacagactcacccgtgaccgcagtcggccctgcaggctgacggacaggacttgactgagtgcctgtctgagacagggggctgggcccttgacccctgcagccacagagccccgcagccctcagccggctcagggggtga

SEQ ID NO: 78349 - DNA, 46 bp, Homo sapiens
  chr16:1164458-1164504
  hypo
tctccctgtggaagacgcatcctcggtgaatcgtggggatcccacc

SEQ ID NO: 78350 - DNA, 225 bp, Homo sapiens
  chr16:1166553-1166778
  hypo
gcaactccagtgcatcggagggacgccaggtctgcgggcggcaggcagatagcctggccaggccctcacatgcccaccgccagcaccagcctggaaatggacctggaggggccgggctccacccggcacttagaccaaagagccctgaaaatagacgcagagaaaatcagccacggctcccaggccccagaggtcctcccgggagcaggacgtggcctggagcca

SEQ ID NO: 78351 - DNA, 30 bp, Homo sapiens
  chr16:11703494-11703524
  hypo
tcccggctgcgtgaccgtgagcaagttact

SEQ ID NO: 78352 - DNA, 169 bp, Homo sapiens
  chr16:1171138-1171307
  hypo
ctaagcccctttccccggagccccgagcccggccggggaaggtgtcgagtcagtggcagagtggaggtgagggcgcgtttcaggggcgacacccctccacgcacccgtagtggccaagcccacctccgggggttcccgggccccagagtggacacgagtgcccaggggg

SEQ ID NO: 78353 - DNA, 102 bp, Homo sapiens
  chr16:11712029-11712131
  hypo
atttatttattctgtcttttacctccagctatttttgtttcttctctccatttatgcccaaacttttcccccttggaagagacattccgttctgccactgtg

SEQ ID NO: 78354 - DNA, 155 bp, Homo sapiens
  chr16:1173250-1173405
  hypo
gttctgagcagcccccggcacctggggccgatctacaggtgcattttgtacatagaatctgacccacaggttgtttgttggataaggggaaaatcccggaatccaggaggcccgtgcgccttcacctccggcctcccgcgcgccttcacctccgg

SEQ ID NO: 78355 - DNA, 30 bp, Homo sapiens
  chr16:11770160-11770190
  hypo
cggcccggaagtccacggctgagccaggat

SEQ ID NO: 78356 - DNA, 23 bp, Homo sapiens
  chr16:11843326-11843349
  hypo
ggcgcggtggctcaacgtagtcc

SEQ ID NO: 78357 - DNA, 30 bp, Homo sapiens
  chr16:11853255-11853285
  hypo
gttttggctaaaactcgctcagccccctta

SEQ ID NO: 78358 - DNA, 42 bp, Homo sapiens; identical to SEQ ID NO: 44603
  chr16:11853669-11853711
  hypo

SEQ ID NO: 78359 - DNA, 25 bp, Homo sapiens
  chr16:1186732-1186757
  hypo
gggtgcggtggctcacgcctgtcat

SEQ ID NO: 78360 - DNA, 30 bp, Homo sapiens
  chr16:1187602-1187632
  hypo
ccctgctctccatcacggtgggtgaatccg

SEQ ID NO: 78361 - DNA, 30 bp, Homo sapiens
  chr16:11879750-11879780
  hypo
aggcgtgagccaccgcgcctggccgttttg

SEQ ID NO: 78362 - DNA, 36 bp, Homo sapiens
  chr16:1188922-1188958
  hypo
tgccaagagctccgcttcccacgtcctcaccaacgc

SEQ ID NO: 78363 - DNA, 179 bp, Homo sapiens
  chr16:1195670-1195849
  hypo
tgaccccggcccctccgcacaggcccccgccccgggtctggctcagctggttcctcagatgtccctgggcggcctggcaccttctctgaggagcccccgggtgaaattcccccaaaaacacacactctaggcccacgcgtggtcatctgtggttccaagggcctcgcctggccgagccg

SEQ ID NO: 78364 - DNA, 34 bp, Homo sapiens
  chr16:1196701-1196735
  hypo
gagctcacacacggacggacggctcacccactta

SEQ ID NO: 78365 - DNA, 30 bp, Homo sapiens
  chr16:1198450-1198480
  hypo
cccaagcccagcctccgcctgcagcccctc

SEQ ID NO: 78366 - DNA, 30 bp, Homo sapiens
  chr16:1199021-1199051
  hypo
acaaaggtgagagcccgccatgcttcgggg

SEQ ID NO: 78367 - DNA, 42 bp, Homo sapiens
  chr16:12012089-12012131
  hypo
gggcttatcggtgtgagccaccacacccggcagagtttgcct

SEQ ID NO: 78368 - DNA, 27 bp, Homo sapiens
  chr16:1202546-1202573
  hyper
cgcgggcacacccgggacacacacgcg

SEQ ID NO: 78369 - DNA, 519 bp, Homo sapiens; identical to SEQ ID NO: 36008
  chr16:1203265-1203784
  hyper

SEQ ID NO: 78370 - DNA, 156 bp, Homo sapiens; identical to SEQ ID NO: 36009
  chr16:1203807-1203963
  hyper

SEQ ID NO: 78371 - DNA, 109 bp, Homo sapiens; identical to SEQ ID NO: 12362
  chr16:1204002-1204111
  hyper

SEQ ID NO: 78372 - DNA, 180 bp, Homo sapiens; identical to SEQ ID NO: 36011
  chr16:1204128-1204308
  hyper

SEQ ID NO: 78373 - DNA, 30 bp, Homo sapiens
  chr16:1207059-1207089
  hypo
tgctgcccggactcccggggttcctgactc

SEQ ID NO: 78374 - DNA, 38 bp, Homo sapiens
  chr16:1207490-1207528
  hypo
gcgctggggctgtcacgctgctccgcgggcgtcccccg

SEQ ID NO: 78375 - DNA, 55 bp, Homo sapiens
  chr16:1209218-1209273
  hypo
cctgagccctgtgaccgaggcatggtcggggcccctcggacggtggggtgggccc

SEQ ID NO: 78376 - DNA, 16 bp, Homo sapiens
  chr16:12130487-12130503
  hypo
gcgggttttctgtttt

SEQ ID NO: 78377 - DNA, 51 bp, Homo sapiens
  chr16:12132399-12132450
  hypo
tacggacaccgcaggcgctaattggcaggtgagctgcgctttaaatagacc

SEQ ID NO: 78378 - DNA, 41 bp, Homo sapiens
  chr16:1213983-1214024
  hypo
cgcccctgccccagccgaggagcagccgatgggtgcggcct

SEQ ID NO: 78379 - DNA, 30 bp, Homo sapiens
  chr16:1214993-1215023
  hypo
agggtgatttgtctccgtggggttctgggg

SEQ ID NO: 78380 - DNA, 155 bp, Homo sapiens
  chr16:1216382-1216537
  hypo
ccctgcagaggaggccgcgcagcgtacaaggccctctggccagcccggcaccaactcattcctgttgttggtcttttcccagttttattgagaggtaatttatccaccacctaactcgccaatgaagggtccaattcggtcgttctccctgtatc

SEQ ID NO: 78381 - DNA, 30 bp, Homo sapiens
  chr16:1216945-1216975
  hypo
aattgctgggtcaggcggaaacagtgttga

SEQ ID NO: 78382 - DNA, 321 bp, Homo sapiens
  chr16:1217182-1217503
  hypo
gcccctgacctgccccgtggggatgaaacgggctctttgcggggggcctgtggggtatgggcctcctgtcagcagcccgtcccggtgggtggggcttgccggccgcccgcgaatgtcaggaaccttggattcctgacacacgggtgcgggggcgatatcggcgcggagcgggcggggtggcgcccgggccgcgggtgggagaatctggcgtgtgtgtttgcacggcatccatccctccatccgtcctctggagaatttcaacacccacacttggaataaaaaaaaaaattattaatgagcttggtgcggttgccatgggaa

SEQ ID NO: 78383 - DNA, 30 bp, Homo sapiens
  chr16:12177673-12177703
  hypo
gcttcactcacatcccgccaagtggcttcc

SEQ ID NO: 78384 - DNA, 307 bp, Homo sapiens
  chr16:1217833-1218140
  hypo
ggggcgtggcctggccgtccgtccgcggggcccgggctgcccatggcagcaggtgctcagtaagcactcgccccaccagtgcgtggagcacgtggggcctcaggagccaggcctgttccccggggctgcctggaggcggccgcttgtccccaaggcctggtgaccgcacctctgtctgccctaggccttcgagttgggggacattttgtaaggagccgctgtgcctaggccagagatgttttcggaaggggtgcctgtaccccgagaggtggaccagaattcccctggggcacggtggcgggagacc

SEQ ID NO: 78385 - DNA, 30 bp, Homo sapiens
  chr16:1218638-1218668
  hypo
tgcatcgtgctcggccgagttggccctgtg

SEQ ID NO: 78386 - DNA, 215 bp, Homo sapiens
  chr16:1220501-1220716
  hypo
gacgtaccccgacaccggcctgcggacccccacaagcccagtggccgtcagccttgggattttggggttttccaactttaatcagggaatgtctgtctcccctgcatgagtgatctgtggagcctggtcggcatcctgattgtcatgccgaccgagtttgtggggccctcctcgtgcccccacgatctggacagggatttcggggtgagggaagc

SEQ ID NO: 78387 - DNA, 30 bp, Homo sapiens; identical to SEQ ID NO: 44469
  chr16:1222610-1222640
  hypo

SEQ ID NO: 78388 - DNA, 30 bp, Homo sapiens
  chr16:1227328-1227358
  hypo
agccgccggcaccctcggagacagcctgaa

SEQ ID NO: 78389 - DNA, 151 bp, Homo sapiens; identical to SEQ ID NO: 15975
  chr16:1228780-1228931
  hypo

SEQ ID NO: 78390 - DNA, 342 bp, Homo sapiens
  chr16:1230012-1230354
  hypo
gcgtgagccaccatgcccggcccggccttgttttttaatatacatctggttgccgggtgatactgagggggccgggctctgcaggcacagggctgaggggcgtcgtgtggatggacggccagcccgttgggtgccctggctgggtccctgtccctgcacaccgggtcagccggctcctgggtgcacaggcaggtggtgtgcgtccgcattgcagaacacggggcgttgcaggccggagctgggttttcacacagattgagaccaggcgtcgcccacagagcataatgtgaggcgagagggactcgggctgctgtgggctggggaggacggtcccatagctgg

SEQ ID NO: 78391 - DNA, 656 bp, Homo sapiens
  chr16:1236485-1237141
  hypo
cgtcctgagtgccctcgtcttgtccctctccacggcgttctcatcctccggcgattccctgggaacgtctctgtacctctgcacacgtgcccacacacatgcccctcgagatggcctgcactgtggcttctgtcgtgaatgtggtcacgtgtcctccgtgactcgctcctcctgccccgtgtgccctggacctggctcggtcccgatgcccgtggcaccaccgcctcctcaacgggtggccacgtaatgcttcctggccggtgaatgtgccacggcagtggagatattctgcccttctagctcttctgtatacaagcagtgcgccctggttctcagggccgtgaccaccaccatgaccggcagacttcagggcggtccgtcccactcccgtggcctcgagggtcctttggagctgccgcggttctgagtgggggtggacacggacacagggctggttcccggggatctcctgtaccacccactgactcccagggtctgcggctggcccggcccctcctgggtctcttgatgtgggaccaaagctgttgcttcctctgcggcagaggcgatggagtccctcagagcccgcgaccgtcccctccgcactgcgggctgatagcgcctgtgggaatgggcttccccggtgaatacacata

SEQ ID NO: 78392 - DNA, 39 bp, Homo sapiens
  chr16:1245806-1245845
  hypo
aggtcctccgggtgccgggctggccggttctatgcctgc

SEQ ID NO: 78393 - DNA, 36 bp, Homo sapiens
  chr16:1247968-1248004
  hypo
tacctcctgaaaagccgctgccggtcctccccaccg

SEQ ID NO: 78394 - DNA, 570 bp, Homo sapiens
  chr16:1248352-1248922
  hypo
gaggtggagacctggcgccccgctggatgcacgtcagaccccagggtgtcagtgtccctggaggccggtggtggtaggaggggagtcccgatcacactaggggtgcgggaaaatcaccagggggtggcccgagtcagtgtgcagtgggcgtggacacccactgtgaacagtggacggggctcgggggtcccgggaggggctgcagccccgaggacactcctgcagggcttagcagtgccaatcctggccctgctgcccacaggcatgcggatcctggtcactctgctgctggatacgctgcccatgctcgggaacgtccttctgctgtgcttcttcgtcttcttcattttcggcatcgttggcgtccagctctgggctggcctcctgcggaaccgctgcttcctggacagtgcctttgtcaggtgcccaggccccacccccgtgaggcccctgcccagatggccctgcccaccatgcagataacgcaccatgtggctccaccgccccacgtggctctgcccaccgtgcagtcacccgccccgccactgctgtccccgtcatggctccgtc

SEQ ID NO: 78395 - DNA, 272 bp, Homo sapiens
  chr16:1250262-1250534
  hypo
aacctgaccttcctgcggccgtactaccagacggaggagggcgaggagaacccgttcatctgctcctcacgccgagacaacggcatgcagaagtgctcgcacatccccggccgccgcgagctgcgcatgccctgcaccctgggctgggaggcctacacgcagccgcaggccgagggggtgggcgctgcacgcaacgcctgcatcaactggaaccagtactacaacgtgtgccgctcgggtgactccaacccccacaacggtgccatcaactt

SEQ ID NO: 78396 - DNA, 142 bp, Homo sapiens
  chr16:1251693-1251835
  hypo
tggtggtgattgccacgcagttctcggagacgaagcagcgggagagtcagctgatgcgggagcagcgggcacgccacctgtccaacgacagcacgctggccagcttctccgagcctggcagctgctacgaagagctgctgaa

SEQ ID NO: 78397 - DNA, 51 bp, Homo sapiens; identical to SEQ ID NO: 44477
  chr16:1253065-1253116
  hypo

SEQ ID NO: 78398 - DNA, 119 bp, Homo sapiens
  chr16:1255901-1256020
  hypo
ccccggggccatcagcggataagcggcttttgaggtgcttccgcagctgttcatgcaccttgatgcagccataccctctcccatctgtgggatgcagcacaggccgctgtggctccctg

SEQ ID NO: 78399 - DNA, 359 bp, Homo sapiens
  chr16:1259060-1259419
  hypo
ctggggccccagtggcgcctggagcagccggcgctccagctggagcagcctgggccgtgcccccagcctcaagcgccgcggccagtgtggggaacgtgagtccctgctgtctggcgagggcaagggcagcaccgacgacgaagctgaggacggcagggccgcgcccgggccccgtgccaccccactgcggcgggccgagtccctggacccacggcccctgcggccggccgccctcccgcctaccaagtgccgcgatcgcgacgggcaggtggtggccctgcccagcgacttcttcctgcgcatcgacagccaccgtgaggatgcagccgagcttgacgacgactcggaggacgtgagtg

SEQ ID NO: 78400 - DNA, 102 bp, Homo sapiens
  chr16:1259773-1259875
  hypo
ggacccaagagcacccgctcacctggccccgtggactccagcacgggtcactctgccgtcaccagcgtagggaagggggaggctccacggtatgggccccag

SEQ ID NO: 78401 - DNA, 221 bp, Homo sapiens
  chr16:1260220-1260441
  hypo
catggtggatatttccgagtgggcaccccttctcacaccgcagggaccggggctgaagtggaggcgtggccagggctgtcctgcaacccccatccactctgccatccacgccgccccgccccacctctcacccgcccccgcccacccaggttccgcgtctcctgccagaaggtcatcacacacaagatgtttgatcacgtggtcctcgtcttcatcttcct

SEQ ID NO: 78402 - DNA, 67 bp, Homo sapiens
  chr16:1260766-1260833
  hypo
gtgccattggccctccgcaggtggtggccctggggctgctgtccggcgagcacgcctacctgcagag

SEQ ID NO: 78403 - DNA, 30 bp, Homo sapiens
  chr16:1261095-1261125
  hypo
tttgctgagctctgccggcgcctggcagct

SEQ ID NO: 78404 - DNA, 582 bp, Homo sapiens
  chr16:1261601-1262183
  hypo
gccaggtgggctgggcggccgggcgggagctgggggtctccaggacaccctggagcgagagggccggcgaccccagctctaaccctcgccagtgaccctggctctggccctcaggccctgatgtcgctgttcgtgctgtcatccaaggatggatgggtgaacatcatgtacgacgggctggatgccgtgggtgtcgaccagcaggtgcgcacaggcgggtcgagctgggtcacctcagggtctcccgcgagcggctgccttggcctctggggactcggggggccatcctgggtagggcccctggcggggcaggcgggcggggacccaccgcctctgtgccacagcctgtgcagaaccacaacccctggatgctgctgtacttcatctccttcctgctcatcgtcagcttcttcgtgctcaacatgttcgtgggcgtcgtggtcgagaacttccacaagtgccggcagcaccaggaggcggaggaggcgcggcggcgagaggagaagcggctgcggcgcctagagaggaggcgcaggagtaaggcgctcccggtggcggtggcggtggcgggtcggtacctgt

SEQ ID NO: 78405 - DNA, 47 bp, Homo sapiens; identical to SEQ ID NO: 44481
  chr16:1262447-1262494
  hypo

SEQ ID NO: 78406 - DNA, 38 bp, Homo sapiens
  chr16:1262762-1262800
  hypo
ggacacccagagcaacgaggggccgcccacacccctgc

SEQ ID NO: 78407 - DNA, 33 bp, Homo sapiens
  chr16:1263717-1263750
  hypo
tgcaggagccaggagcgccgggcggccctcctg

SEQ ID NO: 78408 - DNA, 30 bp, Homo sapiens
  chr16:1264397-1264427
  hypo
cgttttgtgtggagccgaggatggccgtgg

SEQ ID NO: 78409 - DNA, 183 bp, Homo sapiens
  chr16:1265150-1265333
  hypo
ccgcaggctttcccacggaggtctgcagaagcaacgctgctgagccgaggcggggaccccagacgtgtgcgctgagcctccggccacacaggtggaaccagctggacctggccatcgtgctgctgtcactcatgggcatcacgctggaggagatagagatgagcgccgcgctgcccatcaacc

SEQ ID NO: 78410 - DNA, 97 bp, Homo sapiens
  chr16:1265614-1265711
  hypo
ctcagcgcaggcccccggaagacggggttgcagggagcgcctcgccgtccccctctccccctcactcgtttctctggtccctcggttgtgtggtggc

SEQ ID NO: 78411 - DNA, 40 bp, Homo sapiens
  chr16:1266380-1266420
  hypo
cagccttggagggtgcgccgcccagcggggcagtgtgtgc

SEQ ID NO: 78412 - DNA, 30 bp, Homo sapiens; identical to SEQ ID NO: 44483
  chr16:1267184-1267214
  hypo

SEQ ID NO: 78413 - DNA, 869 bp, Homo sapiens
  chr16:1267696-1268565
  hypo
gccccagcccaggtgcggcagcaggggcctcggcccaggggctccgacctcacacccagggtcaccctctgccaggcagggcgaaccgccagggcctcgtcatccacatcctccgggctatcctgcctctgggctccccaaggggcatgtggaggctgggtgcatgtcccgcctccacccggagcgggctcggctgaccgggcggggtctccctccccgcagagtgcagtgaagacaacccctgcgagggcctgagcaggcacgccaccttcagcaacttcggcatggccttcctcacgctgttccgcgtgtccacgggggacaactggaacgggatcatgaaggtacccgccgcggccatgcctctggcacctggcagccccagcggtttttcaggctctcccaggaacgggtcggatccgtccttgcagggcagggggaaggggacggcactgccagggtggcacccgcgggtgggtgtggaccccggcccacagctgtcccccaccgcaggacacgctgcgcgagtgctcccgtgaggacaagcactgcctgagctacctgccggccctgtcgcccgtctacttcgtgaccttcgtgctggtggcccagttcgtgctggtgaacgtggtggtggccgtgctcatgaagcacctggaggagagcaacaaggaggcacgggaggatgcggagctggacgccgagatcgagctggagatggcgcagggccccgggagtgcacgccgggtggacgcggacaggcctcccttgccccaggagagtccgggcgccagggacgccccaaacctggttgcacgcaaggtgtccgtgtccaggatgctctcgctgcccaacgacagctacatgtt

SEQ ID NO: 78414 - DNA, 252 bp, Homo sapiens
  chr16:1270197-1270449
  hypo
aggaggccgaggcctcggacccagccgacgaggaggtcagccacatcaccagctccgcctgcccctggcagcccacagccgagccccatggccccgaagcctctccggtggccggcggcgagcgggacctgcgcaggctctacagcgtggatgctcagggcttcctggacaagccgggccgggcagacgagcagtggcggccctcggcggagctgggcagcggggagcctggggaggcgaaggcctggggcc

SEQ ID NO: 78415 - DNA, 517 bp, Homo sapiens
  chr16:1271155-1271672
  hypo
agcaggagtagctgccgggccccacgagcctccgtccgttctggttcgggtttctccgagttttgctaccagccgaggctgtgcgggcaactgggtcagcctcccgtcaggagagaagccgcgtctgtgggacgaagaccgggcacccgccagagaggggaaggtaccaggttgcgtcctttcaggccccgcgttgttacaggacactcgctgggggccctgtgcccttgccggcggcaggttgcagccaccgcggcccaatgtcaccttcactcacagtctgagttcttgtccgcctgtcacgccctcaccaccctccccttccagccaccaccctttccgttccgctcgggccttcccagaagcgtcctgtgactctgggagaggtgacacctcactaaggggccgaccccatggagtaacgcgcccggccccgatgcgaatcaggcctcccctacatctgggggcgttggccgcgagattcccattgacacctttgtttcgtgtgcttttaaat

SEQ ID NO: 78416 - DNA, 38 bp, Homo sapiens; identical to SEQ ID NO: 44487
  chr16:1272194-1272232
  hypo

SEQ ID NO: 78417 - DNA, 114 bp, Homo sapiens
  chr16:12758831-12758945
  hypo
cggcggtgaccaccacgactcggagcccgtgggggtctctgcccagctggcatccaatggcagatgacaccaccatgtcgaggttctggtaggtacccccggcattcctgtggt

SEQ ID NO: 78418 - DNA, 30 bp, Homo sapiens
  chr16:12798468-12798498
  hypo
cggggcctctacctgcgtggatgaacttgt

SEQ ID NO: 78419 - DNA, 30 bp, Homo sapiens; identical to SEQ ID NO: 44488
  chr16:1288468-1288498
  hypo

SEQ ID NO: 78420 - DNA, 108 bp, Homo sapiens
  chr16:12897794-12897902
  hyper
ctagtgctgcctgggcggagcggaggcgccagcggcccctctgggatcgacctgcgcgcctggcgagtggagactgtctagggcacgcgtgggcggggataaggcttt

SEQ ID NO: 78421 - DNA, 30 bp, Homo sapiens
  chr16:12956299-12956329
  hypo
ccactgctcacctcccgctcacccaccgct

SEQ ID NO: 78422 - DNA, 71 bp, Homo sapiens
  chr16:12971895-12971966
  hypo
ttttcttcttcctcgcgcttctagcgttgatataaataagcacttatagaaggactcgatttctctttttt

SEQ ID NO: 78423 - DNA, 30 bp, Homo sapiens
  chr16:1297961-1297991
  hypo
atccatgcactcacacgtgcacacagatgc

SEQ ID NO: 78424 - DNA, 1385 bp, Homo sapiens
  chr16:12994419-12995804
  hyper
cggggagctggaattcgctaggagagagagggcagatttggaaacacagaggagacgggaggctggaagctgaggaagcaaggcagagctctgcagcccccggtgaggatttccggggggatccgtggggacaggggccagccagctccagagaccgatgcgcgggctccaggtccgggagggtggctgaggctgggtgcccaggccttgcgctgcgccagatccgggagcgcagaggcggcgccgcggtgttccctcctgtggagcgcagaaaacgctgcgggggcgaagagggacagaaagcggcaggttcgagaggctgggggacttccaaggaaagaccttccaggacacgccatagcctcggccttgttcggctgtcccctcttacccccgaccttctttgattcgttcatcccgagcccctctcccccggagggtgcttatccctggctcaggggcttgccacctgtccttcccagctccgcctgggtccttgcttgggcccagagagttgagccatgcgggttgcgctcagggctggagggcgcagccgggaagggcaaggaggccccgcacgcctgggaggggcgatcctgaccagactgcacccagtctgtcttggagtgaaagccatttagtctgtccccatcctctccgagtcatccttcccctgatgcacagatttcggccgccgctcctgcacacgcaccggtgaaaaagctacgagctgagccgcctctgcgctctggacagggctgagccgcgcctcctacccagagagggcgcgggaggtcctgccgcggttttccacctgcctggaaatccgagcggctcctctagcctcggctgctgccgagctcgctcctccccgtccgctcgcctggctcagctctgcacgccccccagctagctcccgctctagtcacctcttccccgcgcccccgcccctctagagctcgcgcccgcccccccccacccgcgcctcctctgcccgccctcctccccctcccccttccctcctgccctcccttcattccacaagtgtcgcttcgctctcttcagcgcacttggcgagctggtgaggtgagagggatactgcgagagggctaggggcggccagtccggggctgccggccaaggctaggcgctgccagcccgattctcctctgctctccacccccgcctcacccagtggccggccggacctgcaccccgcgcttgaccccgctcatcctccccccgcccggccgggcgcgctcctccccggccggcccctcggcgcgcggcgcgctggaggcgaacgcgggctgaggcgaacgcgggctgagccgagcgcagtggccgccgaccaccgagcgccccgcgccgctccctgcatgtgc

SEQ ID NO: 78425 - DNA, 1630 bp, Homo sapiens; identical to SEQ ID NO: 36076
  chr16:12996073-12997703
  hyper

SEQ ID NO: 78426 - DNA, 27 bp, Homo sapiens
  chr16:13064659-13064686
  hypo
tgtgagccaccgcgcctggccggggca

SEQ ID NO: 78427 - DNA, 64 bp, Homo sapiens
  chr16:1307000-1307064
  hypo
cggagaccttccccccggggatgccgtgctgggtcactggctggggcgacgtggacaataatgg

SEQ ID NO: 78428 - DNA, 30 bp, Homo sapiens
  chr16:1307785-1307815
  hypo
cgggctctgcacccccgtgccatggagccc

SEQ ID NO: 78429 - DNA, 318 bp, Homo sapiens
  chr16:1312397-1312715
  hypo
tttgggcccacagcccgagtccttccccagcctccacccaacacgccccgaacatcctgatcgctccccagccagtcacccagcactggtccttcggggtgagctccagcgagaccggggagagcttgaccgtcctgacattagcggctcagatcatggggctcaccagctggagcagggccacatccgcacccagccccgcagtgacatagttggggtggacgatgatccggctgacgttcagcagcccccggcccccgtagagatacacgtccccagcgtggatccggtagatggacgggtcggtgtccttcctgg

SEQ ID NO: 78430 - DNA, 133 bp, Homo sapiens; identical to SEQ ID NO: 44491
  chr16:1315371-1315504
  hypo

SEQ ID NO: 78431 - DNA, 30 bp, Homo sapiens
  chr16:1316065-1316095
  hypo
aggggtcctgggctgcggggggctggggga

SEQ ID NO: 78432 - DNA, 33 bp, Homo sapiens
  chr16:1321465-1321498
  hypo
ggtgctggggatggccgtcgtgtagcaggtggc

SEQ ID NO: 78433 - DNA, 432 bp, Homo sapiens
  chr16:1323678-1324110
  hypo
ggactcacgtgtagacgccaatgctgggccgatcactgtaaaatccccagctcactactcccgcctggagccaggtacccttcttcttgcagaccagggggctgcctgagtcaccctgtggagcagagaaggcccagcttgaccagagacccaggaccctgcacatccaagtccagcatcggagccgcagacaggaaaagagatggcaggagagaggcgccaggtctcaccttccaggtgcggcggcccgtgcggccggcacagatcatgtcatcctggatgaactttctgtctccagcaccaggaaaagcatcgtaggtctgccgctcacagtctgcattgctcagtgtgaggaccttcacctgctgcgggcggtaaggaggcggcagcatatctgcagagacaagccacgggtggcgggagcagctcagg

SEQ ID NO: 78434 - DNA, 30 bp, Homo sapiens
  chr16:13266811-13266841
  hypo
cttttttgtgattgccgtgtgctcccaagt

SEQ ID NO: 78435 - DNA, 51 bp, Homo sapiens
  chr16:1329677-1329728
  hypo
gacagctagctcatccgtgggctctgggaacccgggcggggaggctgagct

SEQ ID NO: 78436 - DNA, 36 bp, Homo sapiens
  chr16:1330337-1330373
  hypo
agcagctcccacagccgacgccgagggcagagggcc

SEQ ID NO: 78437 - DNA, 280 bp, Homo sapiens
  chr16:1330636-1330916
  hypo
ttgggctcatggtcccgctcagcagaaacaacacactcaagctccaacggaagccagaagggaatcacagggctgcagtgctatagaacgtgacgttcccaaaattaaagacgggagctccaacaaataggagaaaaagccatctagaaaagaagcaacagccacactgaagccgtgggtcacactgagagctgtgccttctgtcccaacctgcgatgggtgttggggagaggacagctagctcatccttgggctatgggaaccccggggggtcggaggc

SEQ ID NO: 78438 - DNA, 156 bp, Homo sapiens
  chr16:13676585-13676741
  hypo
atttgtttatattctaactacagccccagaaagatagtcatcattaatccctactttacagaggaggaacccggggcttagagaagggaattgaactgcccaggctcatattgctaggagttagccaagctgcgtatgaaacgactacctcttctg

SEQ ID NO: 78439 - DNA, 93 bp, Homo sapiens
  chr16:13687295-13687388
  hypo
cggtgtgatcatcatcgaaccatgacctgacactcctagtgagtgtggggagaacccctctgcccatctacctggaacaatatgagctataaa

SEQ ID NO: 78440 - DNA, 324 bp, Homo sapiens; identical to SEQ ID NO: 36012
  chr16:1382374-1382698
  hyper

SEQ ID NO: 78441 - DNA, 324 bp, Homo sapiens; identical to SEQ ID NO: 36013
  chr16:1382818-1383142
  hyper

SEQ ID NO: 78442 - DNA, 308 bp, Homo sapiens
  chr16:1383678-1383986
  hyper
gtgcctcggcgtccccgagctggtgccgagcgcagcgccccaggagcccccccatccccgcgccggcccacggtaagtgccgcgggctgcggccagtgctgttgggccgccgtctgggctcggccccgcgccccaacccggacggaccgacggccgccgcccccttggtccgggtcccccaggaggcacgggggtggcctccgaggcggggggcggtgggaaggtctcgacgtcccctcggccctggggaaactgaggccgcgcatgcttggaggggcggggtctcgggggcatttcccctccgaacg

SEQ ID NO: 78443 - DNA, 78 bp, Homo sapiens
  chr16:1384020-1384098
  hyper
cggagcggacggggagggtatccgggcgctggcgacggcctcccccgcacttgagccgccaagcgaggcttcgacccc

SEQ ID NO: 78444 - DNA, 312 bp, Homo sapiens
  chr16:1384458-1384770
  hyper
gggcagggagggggtcggtgagcagagggaggagggagcgctgcgcagacacgggcgaggggaggaagaaggcgcctcgggctccggtctcctgcgctcctgctgggcgccagcggctggaccttggcagccgtctgaggcttcggggagcccaaggccaccggcagcgcttgttagaatgcagattcccggggttcgactggaatgagaccccggggagcagcgtttgcagcgggcccgccaggtgacctgcacctgggcaccgccatcggcttcgcaggggccatctggaggagtcggtgagaccaggga

SEQ ID NO: 78445 - DNA, 30 bp, Homo sapiens
  chr16:1390516-1390546
  hypo
aggtgcacacagacacgcacacacacacac

SEQ ID NO: 78446 - DNA, 527 bp, Homo sapiens
  chr16:1391705-1392232
  hypo
agcctgtctggagagcgggtgcttgtggcctggtccctgctgcttctggactccctgaccccggcctgggcagagcctcgccggggaccctcatgggcatctctgttctccttgtagcgagattgaggatgtgagcacggaccagctgcacctggacatctggtacaggcccctgcgccatgcagggcggcggggatgcacaccttttgcgggggagcaggacggactcagggcccggctgcgggctccagacaagccaggtcctcccctgtccccaccagggatcatgacgacgatgtatccctggtagaagcgtgcaggaagctgaatgaagtcatcggcctgaagggcatgggcaggtatgactgctgggacctttctacccatcacccgtgccctcagcttggtcatggggcccggcgggcagtggctccccaggagccatcagcgtgatgctcaccacctgtggtggccaggtacttcaaacagatcgtcaagtcagcccgcgcaaacgggacagcaggacc

SEQ ID NO: 78447 - DNA, 30 bp, Homo sapiens
  chr16:1394474-1394504
  hypo
caaccgtgagtggtacgacaggatcctgaa

SEQ ID NO: 78448 - DNA, 30 bp, Homo sapiens; identical to SEQ ID NO: 44496
  chr16:1397121-1397151
  hypo

SEQ ID NO: 78449 - DNA, 437 bp, Homo sapiens
  chr16:1397422-1397859
  hypo
aactgcagccccacacgggctgtgtccttgagcatgaggtggccccacgggcagtcaggtctccaagtgccagcgctgaccaccagcacccaggggcccctcctgatgcgcttccccctgcagaggctgaaggaggagctgcggctgcacaaatgttccacccgcgagtgcatcgagcagttctacctggacaagctcaaacaggtagggaggcgccagggacagggtgctgcctccgaggctcccagagcccagctgcgctcacccgcctttccgcagaggaccctggagcagaaccggtttggacgcctgagcgtccgttgccattacgaggcggctgagcagcggctggccgtggaggtgctgcacgccgcggacctgctccccctggacgccaacggtgagttgcagcggggacgggtcgggtggtggtggga

SEQ ID NO: 78450 - DNA, 30 bp, Homo sapiens
  chr16:13977355-13977385
  hypo
acaccaccacccaaccgtaatctctaatgc

SEQ ID NO: 78451 - DNA, 112 bp, Homo sapiens
  chr16:1400845-1400957
  hypo
gaaagtctgtagggccggccatagttcacggggttggcggccaccaggtagggcaacaggcgcaagtggctccctcgcatcttcccaaacggtgtctcgtccagcctggccc

SEQ ID NO: 78452 - DNA, 30 bp, Homo sapiens
  chr16:1404083-1404113
  hypo
aggctcacttccctgcggctcagaagccat

SEQ ID NO: 78453 - DNA, 32 bp, Homo sapiens
  chr16:1407453-1407485
  hypo
agtcacccagcacctcgtgtgtatttcgactt

SEQ ID NO: 78454 - DNA, 151 bp, Homo sapiens
  chr16:1407785-1407936
  hypo
tgacagtcatgagccaccgcgcctggcctcgactttattattaatacggtaaaactacagagagtttgaaacatcagtctggggcgtcctcctctaaccagtgcacttgctgctgcagcgcaggcccttcaggggacggggatgggggcca

SEQ ID NO: 78455 - DNA, 364 bp, Homo sapiens
  chr16:1417076-1417440
  hypo
ccagagcaggactcacgccgtccaccgcctccaggtccaggcgcagctgactctgcagcgagtgcagcttcggcaggggaatggtgccgatgtccccacagccccgcagccccggcagtgtggaggctacgcccaggccctccagctcctcctgcagctgcttcacctgtgcctccacctcctccttcttctgcagcgccagctgccggtcgctatcggccacacgggcacgctccttggcctcctgcgcctctcgctgccaggcatcgcagacctgaaacccagggcccgtctcagcaccccccacctcacctgtgccacctgcagaccctcttgcctgtgtcaccagcgatcctcccctccc

SEQ ID NO: 78456 - DNA, 431 bp, Homo sapiens
  chr16:1417675-1418106
  hypo
gactcctcccactgccggatcttcctcttggcctcgtccagctgccgcctgacccgggccagctcagctccgtttggacttgcactcgaagaggatggggggccggcactcaggatgggggaggggctgggggagaagctgccggaaacaaagtcccagatgctcccggggacaccgttcaaacctgagtgtgaaacggtcgatgacggcccagccctgctgtgctcgcggcctggtgggattggtgggtgctatgccccaggccccaccgctacgtgggcaccctctggggctcacctgccctggcagcaggggtgcagccacgcctgccccttgccccactcctggaccccaccaggctcaggaagaggcgctgacagtgacacctgccccggccggtctccccaccagatctacgccttcctggccac

SEQ ID NO: 78457 - DNA, 30 bp, Homo sapiens
  chr16:1424439-1424469
  hypo
gtcctcacctgggaccgatggtccctccat

SEQ ID NO: 78458 - DNA, 284 bp, Homo sapiens
  chr16:1425400-1425684
  hypo
cccagactcaaccctcgtccacacgccagccgtgagggaatttccggggcgtggaggccgggctgtggcgccacctggcaacactgtccttccccatcccgtcacagaggcagcagggcccagggcagagaacctgaacccctggggcgtccgggacggcacacggcgcatgcgggagtggcctccactcccacggagacaccgttccaatgaagcttttagggactttcgaaggtcttatccagaaactagagtaacaggttgggggtcggggcagccaggcc

SEQ ID NO: 78459 - DNA, 57 bp, Homo sapiens; identical to SEQ ID NO: 15935
  chr16:142626-142683
  hypo

SEQ ID NO: 78460 - DNA, 794 bp, Homo sapiens; identical to SEQ ID NO: 44503
  chr16:1428113-1428907
  hypo

SEQ ID NO: 78461 - DNA, 266 bp, Homo sapiens
  chr16:1430200-1430466
  hypo
cttaaatacagaatccgctcatttcttctattccgtgctccagtcacagtacacctacaacctgaaggaaactgtactattaacacaaggaaaaaacgacccagtctacacaccagctttgtccaaaaccctctacaacagctaataaaatacacacgcagccaggcgggcctacacctggggccagacagtcccgggagccatgggcagggagtccctgagcctggggcgcaggagtgccctggggtcagcgggcaggacactgc

SEQ ID NO: 78462 - DNA, 30 bp, Homo sapiens
  chr16:14359651-14359681
  hypo
ataagatggcaatctcggatctacaaggtg

SEQ ID NO: 78463 - DNA, 32 bp, Homo sapiens; identical to SEQ ID NO: 44607
  chr16:14464204-14464236
  hypo

SEQ ID NO: 78464 - DNA, 44 bp, Homo sapiens
  chr16:14615356-14615400
  hypo
gttaaatatatgtaacgggccgggcacggtggctcacgcctgta

SEQ ID NO: 78465 - DNA, 39 bp, Homo sapiens
  chr16:1469293-1469332
  hypo
aaaaaaaaaggaaaacgaaactttttttttttttttgag

SEQ ID NO: 78466 - DNA, 98 bp, Homo sapiens
  chr16:1469572-1469670
  hypo
aagtgctgggattacaggcgtcagccaccgcgcccgaccggaaaaggaaacttttaaaaatagctgctggtgcaactaacttacgtgctctggtaaac

SEQ ID NO: 78467 - DNA, 88 bp, Homo sapiens
  chr16:14724470-14724558
  hypo
tattaagaaaaagagcggggcgatgtaatagagaataatgggatccgggtgcggtggctcacgcctgtaagcctaacactttgggaac

SEQ ID NO: 78468 - DNA, 102 bp, Homo sapiens
  chr16:14725771-14725873
  hypo
tgaactgggaagcagcgtattaataaatctgtataaataactgtttaatgggggcctggcgccatgactcacacctgtaatcccagcgttttcgggggctga

SEQ ID NO: 78469 - DNA, 102 bp, Homo sapiens
  chr16:14726113-14726215
  hypo
tcaaaaacaaacaacaacaacaaaacaaaaccaaataatcagcataagttctagacgctgtgacctagacgctgggaaggggcgaaacgtggtgataagaaa

SEQ ID NO: 78470 - DNA, 30 bp, Homo sapiens; identical to SEQ ID NO: 44610
  chr16:14728494-14728524
  hypo

SEQ ID NO: 78471 - DNA, 48 bp, Homo sapiens; identical to SEQ ID NO: 44611
  chr16:14761842-14761890
  hypo

SEQ ID NO: 78472 - DNA, 91 bp, Homo sapiens
  chr16:1477599-1477690
  hypo
gctaattcatccacccgtcccccagggggtccccatatcccaccctcgcccctccggccacccctgggttccccttcgctgcctgcttgga

SEQ ID NO: 78473 - DNA, 367 bp, Homo sapiens
  chr16:1486290-1486657
  hypo
gtggcagggtgagcccggtgctgggccaggcccgggctcagggggaacaggtctgtcacgataccaggggattgtggagagtagcgtggggaccggcccagcccagtaacggtcagcagagcccctgcccctctcccagggcctggaggctgtacctggccttgccttcggcggaaatcctgaggtctgagtcgctcttatgaagcaggcacttgtcggagacactctctatctgaacacagagccgggagcggcgggcagccccagggcgccatctaggaccagccttggcctcgacccacacagggagagggaggaggggagaggacaaggtgcagggagaagggtcccacgccacctccaaggc

SEQ ID NO: 78474 - DNA, 129 bp, Homo sapiens
  chr16:1487040-1487169
  hypo
gaccacacaggtgcccgagggaggcagggcaggccccggtgggacccagccccgaaacgcagggtgtcgcccacgtttgcagccgcgctcgcgtgtcggtggatgagcgggaaccggggggcggcgcct

SEQ ID NO: 78475 - DNA, 49 bp, Homo sapiens
  chr16:1487580-1487629
  hypo
ccagctcgggcctcacgggctgcagatgctgggccgaggctgctcagcg

SEQ ID NO: 78476 - DNA, 150 bp, Homo sapiens
  chr16:1487901-1488051
  hypo
ctgcccggccagctgcgccacggatgcctccagagcccggctcttctctcggagctgcaggggacaggtgggcacggggaggcctggctgagcgcccatcccgtgtgcgtgggagaccccgttggggacatgttgcgctaccccctcacc

SEQ ID NO: 78477 - DNA, 30 bp, Homo sapiens; identical to SEQ ID NO: 44506
  chr16:1488680-1488710
  hypo

SEQ ID NO: 78478 - DNA, 498 bp, Homo sapiens
  chr16:1491115-1491613
  hypo
tctcaaaacaaaaaacgagtgtcggcctggctttgctgcctctggccctagagagcactcagacacccggactcagggaaaggcagacgccctcatgagcggcagctcccccacacctggcaccttgggaatcctcagcccagcacccctgcctgctccacacggccactcagtaacttcctgaagggcagtgagagggaggctgccggctccgggcagtggagctatgtgggtggcagctgggtgccccggcagtcctggcccctcacccagcgtactgcctgatgcgcacgggagctggctgcagtccccggtctctatttgtggagctcagacccgggctgctgaaatgtgcagctgcccgttccctccccacccacagcggaggcccctgctgaggccacagcaggagggggagccactccagccccgtgggtgggaccctggcttctaggaactcgtgtcctcgaggaaggtgaactccgctttgtgtgcagg

SEQ ID NO: 78479 - DNA, 117 bp, Homo sapiens
  chr16:1493574-1493691
  hypo
agccctgcagctgcacgcgggcccgcacctggagcagctcccgcagcaggctccgcgtggcgcgctcacagcgctgcttgtgctcccgcaggcaggccacctcggcctgcagctcca

SEQ ID NO: 78480 - DNA, 48 bp, Homo sapiens
  chr16:15052961-15053009
  hypo
taaattacttcattacgttgatgcttcatcatccgtggaagctgtgac

SEQ ID NO: 78481 - DNA, 35 bp, Homo sapiens
  chr16:15191537-15191572
  hypo
tatcgcccaatttaagaagccgaacattaactagg

SEQ ID NO: 78482 - DNA, 24 bp, Homo sapiens
  chr16:1523806-1523830
  hypo
aggcgcagtggctcacgcctgtaa

SEQ ID NO: 78483 - DNA, 24 bp, Homo sapiens
  chr16:1524070-1524094
  hypo
gtgaaactccgtctcaaaaaaaaa

SEQ ID NO: 78484 - DNA, 174 bp, Homo sapiens
  chr16:15241215-15241389
  hypo
atgaaatcatcaccacggcttctcagagcctcaatttcctggtctgtaaaatgagaccaggagtggctgcaaccctgcagtgccgtgatgagctatggagagacaagaacacagagggctcagcgcagggcccggcgtggccaccgcggggagagggtgcggactcttcctaga

SEQ ID NO: 78485 - DNA, 86 bp, Homo sapiens
  chr16:1541511-1541597
  hypo
gcaccagcatggacccgtgccttcaatggctccaggagatgcctgccacacaagcaaaatcttagtccctgcgagggccttctgtg

SEQ ID NO: 78486 - DNA, 259 bp, Homo sapiens
  chr16:15489930-15490189
  hyper
cgccaacttcaactacgtgtggctgcgcctgctggagcgcgcgctcccgggccgagcgccgcacgccctgctggccaagttgctgtgcgaccaggtggtcggtgcgcccatcgcggtctcggccttctatgtcggtgaggggccgggaggggacctggggggtgggacccagtattgggggactggaggctgggactcggggatcaagcggctggagggagggcgctgcaggagcctggggacccgggcaggagccggg

SEQ ID NO: 78487 - DNA, 36 bp, Homo sapiens
  chr16:15522286-15522322
  hypo
ttatttattgctgggcgtggtggctcacgcctgtaa

SEQ ID NO: 78488 - DNA, 808 bp, Homo sapiens
  chr16:15528335-15529143
  hyper
ccccttctgggtacccgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaagtgagtactggggcggggggcggggggccggggacagctggggatccatgcgcctgcgcgggtggtcgcgggagcgcgaggaacgccagcagtggacccagggaagcgcccccgcagcggggctggcagctcagggggatacgcagctctgcgcagcgacgcgctctccccgcgaacaaaagggggggaccctccgggctgagcctcactgggagggttgggagatggccaggcagctaaggcaggagcctgggctcgacttaggagtcccggatccgtcagctcgcagctggtcctgtgaagtcgggtctctcccacagcccagggaggaggatcctctctccgcctgggatgcgccagggcgctggagacgcgggaccgtcctggaaagcgcccacgtccctggagaggggggagtgtctgctggttttccgcttgctttcctaccccctgcgtgaggtttcggagcgcacctgaaattcccagcttttcctccctcgccttccttgggtcggggtgggaggctt

SEQ ID NO: 78489 - DNA, 20 bp, Homo sapiens
  chr16:15552675-15552695
  hypo
aaacaaagccaggtgcggtg

SEQ ID NO: 78490 - DNA, 30 bp, Homo sapiens; identical to SEQ ID NO: 44614
  chr16:15555102-15555132
  hypo

SEQ ID NO: 78491 - DNA, 15 bp, Homo sapiens
  chr16:15594787-15594802
  hypo
cgtgagccaccgtgc

SEQ ID NO: 78492 - DNA, 161 bp, Homo sapiens
  chr16:15595873-15596034
  hypo
ctcttttatgacccccgatttacagataaggaaactgagtctcaaagaggttagggcatttgccgaggtcggccgttagaaagatgccggaccatctactcatgtctgcttgacgccaatgcctgcgtcttcacgtgctgttggtgcgtcctcctgaatta

SEQ ID NO: 78493 - DNA, 17 bp, Homo sapiens
  chr16:15600039-15600056
  hypo
cttttatttttgagacg

SEQ ID NO: 78494 - DNA, 113 bp, Homo sapiens
  chr16:15604260-15604373
  hypo
cttgctggcttatggcgaggattaaaagaggtgatgggcagagcaggtgcggcggtcataacgagggcaattgcaagcatatattaaacgtgacgtgccggggtaattcatcc

SEQ ID NO: 78495 - DNA, 58 bp, Homo sapiens
  chr16:15626753-15626811
  hypo
ctgataaatagacctcgtgcctggtaagtgtgtttacttgctccggattaaattacac

SEQ ID NO: 78496 - DNA, 30 bp, Homo sapiens
  chr16:15628035-15628065
  hypo
atgaccagtgacaatcgtctcctggctcac

SEQ ID NO: 78497 - DNA, 129 bp, Homo sapiens
  chr16:15692042-15692171
  hypo
gctagcccagcagcccggggccactgcctctctagtgacggcaccagctgtgccttagtcacgcagcctgtggaataaagcagctgcctttattccacggctctcacctggagccgtggtaagagttaa

SEQ ID NO: 78498 - DNA, 37 bp, Homo sapiens
  chr16:15743162-15743199
  hypo
tcctctgcataatgtcgtttgtttgtttgtctgttct

SEQ ID NO: 78499 - DNA, 28 bp, Homo sapiens
  chr16:15746797-15746825
  hypo
gagagagccaccgcgcctggcctaagct

SEQ ID NO: 78500 - DNA, 170 bp, Homo sapiens
  chr16:15762561-15762731
  hypo
agtgcttaggagccacgtgtggccagtgagtttccttagtggacagaggggctgcagaccatttccttcattaccaaaaggtgtgttgcactctgccagttcagagcaggtttctcgacctggctgctgttgacattggagcccggatcatcctccgttgggagggactg

SEQ ID NO: 78501 - DNA, 30 bp, Homo sapiens
  chr16:1576652-1576682
  hypo
gcgggcctctagctccggctcctgctccgc

SEQ ID NO: 78502 - DNA, 30 bp, Homo sapiens
  chr16:15767710-15767740
  hypo
gagagagcacgggaacgggcaggtgatctg

SEQ ID NO: 78503 - DNA, 30 bp, Homo sapiens
  chr16:1580669-1580699
  hypo
gccccgtctctcccacgcggaggccacccg

SEQ ID NO: 78504 - DNA, 92 bp, Homo sapiens; identical to SEQ ID NO: 44620
  chr16:15820825-15820917
  hypo

SEQ ID NO: 78505 - DNA, 30 bp, Homo sapiens
  chr16:15841780-15841810
  hypo
tcgccgccaggatctcgtagcttgaaacac

SEQ ID NO: 78506 - DNA, 498 bp, Homo sapiens
  chr16:15950839-15951337
  hyper
cgagctcggatctgacgcacctcccaggccggagcgtccaaatctccctgcgcgtcctcggacgcctctctttatagacccggagctgcccgcggctgggaaaggggaggaggccgaaggggtggagttggggagggtccctcgcggccccctcgccgcgccccctgcagggcgcacccccggcgggagcgcaaggagctggggcgctcgggacaagggtgcacggaacaggtgcgcaccgcacaagggcgcacggaacaggtgcgcacagggacgggagtctcagccccggccccaggcggtcgcagacgctccggatccctagagaaagggggtcgagcaggcagtgtctgtgcgggatgcttgagaacgtcttccctgagtcggttccggccgcaaaggctttaacctcttcctccccgtgtcggggctgtggtggatctgacttgacatctcccaccccacttcccattttattggcatcgcactgtctggaaa

SEQ ID NO: 78507 - DNA, 643 bp, Homo sapiens
  chr16:15951793-15952436
  hyper
catcacaggctctctcgctctgtctctgccactgtctctgcatgtctgtcactctgatcattgctgtctctcgctctatcttttgtctctgtccctctcgcttctctagatctgtcgatgtatctgtctctccctcctgtctcactttgtctctggtctctgtgtctcttgctctccatctctcccgcgtgtctcactcctatctctgcgctttctctctctctcttccccaggctctccgtcttctccccgtccctccctccccgctcctgtccacgcacgcacacacaggccataaaaggaagtcgaggcggtgggctggccccgcgccaggccggggacccgcgggcagcccgggcgctccgctccccgcgcggcaccagctcctccgaggttcccgggccgggccgggccgggccggtccccctccccgggagcggcgggagcggcgggcgggagacaacccaaaaagggcaggcgcggactccttcctgcaggaattcccagcgccgcataccagctctgggctgccggctccccctgactaaatatggtgccgagtggccttcctgctccccggcgtcgggggagggggcccttcacgcagccaccggccgccgttgccccgcggggctagatgggg

SEQ ID NO: 78508 - DNA, 30 bp, Homo sapiens
  chr16:16045826-16045856
  hypo
atgggcctctgtgcccggctgtttttgtgt

SEQ ID NO: 78509 - DNA, 30 bp, Homo sapiens
  chr16:16122579-16122609
  hypo
ccctcctggcagtcccgggggataggtcga

SEQ ID NO: 78510 - DNA, 119 bp, Homo sapiens
  chr16:1642740-1642859
  hypo
gagggacaggtgtcccggcagagtgactggtggagggacaggtgaacaccagccacacggtgcccagcactgacctccccatgaaggctggcaaggtaccctgacggagtcactggcgg

SEQ ID NO: 78511 - DNA, 37 bp, Homo sapiens
  chr16:16663469-16663506
  hypo
cccaaagtgctgggattacaggcgtgagccaccccca

SEQ ID NO: 78512 - DNA, 30 bp, Homo sapiens
  chr16:1682337-1682367
  hypo
gatcaccaagtacatcgactttgatcatgg

SEQ ID NO: 78513 - DNA, 30 bp, Homo sapiens
  chr16:17046472-17046502
  hypo
actcaaagtgttcttcgactgccatgaaga

SEQ ID NO: 78514 - DNA, 22 bp, Homo sapiens
  chr16:17049589-17049611
  hypo
accacgccggccacaacagatt

SEQ ID NO: 78515 - DNA, 30 bp, Homo sapiens
  chr16:17077914-17077944
  hypo
ctctgactgccgctacgttactactattac

SEQ ID NO: 78516 - DNA, 30 bp, Homo sapiens
  chr16:17202525-17202555
  hypo
ctgtggcccactcctcgtgcccagtgctac

SEQ ID NO: 78517 - DNA, 30 bp, Homo sapiens
  chr16:1725008-1725038
  hypo
gggcattggtgtgggcgtgcctgacatacg

SEQ ID NO: 78518 - DNA, 30 bp, Homo sapiens
  chr16:17294271-17294301
  hypo
ggtatcagggagggacggacagaccccgaa

SEQ ID NO: 78519 - DNA, 120 bp, Homo sapiens
  chr16:1729679-1729799
  hypo
agagcaagactccgtctcaaaaaaaaaaaaaaccctttagatttgagggagttaggtcagtattcagtaatacttgtaaccaaataattacccgtggcagggtgcagtgactcaacggct

SEQ ID NO: 78520 - DNA, 455 bp, Homo sapiens; identical to SEQ ID NO: 44511
  chr16:1730306-1730761
  hypo

SEQ ID NO: 78521 - DNA, 66 bp, Homo sapiens
  chr16:17335057-17335123
  hypo
taaattccttgatagcgtttcatgcacctaatggtgcagttcctgtgttcacggcaataaacaagg

SEQ ID NO: 78522 - DNA, 30 bp, Homo sapiens; identical to SEQ ID NO: 44622
  chr16:17341523-17341553
  hypo

SEQ ID NO: 78523 - DNA, 30 bp, Homo sapiens; identical to SEQ ID NO: 44512
  chr16:1734955-1734985
  hypo

SEQ ID NO: 78524 - DNA, 18 bp, Homo sapiens
  chr16:17368739-17368757
  hypo
ctctcagagcagggccgg

SEQ ID NO: 78525 - DNA, 30 bp, Homo sapiens
  chr16:1738302-1738332
  hypo
ggtagcagacctagccggtagcagtgctag

SEQ ID NO: 78526 - DNA, 42 bp, Homo sapiens
  chr16:1738667-1738709
  hypo
agtttgaaactggcttgggcaacatagcgaggcccaatctcc

SEQ ID NO: 78527 - DNA, 54 bp, Homo sapiens
  chr16:1740152-1740206
  hypo
ccctgctttaggccccgccgcagcagtggggccctcaagcgggtctgaagacga

SEQ ID NO: 78528 - DNA, 386 bp, Homo sapiens
  chr16:1741726-1742112
  hypo
ctcagggctggcactcggggttcctatgagaggaggtctccaaagcactgcgggggtggggtggggtggggtccggtggacgtctggttgctcagtgttctgtgatcgtttctgcagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggtatggactgcattcagacgtgacagcgcagcagcgggtatgccaggtgctctttccaaaaaggctccaaggcagatgcgacatgtttttagggagaatcatggtgggtgccgtagattatcctgg

SEQ ID NO: 78529 - DNA, 16 bp, Homo sapiens
  chr16:17566188-17566204
  hypo
tgagataggcctgggc

SEQ ID NO: 78530 - DNA, 30 bp, Homo sapiens
  chr16:17659142-17659172
  hypo
aagctggcgtggggccgggcgcggtggctc

SEQ ID NO: 78531 - DNA, 29 bp, Homo sapiens
  chr16:17821439-17821468
  hypo
tgagatcaggccaggcgcggtggctcaca

SEQ ID NO: 78532 - DNA, 30 bp, Homo sapiens
  chr16:1782670-1782700
  hypo
gatgccagcttgccccgagaacaggtggtg

SEQ ID NO: 78533 - DNA, 88 bp, Homo sapiens
  chr16:17866374-17866462
  hypo
aggaatcagaagcaacgcagagctcagagaagtgggagagaattagtgcagcgtaggaaattagccttcttcctgactcctcatacac

SEQ ID NO: 78534 - DNA, 152 bp, Homo sapiens
  chr16:17913465-17913617
  hypo
tataacacgatcctccggcacaccgggttgtattactcatttcatcagcatagatggaatccgatatttggctccactatcataacatacatccaagggcttatttcctccaaaagaagtacaattggaaatagcatcgattgagccaaaac

SEQ ID NO: 78535 - DNA, 30 bp, Homo sapiens
  chr16:1793857-1793887
  hypo
tgcccctgagagccacgcctctactctcgg

SEQ ID NO: 78536 - DNA, 119 bp, Homo sapiens
  chr16:1807880-1807999
  hypo
agggcagcaggcttccgggtcagggctcggcaacacagccctgggctggaccacggcgcctgggcctggttccctgcaggcctctgcctgggcacacggggcaccgggacctgctggag

SEQ ID NO: 78537 - DNA, 555 bp, Homo sapiens
  chr16:1813482-1814037
  hypo
ctgggcacccagtgccgggaaagccacccttcccagctgggcacccggtggccgggaaaaggcgaggatgggcccaggcgggcctccctgccgtgacctcccccaggacaagcctggggcactgtgggggccgctcaccctggacagagacatcacccatcattcttccactcagcgactgcacgtcctccgcccgtcgagagcagaagcgcgagcagtaccgccaggtgcgtgagcacgtgcgtaacgacgacggccgtctgcaggcctgcggctggagcctgcccgccaagtacaagcaggtgcgggcgggcgctgcggggaccgggcggggccccgcagaggcggggcgggggtaaggggcggggcgctgtggggcggggagagggcggggcagtgctagggggtgggagaggacggcgggtggggcggggcctggcaggttcctagtgagcctcctgggcaggggtctggagggtcggagaaggagccccgcggctcccacgcccccacctgcctccagtcttgaagtggctgtgccgccagaagctggca

SEQ ID NO: 78538 - DNA, 116 bp, Homo sapiens
  chr16:1814253-1814369
  hypo
gaggctggggagtgccggtgacacccgacctcggccctgcccttgcagctgtggtgtgccgcgggcgtcaacctgagcgggtggaggcccaatgaggacgacgctgggaatggagt

SEQ ID NO: 78539 - DNA, 68 bp, Homo sapiens
  chr16:1831357-1831425
  hypo
cctgcccatcagagtcgtagccccagttagtggagcctgctagagccacggcccgggcatctgcgtct

SEQ ID NO: 78540 - DNA, 77 bp, Homo sapiens
  chr16:1833990-1834067
  hypo
gcccagtgctggagtcttattccagaggagaagcctggaaaagcctgtccttattatcaggacggatttactacaaa

SEQ ID NO: 78541 - DNA, 36 bp, Homo sapiens
  chr16:1839644-1839680
  hypo
gagcacctgggctgacgatgccggtgcctggggggg

SEQ ID NO: 78542 - DNA, 30 bp, Homo sapiens
  chr16:1844136-1844166
  hypo
ctgccgccccttccccgtgccccacccagc

SEQ ID NO: 78543 - DNA, 30 bp, Homo sapiens
  chr16:1854152-1854182
  hypo
tgaacttccttgttccggttgtgtgtgtcc

SEQ ID NO: 78544 - DNA, 146 bp, Homo sapiens; identical to SEQ ID NO: 44624
  chr16:18802485-18802631
  hypo

SEQ ID NO: 78545 - DNA, 128 bp, Homo sapiens
  chr16:18804414-18804542
  hypo
cgaagccttacttggcgagtctgaatttctattaactaagggcagagtgagggagaacaaagagctacttccgtaacattttagtatccagatagtacagcagaaacggttcccggggcaatgggtgc

SEQ ID NO: 78546 - DNA, 30 bp, Homo sapiens
  chr16:1889598-1889628
  hypo
aaaacacactttctacgcagccattctcag

SEQ ID NO: 78547 - DNA, 33 bp, Homo sapiens
  chr16:18950653-18950686
  hypo
ttacatgctgcaccccgcactttaaatgacctg

SEQ ID NO: 78548 - DNA, 32 bp, Homo sapiens
  chr16:18950986-18951018
  hypo
gcgtgagtcaccgtgcccggccctcctgcaac

SEQ ID NO: 78549 - DNA, 40 bp, Homo sapiens
  chr16:18995550-18995590
  hyper
tcccacccccgacgccgggtgctcccggctctggggaaca

SEQ ID NO: 78550 - DNA, 17 bp, Homo sapiens
  chr16:1900285-1900302
  hypo
gtaaaaataacaggccg

SEQ ID NO: 78551 - DNA, 23 bp, Homo sapiens
  chr16:192028-192051
  hypo
accgtgcccggcctgcataacat

SEQ ID NO: 78552 - DNA, 197 bp, Homo sapiens; identical to SEQ ID NO: 36017
  chr16:1922108-1922305
  hyper

SEQ ID NO: 78553 - DNA, 142 bp, Homo sapiens
  chr16:19422024-19422166
  hyper
gcctgcgggctgcttcgggccagggtcgacccgagggccagcgcaagcagcggcaacaggagcgccaggaggtgaggcgggttcgccaggagtggggccagcgcccgggctgccagcctagcaggggcgtcttggcggagcc

SEQ ID NO: 78554 - DNA, 166 bp, Homo sapiens
  chr16:19422383-19422549
  hyper
tccggggaatgcacacggcctggccgccgccttcgtgcagcccgccctgcaggtgcaggaagaaaagaataatcgcacccgtttctcaggtgcttacttcaccatgtccgatccggtaagttttttatctgagcagcggcctgggtgagagcgaacatgagctttg

SEQ ID NO: 78555 - DNA, 30 bp, Homo sapiens
  chr16:19442928-19442958
  hypo
ttgttttgcctctctcggggcaacttcctg

SEQ ID NO: 78556 - DNA, 30 bp, Homo sapiens
  chr16:1946488-1946518
  hypo
aggctgggtgcgtggcggtggcagtcccgc

SEQ ID NO: 78557 - DNA, 30 bp, Homo sapiens; identical to SEQ ID NO: 44519
  chr16:1946973-1947003
  hypo

SEQ ID NO: 78558 - DNA, 30 bp, Homo sapiens
  chr16:19485502-19485532
  hypo
ctgcattaatctggccgtgccatgcatcta

SEQ ID NO: 78559 - DNA, 30 bp, Homo sapiens
  chr16:19498338-19498368
  hypo
aaatgtgagtcagtccgacattgccatcaa

SEQ ID NO: 78560 - DNA, 30 bp, Homo sapiens
  chr16:19529179-19529209
  hypo
gtgaaatgctcattacgatgaagatttctt

SEQ ID NO: 78561 - DNA, 23 bp, Homo sapiens
  chr16:19534847-19534870
  hypo
atcacgcccggtgggttcagcaa

SEQ ID NO: 78562 - DNA, 27 bp, Homo sapiens
  chr16:19554463-19554490
  hypo
ggaagtcagggaccccgaatggaggga

SEQ ID NO: 78563 - DNA, 486 bp, Homo sapiens
  chr16:19567041-19567527
  hyper
gactgggaagatggccgtctttccttggtaaggaagcagcggcgggtgggctttggagaggggctgtccttacttgtgatggggtcggcctgggtctgagagtgtgaattcctctctgtcgggttctggtggtcgaccggccacccccaagttgtcttgaccgtagaatccctggccgctaccgcggtccagcggagcaatctgaagccagactggcgggttcttggttctctccccgtctgctgcctctctgcgccttccacgggcccctgtccattcattccctaaagaaaacttgagtttccaggcttccgcgtccccagaagttggcgcgggttctggggtcgctggatgagggtaatggtggactcagcttttaaagtctggacgagtcgggagatctggctgttggtcagtttcctcagctcctctgttcacctggagacttgcttttctcatctgtaaaatggccgccattcatcctat

SEQ ID NO: 78564 - DNA, 42 bp, Homo sapiens
  chr16:19568977-19569019
  hypo
tacaggcgtgagctaccacacccggcccgtgctctgaacatt

SEQ ID NO: 78565 - DNA, 30 bp, Homo sapiens
  chr16:1960214-1960244
  hypo
cccaccactccacagcgaggcctgcagcct

SEQ ID NO: 78566 - DNA, 36 bp, Homo sapiens
  chr16:1962525-1962561
  hypo
ctgtgcaatccctgccgtcctcgcttccagagccag

SEQ ID NO: 78567 - DNA, 90 bp, Homo sapiens
  chr16:1967819-1967909
  hyper
tgggaggcaggatatcgtgccgctgctccctggggcgcacgataccctccccaggaaggcgccggtcagggcggacgggccagggtgctc

SEQ ID NO: 78568 - DNA, 898 bp, Homo sapiens
  chr16:1968132-1969030
  hyper
gggcgcgggggccggcgcgggggcgcgggcggccggcgggcagcggccggggagggcgcagaggcagtaggcgccgagcaccagggccacgagcagcatcggcgcgcgggacgcccgcagagcggccccttgcccggcccctgcgccctggccgcccccggccccgccgcccaggccgccgctacctgccatggggtcgcgccgctccaggcccgggagcgggggcagcaggcgggcgcgcatctcggcccgcgcgccgctcagtccgtgggtgcccggcttgtgctctgcgcccggcggtcccgcagcctgggagcgggcgcggggcgggaccgggggcggggtctggacgccctcccccctccccctcccccgcccactccgcctccgaggccactgcctgggctggacccgccggcagccgccaccacccgggcgcgactcgagctgccgggaccaccaggacgctcctgctccgagatcccaggccctggctcgcttgactccggcatcttcacctctgcgcggggaggatgcggcggcggtggccgttcgggacgcagggcagggacagggcggcgcgcgggcctcgggaccctctgtttgaagaccgatccccttccccccccaccccactccgggacgtgcgcggcaggtgcataggccaagccttggcctgcaggagcgggagcctcatcgccaggccaaggggacccaggaaaagcgtcgatccgggcactcggcctgccaagggagaaagaggccgggacagcaccctagtgtgcagagagggatcccagaacgtgtggggggagtctgcggccgggaatggcgtgcgtcctgcactcccagctgacagtcacacatcgggtcacagcctggccgctgagaggtcaag

SEQ ID NO: 78569 - DNA, 57 bp, Homo sapiens
  chr16:19708504-19708561
  hypo
gattgggctctttgccgtcggctctgctgcttctgtgactgtcgctgctctaggctg

SEQ ID NO: 78570 - DNA, 18 bp, Homo sapiens
  chr16:19929829-19929847
  hypo
tcccggtcggaaatttat

SEQ ID NO: 78571 - DNA, 97 bp, Homo sapiens
  chr16:20084459-20084556
  hyper
acacaaagccctctacgcccccaccccatgaaagccgccccctccagatgcgcgcacaaatgcaccttcgaatccatgctcacatgcccagcccatc

SEQ ID NO: 78572 - DNA, 283 bp, Homo sapiens
  chr16:20084616-20084899
  hyper
cacacacacacggtccccagctagggcacagcaacttcctttccccccgtgtggaaatatccatagttgcccttaaagcttaaactttttccgagggggcgccagggaacgcacgggggaggacgggggattctgggtagggttgcccggcacttggggttcctggcttccctccctctcccccacgcccctcacctggtaaaccgaggcacagcaagaggctgtagtagaccacgggcacgaaacccaagccgcaggccgagccgggggaccaccaagacag

SEQ ID NO: 78573 - DNA, 129 bp, Homo sapiens
  chr16:20085303-20085432
  hyper
cggagtgtgtgtggggtgggagggatgcggaagaggagggggtcccagccgcctcgcttggctccactttcaggggagaagatgcagttagacctgggagccccgaaggaagaccggagtggaaaacag

SEQ ID NO: 78574 - DNA, 205 bp, Homo sapiens
  chr16:20085652-20085857
  hyper
gcgaggatgctaaagcgttgtcggttttcctcgacaagggaagctgagcttgctggctctggaaagaggggtgcgtgcctccctgtgcgtgtgtgtggcgactctgggggtggccgccggtgaactgtcccctaactggagtgcgtttgaagaggatacagactggctaagagaagcccctcctgcatgccgcccttcagtcagg

SEQ ID NO: 78575 - DNA, 30 bp, Homo sapiens
  chr16:20133385-20133415
  hypo
tgttactccagggaccgtctcaccaacatg

SEQ ID NO: 78576 - DNA, 30 bp, Homo sapiens
  chr16:2020979-2021009
  hypo
gctaactcctcgccacggcgcacaggcaac

SEQ ID NO: 78577 - DNA, 668 bp, Homo sapiens
  chr16:2028539-2029207
  hypo
tgtccaaccccagagcggcactttcagcggctcagcaggaccctccaggccgccgctttcttggacttcctgtggcacaacatgaagctccctgtgccggccgccgcccccaccccctgggaaacccataaaggcgcactgccctagccggtccggcctctctccagtccatcctgaacccctggaaaacccataaaggccgctctcctggccggctctgtctctctggactgcagtccagccccccaccctggccaacaccctacctagccagccagaagggcactggagctgatggtctcggccctgccacgcccatcccgcaccctggcctggcagagatccagcccgcggctccgcacgcttagacggtgggggtcatgcagaacaagctttactcagaggaacagcaaatggccccctcccatccctgctggccagggagatccgccctccccgctcctccccagccctgggatggcgcggtccatcccctcatcgggatcctcgcgctcactgctccgtcgtggggtgcggcacagagtccacgcaccctcgagggcggccctggcgccgtgggcgccgctccagggccctgcgtgtgacggtgcagcagcggctctggatggcgcccggcgaaggtcgggtgggcacggtggggggagggg

SEQ ID NO: 78578 - DNA, 201 bp, Homo sapiens
  chr16:20327304-20327505
  hypo
gaacccgggctaggtcgatggccggtacttcactgcggacttgacttcttgagcaagactgtagggatgatgaacttttattatatcaaaatttaaatgcctggattctatctagactgctcctacaatgggcagctctggaccaagaactgtgtccagaactggttcacgctatggccctaattccgatgctgtggttat

SEQ ID NO: 78579 - DNA, 32 bp, Homo sapiens
  chr16:2033521-2033553
  hyper
ccaggctctaggatccgcgacagccggcgagg

SEQ ID NO: 78580 - DNA, 201 bp, Homo sapiens
  chr16:20359734-20359935
  hyper
actgtggggagactccggctgacctgtgcagtacgccaggtgacactcggggggcgctgtcaggttgtagacgtagtagccgccggcacaggccttcacctggacggacgcatcccacaggcagcagtggccgctccagtgcgcgcaggccttgcggctcacgatgccctcgtcgctggacggatgcgtgccattgagcca

SEQ ID NO: 78581 - DNA, 114 bp, Homo sapiens; identical to SEQ ID NO: 1244
  chr16:2040847-2040961
  hyper

SEQ ID NO: 78582 - DNA, 1 bp, Homo sapiens
  chr16:2040980-2040981
  hyper
c

SEQ ID NO: 78583 - DNA, 531 bp, Homo sapiens; identical to SEQ ID NO: 1246
  chr16:2040982-2041513
  hyper

SEQ ID NO: 78584 - DNA, 922 bp, Homo sapiens
  chr16:2041581-2042503
  hyper
cggtgcagagtacctggcttgaatcaaccccggcttttgtcagccatgtgatcccggacaagtcacttcacctgttggggtcccaatgtcccccgcatttataaagagaataagaacaatggcgatcccacggggactttctgaggatttggtgaggggacgcatgtaaagtggctgtttaacacaatgtctgggcatagtagatgctcactaaacggcccgtgttgtcaataattactaaatacgcgagggttcgggaaagaaagaggtgacaccgccccccacccagatacgggcctgggaacgcagggacaggcccaggggcgtgggcgctcgaggcgggctcgcagaggtcgggtcgccgcagggccctgagcgccgcgccgcacgcaggtgttctccatcgccgtcttcgggcccatcgtcaacgagggctacgtgaacaccgacagcggccccgagctgcgctgcgtgttcaacgggaacgcgggcgcctgccgcttcggcgtcgcgctgggcctcggagccttcctcgcctgcgccgccttcctgctgctcgatgtgcgcttccagcaaatcagcagcgtccgcgaccgccggcgcgcggtgttgctggacctgggcttctcaggtgggcggggccggggcggtgagcgcggagagccttccgggtgggcggggagggggcggggcctgggcggggaacaccgctggagtttccagctgggcgtggccgtgacgaggggcggggactgaggcagggagtgtcaatgggcctcccgggtgggcggggagggggcggagcctggacggggagcgccgcgggactttctaggtaggcggggcccgggtctgggcggagcctgggcgcggaacgggtctggcgctcccgggtgggcggggtcagcgcaggagagggagg

SEQ ID NO: 78585 - DNA, 27 bp, Homo sapiens
  chr16:204415-204442
  hyper
ccccaggacaggctgcggcccctcccc

SEQ ID NO: 78586 - DNA, 41 bp, Homo sapiens; identical to SEQ ID NO: 35989
  chr16:204480-204521
  hyper

SEQ ID NO: 78587 - DNA, 36 bp, Homo sapiens
  chr16:2048205-2048241
  hypo
cgacagctctggccacgctggcgggagctacgtgat

SEQ ID NO: 78588 - DNA, 92 bp, Homo sapiens
  chr16:2068929-2069021
  hypo
tgtgagccaccgcgcccggccaaggatctgggccatttaagtggagtcttgaaggatgagtaggtgttaggcacagacgcacagaggcaggc

SEQ ID NO: 78589 - DNA, 339 bp, Homo sapiens
  chr16:2069769-2070108
  hyper
cctgcaggggacccacggctcgcctccagcctcctgcgctccggtacctgggcgtcccaactccactgcgcgcccaaacccagccgagccggttcgtggcccgccccgccgggcggccgtcgacgcgagcgccctggcgtggcgcccaggggagcggggggctcccgcgagccggccgcggctggcactgctgctgcttctgctcctgctgccgctgccctccggcgcgtggtacaagcacgtggcgagtccccgctaccacacggtgggccgcgccgctggcctgctcatggggctgcgtcgctcaccctatctgtggcgccgcgcgctgcgcgcggc

SEQ ID NO: 78590 - DNA, 275 bp, Homo sapiens
  chr16:2070147-2070422
  hyper
cgcagcccgcgaggctcctctcctgctgccctcgtgggttcaggagctgtgggagacgcgacgcaggagctcccaggcagggatccccgtccgtgcgccccggagcccgcgcgccccagagcctgcgctggaaccggagtccctggacttcagcggagctggccaggtacgtgagaggggagaggcctggaccgccgcgggcaagggggtctcgggaggtctgagccggagcacggagccgcgcgttcagggggcaccctcgggcccttccattc

SEQ ID NO: 78591 - DNA, 51 bp, Homo sapiens
  chr16:2083370-2083421
  hyper
gccacgccacctgcccgggctccgggagcccctccacggagcccaccccag

SEQ ID NO: 78592 - DNA, 23 bp, Homo sapiens
  chr16:208745-208768
  hypo
ttttcttttttgagacggaatct

SEQ ID NO: 78593 - DNA, 622 bp, Homo sapiens
  chr16:2104762-2105384
  hypo
ggagcgtactggtcccgtcttcctcctcctttctccactttgtggaccttcctcctgccatcctgtggtgggaggtttccattagtcttgggtctctgtgtcatgattctgggaagtagagaaagaggaggaagagatcggtctgactctggctttgctgttctgtcgcccagaaaagggcctcagtggctgggctgcctgcaggacaggtgccggccaggtgcctaccgtcaggtttcctgtctgaggtgacgtggccggcagccaagtgtgcacacgtctcctccgagccactctctgctgggggtggggaacgcccaggagtctggtgatgtcggcgtctcccagcctcgggttgggccctgagtgtacggcatacacacttctgctgccgcctcggcacagaccctctgtgcagccccaggggcggtagatcctagtgtccgtgcgtagccggcctgccctgggctcccctgagcctcttcgggcccagtgcgtggtctgtctgttgctgccgggggactgatgatggggtttctggcagtgacgggtttggacacactgtcctgcggcgggagggggaggtgagtgggagatgtagattcggcgtcctcgcaaactg

SEQ ID NO: 78594 - DNA, 41 bp, Homo sapiens
  chr16:2106600-2106641
  hypo
ggagctggggtaggacgggcgtgagccgtctccctctccac

SEQ ID NO: 78595 - DNA, 42 bp, Homo sapiens
  chr16:2107015-2107057
  hypo
agggcagcagccaggcggggccagcagcgggactggggctgg

SEQ ID NO: 78596 - DNA, 30 bp, Homo sapiens
  chr16:2128577-2128607
  hypo
tggagctcaggcagccgctcgcctgcctga

SEQ ID NO: 78597 - DNA, 108 bp, Homo sapiens
  chr16:21289404-21289512
  hyper
cctgtgcttggtcaccggcaccacggtgcgcacgggctgcatgacccctccttcgggaccgctggagaagttggccagggccgtctctagaggcgggatgaggaggct

SEQ ID NO: 78598 - DNA, 127 bp, Homo sapiens
  chr16:2129118-2129245
  hypo
tccacctggagctcacggaaacctgtctggacatgatggctcgatacgtcttctccaacttcacggctgtcccgaagaggtccaggcggcactacagggctgggcgggcctgcgggagctccacggg

SEQ ID NO: 78599 - DNA, 386 bp, Homo sapiens
  chr16:21294910-21295296
  hyper
ggccaggacaagcaacggatgaagtatctcggaagccggagaagggtggtctggggctcttgggagcatgcgcggggtggggcggtggggggactgaggtggcgctcccggctcctccgcgcgcccccggcaccttccgcgcgtccccggctccccacactccgtccccggctccccacactcccaccccggtctgccccgggcgcccccggttccccacctcctggtgtgcctctggcgggtccgcgcaggatcaggctacagactcgcccgcgggcggctgcgcggcgggccgttggggagggtgttgggatgaggagccccaaccagatggacgcgcaccccgcagcggcggaggcggcggcgaggcttgagcagtgagtgct

SEQ ID NO: 78600 - DNA, 34 bp, Homo sapiens; identical to SEQ ID NO: 36085
  chr16:21295340-21295374
  hyper

SEQ ID NO: 78601 - DNA, 98 bp, Homo sapiens
  chr16:2131668-2131766
  hypo
gcaggagctgtctaacgccctcatggcggctgagcgcttcaaggagcaccgggacacagccctgtacaagtcactgtcggtgccggcagccagcacgg

SEQ ID NO: 78602 - DNA, 59 bp, Homo sapiens
  chr16:21363314-21363373
  hypo
tcttggtgtgtttgccgtgtctgcgggtgtcttggcgtgtttgccgtgtctgcgggtgt

SEQ ID NO: 78603 - DNA, 30 bp, Homo sapiens
  chr16:2141909-2141939
  hypo
gccggagaggggtggcgtgggtgccgcacc

SEQ ID NO: 78604 - DNA, 82 bp, Homo sapiens
  chr16:2142546-2142628
  hypo
cgtagggcagcagcacgtgggccatccatggccagagctcctcagacctgccacagcatcagtcacacgctccagcccctac

SEQ ID NO: 78605 - DNA, 102 bp, Homo sapiens; identical to SEQ ID NO: 44525
  chr16:2145625-2145727
  hypo

SEQ ID NO: 78606 - DNA, 99 bp, Homo sapiens
  chr16:2146363-2146462
  hypo
gggcatggcagagcccggggtcacacgcgtgggaacacgccgtgggtgcgctccgccgccggctgccatgtgcgtgactatgtgcgtgactacatacaa

SEQ ID NO: 78607 - DNA, 749 bp, Homo sapiens
  chr16:215124-215873
  hyper
atcctctgtcctgaccgagaagtaccgctgagcgccgcctccgggacccccaggacaggctgcggcccctcccctgcccttcaccctcccacagttcctgccctgactccaataaatggatgaggacggagcgatctgggctctgtgttctcagtattggagggaaggaggggagaagctgagtgatgggtccgggggcttcgcaggaactcggtcgtccccactgtcgtcgcggcctggggttcacttggggggcgccttggggaggttctagcccctgagcaccggagctgcggcccgggtggagcggagcagtcccgggccggcccgcggcgtctcctggggtccttgagtcggacgggcgtttgtgcgtctcccggcttcccatatcgcacaaagattgtcacttcactaagcgtattggaagcgtgtcggggctcagggaacttttccacaaagcctgacgtccgaatcccgggactctggcagctacgggggtccctgaggccggtccctccccgactcctaagagagtagggggtttcctgcccggtgttctctctccggttcctcccatgtgctccctcctggcagagcagtaactttacccgaggggagtaaacagatgcccctaaagtctgcagtaaaggtgcccacgcgcaacggcgtgggtcaatgccagaaaccctgggatcccggaggtcgaggcctccacacagacgggaacccgggctggttacgttccccgg

SEQ ID NO: 78608 - DNA, 32 bp, Homo sapiens
  chr16:2151266-2151298
  hypo
gagccaccgcgcccggccgacagtttttaaaa

SEQ ID NO: 78609 - DNA, 90 bp, Homo sapiens
  chr16:21526523-21526613
  hypo
ataaataaataaataaaataaatcactttctatggcttttcactgctccaggaacaatgtccacagatcaaacgccgagcctctccttca

SEQ ID NO: 78610 - DNA, 48 bp, Homo sapiens
  chr16:21539162-21539210
  hypo
tccccagaccaatggcgctgcgagcttctggggcgtgggctgggccca

SEQ ID NO: 78611 - DNA, 38 bp, Homo sapiens
  chr16:21541457-21541495
  hypo
agcttgatccagacccgacgcggtgactcatgccagta

SEQ ID NO: 78612 - DNA, 157 bp, Homo sapiens
  chr16:21566618-21566775
  hypo
tggaaagccgtgtttcgctgctcttcctgtagacaatacagcatgggggcaggagtggggtctggagtcggacgcacgttcagaggctggggtcacttctcccaaaccgtgtgcagtcggacgcacgttcagaagctggggccgccactcccaaact

SEQ ID NO: 78613 - DNA, 51 bp, Homo sapiens
  chr16:21569348-21569399
  hypo
tcatccaaaaacacccgctgagtttctcccgcgtgccgggcaccacgctca

SEQ ID NO: 78614 - DNA, 48 bp, Homo sapiens; identical to SEQ ID NO: 4305
  chr16:215912-215960
  hyper

SEQ ID NO: 78615 - DNA, 486 bp, Homo sapiens
  chr16:215961-216447
  hyper
gcgggcgcggcccccagagcacgtcaggcggcgccatgctcagcgcccaggagcgcgcccaaatcgcgcaggtctgggacctgattgcgggccacgaggcgcaattcggggcggagctgctgctcaggtcggtagaggcggggtctccgggagctcagggaggtggagatgagggttttgggcgcgtgggccgccaacgccatccaaggtccttcgggtgcggatccccgggctctgggcggtgtgggcgctagtgaagccccacgcagccgccctcctccccggtcactgacctggtcctgcaggctcttcacggtgtaccccagcaccaaggtctacttcccgcacctgagcgcctgccaggacgcgacgcagctgctgagccacgggcagcgcatgctggcggctgtgggcgcggcggtgcagcacgtggacaacctgcgcgccgcgctgagcccgctggcggacctgcacgcgctcgtgctg

SEQ ID NO: 78616 - DNA, 471 bp, Homo sapiens
  chr16:216505-216976
  hyper
cgcagccggggtgggggggctctgggggtccctagcggggcagaccccgtctcaccggccccttctcctgcagctgctaatccagtgtttccacgtcgtgctggcctcccacctgcaggacgagttcaccgtgcaaatgcaagcggcgtgggacaagttcctgactggtgtggccgtggtgctgaccgaaaaataccgctgagccctgtgctgcgcaggccttggtctgtgcctgtcaataaacagaggcccgaaccatctgcccctgcctgtgtggtctttggggagctagcaaagcgaggtcactattgttggccagtgaagctcagggacctaaaaggagcctcctagaactctcaaatgcgccccacccccggaggtttgtcctcccatggcgaggagtgcgatggggcagagggagcactgtgatgtggcgggggtagggagggtggccttcgacttcaacccttg

SEQ ID NO: 78617 - DNA, 256 bp, Homo sapiens
  chr16:21675205-21675461
  hyper
ggtttgaattcagatctaaataaaggtcccatgtagcgattggtggatagctctctagtgctccccatcctcgcttcctagctgccgccccgaagagtggctggggagcaggcatttgtgcgtcttgcaagcttcgacagataggaagtcccaggcggggactgtgacccccgccgctgccctggctgagttcccacctgggccgctgcagggaggaggtcgcagagctgccggctggcgccgccccgccgctctc

SEQ ID NO: 78618 - DNA, 33 bp, Homo sapiens; identical to SEQ ID NO: 44635
  chr16:21719131-21719164
  hypo

SEQ ID NO: 78619 - DNA, 411 bp, Homo sapiens
  chr16:21831546-21831957
  hyper
atccgctcctctaagcgcggtcctgagctttggtcccagacgcgcagaaggaagcggcctgaatcttacccagtcctcgacgcgcccagcgtcttgactgcagaggacgaagcggccgcatctcccgacaaacaacgtgtgaagcagcggtgccgccattgggccgaactaacgcgaccgctgcgcctcaggccggatgcccagctccttccagccacagcctctgtcccggaagttgcgcgtgccagcgcaaccttcagacaatcaggggccccgtgtggggagggcgtatgctctcggcgggctagagcgccgctaaaacgcgctcttcgttctacttggaggacttgttccagccagcgtgagtgcgcgagtgtaaggagagacgggaaggatcggctccatccagcc

SEQ ID NO: 78620 - DNA, 20 bp, Homo sapiens
  chr16:21839328-21839348
  hypo
acagacagaaaagcacggtc

SEQ ID NO: 78621 - DNA, 135 bp, Homo sapiens
  chr16:2193270-2193405
  hypo
gatccctgcacctgccgtgaggccatgtgtgtcactctgaggctgccgggagagcctgcagccaggagccctgatgctgcctcctccaatggctaagcggacaccctcactcagctcaggcgcaggaagccagca

SEQ ID NO: 78622 - DNA, 142 bp, Homo sapiens; identical to SEQ ID NO: 44529
  chr16:2212716-2212858
  hypo

SEQ ID NO: 78623 - DNA, 72 bp, Homo sapiens
  chr16:2213240-2213312
  hypo
tgtgggtgacctgcacgggttccaggggcgggctcatctctctcctgtgcttttttccgtgcagtgcggttt

SEQ ID NO: 78624 - DNA, 78 bp, Homo sapiens
  chr16:2213645-2213723
  hypo
ctaagccttgagggacggtgacgcagagccgcctgcctgcccgggcctctgcatacctgggatcggggtgaaggacct

SEQ ID NO: 78625 - DNA, 328 bp, Homo sapiens
  chr16:22173605-22173933
  hyper
ttttcccacaagaagcgtggaccatttcgcccatcccagccctactggcttcagtttcccctctatgagagcccgcgggtctccacctgagagaatgcaggtgctcccgcgccgggagtgggcgggcagaagagcgggcggggggcggtccggatgcctcgtcccgccccgccccgcccctttctgccctcctcgggagaaggaggtggcccggtggccctggcggcgcggagactggcgcagcgcggggagcacgcagcgccgcgggagcccgggccaggtgagcgaagcccggacgcgggccagggagggacgcaggtgctggagg

SEQ ID NO: 78626 - DNA, 30 bp, Homo sapiens
  chr16:22189581-22189611
  hypo
gaggtgtacactggtcgggccctcccagcc

SEQ ID NO: 78627 - DNA, 377 bp, Homo sapiens; identical to SEQ ID NO: 12422
  chr16:22203596-22203973
  hyper

SEQ ID NO: 78628 - DNA, 19 bp, Homo sapiens
  chr16:22216598-22216617
  hypo
gtttttgtttttttgcgac

SEQ ID NO: 78629 - DNA, 30 bp, Homo sapiens
  chr16:22289966-22289996
  hypo
ttctggaatgtttcacgagacccacaggcc

SEQ ID NO: 78630 - DNA, 533 bp, Homo sapiens
  chr16:2229690-2230223
  hypo
gacaggcggcttggccggcttccgggcttcgccctcgggcgggggcaatgggggtaggtgcgccaggtcggtgggcgggggttcggcaggcgggggcggtggaggcagctccggaggcccagcctgctccgaggccggtcggcggcgcacggtgccagtgccattatggtacacggacagtggcggtggtggctcaggcccggcctcccgctccttggccttgggcctgcgcttgaccgtgtcagactcggtcaggatgaacttgacgttctcctgctggttctgcttggcccggatgcgcctcttgagtgtggcgctggcttccaccttggccaagggcgggccttcgacacccgcctcgcccttggagggaccccgaggccgctgccggccagtgccatcctccacaaaggggcctgggtctgccgactccccaggcccccggcgggcagtggccagaagtccggtgactggcccgctgagcgtgcggcgccggttcaccacctccccgccaggcccgatggcctctttgt

SEQ ID NO: 78631 - DNA, 695 bp, Homo sapiens
  chr16:2230488-2231183
  hypo
ggcactagccagggccgagctggagcgcttgggtgggggcggcgggggccccttctttcggggccgcacggcaaaggactggctgcggttgacgttcttgtcggcacctgcgggcgccctcactgagtggctgcggcccacgcgccgctggaccgtggcataggggccggcagccgcaggcaccagcagctcgtcccgctccggctcgctgtcggacgccgcatagcgattcaggctgtgggcccgcttcttgggccgccccggctccgcgtcggcctcagggggcaggcacagtgtgggcacagccgtcggcacgggtgggggcgcaggccccggggcagccggccccacctcgccctccacgggctggggcagcacgtaggcaaagccgcggtgcgtcggtgactgaggcagggagcggggtgacatggggcgctctgtcggcggcagcagctgcggggtgggcttcaccttggccgtagctggggctggaccatgaggtcccccaagggcctggggagagcctggtcgggttttggtgggcgtctgggggggcgtgaagtggctagtgcctggtgggaggacctgccgtggcttgccaggcacggggggcacgctggccctcttgatgctgtggccgtggcggccgggccgggcctccctgggcggggtgccgggggcggggccctcatcca

SEQ ID NO: 78632 - DNA, 81 bp, Homo sapiens; identical to SEQ ID NO: 44534
  chr16:2232745-2232826
  hypo

SEQ ID NO: 78633 - DNA, 141 bp, Homo sapiens; identical to SEQ ID NO: 44535
  chr16:2233066-2233207
  hypo

SEQ ID NO: 78634 - DNA, 214 bp, Homo sapiens
  chr16:223318-223532
  hyper
caacttcaaggtgagcggcgggccgggagcgatctgggtcgaggggcgagatggcgccttcctctcagggcagaggatcacgcgggttgcgggaggtgtagcgcaggcggcggctgcgggcctgggccgcactgaccctcttctctgcacagctcctaagccactgcctgctggtgaccctggccgcccacctccccgccgagttcacccctgc

SEQ ID NO: 78635 - DNA, 57 bp, Homo sapiens
  chr16:2233791-2233848
  hypo
gtgggacgcagctggcgctggcggcgcatggaaagctcacctcgggagtcatgcggc

SEQ ID NO: 78636 - DNA, 735 bp, Homo sapiens
  chr16:2234304-2235039
  hypo
ctgggaaaggggcctcgggctggaccggaaggtgggctctgtgcccacaggcaggggcaccttgcctcctccaccgtgcaggactcagccagcagcttacagctctccggcacacgagtgcactcacacaccatacgccgtgcccatgcacacgctgcaccatctcatacccatccccttccacctgtacacagacacgcgtgcccagctcgcagtcccaccatcacacacacacacgcacacacagaggcacaggttggcccacacgcacagcctgcacaatgacgacacccgtacacacaggcagacacacacacaacacacagactgacagacagaggagagggtctggcctggcaatgcccccgaccccgccgctgccaggccaggcaggccgtgtaagcacccatcagcccatcggccttacagcctctccccggagcccacgctgagaacacccccaagccctgtaccttgccctccgatgctggctccagcttcttgggcggctgctccccatagacctgcccggcgtgggccactggaggctgggaccgggccacacctgaggacgagagtgggtgggggacaagggctgtcgggctgctttcctccatcgggctgcgtggcagcacccttgctcttacctgcagagccttccggaggcttggcggggctgtcccccgggccggactcagagacggacttctgggaaagcaccgttgccaggagctg

SEQ ID NO: 78637 - DNA, 267 bp, Homo sapiens
  chr16:2237256-2237523
  hypo
cgtgggcattgatcccgctctgcacatgtgagagatgaggctctgtcaggagcccctacagtccactgggcccagcgcccctgggccccacactcacatccagcagcagccgcaccacctctgtctttccgcagagcgcagcctcgtgcagggccgtgccggacttggtctggcggttaatgtcgatgccggcttggaggaggagcctggcgggaaggcaaggtggacaggcggggccttccagcaggaggccggccccagcacccc

SEQ ID NO: 78638 - DNA, 108 bp, Homo sapiens
  chr16:2246993-2247101
  hyper
cgggcgggcggggaccgggcgccgagagacccgggcgccagtgcccctggagccggcccgccaggctgtcaggcgttcctggcccagggttcccgtgggaggtgtcga

SEQ ID NO: 78639 - DNA, 183 bp, Homo sapiens
  chr16:2256439-2256622
  hypo
tgagctctggtgggtcgacctcagcacagccaagcttcagttcagcctgtgtccctaggttaccagcacatccgcatgtatgatctcaactccaataaccctaaccccatcatcagctacgacggcgtcaacaagaacatcgcgtctgtgggcttccacgaagacggccgctggatgtacacg

SEQ ID NO: 78640 - DNA, 402 bp, Homo sapiens
  chr16:2278383-2278785
  hypo
gtgcacagatgcggccgctgccaggcagagttcaccgccttggaggattttgttcagcacaagattcagaaggcctgccagcgggcccctccggaggccctgcctgccacccctgccaccacagcgttgctgggccaggaggtgagccctcacccactcccccatcccctcccgggttcacctgacaggtgggggaggtggccgcgcttcaggatggacctgtgcagccggttccgggggccacgtgggcgggcagagggcaggcacctggctgcggtgtgggagggtccgggtgtgtgagcctgtggtgctctggggcgtcctggagggcctgcggtggcccagccttcttggcagcctctggtcgaagcccgtgctgttgggggccgggatctcttcttt

SEQ ID NO: 78641 - DNA, 199 bp, Homo sapiens
  chr16:2281203-2281402
  hypo
gcgggtgcaggggtgcggtcagctgtgtgggcagttggaacccacctccaggccctcctgccgcttcgcggaaaaagttcgcgtctcctctggcctcgcagcagccatgttcccccaggtcctccccatcagaggcctctgtcctttggaagatcactcctggggcatcgagcgtgtaagggctcgggcaggagaggct

SEQ ID NO: 78642 - DNA, 63 bp, Homo sapiens
  chr16:2281639-2281702
  hypo
cgggtgtctggagagcgttcactctcccaggccaagcctgccttgggacggggctctggccag

SEQ ID NO: 78643 - DNA, 604 bp, Homo sapiens; identical to SEQ ID NO: 36090
  chr16:22824473-22825077
  hyper

SEQ ID NO: 78644 - DNA, 313 bp, Homo sapiens; identical to SEQ ID NO: 36091
  chr16:22825157-22825470
  hyper

SEQ ID NO: 78645 - DNA, 466 bp, Homo sapiens
  chr16:22825885-22826351
  hyper
ggtgccccctcggaaaccatgacccccggcgcgggcccatggagccatggcctatagggtcctgggccgcgcggggccacctcagccgcggagggcgcgcaggctgctcttcgccttcacgctctcgctctcctgcacttacctgtgttacagcttcctgtgctgctgcgacgacctgggtcggagccgcctcctcggcgcgcctcgctgcctccgcggccccagcgcgggcggccagaaacttctccagaagtcccgcccctgtgatccctccgggccgacgcccagcgagcccagcgctcccagcgcgcccgccgccgccgtgcccgcccctcgcctctccggttccaaccactccggctcacccaagctgggtaccaagcggttgccccaagccctcattgtgggcgtgaagaaggggggcacccgggccgtgctggagtttatccgagtacacccggacgtg

SEQ ID NO: 78646 - DNA, 30 bp, Homo sapiens
  chr16:2285581-2285611
  hypo
ctgcggggtcctggccgggcagggacaggg

SEQ ID NO: 78647 - DNA, 95 bp, Homo sapiens
  chr16:2286027-2286122
  hypo
agcctcggcctccaccgcagggtgagcaggtggagcagcagcaggagatgctgggtagggagtgtggctggtcctacctgcgctgccttgctttc

SEQ ID NO: 78648 - DNA, 97 bp, Homo sapiens
  chr16:2287079-2287176
  hyper
agacccagacctcagcgccgtgtccgcgctcatggagcagatcaacaggtgtggtgggcagggcccctcgtcgcgaccccccgccgggatctcgccc

SEQ ID NO: 78649 - DNA, 291 bp, Homo sapiens
  chr16:2287230-2287521
  hyper
cgagtacagctttgtgagcagccagcccctgggccgggaccagtacaaggagatgtacctgttcgtgtacaggtgaggggcgggccgcagggaggggcgcgcggggccgcaggtcgggggctcagcgggtcctccccatctcctaggaaagacgcggtgtcggtcgtggacacctacctgtacccagaccccgaggacgtcttcagccgcgagcccttcgtggtcaagttctcggcccccggcaccggtgagcgggccccgcccctcccctcccgccgagctctgacgccc

SEQ ID NO: 78650 - DNA, 225 bp, Homo sapiens
  chr16:2294431-2294656
  hypo
ttggactggtacaaccgcagccacagctcctgaacggccttccagtacccagcgtagtgggcggggctcctcccacacatctccgtcaggtccaggccggccgagaagacacccgggcggtcctgcagggggagccggggccacatgcccatcagagtccacctcccagctggcatcacagcaggagggctggggagcccaggtgcacgacgcacagcagggcca
